United States Patent 7,868,149 (PLANT GENOME SEQUENCE AND USES THEREOF) - sequence listing, part 114

SEQ ID NO: 62568 - DNA, 1146 bp, Oryza sativa
acatatcatatcactatgaatatgtatatgtttatgcagtatgtattacatgttgttttgtgtttatttatttttgggatggagagattcagctttcagcccccatcgtttggcatatctacaatcgaaaaataatttgtgaatgaaatttttacatacatattcttaatgatctaaaagtaaaggctgaaaaataagtttcgatgaaaaaaaaatcaaaatcaacttcaaatttaagtttgaaaatttaaattttggctgacaattcaaatttcccaaacataaatgatagaagaccacaactattttattaaaattgtagattgtagatttgcccaacttgagctaattttagaaaacaaaaactaaataatataggtggatcgggcccaacagatgctgtgttgtcgtgactacgccatccttggatcgggcccagcccacgccagaatggctgacctgtcaatttagttgcagcccaatcatggtagacccattagtaggagcctacggcccacatggtcttgcaagaggcccatccgaataaaacaaccggacgtcgtcttccccatcctggttgggttggagtcggagagccgagagcgtctcgccgcctaccgctcgctcatttgggcagaaaccctagccctaggcgagcccctaaaccccaacctcgcccgcgatttcctccccgagggcgtcgaggggaggtaggttggcgccatggatgcgatgaggaagcaactcgacgtgctcatgggggcaaaccgcaacggcgacgtgcgggaggtcagccgcaagtactacgaccgcgacgtctgccgcctcttcctcgccggcctctgcccccacgacctcttccagctcacggtaccttcccccttctcagtatccagtatccactcatctccatgatgcttctctgtgttttttttttctttgtgggaggttaatttggtgggtaagcgcttggggtcaggccgtagattagggttcggagtgtaaatcaatattattagcctattgcgttggtgtgaatcaaaatctaggttctctcatttgagataatttcgtgctgtgattctgttaactaatcggctattcattcatggcagaaaatggatctcgggccttgccccaaagttc

SEQ ID NO: 62569 - DNA, 2135 bp, Oryza sativa
tgccgttgcaacgcacgggcacccaactagttaattataaaaaatgtaattaaaagaaggggaagaacacatttttttttaaaaaaaaagcgaagatgaaagaaataaacgaaataagaggatacgaggcgacggacgtcgattgcctaacgccgacgcgagggtgacgtcaggggaaggatgacgcagagtagacgtaagcacgtcgttggcacgttccagctccatccattccaacctcgcccgcgccgcgccgcgattccggaagcagccgctcccgcgaaggaagaaaccaataaaacaaagcgtttttcatccacacgtgacgcgaggcagaggcactacacacactgctctctctgtttttttttggtcaaccccaacccaagcaaagcagccgcatatctctccattaatcacctaccaaaaaaaaacaaattattttgtttttaaagatcatttccaacaagaacaccataccaatccttggtcaaattctgctagtatttatcctcctagagagggacatggggagaggaggagtggatccacgatgatgacgaggagcatgatgaagtttttctctcccttctcctccgctatttataccaccctctcctctcgtctcgccaggatcaacgccactcgccacacaccgccaccaccaccaaagagcagcagagcagcaagatcactaacctgtactactgcctctaaccccagatccaaatccaaatccaaggccaagcatctcctgctgcttctcctgattgtctcgctcatcttgcttgcagctttcttgctgattcgagcaaccatgtcttcttcgtcttcgtcgtcggatgctgtcgccgcggcggcggcggcgacttttgagaagccgaggacggtggtgaagaagctcctggcggagtcccagcccgagggcgacggcgccaccgtgcgaaggagcatcggcaggtgaaggatcatcatcgattcaatcctatctctgaatctctgatcgatttgttttgccgaatcgtgttgggttctaatggatggggggcgttgacctctgttttttctgcaggtacgagctcaggaacctggatcctttcctcatgctcgatgaattctctggtaattacacaattccaattcaccggtagagtaaaatcgcggccctttttgtgcccgaatgatcttaattttccccttctgttttaccagtttccaagcctgctggatttcccgaccatccgcatagaggattcgagacagtcacctacatgctcgaagtacggatgactaaacttcttgtagttccatttcatcttttctttatgcccgtaaggtgtttgctgaaatgctactcatggtttcttccattcagggggcgttcacccaccaagactttgcaggccacaagggcaccatcggcacgggagatgtccaggtcttactctaccctccaactagggacatatctttcatcactttcagaaattgacgtttcaccagaaaaaaaaaagggtgactttgttttctaatttcagatgctgacaatgcaatcttgatcatgtttttgttcatcagtggatgacggctggccgcggcatcgtgcactcggagatgccggcagcggacggtgtgcagaagggcctccagctctggatcaacctctcttccaaggacaaaatgtatacacaccatgattgatttgatttgcactccaattttgcaagattgcatgtttgcaaatgctcattggatgaacttcttcaatgcaggattgagccgaggtaccaggagcttatgagcaaggacatcagctgcgccgagaaggacggcgtggaggtgaagatcatcgccggcgaggccttcggggtgcgttcgccggtgtacacgcggacgccgacgatgtacatggacttcacgatgcagccggggtcgcagctgcaccagcccatcccggaggcctggaacgccttcgtctacatcatcgacggcgagggcgtgttcgggagggagaaggcgtcgccggcgaccgcccaccactgcctcgttctcggccccggcgacggcctgagcgtctggaataagtccggcgagccgctccggttcgcgctcgtcggcgggcagccgctcaacga

SEQ ID NO: 62570 - DNA, 4274 bp, Oryza sativa
tcgtgttgtttggatgtagttcgcggcggattggcaggcggcgcgcgcggagagggaccaggggaagatcctgaaactgcaggtgatacgggccaacagcggcgggttgatcgtcaggttcaactccctccagggcttcgtgcccaaccctctccttagccccgcgcattggtgtaaaggtagtcagtttctctagtttgagttgtttgcagaatttgtccagatttttgaaccagctctagctgcaattgatcgccggattaagatgtgattgcagctgtgggctaccgtaactgaactcatggtggatgtatggttttttccttgtagaccccaaaaggcccattcaagatgttacaaaggaccttgtgggttcttccatttctgtcaaggtaattaagaggcttcaattaccttttgagctaccaattagattatgggtactataccatgcagtagtacaaacacatgctggttttggatcaaaacgctgatcaatgttacttttaggctgcttgtgtggcggaatttcagtattaaactgggtgtccctctccaaggaactgtgatattctttaactttgctttctaaactgcattatgattttttttcaagcacattctggcaaagttgtatcattggctttcaattctctattactatgggtacaatctaagagcgggcaccagattgtaggattcgaactttacacatttttcttcagaaactgaagctaattactttaggtggtcgaagtgaacgaggaagaaaggaagcttgtcttctcagagaaggatgcaagttggttcactcattcttctctagtcaagattggtgctatctatgatggaattgtcggttcagttttccactacggtgcatttgttcatctgcgatttcctgatggtacccattggcaacaccccttgtcatttttgttggtaaatgttttgttgattttctgacaaaatctatcctcaaacaggaaattatcatcttactggccttgtacatatctctgaggtctcttgggatcttgtccaagatgtccgggattttttaaatgaaggtgatactgtcaaggtcatagtggtgaacattgatatgtaagtatctaatacttctttactgtcttcctccacaattgtcagcatgtgtattcgcaatgtagtttctcgtgatctcattccatactttttcaagaaagtttgcaattatataatcaatgttgactgtaccaatgaaaaatagcatatgtttaattgaatctagcgatggagaatggcgcaatacaccttaaatctatatagattaggatttaacgatgcaataactattgagaacacagattgtctttaaggaataccaagttgatgcattgaaatagatcacttatgactcttgagggctgatgaataaaatgagaggagtttatgatctatttttttttcctatcattgctttcttcgcaatagggcaaatcagcatatgctggaagaattatcatgaatcagaaaattatgttacataatctgatactgatgcatttccttcacaaatagggagaagtcaaggatagctttatcaatcagacaattggaggaagatcctctactggagacattggacaaagttattcctttggttagtttgtcgaaagcacgtgtctttgtggcaggttatttagctttgttattttaaaggtcaactcatgcattaatattggtttataggaggctgatcaatcacctagtgctgggatcatatcatctgattcatctccttcagaagctgatcttcttccaggacttgatggtatatgtaatgaactattgcaagaggatgggtatgatttctgtttgtgtgtttttttttttttggtgtatggttttttgatgttgatgtactactttatgtgcccagtagctcttcttgactagagaacagttttgttaaccaggagggaacccatgaataggtttttacgttgcaatctccatgttttaatcagttctatttcttcacagtataacagacgtacagtttgggcgccgagcattggagaaacgtgttgtttcacaagatctggaactctggctttccagtgtatgatccaaaatgtctccaatttaaccagtcgaagctcacaagatagaaacatggactgatgtgttggatctcattgtgcaggtgccagctaaggacaatcagttcaagcttcttgctcgagctgggcgacaggttagtttcttcttgatatagcactgttttcttgttataaggagtttcattaggcaaggattgatgtttagtcggttttcagtcccaactgaacagaaaacaaaggtacatcctgtaaaaccaaaatatcaaacaagtcttcaaaatggttacaccggaagttagtacgacaagttttgtgaaagattgtaatggttgtctgatgagcgtgccgttggaataattgttgtagttgtgtgacagagtgtaagtaaaaaattataatcctttaaactggcaggtccaagaactatatttgacaaccagcctagaccaggagggcataaagaaggcggtacagagagtactaggacgtgttccttgagtttggagaacagcgagtatgaggcagcatgcctgtactccccccaattttctgaccaaccgactatagtgaaacaacagcacgagcagacaacctgaaaagttcgtcgttgtttcctcattctgatgctgagcttcctctcagctggagactacttaaccgaaaattgcaaattttgtcagtaatacaatgagtaggtagttatcttcgtgcatgcatgtacctatctgaaacctcaaggccacctgtatatatatcagtattcatcttcagtgtcatcaattcatcatatcttgttctggtaactaatagctagatatgcctttcttgtcaaagctgtttctgttcaacatgtaaatctactccgtaatactataagtccgttttccccctagagcgtatgaaccacttctttgtcccttaaaatttactgctaattctgtactgcctgaaccacttctttctacgtaccttgttacatgttctgttctgactgcaacatctgtaggatggtacaggcaagtaggtgagatcagcaattgtgtaagcacaagtactgctcttcttgcaaatatttttcgttacatattaggctgggcagtgaccactactgacacagttgaatcaaattgaatgggacatgcagatattatccaaattatccaaaaatgtcacacattgactcccctagaagtcatagaactaactataatgcataattgccaatgtgatggaacgcccatggtttcgtggcatttcgtggtgccttcttctgccttggctagtgtcaccatcttctcatcggttgatacatccaaaggcgagagaacaagaagccggcgatgaatccaagaagtaataaacagacaaaattctcaactatattagctcgaatccgccgcatcgagcaatctccccctcgcattgcctccttcgatcgatcaatcaacggcgacaatgtcgcacggcggcggcggcggccagccgtcgtgcgccgcggtgtcgcttagcaagtacctccaacgcaagctctggaagcgcatcaatggtggcaagccgaggaggaagaggaggcctgaggtgcggtcggcgtcgggcggcggcgaggtccccgtgtcggtggagctgatgactaccagctcgtggtcgtcgtcgacggtgaggtcgccggaggcggtggtgcgggtggtgatgcagggcggggtggtggaggcgtacggcggggtggtgctggcgtgcacggtgatccggaagcatccgccggggctctgcctcgcctaccccgacgtgttccgcaatccgcacggcgcccgcgcccgcccgctccagccgctcttccccggcgagaagttctacctcctcccggagcgcaccatcgagaggctccagcgccaaatccccgagagctccgtcggcgccttcgacaacgccgacgaggaggaggaggaggaggaggacacgcaggattacagcagcggcgcggcatcgtcgtcgtcggaggaggaggcggcgtgcgacgacgacgacggcgacgagtgcgccgcgcggaggtggtgctgcgcgagggagtacttcgaggcgaaggagcggtgggaggaatgccagttcaagaagatggtggcgcgggggctcgccgtcgagcagaacaccgagaaggagacggcgatg

SEQ ID NO: 62571 - DNA, 8780 bp, Oryza sativa
ggtcacgtattgttttgtttttttggttgaatcagcttcgactgcatgtcttgcactcactccaattgatcagagcagatacgattcaggtcgtgtgttgtgaattgtgtagccaattgcaaagtagaatgggttgtcaaatcgaatcttcttcttcttttacggatgtatccgcacgagactgaagcctaatcttttcgcttacgttcatacttatcaattaaaatttaaattttcaatcttaaatttaaagttgattttggggttttttcatcgaagtttctttttcagcttttaattttcgatcgctaagagcacctatatataagttttattcacaaattatttttcgtctacaaatatgccgcttcgaccatgaaactgaatttcctgtactggccgttagggaaatgggccgcacgtaattgaaatccaattctggcccaaactagtatgggccggacgtgggtcacggcacctttcaggcacaattaatatgggccgcacaaagtcctactcccgctgttgggccgcacataaccgaaagaacattcagatccggatatctctacaccatccgatgaagattacacggtccagatcgagttcaagagggtgccagggccagaggctctttttcacgggacaccctgtgttagcacggtttatcgtttatacccttcacgagttggatcgtccggggcctttcgccgccgccgacgcaagcggagaaggaaggcaacgaagaagaaaaggaggattgcactgcaaaacgcaatgtggtgttcttttctgtcagttattaccaaggggagttaatttgctttgcttgtgcaaaatcttactgtgggggttgggatgaaacgaaatgaaaatcttggtctcaagccttccatgatgctgtcatatcttcatcccaaattaggagagaatctgggcgagtcgacggccgtgggacccgcgcagccattgtcccttcccgcgctttccccaccgctcgaatacagcacatgtcaaccgcgcgccaaattctcccacatatatcctccacaaactcccaacgcctcgctcatctcgatctccatctccaaattaaacagaaccatttttataaattttagttgctgctcgttcctccgttgaagagatcgatatcaatatccgcgccatggccgccggtcaccggacgctgctgctcctcgtcgccgtcctcttcgcggcggccgccgtggcgctcgccgacgacgccaagccgacgatcctcacccccgtggcgaacaccccgctcggctccttcgacggcgactcgccggccgacgacgccatggacgacgaggacgccgcgccggtcggggcgcccatcggcaccaccatgaccgagcccaagcccgagctcaccaccacgccgggcgccgccggcgaggcggcaggcggcgccagcgccggttactcccttggtgttgcctctcacgtcggcgccgccgccgcgttcgtcgccggcgtgttcgccttctgagggcgaggatgctgggaacgagagaaacctccagccttgtgttgtgtcaatatatactgacaatacatacatacatatatacatacagcagtgctaatttgatgatgtacaattttcgttcttttcttcatccttgtacgataatgagcaaacattgcaaaagtttgcctcaaattctttcatgtaacagggcaccgtgcatttcaagattactggtagtttgcgtaaaatgctaaatgttgagtcgatcagaatgtggtcaaaatcaggcgaggaagacatacatttacagccacctttgcatctgcatcatggggggtcaacaaaatccttattacttcctcgaggacaatctacaagctacgctcttctacatcctgagtctcctaaaggcagaaaaagcacaatgctagggcattgtttcaaaaagattatgccgcctactatcttcttgtaagaatcgactcctgtagctgtatcctgtctgtctgaagctcgcaactagcacgtatggtcaattgcctatccttgggtgaacatgctgaagcagcagataggcatgaattggtgatcctccataggcacattatagcagcagataaggctagacccaccaccaccagtttccatttactacactgcagatttgtccattcgtccattctctacactgcatcttgttcgttctcttcgtccctcgatttatgagcgtcatgtgacgtagggtcgataactgaagaatggctgtcagttgattcctgaattatatcctacaatatagaatggttatattagaatctaaatacctttgattgattgaaacttgggtctgagagagctttgctatttgtttctctactttacctacttaaagatgtttgttgccttgataaggacaaagcatacctctttcatgcttccatttggtatcatttcatttgtactatggctaagtccaccattgccgttagctataattggttcattttcatgagattcctgttttgagtttgtcaacagcacagagaacttcagtttctgaaataagtgataaaacaatcaacaaaattacaaaaatgcctcacctgttcatctatgttgtctccagatgcatctgaattctgttttccatcgacgatgccagcttgtgtgcctgcctgttctgtctgttccgctttttccaaaaacacttttctccttgactcttcttcctttagttttctaaatctgaaactcaaaatgaatagaatatattttaagtactcatgttttcccctaacttgtgagattcaggaaactacaattggacatttcctgcatttaaatatcaatcacaactggacaactagattagcttctaggaattaactaacttttcatttaccaagataccaaccaaaatctctgttgaatgtccattattgtaaggctcatcgatctaatggtttgtgaccacggctgaaataatgcaggcattcaacaagcaatatctgaaaactagacagtacctttcaccacgttgtggtccacttggttctggctcttgactggccgggggtttaccaactttagggagaggatcactcttaatagcaggctcgggctttccaagattagttgattcttctttagcgagcttatcaatgtattctttgacgggatttttggcacctccaagcttttgaagccatacttgttgtgcagtgctaaggatattattcgtaagcctgcaagaaaagtattgctaatgacaaccacaaactatgaaaaattcaccagttaatgaagaagaaaaatgattaggcctgatgagagtttcacatatgtaaaccaagtttttcattccttcaatagccaaagtaacaggtttacagcgaattgcatatatttgccattctaaatagtgtagaaaatctggctctgttcattctaaatagaccatgaagaaagttatgatgaagctcttattattaaaagaaaaaaatctgaataaagagaggttgaaatctgtaaaacacacgcaccaatatagacttagtccagaaggaacagagagagcaaaataaccaattagcaaaggcaggaacttcactacagcttgagcaccttgttggctaggatcattgttctgcaggacaaatatagcaatcagtaagtttgaacacaaacttaatcagctattggtgtaagttggcatgatacagaaaaagaaattgtgtgccttgatcttttgtgctttttcagtggtccggattatttcccatgaagagggaacaaattatagagttcaacaaaattattactgtacagactacatatctttacaggtaatcttctggagatcttttcagaatcttgagttctataccaagaataattgaacccgatagaaattatgtgtttattcattagaagcaccatacagatataattcaactgataagaaaattcccatcggagtgttgaggaccaaaaggaattgaatacaatggactaaacatgctgaaaactttggtagaacaaacctgtggtggctgcattacttgagaagatacatattgggaaataacaagaagaactggtaaaacaaggtatgccagagtgtccgaccagccaagaggtggatgaccatcctacaacatcatcaattacactggagtcaagaaaaaaaaagagaagaaaagaaatgactccaaggtcaatgaaataaatgtcaactaacattcagaaatggtcctatccaaggcacttatataggttaatagcaagcagcattaactgtccgccgttaaaattccagaaataattagatgtgcatgtgcttgatttttgcaaatacattctagaacaaccaacggagtagagattgtgcacatacatttaaatcacatgcaatcacagttttctaatgcctgcaagcagacaacaccggcttacaaatggccttaacaacctgatcacaattctaaaagtcaaattttacaattaggtaaaaaattgaagttgcacatgaacaaaagttgcttgggtataccagggaattatcaagttctgtgtgcttaccgtaaagggaaatagccatgatattccctggccactttgccgtgcagcaattgttgtagggccagccaaagaaggtatccagaaaaagccttcggtaagaagtccctttcgaacaaagacacggatgcatcaggtgatgcggatgtttactcaacaaaaatagaaatgacaaaacacaagcatatcaacctcattagctacattggagagagctctgtatagaccaatccaaaccggtattgtcacaagagtaggcaagcaccctgttgtatagaaatgttaagtcaactgcaagtaaaactaatgcaggaatgtacctaagttgctaccagaaaaagggtaacagaaaaccaatataatgtgaaactattctacaaagccttgctatgcattgaacattgaggggcaaacactgataggaaatatatcaaaaatagtactacctgcgagcgggtcaacatctgacaacttatataaacgagcagtttcaagctgtatcctttcctggaaaatatgaataaataattaacctacagatggaagtgcctcgggtagtatttcaaatccattaatatgatctacaatgtacaccattgtgttaaatctcccgtgtgaaatgggtaaatggtagtttgtttacatggagtttatttgcagtatgcacttgcgtaataagtacctttcctacagaacattttgaacaaaatgacctcattagctgcatgtcttggaaggacttagatcttccagttaatgtgggcttcagtttattgctacataaataaggaatttacccccaatcaaatgaactgctaactaaaataaatgcaagaccttgccattagcccacagtgcacacagaagattcaacatgtgagcatgttatattattgtaaatcagatcaatatgtaaaatatacctacctgatcaccagcataacgttcttgaatagccttaacttgaggttgcagtgacctcattgcaattgcagactcaacctacaccagaaacaacaaatatgaacaaaaataaaaatttatgcaggaatagaatgtgtgtagttttactttgcatgaacatttattactacaaaatgccatcaattgatttgggacagaaggtgacagaatattcttgcagggtgaataaccatgtgatacacatgtttgcagtcaaatggtttccgcattgaagtctctgtcacaatgtcagtatggattaagtcatgcatgcatttattactggctccgctaagaaagtcctgaaaggaatcaccaatttattggatatgcttgaagctacagccggtatatataagaaatagaacagtacagatatgtaccaaatcatctataataatgtgttgaaaatagctacattattcgttcatctgtggatcacaatgtatcataagttgggttatggtaaatcttgttacttcctaaaaatgtgggtgaaaagtgcaggcaaattataatatgtctcacagaaagatctgccaaaatgaacattttcatggagtgatatgatcgtaaaagtaatcttaattatgaaaaaaaaaagatcagagagtatccttcaccaccttaatctgaacaattcacgatatgatatataaccacaacccaattataccactatctattctaacgcagcaacatggcaaaaaaaaatacctgcttctttgtaagaggaaatgtagctgccttgacgagaactgttagaaggatgattgcaaatccatacggataaggaacatggagagctgacagaccatcttttaaaacctgcaatagaaaaaagaaatgtaaatcacctgaaaatatgtagcaagcaaggtataatgttataagagtaataaaaatttatgcaaaccacaagatatcctagatgcaatgcataatggtggccactcattatgcataatggtggccactcacatgcacaaaaattgtagtggcaggagaacagggagataaattgtttgaagatttggtggtaaaacagcgtttgcccactgtcggttaaagagtgaaaacagttgaaattagatagcatggaaattccggccatacttttccgttgcaagtgatttaattccctaattagtaataaggcacagtacaaacagaatattgagtaataattgttggccattagccaaacaacaaatatgaatgtgatcacttcatatttccctcttcctatgaggtctccacacatatccttcagttcttttttgccttatggtccatcaacagctatgacaaccaaatcttacctaaactactttgggcatggatatcagggaatcgtgtttttgctttctttttttttgttaagtggatgaaagtgctgaagaaattccccatgattgaaccaaggtcacaaggtcacttctatggcaaaaccccttcctttcaacgggaatgctaataattgcctgatctgaaaaggatgctcagaaagctaattaaatttactccattcctcatagagaaagctttacccatcagcagagtagaatactactgtgcaactaacagcaacacagtgatacatggattacattgcccagagagtcgctctcgggcaatacagcaatctaacccaggttaagcagatttttcacctactactccgctacattcttaacacagaaaggttcataggtgacagcatcgcacaacactgaatggagaaggcgcgcgcgcacacggcaagacgctggaaccagctggatatgagaacaaagtcaagagtcacgctcaccttgagcacggtctccatggagttggtgatgccggagagccagtccccggccgcctccttggtccccccgccgcctccctgcaccacctccggggacgccgagacggccgcatccgcgaccgtgtagaggaacgcctcgacgcgcccgaacagctcccccacctccgcaaatccaccaccaccccccagcgccgccaccggtcgaagtacgacgcggcgcggggccacccggcgcgccgaggcgggccgcctgaagccggcgacgccaccgggggctcgcgcggcggcgagggctagggctcgcgggcgcgcgaggaggaggaggtgggcgtccatcggcggaggcggagatggtcggagtcggagaggcgagtggcgagtccacctaaactagtactcctactactaggcggagcatttggatacggaaatgaaattggggtgggacgcggcacgtgggccggtggtgcggggtgcacgacgccgcacaagtcaccgctatggtctatgcatgtgtgggcccacctagcagcgtggtgggccgggcctctttcgtgcccgtcggcctcctacgaaatttttttacgcacatgtttcatgcgagatcggcattaataattcctttggagactttgacaattcgggcctgtttggtacagctccaactcctaaataaaactccaggagttgagactggagaggagttgtggagctgtctaaacccagctccataactctagtatattttgtgagagagctccacccaactccactcccagttttggtagagctgaaactatttggttgagctccagctccaggaggggtggagctggagctggagctgtgccaaacaggctactttacctatatacgataagataagactatctccgtttttgaacataagatcgtgatgttgactttatgaatatgatgtttcaacatttatccctttttcatttattttatggacttgttttaccattagatgtatttaaatgtgccctttttctctttgcattttttgtattatatgtttgaataatataaatggttaaatgttacctccaaaattcagtagcatcatatatttaaaaacagatgaagcagataattagatgctaagccagcaacagaatgttgattatctagcggatatatcatttgtgtcacgcttccaaatttatggtaactctctaaaactttctttatcgatattgattacattgctttttccaagctattactccgtcatccatcatttaactctcaatctgtttcaaatgtgactttaaattactctatagaaccctctctgttttatataataagtcattttgactcttctcaggtttgataaaatttataaaataaaatttagcgattagaggtagcactatcttgaatatccaccccttattatgc

SEQ ID NO: 62572 - DNA, 10891 bp, Oryza sativa
atttattccggtcgacagaaacgtgaaggtgatagagtaactaataacccagattaaatccggtcttaatctagagctatcaaagtgcattgcgaattaatgccaacatgtaccaagtagtagtgtatcgacaccggcggctgctatcgcaacattataaacacacagatgcttagcgtgctcgacttgtaatattcgacatcatcgaattgcagaaatattttggcgattgcatcgtccgcagcccattagtgtttgggcccaaaaggcccagctagaaacaagatcgaagtctcccttccgtctccgatggccggagctctgccgctgccatagcactaggagagagctactactagtactatgaagcaagagtaaccatgtaatgccatgccatcgtatgaccctacaggattgctctctctgttacagagaaaaccaactatacaaaagtggcaatgcttttgcttttcttaggtcatgtttgtttcagcttagaattattataatctgtattattatgagtaaactgaaacaaacagatagcttattacgatagaatattacaatctataagctagattactataatctagtaatccactctaaaggtgctttttttcattattggtttgctaacacctaacaaccggctaataatcctgagaaacaaacatctaacaatttattctatgtcggcttattataatccagcttatattaatatgtctcaataatctagattacaataatcttaagctgaaacaaacagagccttaaaaaaggaagatagagaaaaccaacttataactctcttgatgtactcactccatctcaaaataataaaaatgctatataccggaatcccgtgtccacccctcgggatgggatcccctcacctcgcccatgatacgtgcggcaaagaagacggagagcaaaaatcagtccaatgcaaagcaacaggacagagagcaagacgcatgcgatatccgtcaagtatcaactaatacctatcggtaccatttatcagttggtatctgacaagtatcggccggtacctatgaggtatcgagatcttatacctactcggtatctcgttcggatgaaattttgtagtatagctaccgtctaacataaataaatctaatataaattatggttatatctttttttattctaaggtgaaaagagtagttcaaaaaacattgacgaagggaatacttcaatgtgagtatgacctccggtctgctcttggtaaaaggtgccctgtttagatgggactaaaacttctaagtccctatcacatcagatgtttggacactaattataaatattaaacgtagactattaataaaacacattcataatcttggactaattcgtaagacgaatctattgagcctaattaatccatgattagcctatgtgatgctacagcgaatattctctaattatggattaattagacttaaaattttgtctcgcaaattagttttcatttatataatcagttttgtaagtagtctatatttaatactctaaattagtgtctaaatacagagactaaagttaagtctctggatccaaacacctatcgaagcagatctgaattacgcgtaccatcctagtacaacgtctgattttggggtgcaatgcttccacctaacaaatcggcatggttatggtgcacacgcattagcgagccatgagtttccgagagtatagtagtactgtactagtactggtacattaattaaaatgactccactagtccacttattaaccccacaccaccatctgtcagtctcatgttggattgaatccccacacggcacacggcgtgcactaatgacactgcctgcgattgtaccatcagtctacaattactggtaggtacttctacttattcctgatccagagccttccactgtcagagataaaaaggagaataaaaatggtgaaaaaactgaagaaaaaaatattatcaggaaggccgagatcgttgacacaactaaagagtcgtccaatcctatatattccagtcgtatgtatgtactgctatcactaaataggattcgtatcacgcacatagtaattaggcgttaaggacgatgatgtattatttggagtagtacaatatacgatgggtaataccaattgggtaagtagtcgtagcagaactagtgtacggtgctattacttgtttgggaattattcaacgtccaactaattatctgcgcgggtaataaatgcagtgaagtttcttgccacacttgccctttacatgattttcatagatttttaatgagaaaattccctatatacccctgaaaatttactcaatcccttcaatacccctgaatttgacatcaccccttatatacccctgaattttcattttgatctcatctatacccatctccgttagttgacgattagttgaccgttaaatattttaaaatgactatattacccatcctatatacatatgtggtacctacccaataaattttcatatgaaaaaaaataacttatacaaaatacaagcaatataatcatttaattcccaacttaaaaaataaaacttattattttttatttttaaaaaattatgattaaatccatacattagtttcaccagaaaattaagagcaaaaactaaatgttatttaggtttaattttttgggaagatatacgaaattcatcaaatttgatctgaaatttattttctaatttgtgataaactaattacatctcctttgttttttcacaacgaatcttttttcactaaatatttgttgaaaagtaattttcaaattttgtgcagaacttttttgacaataaatattttttattttaatgaaataatgttttatttttaaaaattcataacaaatatttagtaatttattccttattggttttcacaactcaaataatttacacataaaaaaatttctagcttttaacaatataccaaggacaagaaagtaatttctacaataactaacggtcaaactaatggtcaactaacggaatgggtatgtaagggatccaaataaaaactcagaggtatataagagatcaaacaaatttcaggggcgtagaagggattgggtgaaattacatgggcatgtagagaattggcccatttttaatccatttacatggtcaggagtaatctagaaattaaattacctacggttaattcgaaggtggatcacttcactctctataagaagcagtggaagcggaaacacactgaagcacacagacgagtgtgactgacatagctagctagctcgatctcgccggaaatggcagctcgcgtcatcctgctcctcatcctcctcatcgcctgcgtcgccgtcccggcggcggcggcgttcgagacggtgtacgcgttcggcgactcgttcacggacacggggaacacgcactcgacgacggggccctactccttcggctacgtgtccagcccgccgtacggcgccaccttcttccaccgctccaccaaccgctactccgacggccgcctcgtcgtcgacttcctcgccgaccgcctcgcgctgccggggttcctcccgccgtacctctcccccgccgccgccaacgccacccacggcgtcaacttcgccgtcgccggcgccacggccatcgagcacgagttcttcgcgaggaacaacctcagcgtcgacatcacgccgcagtccatcatgacggagctcgcctggttcgaggcgcacctccggcggtcgcccgccgccgccagggccgtcggcgacgcgctcttctgggtcggcgagatcggcgccaacgactacgcctacagcttcatggccgccaccaccatcccccaggaccaaatccggaacatggccgtcgacaggctcaccaccttcatcgaggtatatatatatatacatacatatatctcattaattaattaattgttttttctcggccttttggctatgtttagttcctgaaaaaaaaattaattgcttttagttaaacaaattacacaaagtgctaagctagtagaacaagacaagacgagaatttagaggttgtccgatgcgggtccaggatagtaattacagtgacagtaaaattataagtcgatcggtctaatactaattataagttatatagtttattaaaataatggtaaaactttttttttaatataggtgtccttagccatttaaaaacgaatgcttaaaacgtaaacttatataggaaaacatcaaaatcaagttttaacacctaaattttgtcgatagcttgtactccctccgtcccaaaaaaaaaaaacgaattagcactggatatccaaattcgtaatactagaatgtgtcatatccagtaataggttggttttttataagacgaagggagtactccattcatacaaaagtacaaagtatttttttttgtcactaggacgaataagtaagaccaataaataattaacgcatccatcatgcactatatacatatattatatctaggtaacaatttaatttagcatataacgactagaaatagattttagagttttgaaaaactaaaaaaataaaatatgaattagacttttggatgtactggagaggaacataggagctgatattagctaagagcattaactaatactttcaccgtcttataaaaaacaatatagaattatgtatctgagtatactttttatcttggtacgttgtattagaatgtgttatatgtccattcctggatttttttttcgaggcctagattcgttttttttttactaagcgagtaactataaggccttcgatggttcagaaattagaacccagcctgtcctaatgtatctacccctgtcggtgcatttgctactagcatgacagatcaagagcatggcgaccctgtagctgcagccatggcgaccctgtagctacaggtctgcagccgcatgcagaagagtagatagatcaggaagcacagtgacatctctttaattttgctgtccctgttcagcttgtttgcaaacatttactgtactgcttatgggaattccctgcttatgctgccatcttcagtgtgcgaatacatgagttcgtagttcgtactagccggagtattcaccgagctacagcctacatgcgattaggagtacttagttgcactgttcatctcaagaatatggagttaagtcgctgaacatgatgttgggaggctacagtagacgctttgatgactggaatcaatcagccaaccaaatttgatggccaccaaaatttgacggccaccatttactgccttgctctttctcctcctagcacactatactctcaaattctgaatccataccaagtttgaatgcagctagccggacatgcatgtgcattgatctactacttattctgaatactggaaaagtaaaaaaaacaaactaataacaaacacaaaagagcactagcagtattctctctctttttatgctgttattttaaaatagttttcttgtttataattaagttgtgattttgtaattcgcagccattcaacatacaatctaagtatatgataattggtttaaaaaaacacaaatattagggaatgacctaatatcaaataattagagaggtggcgcttcgaacccaaatcgtctagcccactaaattgtggagctaaccggaagaccgcttgacatttctcgtataattggttttacctaccttctgtccttcgagagagagaacaataattggatgcatggcaggcattgctgaagaagggggccaagtacataatcgtacaggggctacctctaaccggttgcctgccactgaccatgacgctggcccgcccggaggaccgcgacaacatcagctgcgccgccaccgtcaaccagcagagccacgcccacaaccgccgcctccaggccagcctccgccggctccggcggcagcacccggccgccgtcatcgcctacgccgactactacgccgcccacctcgccgtcatggcggccccggcgaggtacggcttcacggagcccttcaagacttgctgcggcgccggcggcggcgcctacaacttcgagatcttctccacctgcggctcgccggaggtgaccaccgcctgcgcgcagccggccaagtacgtcaactgggacggcgtccacatgacggaggccatgtacagggtcgtcgccggcatgttcttccaggacggcaggtactgccacccgccgttcagcaccttgctcgccaggcggaacaaaggcaattaagcaagtgatcatatcttttctgccattaagcaatattgatcagtgttgttgtctctttagtagctaggtgatcattgatcagcattgccattgaagtattgaactgaattctgagcagcatcagtattaagctcttcattcttgaatcattttgtgacttgtgtcagccaggcataccatgtgccattattgtcgacgacagagcattcaataagaagaaacctagagttttaggtgaagtttccacttaccagctcttggcttaatcagttttgagcatcctctcttggatactgctccatagtaataagattaagtaagctgcaccccacacattctttgagcgatatttgttcatattgtactcaagaaaaaaatttctgtttccatttacaaccatgaaggcccatgccaactggagaacaacgatgactcattttgaaggactaactaacttctatctactgaccaccaacaaccatttgcttccaaaacaaacacccatgggaagattgcagcaccagctgaaaacaaattgcaagttcgcaaccaacttcggacaaggttaaaggatagtaaagcaattaactgcagatctcagcatatcaaaagccaagactcaggattgagaggtgattgctggtactctgcgtaacccaactggcttctcagatcttccatcaatatgcccgccttgatataccttgtctgtacagttcaatcctgtacagtgctttttgaatctccaaggacctaacaaatgaggtggattcatacattagaagccactacctcaaacttgcaatgcaaccaaaaattagtaaacttccttaccacttgaacaatgcgctagacagctgaagattggcgaggtaaggttcgagagacaagcacagctgctccactcgttgcttttgctgatgccatctcttccaggcgcttccatgcgacttcttgcttcaattttgtctccttctctttggctttttcatcctcgtatttccgctgacactcatcatatacaccaacatcatgatcggagaacaatttccgaacattaagtgtgaggctttgcacagcttggttccagtgcccattagcatttctctcgagtgcagggaagatgataggtaagatcaccctactattttgtttgatcagattctcgatatgatcattgttccacaaaaacaatgctctctcagcaacctagaagtagcataagcactattagataaaatccatcaaccaatatgcgtatatcatgtttctgctgcttcaatataatttgcattaacaattccccgcaggaaaaaaaaggatgcactggtaattatgaaatattgcacaattaaacaaaatttgatgtgctaaattgtgaatcctcataatagcagggagtgattaactgattacaaagaaccagaaacaaaatcctgcacttaaaagcagatttgagatgtaagacaggggctctattgaaataaaatgcaagtataccctgtgtgttgggtcaactctcacactgttaggtttccaaactccacagcatttttggcatagtcaaacaaatagttatgggagactcatgcctgagcatgcggaattagccctacaatatttctccactcataacataacaagaaataaacaatgaaaaacaatttctatgtaacaagattcagggaagacgcataacagaactaaaactctatacaatttcaaggtaagtttccaaatgagcagtgtaagccattaataaaaaaaaatgaaaaatacaccaggactctataaatgatcactgttttagtcaatcctaactgtgagcataacagggctctaaagatgaatgctgttttagtcaaaccctactatctatttgaagggcataaggagtcagattgttttctatttcaacttacaaaactccatcataccttgggaattgataagaaaagtcacagatgaaagatcaattgcccttcaagtttttggttggtaagtaacatatgaatataaatccgtactgatagcagtgtcaatgcattgatacactaaagtagctcgtggctagactaagaaagtaaaccatgagaaaaaacactccgagctacagcttataacagccagttatgctattctttgacgtggttgagagggattttgttttccatgcctctttttcactaaggacccttggaaacccaagtccacccaaagagtaacactaattgatggttagcacataacaaacatttttcactagtttgaaatttcaaacggcacaataatatataggaaaataacttcagaaatccactcagcagcctacggtgtacacgagaacaattggtaggattagcttttgcgaaagattggctgctcaccagttcttcagtctaattatagagtgaccagcccttagcttgtattctgatttaccaccaaacagtaagtcacttaaaaaagaaagaagaaacaaagcccctacaaataaaactaacaaatatttggacaaacgaaattatcatgacagatgattggaactttgtaaatgataattcactacattctgatattctattataatgctgagctgtatagttctaacttctaagtgaatacccaacaaagggtaattaaacttaataaacactatatgtaggctagcttaacttgaacagaaacaaaatgtgcaaaatgagacggttaccatgcaggaaatgcatctgtttcagttttaacatgataaactgacgaaagaaaattacattaaagaagaaatgggagtaaaaggtggaatgaaaaatgaaggggaaagtttttaatgacagtcacgcaattaatgttacctggaagtgagaactgtttagacaatgtgcaatctgacggaaaagaggaaccatgcatttctgaaactctgcaggttgtgtagcctctaatatctcttccaactctcccaaaaacaagacctccttggagctgtttgtgattggccaatatttcaataggcccctgataacagtgtctgcgagtttgcagtctttttcaacaaattgtgtaatgcagtaagacaactgttgatggtacatcccaatgcactttggcttatgaagtggaatcagggcccggacaaggaacaacttatgctcctccttaagtggcagtgcaaacccatttatgatacttcctaaaatctccaatagttctgcaattccattgtgtttttcagtttcatagatgaactggtaaaagatgttgttgattgccttccttataaatggtcgatgtaccatgaactttccgtagacacggtgaagtatcgtcttgaggtactccctctccctagggtcctccgagtcaaagaggtcaagtaatctcaggacaaatgaatgatcgatgtatctttttgccaacttggcatcggtctctggagactgaatgaacctcaagaacagctcataaacaatctgcaagtgtgaccatgcaggatccatcacaggctcctcatcatccacatcgaaggcttcaatcttattctctctgggcggggtagtcagtgtcctgaataagtttacagaaaccatccttgtgatctcttgcataattatctccggaaacttcccattggctgaggcaatatagtcaacaagttccaacaaagtttgcctctttacttctttctcctttacactctttgttggatctgtgaagtcaaatgtggcacagcacaagttcagtttttttacgaacaggttattcttctctgtgttgggcacatccttaaagcttggcaacagctcaacagtcggttgtaccgaattcccgttcacccttgagtttgcattcccaacatgcatgccactcccataactaagcccagagcttgagataaccggtgtctggctactcaaattggaggacctttctgcacctcttggacccaatggtggattcggcactgaggggcttgacctgccaatagggtccttgtctccggatttggatggcttcttggggaaccgtccaaggatttgcttgatcatgctatcacccagcttagtcaaaaccaaccagcagtagctctcgggtgcttctgaaacaacttttctcccgactccaatgtggcaattggtattactgaaaagtaaaccctaagtccatttccatataacggggatctctcatccaaacgatgaagctttttgcagagctagtgcaccaaatggagccactctgacctgcttgaatcaaattgacaaggaaaaacaacaaatcaccctaagatcgctgaagaaaaacaacgcctagctatccacaggatcacatgacagttgatcagaggacggggctgagtaaaacgcgctctacctctccatcgccactccaaattttgttgaggaggtagtaatggggggcttcgccggctcatcgattcggcgggagggagctcacctagttggctcgctggcggtggtgctccgcggagacctggcagctcggcgacgggagctgtgcacttgacggggacctcctcatgcggcggcggcggatggcaggagctggaatacacagagacctccgagccaccggcggcgctcagagcaaaatca

SEQ ID NO: 62573 - DNA, 3399 bp, Oryza sativa
tggggttcgcttttgctcattgccatgcaaatgcaaatgctttgctaggctgtgttgttgttaagtgctgtagatgctgttgttaatctttaagccgtgcaatcaggaaaaggcccttgccacctaatgtgtgaatgatgagcctgtctcacatgttgaactaactaatactcctgctaccactaaccaatgcccatcacatgatggttatatgttttgagttaggattctctcttcttctttttttcatatatgcaatttgcaaccagtgataaagtcattagtttttgtcctcaactcgttaatttctgtacggaaaaaaatcattcgtactcataactcaagtgtcactgttctatattttggtaactcaagtgtcattgttctatatttggggatggaggtaatactaactaaatacagtgtcatggagtactattgatagaaaacatgaaggtatactgtaattttcgtttgtcaatttttaacaaagcttgacaattctagatgccattcgaagtacaggaatagttgtacatcaaaattattaaccagcagactgatcccaagggggatgatgacaacctgccagcagagatatttaagtcaacaaactgaggcatattttaggacatacaaaggaaccacctcaattagattgctcacacatatgaacagcagcagagaacccttcaaagcaaatttcagtttcaggtcacgctacgattgccaccaagtttgcaaataaaaaaggacttagatttctacctcatggttaacatcaatcttccttattcccaaaattgaggactctaacatgggcatcctaggagttcctaccactggtactcctcaaggaatcttcaagctgaggtgagaggtttccttgtttctttcattcttttcaattgatccttatctcacatggaaccattttcaaaatattagctatgtcctttagatcccacaataagctaattttgcattcttttatggcttcatctataaagtattacaatcaggagtagtacaaaacaacatacagacaatgctactttctctctgaacaattagctgttttgcaaaggaaacaatcagcatataatcatgtagtcccgcaaacatcaggcatcagcctcccttgcctacaaaatttgtacagctaaggatatctgtttgagcttgcaacatcctgctgctaaaactttattcactcagccaagctggaagcatctttcaagcgctcccgaagtatgtcacagagcttactgcaggcatccatgcagagctccaccgcctattagtggaaggaatcaaaatgttattaattcataatgttttagtatcatgtgttaatatagtggaaaagacacacacgttcgtgattttgccatcagaccactctccagtaagagttagctgcgtgatctctttgcgggctggcatgtacgccaccataaggctgccgtcttgccatgcttcctcgtcagaggttggatcaatgattatgttcttcccaaaacaggactgacaaagaagcacaggtggattgtcttcaaattcaaatgtcgagttttaagtacacacatggtaaaggagagagaatgtgaggccataccacagatactgatgtaacaaggtcatacatcatgattccagcatcagccaacgcaagactagcacaagaaataatgatgggaagatcacctgaaatcaaagaaataatgatgggaagaatggaagatcacctgaatttccagtatgaacgaaagtagttcaattcccatttgcaaggaaataaagttctgtggaataactcatgatgatatgaaggcttctctcaaaaacataagcaagacacattcttgtgtgccatcatattataccttgttcacaaagttaaagtgcaggtcataattcttcctaaaataagtaaatacggattattacagtaaaacagcctgagcatatcaaatgcagcaagatcaatattaatatgaaaaggcagagatcaaattcaaggatagtatcttactgccaccagactcaagaaccaaggcaaaaacatcaacagtggtctttggaaaagtgtgcaacatcactgcgccttccagagctttatgaagcattgcggagtactccttgttatctgttccctggaacaaagatgcaaactttcaacacttattttcaagcataaatggtccagtaacaaatttctccaaagagacaatggagagctaataaagcagcagacctgcccacgtataggagtggcaaatgttgtgtagctcacattgcaattgagtctaccagtatcactgtacaacattgctttcttgctttctctcggtccaaacctgagaaagtaataatcaaataaacatgaccaagcaatcggagcaataagacaatttcaacaggaatatacaatctgataagttttgactgacaagatacatgaaactgatgtaatatgaagctaggaagtacatgttaaaggtcagcctcaaggccttcaaactatcattgcgattgcctttttttttttgggttgccccttgagaaagggtaagccatagagacaaaaccctcaaaagtcataagagcacaaatttataaaatgctgataaatgttagcatgctaaactgatagatgtataaaacatactgatacatgaatccaagctgattatgaactgttctcaagagcttagtaacttttaagtgtatttcaagttcaaagaaagaagtttgaagtgtaaacatatttcagttgaccttaacttgctaatatttggtcccacaaatgccaaaatctttaaaaattcaaatttggaatgatgtgtaggaggatagattgggaatatcataatggaaactgttaattatgttttagtagcaagttgagtttatgagacacctttcacattgggatctaatgaaagatatgttctttaacacttggaaactaaaccataacgtacttacatacataacgtgattgtataaaaatgcaactatacttacactgacacaatgacctttgtcttcccaaattctgcataagcagatcctgatgcagcggttgttggtcctgtttgcataactgcaaacaaatcaaatttattattggctctgagcaacatatgagtcccactagtttcaagcatcaaattccagtgatcatagaacaatttgcagtaccattgaggttaaaattaatacttacaaggaagaaagaaatagaggtagtgaaacacagtttcaggtaatatatcaaagaaggttctgcaatcatgtaacatggatcataatattcatacatgaaaaaaattcgttcttccttcaaggttggtagatgcatactgtaaaatcctatataaattcaagtttttt

SEQ ID NO: 62574 - DNA, 1293 bp, Oryza sativa
ccatcgactgattccgagatgctgcagccgataatgattctaagccgatgacgtctttgccgattaccaaatttcactgttaacagcgaggcgacatctatatcaaatttttacaaagcctgaatagttagttttactggttttggtttatttataggtgttgttaaagtgaggtttgcattaagagaatgactttagaccaacatcataatgtcctccaaagtccaaaggggaaatggtaaagggaaatagggaaaaaaaagagtaatatatgaaaatggggaaaaataggaaatttgtagcaaacaatagatggaccagacgggccgtgccgtgccggcccacggggggaggcgtcggaccaagcacggcccacaggccagcgtgccttgccatgactgggccggatacagtaccgtcgtggtcggcccggcccagcttagcacggtccatttagcctacaatacccctagccagttgccactcccgtcccaaacccttccccgaatcactccaccgaaagcggcgctgctgaggaaggccgacgcggccacggccacgctctccgccgccgccaccgccaccgccaccgtctcgtcgctgcatagttcgccggcctccagtctctctcgaatctagagacgcacgccgagctcagagacccgatcctgctaaggtttggttggtagctcgagcagccgacggcgacgacgcacacccagttcccggcgatgtcggcggctgccaccgctgggacctactctccggcttctgccgcgggggaaaagcgtcgggagaggaaggaggagctgcggcgccacctcgccgaggacgccgactggccccgcgccgacggccgctccttccacgactgccgtcctgcatgtaaatcctcctcctccaccttctcaacctgctccgatttctctgtttgctctgatttagtgccgaccctcatctccatggaacgcccccattcgtgctcaggggtccgattaagcaacattttctgccatcgcctggtctgcgctttaggtgctcgacgttatgcctgagtagtacacacatgtcttacatacaacggtagttccatgtcctcagtggcagagcaaggatgctgatgatggtgttgtggggcgaaacattcccactgtcaaatgttttcttttactgttcaagtcatcgtcctactgtgaatataccacgccttagactcttaggcactgacgtaatcgaaggaaaatagaacgacattgcgctctctatttgagcagggtattgaggaagaccttt

SEQ ID NO: 62575 - DNA, 1920 bp, Oryza sativa
aagtcttataatatgaaacggaggaagtacttggtttcaatagttcgtagttataagttttactaccaaaatacttaatctttctcgtcaacatgtagattttgaagggaaaactgatgataaaatcaagaccatggaagtggtggaagaattaagatctaaaagggctgacatgcaggtattattttgaaagcttgaatatatgtgctctcgattctcatagtttgtgtataccagcacatgtaactaatagtaaataaagttttaatcctactggcatttttcttctttgttgcaggctacccttctgcttgatgcctttaacaaggacagagcttcattacctcagcctactccaacacctcaaatggcatcagtaccagcacctgctccccctgatgctcgcactcaagaaatgatcaacgaaaagataaagaaagctgaagagcttggtatgaaaagaaccgctctactttattactaagtagtatgcatgcgggttgttttcttctgtgaggttactggctcagttacaagggccaagatatagtttatttttgtagtttatctcagtttcactcactcagttcacagcacatacagtttctagtagcaatatgaactatttgctagtcaggcagcagtgctttttttttcccttttatacctatcaactccaatcttttcaagctaagatgctatttttgcagtgtactccatccgtcccactcactaaggcgcacacgcattttaagattcaaatctttaaatatttgaccaataaatagtttattataaattaaagtttatttgattaaagtaataattggactatcatttaaatttactttcatatgattatgattttgttgttacaaacattatagtatatgagaaatttaaagtcaaagatttgtcttgaagactatgccaagtttgaccgcgccttagtgagtgggatggagggagcatttgcattggttatggtgctagtagttttttaatgacataaagaagtttatgtgatataatcttgctcatccttttgttaggtgaacaagggatggtagatgaagcacagaaagttatggaagaagcagaggctttgaaaaaggtagatatcgtcatgtacactgactatattgtgtccatcctttcacagcctagtactgggttaatttctagcctttcaattgctggcagcataaatgataactcttatttttttaggacgttggcattttgtctatttttctgtggttgtgtagatcatgactaatgccttccattattgttgctgttgttctatgaccagttggcagcacggagggaaccaacttcggatcctactaaatatactgctgctgatgttcgaattgtgagtttaatcctaacatggttaattttatttgattacttatttttgttgtattaatttacacagtgctatcactagctttgccttctttattgaagaccagtagattctgcaatgcttattgtcgccttagacacacttggtttgctactagttattcaatgatattttttgcccaacacttgggttgctaaagagctttttttttttctataagattttactctgtactgggatgctgataaaaaatatgcatttcctggacatgtatttaaggacatttttataaaattctgtacattttgatagagtctgctattaagtgaaaactcatattttatgcattaagaaatttatgcttatcatgcgagctattgttgctctcaagggggtatgtatcattgtctggccatttgcacatatgttactagaaaagtgataagccgattattctataatcttggagtacatcttttgcaacaccatccccatagttcagttctttctaaaaattaccatgtccattcatcatatttagatgc

SEQ ID NO: 62576 - DNA, 1229 bp, Oryza sativa
aggaaatttctatgtcagttctatttgttgtgtgtatgagacgaggatggtctgtgccgcggtccttctgtgtcttggcttgatcaagggctcgtgcccaagtcctagtcctcaaatggctcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagcacgagtgacctatttcaagtcaagattcttcaaaaaggaaacaaaagcacagacacaacctttaagaaatcgaaaatgcttttgttgaaatacggaagagaaaaaagataagcccccggccaaccctgcacgcccgggggggtgcggggttggcccgagcccgaaacctgacacccgacccccactaggggtagaagcgacgaaggtgtttgatgttccacgggttaggcagctctgtgccgtcgcccgtggccagccgaacggagcccggccgggggacgccgatcactcgatacggaccctcccacattggtgagagtttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcaaggagcgccggccttctttctgtcgctcgcagacctcccctttcgggtggccagcgaaacgccctcgacggcgaggacatgaccctcgtcgtcggaatgggccaacctcttcttcctcctcctgtcccgccgccctgtctgagcagcggatccgggggcggccgaagctgccactccgggaccggaggggttccaggtccatgcctcctccttacgagccactcgatccgcaagctgaaaaagctccgcggtagtctggggctctttggaggcaatcttttcgagcatgcggttgtgccgcacaccccccctgaacgcgtaaatcaccgcgtgtgcagggatgcatggtatggtgttgcggactgacagaaccgctgaatatacgagcgaagtgactcatcatcccttcgttgaccgcgtgt

SEQ ID NO: 62577 - DNA, 1767 bp, Oryza sativa
acgctcccatcatacttctcggtgatggtgggccggaaccttgggggccaacggacattccgaagactcgccacaaaggctctacagccgacaccaccagccgggggcacggagggctgatcctcacgtccatgtcgaggtgacactctggacgaggaggcgccctccgttgcacggggagtacgccggctattacgctcgatgttgaggcgggcatccggctccccatgctgatcctcccgagtcgacggtgtcgacgagggagtggcagccgaatgacgtgcagccgccgccgctcgccgcgccctccgccttgatgacacggagccggtggtagcggcgccggaggtcttggtggtgacggaccgtccaccagcacccaggcgttgctgcgccgtcatgaccaagttggccacgtcgtccagccatcgctgggctggagactccgggtcagggacgacaggcgggtgtcgtaggagcgcgccagcagcctgaagcgcgccctgaggcgtgctgccgtcgccgtagacgaggaggcgacgctccccatctcgccgttctcctgcaccacccgcgactggtgatgctgcggatttctcgactctctcgagcgcctccccctgcttgggactttggcgtggaggaggtgggggagtgcgagctcgacggcgcgggtttggctccccgtcatcgccgctcacactcggagagagattgtgcgcctttgcttgctcggccattaggctgaacaagggaaacttggcgcacacggaagagtatgagagctcagaaaacacacgctgagccccctacctggcgcgccagatgacggagctcgtggctcctcaccgggagaccgcgcaggcccccctttgccggttcggccgggggcttagggtgcgatctcaagctctctctgtatgtggaaagattactcgccggcaagacacacgagacacggcgatgtatacaggttcgggccgctgcgaggcgtaataccctactcctgtgtttttgtggatttgtgtatggacaagttacaaaggatcaacttcctttcccctcagccttccaaaagggaaaagtcccccctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgatcagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcggggtgccccggccctcggggccggggcaagcgcaaccgaccccccctgggggaaat

SEQ ID NO: 62578 - DNA, 779 bp, Oryza sativa
ggggaaatcacgaggagggcggacacctcaccctcgggcccgacgtccccgaaggtgccaggccacgtgggcgattgcgtctgcctcaagcctctggtcatgatactcccggtcccatatcaccgacaatgatgaatgcatatacttagataatgaggaggctgttgctggtcaagctgatgaaactagaggtgaaggggctgccaatgaagaatccgaggatgaatcttgggctacatctgaggatacatctgaggatgcatctgagggtgatggtgttgatgaatctgaggatgagtcaatggcattggatgggatgccagaaaatattcctagcgcaacttatgacaagaatgacccaccaatgatcgtaggaagcatatatcctaacattgatgaatttagattggcaatagcacaacatgcaataaaaaaggagtttgaatttaacattatccggagtgaaccagggcaatatactgcaaagtgtgctgctcaaggctgcaattggaggatccatgcatctgtggttgctgatggtgtcactatgatagtatgtatttaatttaaaacagcatgcattcttcaagtattgtatatgtattttattgtggtattgaatatctttatatttcaggtgaaaaccaatccttttccacatgaatgctcaagtacgagaagaagtgagactatcaaggctacaagcaagttttggatttgtgagaaagtaaaggattggttgttggaggatgctagtgtgggagcgaaggaattgcaaa

SEQ ID NO: 62579 - DNA, 3804 bp, Oryza sativa
gcactggcgacgctgtcgtcgccgagccacatctcatactcgagcatgttgaggcccaggtcgaagtcattcttgttctcgagcttgagatgcagcgtggcggtggtctcctcgaaggagaacctgtggaacttgatcttctcgacgtcgacgtcgggcttgtaggggatggggatctcgccggacttctcgagggggagcttgatcctgccgatgatggggacgtcgatgaggaggacgaccctgacgaggtaggggatgatgctcccgggcttgatgtcgttgtaggtgctcttgatgtcgtcgtagatgagtgagatggggatcttgacggtctcctcgccatgggcgtggattgtgccggcgtccgggatgaggccggagacgagcttgcggccgtcgctctcgatgaggtagtcgatgtcgacgagcgggatagggaccgggttagggttcttgatgagcacgtcgacgacgaggtcggcgcggtggaggctgatgtgcgggatgtggacgccggagacgtcggcagtgggcttgccgaagccgacggccccctcgatcttctccccgatgtcgtggatgaagtccttcaccttctccatgaatcccccgcctccttccttcttttcgccgccgtcgtcgtcccggcggtccttcccgccgccacgctccgtcaccgtggggttctccgacgaagacgacatgctcgctaacttcaggtagcaacaacaacaagcgatcgaatcaagatctcacagcaagatcaaatcaagcaaacagatcgcacgccattgctaactccacaagaatcaccaaagacttgatcacaagaaagattgctttcttttctctttcctattctacacggctaggctacacacggcaacaagatctgaggcacaaatatcctccaaaacgaagcgagagcaagtagaaagaaacatagattgattttttcttactttacctgtgggttgatgcggagatctggacgaagcgagtggagatcgcgagcggaatggagaaatttagagagagaagaagaagaagcacgcggagagatgagcagagcagagcacgagcttatcgtggagcaagtacggcgtggggcccacttgcagtgacacgaacggactgccagctcagctatactgtcggctggacacgaagtcagaggcaaagcgagaatttttttcatttttaaatttttattttttaatatttaaaaaatattataccatccaaaatatttacataaattacccctgacacctaagggtgagtttgagaggaggggaaaagagaagattgggaagatacgtaaaacgaggtgagctattagtacatgattaattgagtataaactattttaaactttaaaaatagattaatatgattttttaaagcaactttcatatagaaaatttttgcaaaaaacacaccgttagtagttcgagaagcgtgcgtgcgaaaaatgaaacaaactaactcacaaactcctcctgccgaacgctccctaagtggagggtggcaaggtgtgcgtattttgcaccgagatataatgcaattttcaccttgtaaaaaatacagttttctagttttttttatcttgtccgtcctcacatcaccttgccgccctcgggatctacttctgtaaatgttttcgccgtacaatatttctgtaaatattaaaaaataaaaatttaaaaatgaaaaaacttaggcaaagcgaagtggctggaacctttacctgggccaatcaaaagccggtccatttggcccactaaccccggcccaacaaaaaccggtttaatgggcctccatctaaaaatcctatccttatctatccactggacacgaaggcaacacacctcgcctacctccactctctcgcgctcgctctccaatgccgccaccaatggcgctctccatctcctccaccgccgcggcgaccgctctcctcccgactctcccgccctcgcgctcgcgcctgcgcgtcgcgccgcgcagggcggcggctcgggtggcgcgcgtggtgtcggccggatacgccgcggggttctacggcggggcggcggctgcggccggtggcgagaacgacgaggtgggggatgaggagggttcgtcctcggggttcggtgctgggctagggataggaggcggtgggcttgggatgtcggccgcggaggcggcgctggcgctggaggagcgggagatgccgccgtgcccgcccgggcttcgccagtacgagaccatggtcgtgctccgccccgacatgtccgaggaggagcgcctcgccctcatacagcgttacgaggaggtaaaaatcaaaattactagtaaataattagctgcactgactaggcgccaatgcatttgctatctgctgcagtagacatgaatttccgaggaagatttgtagtggccaatgcatgagaattttatcttttgccagtttatggtaaatcgggctgaatttatggcacactggtaaaactcaaaatcactactagtggtaaataattagctgcattgactagacgccaatgcattttggatttgggctatgctgcagacctgctcctgcagttgacatgaatttctaggaaggtttgtactggccaatgcatgaacttgtcatcttttcccagtttatggtaaaccaggatgagttaatggcatacttgtttcttattaaaaatgctgtcatttggctcgttctgtcattaacattgcttaaaatcatatatcagtcattgtaggtgaagctgaagcaaatcattttgttgcaaatgtatactttctggtcaacagctacagccccatattatttgcgtatgtcatagtggagatacaggaagcataaaattgtttctgctgtagaacatacgtttactacagaacctaccaaaaaaatagttttgttattatatatccatcattccatcctgcgcgcacaatctcctgcattgtttagtaggagtagtagcaatcaccagttaacacgcattcaagtttaccttggtctttttttttttttgtcccataattgtcttggttgatgatcaatcaagcctcttgcccattctgtaaccttaaatttgatggtatcctgaagtgtgacttcactccataagatgttcacttgctacaaacctatctgcaatttgcttactgagttacttatggtggtttttcgcatgtcttgcagctccttgttgcgggtggcgccatgtatgtggaagtcttcaaccgaggagtcatcccactggcatacagcatcaggaagaggaacagcaggactggtttgccatccacctactacgacggaatctacctccttgtgacatacttcaccaagcctgaatccctggatgctctgcaaatgaggctcaatgctgacgacgatgtcatccgctcaaccagtttcaaggtccgcaagcggaaagccttttaagatcagtttcaccacctggactcaggtttccatgttttggggaatatgtttatatcatacaagaatcctactgccatgggaggagattggtttttcgctgcaatcgttgagaaaaaatgtcgccctttctgttgataatttagaagaaatttgtcttccttttttttcgttatagcactgctctgatcttacctggtactcctacacgttaagggatattgaacgaacacttttgtggagcatggcctgctggggcctctggaacaagttatgctgttaacaaaatcagggctcatttcctgtacgccatggcatttcatttataggctgccttacccggcatt

SEQ ID NO: 62580 - DNA, 959 bp, Oryza sativa
tatccatgctccagagttcttcagtaaaagctcaacaaacacaatatctcggaggaccacaagtatcatgtagaaaaaccagaatactccaaaatcagccatcatggagcaccagattcagtatctatcgtggcgcctgaaaataacaactgtctaatgttagctcctagtgatataaaggtttccatatcaaaagcagataatttcattgtgtttctttgtcattatactgtcaaaagtttatggtcggaataaatcgctatacaagaaaggcagagagaagtgagcaaagaaaccattgaaccatacctgcgctccctggatcgagaacgttcccttctccttgaatcatggccacgcgaacggtcataatctctatcccgatcgcgatcatggcggcggtccctatcgtggcgcctatcccgatcacgatcatggtctcttctgctttctcgaggttcaactctgtcctttctttctgaatctctatccctggatgcctgaccattgcggtccttgctgtattctcttgatctgatgagcacagcatgtactttcagattatgctgacactacatgaaaatgaaactaggatggaaaagcacataccgcctgtcatcttcaggtgccttccttcttttacttctctcctcctggaaggcggcatagaatattttataatgataaaatcatgatatcaaggctccaatttgcataggagggaaacagataaaggaaaaaaagtaacatatatataaaaaaaaggtgcaagagatacattacggttaaattgctccagcaattaatttacaaacttagtacttacagtaaaagatggcaaaaggagtgcactttcagagtaacttaaccggtactatttatcaccatctctacaaaatatggatcacccagcagaaaacaatctccagcttctgatcaacataatactaagcagatta

SEQ ID NO: 62581 - DNA, 2864 bp, Oryza sativa
  unsure (1)..(2864): unsure at all n locations
tgctctatgcgatatattcataactctcttttgtagatcaagatcacttactggctcaaaccaacctgagccatctaatatgattgcagccatgccatgtcttggagagcaaacacctccagttgcaccgaaaaaagccaagagcaagacaaagggaaagccaccatgttctgctgttccaaacagcccagctatgggcacaaggagcaaaaataagagccctgcaatgggcactaggagcaaaagaaagcttatggactaaattatatatatatatatatatatatatggctagttgattaggttttatttggtactgacaatttattatgtggagcctgatggattttgttgttgtttgctgtgttatgcctcatgatgcaatgatgtagtggtatggaccttatgctattatgctcatgatgtactgcccacttactgtcatttgcaacatttgtgtatggagtggaaagttggtttggttcctgcactactaggtatggaaatgaaattgtggtctttgcatgatatgaattgttctgtatggatgatggaaatgagattgatatgaaatgctctttgtggatgatgaaaataaaattgatatgaagtgctttgaatggttgctacatgatttgattgatgatgtatgatgctcttattgatccggactattttgtttcacaaaattctatatggatactctctttatttacatcctgcctaattttttttgtatggatatgaaaaatttttttgcaatggatttcctcctttgtccacaacaagttcagcttcctattgaatgtaccaatttttgttgtacagaggaaattaatgtcactttgattttctaaccctattattttttttgatcctattatttttttaaaacgaaagtgatgtattgcatttttttccaataccacaataaaagttttaaacttattattagcctcataaatacacatattgtgtggtcaacgtttttcaattctttttcaatctacctagcacctgctgttcctcctccatctacaagggtattatggacattttcaatcacatgtaactggaaaatgaagaaaacctaacgggagaggcatggaagggatgaaagcgaaaattcgggggtataaaggggatcgagtaaaattgggggtatagaagagattagggaagttttcatgggtatacaagggatttactcctaaatttatcaagggtcatgcacttgataaatcaaaattggagtgtgacctttttggggtctactgataataatcttttggtacatgctaaatttcaagttatatgccttgaacagaatatatatatatatatatatatatatatatatatatatatatatatatacacaaaactgaaaatcatcttaaaggattacaactgaatttacatggaatccaatccattagacataaatgaatctgagtaattctctggatagtacactatgtgttcacggtaatctttaaaagcttatagaatcctcagtacatcgagttgcaattttgcacagataaatacaattctctaagaaacaggaatgaataataagaaatgtcagtggtagcatatggggcaactgtggaggcacaaatggacgcgccaagaaaatgtaaaaatgtgctatcaattgcaacttagggtgtgtttgaggagaaggggattgaggagattaggaagatacgcaaaacgaggtgagccattagctcatgattaattgagtattaactattttaaatttcaaaaatggattaatatgattttttaaagcaactttgctatagaaatttttttgcaaaaaacacaccgtttagtagtttaaaaagcgtgcgcgcggaaaacgagactcaaatctcccctatgtccccagaacgaacggagccttagtgaacaaatcttggagaagaacaatagtttattagttcagacaaaaatgagagttttaacttctatactgagaaatggaattttatacaaaaccatatacctttgaagcatgaaaaaaggggtcactcctatgatcaccaggaaaaaggcaacatcaaatgagattgtaattttatagtgatcaataggattttagtactgacctgattatttgacagagtctctgttcacttggtaaaagagttcacaattcaaattaatctgctttagtcactactcatattggaacactattccatgtatataccttgagacaaattccaggcctgctgatcaattatgaattgaccagcacatttggactgcagtgaaaacagaagaaaaatgatatctcagtcaataaaaaagccaacgtgtgagaatagccggtaaattagaactaaactgcacatagatattatactgctcttccttcctaatatctgaccatgcactgatttggctactcccaagaatcagatgggaatgattagaacaaaccactgtgtacaactatgatatgaagtatatgaaccgttcatatctaaaactctgcattgcaacaagactacctgaccaaactgatccatggaagcagatctgaaaaatgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62582 - DNA, 1203 bp, Oryza sativa
agctcctgcgtgactgcgcctgctggttgcttgtcgtcgcgacaggaggtccggcggggatcccctatactcgtcgtgtccggccgaggcggcgccgctggctgtggatgaggaggggaacatggacttgatgctgtcggagactcgatctgcgcccagcgaatgtggaaggaaggagccagcagcagacgcggcactggtcatggcgccgccggtgttgccgagcctgtaggatgtcgaggtcgcctgctcggtgacctcgggctgctccgtcgacgctgcggcggccggcggcagggcctatctttccaatctttctaccaaacaatgggcaaacagatacatctgaagaagtgattgtaatataaaagttactatggacttttctgtaaaatgagatggtcaatgctaatgtggcactttcgctgaggtggaacaatggtgtggcaacttttgcaccatgagcgcacccacctagccaagttattgtaccgctacgctcgattttcaagtttttacacctaatcgcacccacctgccaagttattttttccgtcaacgcaatttactcctaaacaaattagcaacgcttttgctattttgcagtcgcctgcaaaattttaatcgatcagtcgatcgcatcgaccatcgattatgtgtcttgattttgtgcgcgccatcatctttcccttgctaataagcccagagtccgcagcccacagcccatagcccacaacccacaaatagctctggaaaaatccgcccgcacccgtgactcctctaaaaagcgcttctgctcctcgagtagatagcgtttgtgttttctcgagcagggaggcggagtcctgtgagcagaaggtgccggagattcttccaaggcaggaggtggaaggggaggcgagggggggggggaggtgggctgtgcaccgcgagcggccgtggacggtgccggagaaggcaccgcgagtgtgccgtcgaaggcgagcgcgcttgagttgaggcactgcaggtttttcatcgctcttttttgttcaaatctcacgccgcgacggcatgttcccctcagctccagatttctatcatgtggattttgtgagttgtttagggctggttggctaccatttcaagggaggggggagggaggggggaatcccgcggagtttttttcattccttgatgctttggagtttactgggtatatgt

SEQ ID NO: 62583 - DNA, 1172 bp, Oryza sativa
tttttttcaaacttccaacttttccatcacatcaaacctttcctacacatataaacttcaaacttttccatcacatcgccaatttcaaccaaacttccaatttttgcgtgaactaaacacaccctaacctcaatagcatatgtatgcaacttttgtagtactaacaggcaagcaagatgccaaagcaaatggaccatcaccagcggatggaaaggcaagcatcagattggctaacaggcaaatggaccaccagtatttcccccaatacactgctagctagtactaccagcctaccactatcacaatcccagcaaagaaaaatggcagccgtttcactggaaatagctgttggcacatcagtgcctggccagccagcagcctgctctgccctgcctgcctctactcatgaatgatactagtagctcccccaattcatacgaacaaacaaacatccatccaaccaggcaaaagaagcagcagagaagcaaaccaataaagaaagaaacggcagctgggagggcattgaagagggcccctggcagcagttggggtagctttaagacccccccttttaacaaccttatttgagaagagaaaggcagctggtgatagctaagctactccttagatagaaaaagcagcagaggacatttcatatctcatctcacctattgccagtacatgcaccagtcccaaaacgacattgagccaaaagatggcacacagaaatcacccaaaggccaacccccatctccactctcgaagtggcagccatgcatggcaacagtgcagggcgccactctagtggccagaggcagcacaagtgagggaggaggtgaaagagacaaggcacaataggggtgatcagaaactatgacagagtacagtggaacagtgaccactgggaagctatctccactgtcagcaatggaggcaggcggaggaatagttgctggatagcaagaaaagggcaaagcttcgctccactagacactggtgcgagtgggccccagctttagtgcccactgttcaaattacaactctgtaaaaatacagtagggagggccaatcacttttagccagaatatcttacattaattttattgtagagtcaaagaggtacaagggtgtttacctggtagcacggtcacgattcgtggtttcgcactcaa

SEQ ID NO: 62584 - DNA, 1081 bp, Oryza sativa
tgtggttcatggaaagttgcaagctgacagatttacttcctgctatatctgacagttcacaaggcaaacagtatctacggctaccattatgtaattaaaggaacaaacatatggttcgtcatctcaagaaataggagcatggaagtagtagctaattagcaatcgaatgttaacttgaaacaagtttaactgtcttttcaaattgcatataagttttgatgatagatataccctgaggttcacaaagaagcccggacaaggagatgcatataaatgtggatgctgggacatcgatgtgccctgaggaagcacaggccactgaggacttattggctacagaaaacaatcacaaaatgatacctcagttaacgttatcagaatcaaggtaaaagagctttgtggctttggaactgttataggttataaaaatacacagataaacaaaatatctagccagtctcttcaggtggtagttgttcggcaatttctttttcaattcaatgaactggagaaattgaataaaaagattggcttttcttgatttgggaatacatcaacagtgagttgtcatttgtcaataagctgcataagatggttcccagatggtttcatacaacaattctagtgacacatacaattagtgtactaattattttgaaagtgatagtataatgttatgaaaaaggactaaccacctgatcaaaagaatctgaagacggtcaaatctcaaatggtatagcggttacaaacaccaaatattgtagcatatttacctgagtaacaacagaacttgaagcttcaggagaatcacaattcaactggaacccagttagggtaccatcacttttcagctcatgaacgttaggctgtgaaattctcagatttaagtcaatgatgtctccatcaaccactgctaagacaatccccagtgtgcttttgttaatataaaatttggatttgtcgttctagtggataaagcacaatatacatagtacaaaagaaataccttcattgtcggtttcaggtagaacatctccatcataagaactaggatcaaaattagtaacagcttcccttccat

SEQ ID NO: 62585 - DNA, 3891 bp, Oryza sativa
cccaaggaaacaaaaacatttcccctcaattaattccgaggagccattccgattcacttagttctttcctaaagaagctagcaatctataatcattgaacacctgtggtgttccaatagtaaatggctagtgtgtgaagagtcaacatcaaatcttcaggtggatgtggactccaggggtagcctaccattctccagcttggtagtgacacattttttttctttccctttttgaaaagcaaacttgacacagttttcgttcatggcatgaaaaatggtcctgaactaatctaaaatgtattgtattgtaagttactagcaagaacaatcaatgtttcagggatcttacttcttgccgagcagctggcccatccgagcttcccaccggccacacttgtgcagtgtcacaccccggtactttgagctcccccttgcaaatcctgtgctttggcgccgaagtatgtgcacaaactcctccttggtccaattgcgcatctaacaacacagcacgaaccaatccatcataaaccatcacaggccggtgaatgaacctccccttagaacctaaagaatcacacatgacaattgaactatattccaaacaacctgcttcaagtcgtcctcatagtcattcagattaaagttgatatccgcgtcgaggcctctgaacttgatcgccgcgcgatcataggccctgcacaaggggttctacaatctcagcacacagggcaaaccagagcaacaattaagatacaattggtgaccatttatagtaacctcgctgcggcatgagctgtatcgaaaccacctgaaaacagaaaaaaaaaacaaggcaggagcaaacaaatcggaatcaagctaagtagagacccaaatttagcagtcatgcgagcgaatttagcttgggagactagaaataggagctcacccaggtacacctgcttcccgcagtccctgccaaaattggacgagacaaacgaagagattactactccaatcaagcagagtcaagcagaggaagtcagcgtgagggaaatcgagcaaggcgaagctaaccagatgtgcgactcccatcgcccggtcctcctgtagaaggtgacgcccctgtactgggagctccgagacctcgggccgcggcggctcttcttcccgccggcgggggacctctggctctgcgccaccccgagatccgccgcgcggcgcggccacggcccctccccagccgccgccggcatcggcatcgtcagcggtggcgtcgacgacccgtcccccgccagcgccaccaccgcagacggcgaagggaagagctggcgcgtcatgacaggcgaggagcacccgtcctcgtcggggctcccgccgagcaggtcgaaccggaagtaccccccgccgccaccgtcgggcggcggcggcggcgtggacgagctcgacgtcgccgccgacccacccggcgactccacattgagatccagcaccatactaaccaaccgctctcccccgcgcgcacccccaccagccgcggggcgacagagcgagctgggtcgcccctaccgttcccccgtcgcgctcccctagcggcggcaaccggcggcggctaccacgcgggagagaggagcggcggaggcggccatggcagtggaggtggaggagagggaaaaggggggggagggatggatgggacgtgagggagacgaagggtatcgcaagtaaaaccatttttgtgctgcgtctccgccggaaaggctacgcgtacacacacgcgcggcgggggaggggtgacgtggcgcggcggcactgggcgggagatggaggttttttttttctttttcttttttcagaacggtggagactcctactagtagtagtagtatggttttgtgtatgtagggtgtattaaggaggagtgtgctatgctttgtttgacttgactctggtcaaatagttgcaatgtgtttgccgactactggtgctagtccctctaatctagattataagacgtttttacttttatcaaagttaaactgcttcaggtttaaccaagtttgtaaaaaaataataacattttcaactcaagacaaatttattatgaatatatattcaattattgattgaatcaaactaatttagtattataaatattactatatgtatctataaatttagttaaacttgaaagagtttgattttgaccaaagtaaaaacgtcttgtaacctgaaatgaatagagtagtatataaaggtagtcgtatataggattgcatcacagtgataaaagttgtattttccactcgacattgctttaatttattttttagaattatatactaatgtttaaaacgtattatcaaaatgtattgaatgttagaataaaactaattttgtattgtagatgttgctaattttctctatataagagtatatcaaactttagtaagtagctagagaataattaaatcgacttataacacggttggattttggttacatggttggagtacttcttttgaagtcagataagcatatatagattaaggttgcatttacttgtaacaataattaacggctctaagctagcattgttggctcgttttattacggagtaaggatatctacacgtctacctaaactgatccatgatatagtgaaaacaacatttctagagcacacgatataaattattttcatcgtttgctctgccattaagttgtaaaatagaatgaagcaacaaaaattgatttatgtataaaatttgtatatatgtgctcttggcaattttaaaaaccaatgctgaaaactaaactataataaaaaaatgcctcaaaattaactctagaattaagtctaaaaattcaaattttgctttgactcataagctaacgggcaaacgatggagcaaaatacaacgtgatgtttttaaaggtatggatatgaaatatagaaacaaggtgcttctttaaaaggagataaatatattccaccattccataatattcctcacaaaaaaataatataacatacatgtttttatatgcacaagacaagcactttctaggttgtggttaaattaatgtacaatcttttaaaaaaaatgaagtctaactcagcttctggacgagagagacacccaagcatggcactgcatattctacataatacaataaacttgattcataatcaagtataaatatcaaaggagcaaacaataataataataatacttcactgttaagaaaaacttttatgacatgatgtatctgcagggaccacatgatgcgagggagaaattaaaaattttaaaaaaaaactttgtgagcaacattggttagtgcgtgcagcatttcctgtcggcaaaatatccaccggtgtagtttcccattggccgccccatccccatggctgtcttctcctgtgctgctactgtccaccaccagcgtgcagtaatgggcaggaagtaccaaacacttgttacacaaacaaggaaacggatctgtgaccccgggatattttgcgcccgttgcacgtaggaactgatttatatatgcatatatatgtactacatgcctcctaatttaagtgcagttgtgagttttcgtgttcaacatttgacagttcatcttatttaaaaaaaataaaaaaattagttatgcataaagtattattcatgttttatcatctaataaaaaatactaatcatacaaaattttcaaataagacggacgatcaaacgttgaacataaacgttgtaaaattgcgttatttttggacaaaggtagtcctactgtcttcatcatcattattttatatatatatatatatatatatatatatatatatatatatatatatatatataagtcttaaggtgctacgtattaaacggcactcacagtaacca

SEQ ID NO: 62586 - DNA, 2740 bp, Oryza sativa
tcctgcaccccaaactttttttctcataccttaattttttttgttattatatttttcttctgtttcattatgtttttgcaagtaatttttttactcatgcatgtctatttatattaggtgtcgatactactgtacgcctgtacccaccattctcattctttaatttctcatacgatcctgatttttcggatcgacgatgagacatatgagaggagatcctaatatccctcaactatcgaggcggatcatgggggattgacgccctgttcttcctagccagtggaggagcgttggcggcgacgtctctgacggcatggactcgtcagtgcggtggtgccgatggtcttctccctcgggagtgagattttgtttttctgtttcttttttattttctttttgtattttttacagtaccaaggaggctaccacgatttacgctgatctggcgacagtgcggcggtggcagccatgcgggcgaggccatcccaagcggtggccggtgactgcgcgacctggtggggtggagcagtggtggcgtggtggtcgttggcagggacgccatcggatctgtggccaccgatggctgtcacgaccaggagcagccgcagcatcatcctttctcccatcgtcttccattgcagtggcaggccaggcctgatggcgtcgcatccatggccgcttcctcaccaccgccatcactatggaagatgacgacgggagggacagcagcaacaagaggaggcggtggcactgccgacacaagcaagtgtcatcgacgggctacgacggcaaaaaacatccaccatgcgccgctgccgcccgctgggccttctaccctccttccaagcaactcccttggtggtcgcagcgccactgggatgacctccgatccgttggtggaggctgcatacaagatgacggcgcttggatctacagctgcatgtgttcatcgtcggctgtcgagctccagccaggcctcttcctgtcagtgctgcctagacgctctgtgtggtgggggtttttctctgaggcgtcgatgcctcgttcatcttcaccggcggaaggagcagaaaggaggacgacgattaaacagtcgacgcccgctatttccgttttttctatctagacatcatcgagagcaacccatgtttatttcctcaccccgtgtccatgttcttcttttttttgttctttttttcccaccgtgtgtataagtgtatcaagatcatcactacatgcacgcgattcatcccggtggagttaaaaaattactaggccatgtctttttttatgtcaacaaaaaatcttactctgcccactggaaatgataaagtgaaaaatgcgtagtaatttttttatttgataagtttaggagagactccaacaagggaaaatatatggtgaaaacaacatatacagtgaaaacctgaaaactacctttgggtcgaaaaatagatgttcgtcaacatcatcacgagtaaaagttttactcgcatattcactcatgagtaaaaattttactgggagtaaaatctactcgcatattcactgatgagtaaaaattttactagaagtaaaattttttacttacgttgacatgtacacatctcggacgtccatttttagatccaacggtagtttacaagtttttactatgtatgtagtttgcactaaataattttccctaaccatgtcgaaataaccggtacaataattttttactcgacaaatctgttggatggaactctgataaagtggacagagaacatggagtaattttttcacttaacaaatctacgggagaacccaataaagtggaaagtacaggaaacgagagagatggatgcattcggaagcatgaaagcaattttttttactggccgatcaatgcatattgaacaggagctagtaactttttaactactcaatatgatatcgtgtggacgctgttcaaaaagttaaaaagttaaatctttttaacgggacctaatctaatcgggcagtgatttttttactcgtgaccggatacatgtggcatgagaagcaaagtgatttttttactcgctcttagtgggaaccagcaggtgtatcgaacgaaaaaaaatctgagattgaaaacaactgtgcgtatctaacagaaatttcggagagaaaaatcgataaatctgggtgagcaatttttttaccgacgttggaacgtgggggtgggagcggggacgccagggaggagcgatggaacagaaaaaccgggagtgggggaagtcgtgacttgcgctatgaagtttcgtagcgcacggtgtttatgtgtggcgctacgcagcgccaccgtgtgattggtgctacatggagtatgggctccatgattcaaattgagtatatacccaatttgaatgagtatgaaatttttttaaatgtttagatatgaacattaacttctttactaacaagtttgaacttatttttttttgttagattttggttctagatatataacatccaaacatataattagttaggtatgtaataatgaattgtgaaataaagttgagtttgagtgttttgttgttaggtatttggatgaatcaaattcatattcctaggtatatactcacaatttaaacatttttaaaaatttgagagaatttgtgtgttttatactttggagcccggacaccatggagtcccatatggaattatatatatgtatatatatataaatatatatatagggctgcaggaa

SEQ ID NO: 62587 - DNA, 1202 bp, Oryza sativa
ctagtctctaagaagactcataggggtatgtgtatgtatgagttcatagaggtgagtgtgcgtgttgtgagcgcccgcatttgtactttgttttaaaaaaatatcaaacattatttattgtttctcttttaatttaatagataaaataatagggaggggacgacattgttgcgtagatatgagagtgaggaggaggtggagattttgtttttccaatttttctaatttttctaaatgacttaagtgaaagcctacgacgggatgtttcattttttttaagaatttccaatgtttatccctttttttataggacgtgccccatggtaacttaagattttttttcaaaaaaaatagatctaatagttaaaaataatggagacgtcaatttaattgaattaatttaatctagcacctcgtacgtccagccacgtgtcgctcggtgattcgcagtcagtgttcgttatgttctttttgtttcttttcgtgggaaaaaggctgttggttactccctgtgtcaaaaaaattagagataaatatggaaaaattcacatttatccatatcttaactacttaaaaattagtaactttccaattgtcacaataattttttgtccgtcaatccgaccaagcggcaccctccatccacatacgtgcaattacatcccatacgatgcccaaagaaaaaaaaacagagtttgaatcaaaataagctaaaatttctcacctattttgactcggaaattataaaatatttcctccagtgtcctatagccaattacataatttttgtagtgtccatcagccatgtcacgtttttacggtgtctcccagccaattacacgttttttgggtgttctgtatcaaattttgcctttttcttaaaattttaggacatattatatggtgatttattagcgctctagtgggctttaattgatttttgttacctatagtgatttagtataacataatacatatgttcgattaattattggctgttatttagttgccattcaaatgatagggtctaccatcaaatgatgtattttaactttttatagtaaatatagctaatgttatcttgatttatttatttaattataaataaaacaatagttatattatgttagttaaaaaaaagaagaggagataattgaattggagaggagatgatgggtcagtccgaggtatacaaaaggtat

SEQ ID NO: 62588 - DNA, 1570 bp, Oryza sativa
taaattatatagtaagtctaatttatcactatttgagttttagtataagattaggtcggccgtcttcgtccacttctgttatgatgtgccgaccctcaagcttcttcgcggcacctcgttgcccgcgtgccctcttctgtccaacggagggttgacttccactggcctcctcctcctggttcccctccacatccctttccacgtgcccctcccggttcccctccgcatccctctccacgttcccttcctcgttcaaatactggtttggatcctcgttcccctcttcttcgttccagtactggctacttccctccgcgattgtatcatacaatatctgttcctcattacgatcagccatctgttcatacaggaaacatctgctaagtcatgagacatttatgttttaacaatcttatatgctaacaatcatatgctaagtctaggtgacgtatattataggaccctagctaatcaataaattatatagtaagtctaattacaaatctaataatcttatactaaaactcaaatagtgataaatgctaagtctaggtgacgtatattataggaccctagctagtcaataattatatactaagtctaattacaaatattataatcttatattaaaactcaaataatcttatactaaaactcaaatagtcatgtatgctaagtgtaactgtcgtatattagaaccctacacaatcttatatgctaagtctaattacaaatctaataatcttatactaaaactcaaatagtgatatatgctaagtctaagtgtcgtttattaaatctaatagtcttaattgcattacaaatataacaatcatatatataattacgtcacttgcctgcgcgaatgtcgcgaccgagaaaattgcattttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactcgggtgtaagccaagactctacctaagacttcttctccaaagcttctcttactgaaggggggagaaagatagagcaagaatgagtacaaccacagtactcagcaagccacaccggcggatgcacgattaatgcaagggggtacaaggggtaatgatataggggttaagttttgcagaaaacagcatttaaaagtcacttagttgcccaaagccattttaaaaagacgatcctagagctacacagtattattaatcaaggtcgtgaacccgcatgaacctgccttaacccaaggcctacatgattcagaccgaactggcaacccgaccctgggtcccagctcgtcccaagccaacccaggccaaccattccacattttagttgttgagcaaattttaagaattaaaacactaacttgggtacattgcttggcttgcccataaccgagggcgcggctattcgaatagattatactctgatcagaggtgta

SEQ ID NO: 62589 - DNA, 1309 bp, Oryza sativa
  unsure (1)..(1309): unsure at all n locations
tgtttaatctagggtgaacaaggtaataataacaataacaataataataaggtcataacaaaggtagataggcatggctagataaaacagtgataacgcgggaatttaaataaagcgataatgcaataatttaaagcaacataattttataaactgggattcaatatgttcaaagatgatgtgacttgccttgctcgctttcccaaaacgccggcttcaacttccacgaaaagcggatcctccgaagctgcagcgtctacacgaccaacggaaaagaaaaggcttttactctaataaactccatataacaagcagaaacaaagcacaaaaatgggttcttgacttcttagggaaaaattagagacttgaacggtccaattccgagttcaaatggccaagttatggccatttgaagtttatatgctctttaaatgaatatttgcgaatttcttcatttaaattttaatttaaaatggattttttgcgtcagccgaggggaggggcgcgcggaccgggtccacgggcgtgggacccacggcgccggccggtgtgagcccgggtgcgcccggtccaccgtggaccgtggggctgccgccggtccaccgtggacggtgccgtgccgcggcggcgtcgtggcgtctcgtcgtgtcgtgccgctgcggcatcgtggcgtggcgtcgtgtcgtgacgacatcggcgtcgtcgtcggcaacgaggcggccggcggcaaccgagagggaaagagagaggttgagatcggagagagatagctgatgagagggaggcggcggcggaggaggcggcgacgacgacgagcgcgagacgacggcgagatacggcggcggcgtcggcgcagggatgccctacgcagttgtggcgaaggagaagtcgagagagatcgatcgggcaaaaacttctaagtgttggtggagaagacgagggcgagcatcgggaatatatatacccctagatctttactcccggttctttactcccggttgttctcatcaaccgggagtaaagatattttcccgctatttccaaattctttttaaacccggttagggttaagaaccgggactactgataagcgtactgaatattattttccattacatatgtgcttctaaaatagaaaataatgcattaaaattatttaaagtacaaagattaatgacaattacttcgaaaaattattgttgttctngtaataaattaagtggataaaacgtaataagcaaatatatgatttaaaattaataaaaattctaataatcatatatacttagcatatgaatgatattaaatt

SEQ ID NO: 62590 - DNA, 714 bp, Oryza sativa
tgtgcccctgctcgcaacctgagtacaacgatgttctgtggtcctctaacatcttgtccaatttatgggcccccttttcactttcgcagtcctccttggcgtcctgcaacatctgaccaagatcatccgcaacgtcgttaccatcagcatccctttcctcctcgcccgtttgatttccttcaaatccaatgtactgagcaaagtctggaatattgtcgtcttccacttcattttattccatttcaacaccttgctctttgtgggatgtctaacaattatagcttggcatgaaccccgactcaaacaagtggaaatgaatagttctagatgcagaatacttcttctgattcttacacttattgcatggacaacaaataaaactcctttgcctgttagctttggccactctcaaaaaacagtgcataccgtcaataaactctttggaccgccggtcagcatacatccattgccgatccatctacatgagtcgaaaaaaaatcgtacacaaataattattcttataataatgacagtcatacaataattataagataattacaaactctttcaacagtcatacaataatgacatatctttattcatacaaaaatcataaaatattacaccaaataattcttatttactatttctaaagttttaaactaattttaatgtgttttacttcttttaattttcatttttgttttctattat

SEQ ID NO: 62591 - DNA, 744 bp, Oryza sativa
gctaaatgaggctggctcggtcggatgtgctactataataatgataaattaattagaataataatgttcatagattgcacatataaatggtataataatttgggcatgcagattttccctgaaaggatttgtctgaaacacaaacaatctataccaacaaatcggttttgatcaatttgaagtactaactccagccgttcactaaaattgttcatctatctaccattaccagctggatcttacatccttcatacttcattcatcaaatccaacagacgaaaatcatctgacgcttcagatccaacgaaccatctccctcagcttccaccgcgcaccgctccatcccacggaatcgccgcacgcgcaccactcccatcccacggaaaccgcatccgccatcatcgccgcacctcgctctcccccaaccccaaatcccgcatcaatcgccaatcgccaatccacatcgccaatcgcaaggacgtggtaacaacaggtcgcaacaaacccccgctctaccgccgtcgccgaagcctccacgcgaggacctgcgcttctgctggccgaaccattcccccaactcgcacgctatccagacgacggcgctgtcatggcccagcctcacaaattccgcgtcagtggcgccgccacatcccaaggttcgtccctttcttccgttacattactctgttttgcttcctgccgagatgaaatgctgcataaacaatctcccactgggctgcagga

SEQ ID NO: 62592 - DNA, 4973 bp, Oryza sativa
  unsure (1)..(4973): unsure at all n locations
cctgcacccccattttcaggataattaaattaactcatgctgtgttattaaatacatttttcaggagtagtatgcaaaaggttgatattgccggaactaggcaacttgtaaattaagccattccatttgtatacttcttcgggccgttctaaacagaggttggaaaccgctgattagccgcattgtatatataattaagtattaattattaaaaattttaaaaaataaatttatttgattgcataagcacattctatataaaaagttttcgtacgaaacatatcgtttgtagtttaaaaaatgtgataacagaaatcgagaagtaactaattaattaaccgatctctgatttgaaacaggcccttaagccctattcatcaggttacatttcagcttttctgttctttgtcttatacatataccagtccgaaatactatcaaatcatgtaaagtttcaatgctttagatgatcactactttgactcaatctcgagccagttagtcacatagccttccttggtcaaatcatcaaagtaatatagctcccttttccctctttacatatatattgtttttcaagaataaagtgccctatcttttccatagaatcaagcaagtggattagtagcttagtcttttttttgcctcttttgatggagaccatacaatacaagaccaaatttccagcttccagtgcgcgaaacataaaagattagcacgaaaacactaaatcatgctacgacaagtttagtgtaaataagtttcattcatcggattatctactttatagtacaaataaattaaatattttaaaatataaaaaaataaatacttctaaaaacaagtggtgtaaataatatagtactagaagattttttttagaaaaaacatattttgaagacgctgaggaaataatttatgacaataatccggtgaaacagctgaactacatgaatgatttgagccaacaaggctatatcttttaagatgccgtgcaagataccatttttacatatatgaattttgggtaaaaaaaaaacaccatgtagtaaaagaaaaagagagtagaaatatacctgcacgatgcagccaccgagtcccatgccctcgaacatttggtggaagctgagggcgaccaccagcggcttgatggtttccggattctgtgacgcgccgagggagatgccaatgatcaccgagtgcaccacgatccctagctctagaacctaattaaaatcaatcaattgtataagtcaataatgatacacaatatatattattctgaatattgcactcgtttgttaaattctgcacgcatttttctttgcattttacatcaccgaaaatgatatatgtacgacacacattgaatttgaaacctttgggcgcatgtgccctcgtttttccgcgattcggctctttcttctatcactccataatacgccgaaaatttgatctttggtataaatgctattttcgagaacgccaatttataatatatggtgggatctcttataaaaaaaatatatgtgcaaaagaaatgaatacacttaaattccattttaattctgcaatatttatttgaaacgtacatactactccctctatccctaaatataagggattttgattagatgtgacttatcctagtacaatgaacttggacatgatttatatctagattcgctgtcttagaatgtatcacattcaaccaaaatctcttatatttaaggacggagagagagagtagtaatgaaagtgtggaaaatgacagtaaaaaaaacagaaggttactgagactgctgtttcttacctatgggttaattaaaccaggctggcgtcatgatgaatgcatggtaattagctaggtgttacgttaattaaaggaggtggcctctcacctgagagatgacacgatgccggagagttgtctccttgtcgtcctcgccgacggccgcgacgagcgccgacgagccgtgcgcgtggccgtgcgtcgcgtgggtgtgcacgtgcacctgtccctcgtgctcctcgccgccgccgccgccatcgccgacgacgtggtgattgtggtggtggttgtgctgctgcgtcgcggcggcgctctgcttctcctcgtccgcgacggcggcggcggtggcggcgtccttcttggacagcgcacgcgtgaagtagccggtggcgagggtgtcgacgacgagcgtgccgatggcgccgaccatggcgccgaagccggcgaaggggaactccttccacggcccgccggcggggaggcagtcgtcggtgaggttgtcgaacgcgtcggggaggatgtggatgaaccccgtggcgaggatgacgcccgccgcgaacgccttgacgaggaagaacacgtcgccgtcggggcgcagcgcagggacgtggcgccccagcgaggggaggccgcaccccagcgcgccgcacaccaggatggagaagaaggccgcgatcttgagccccctcgcccgcgcccggtcccgccccgccgccgcatcctccttcccgcacccgccgtcgccgccgtcgccgcgcgccgccgtggcgagcagcagcgccacggccgcggcgaggagcacggtggcggtggtgttcgtcctcatggccgctcttctgctcctgctgctatcgcggattcgcgggttttatagattcggatggtgaaggtgaagggagtaattagggttttaatcaccttggattagtcgctcggtttaaatggggggattaaaaggtgaatggtagtagtaacacagagtgacgacacttgacagtaactcggggtgaaatttttggttgagggagatattttagtttttgttttggcaagtaattacggcgtagaattactaattacgcaaggatgacgacactatttgtcacgaagtgttgacatgctgagtaggagagagaagtgtagcattcgagggtacgcgtgtgagaatttcaggccatgaaacgcgtaacgaccggaagtgtagcattccaccgccgtcgccgtcttctcccattccacatggatgaaggtactcgatctattcaatgacaaatgggttcgaggagtcttatgtatcgttaagtactcccctccatttttatttttttttttacgcttcccacaggcccgattaaactaaggaagctgtgaattaacttgtttgcccttcactcttgcccctttgcactaatgcgtttcgtccatacaggggtgaaaagggcaagggtggaaattctcgtatgggaggagggcgtctgaactgcaagcgtcaaaaaaaaaaaaacgccttcagagcatctccagcaggaaccttaaatccagcccctattcaatttttgagagttaagataaaaaaactagatccagcagggaccctattacagccccaaaataagaaggccctcaaatcctcccctaaggcctcagtcctaggggctccgagcacggccccatcattctttttttttggcgtggataacaattttgcttcgcgctttttcgtgttattcctgcgcggctgcgacgagggatcttctccggcgaccaccggcgaactcccagcatctccgccaagcctgccccaaaaggtaagacttttccacacatttgttcgcccgtcgtccacaaggccggcggcggtggtccatgcgtacgcctggtcaccgacctccccccatccgcctggccatacgccggccgtcgcgtgccctctgagactgcccgcacgcacatcacccacttgcatggtgtttgcccccacgctggcctctgcccgatcatattttcagatttcactggccggagcctgtacaccgccgctgccccattgatttttctggaaaaaacttgaagttggtcatgtggtgtggtggttgagtagtagaggagatctcagtagtagagtaccagtcaatttttctgaataaactcgttcttgactacctgtggacgtggtgacagatggttatggtggtgaatgatttgtttttaatatttttttgaagaattgtagtggactgtcggccaggacaatctaaattctcaactagtatatatcactgtacttatagtagcactgcattgtgtagcactgtacaattgttgcaatggatcgattataaccatatatatatgcactgcttttcatagattgaatgttgcgtactgtatatgtgtagttggatacgtgtgtgtatatgctctaaattttcttattaattttatgatcttgtgatggcagtgttttttacatggacttctacgacggtgacgacgacgacgacgacgatcttattaccgaatggtgggatcaagaggagttgtttgacgatgatgactactacattgcagctgctcttcttacggacatagagcataagaggaccaaaagaaagcgtcgtggttcagtcccaggtcgtgagataatttatagggataggtttgctggcaatttgcgcatagtggctgattattttgcagatcctcctgtatataatgcaaaattatttaggagaaggttcagaatgtcaagggagctcttcttgcgcatcgtggctagtgtggaggctcatgatgactacttcaggtggagaccgaatgcagtgggtcttctcggtgctactgcattgcagaaggtgtatggtgcaattcgcatgcttgcatatgatattccagccgatagtcttgatgaagttgtgaggatttcagagagcaccatgatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62593 - DNA, 1460 bp, Oryza sativa
catttaacccaatcactgctcaacgctacaccacgttgagactggcccaaaccaccacctgaactaatcagttccattatgctaagctaggggtgagactaatcacagtgaatctggttgatcgcccataaccacgagcacggctattcgaatagttttactctgatcagaggtatacaactatacccacaagacacagccccacgacacattcccgtgagccgacatgccatcacgacataccaaaaagaggccgtgacaggacccttcgcataacccctctaaccaagcacaccacacctcaagtttcacccccactcctcaaaaggcaatgggcacctctcatgcctaggtgaatccagaagcgacaaaggccatcgcagggcctattccgctccatcacgcccacccttacctggatgtgtcggctagaggaaagctacactacaactccagccgttgcccaccctgcttgtggtaagtacgataagttcttccagggcatcctgcgaaccggtccttaatcgccatgggcacgaccagcaaaaccatgcacccacagcccaccatttagtgtattttaattaaccaacaccattgcggtggtactaaaccaaagtcatgctagattccaaagtctatgtatagtgtgtttccccctttgtgtactagttgaactaagcatagctatgcaattcctaatccaacatatagccatgttacaacctaagctagcaaaggaataagatgaacaaatagtatggctgataatagtaggtaaacatctcatctagtaacattataaaacaatgcataattttaaagaaaacatagagcatttgcaatataggatcaatatgttcaagtaacaagcatgacttgccttgctctgcggctagagggacctcggcgactatttcaaagtacaccgaagcgtcgggagagccagaatctacgcgacatacaaggcaaacaatgcaaacatgctataagactactaaaacagagaacaaaacattttttaatggattctttgcatttttcttgatttactgagacttgaatgggcttaaacggagcacagtggaccgagtccacgggactggggagaggagcaccatgtgacgctgacgtggcgccgaggtggcgcacacgctggcggccaagtgggcggaggcggctcgcagccggcgcgcacgggcggcttaagccggcccggcgccatggcgacgcggcggcggcggcgcgggcggcgacctgcggcgaacggctggcggcgaagagcggcggcgatgcggcggtgctacaagggggagagggagagagggagaggagatgctggtcctcaccgagggattcggtcggcatggaggaaggcgacggcgaacggcgaacggcgacgatgggcggcaagatgtcgacggtcacgggcgaccgagcttcgtggtaacctagggaac

SEQ ID NO: 62594 - DNA, 1820 bp, Oryza sativa
cccagcagaaaacgcagggatagtggaagggaagaaaagcaaaaaaaaagagagaaaggaagaagaggttaaactagtgagggggaacacaaaaaaaaacctccatcaagtaaatttcccccaagttcttcccgttctttcctcaacacacgttgttcttcagaggaagggggtggtggaaagggaagaaaagaaaaaaaaatcaaaagatgggaggaagaggtgaaaaggagggaggtgggaacagagagcaaagagaaaaacctccattaagtaaaaatttttcgggttcttcctgtccccccagcacacgttctttctccttcttcgtgttctttctctcctttctcctttttgcttttccaatctgagttttgatctctcctctagtttttcttttggatctgagttttgatctgagtttctatcttggagcacaagacattttttaagggactcagggagtggaccatttttgtgacagaacccaattcggagctaaaaagcccaaaacgggtatcatgtgagagcccatttgttttgttgaaaaaagcccaaatcacagctaaaaaactgaaaatccagactcactgaactacagccaaaaaagactcgggcccacaccttcgctggcccataacttagcccaaaaaactggggcccaaacattgggcttttgttagttttttggacccaaaagtgtgttttaaccaactttgggctttgggctttttgttagtttttgggcccaaacatctgcaccaggttgtgattttttttgcacgtcacattttgattttttgagctttaccgttagatacatatctaatggtgcacaaagttgactgatcaaatgcaaaaattgcaatcgactgcagaataggcggtcccgattagcaaacacaaaggattaatgaacaactaggtcggcttgtgcggttgtgcccgagtgtggaatggcagacgctgcccaggaataacggagatgggatcgatggcccatatacaaaacaaggatggatccatccaatggtgtcgtgcagctgatcaccaacgtacgtaaccctagagcgtcggcaaaggcaatgtggcggccgattcttctccagcctcgccgcactcccatctcccatctccggcgtcgtggccacgacgcgaccggccacgacgcgaccgacgacgacaaggcggttcttcccctccgccgcctgattggctcacggggctacgcctcctcctctgatgccaccaacgccgccgcctctgccgccgccaacatcgcggctcctcgagctgacagcaggaggcggcggcgttcaccggcggcaaaggcgaaggcgaagcagcatctgtacgtcgtgctgaatgaccggaaggacgcgtgcgagatccacaagctggacatcgacggcggcggcggtggccgcctgatgatgaacgccggcgacatggcttcgctgaagaccctccggcggctccccgagccgccgctcctccggctgcagagccccacagtccacccatgctccaagttcaccaccgtcggcagcagcatcgtcaccatgggcgagtatttcagcgatcattattgcggcgattggtttcgcgaggccagggggaacacccttgtctacgacaccaagacggcggcgctcaccgtcgtgcgccacctcccggaaggccttcttggtgtctacgacttcgtggccgccattgccgtcggcgccaacaggctgtacgtgctcgacgagggcaccatggacgattaccgtggcagaatcgttggaggcatgcactggtttagattgaccgacgacgac

SEQ ID NO: 62595 - DNA, 4242 bp, Oryza sativa
ttcctgcagccctgaccaagatgtcgcgtcgtgtacgacggcgacggcgagctcacgtcgccgctcaccggctctctggctgctacaaggtctcaaggtctgagaagtacagtcgtcatatggcagcgttctggatgtaacatgcatacgcataattactccatcaattctaaaataaacaaagctaatacgaaatatgtcatatcccgtactttattttgggacggaggaaagacctaagttaagacggtccattaagctttacttcattgtactctgcctttctctcaatgttcttgcctcttaaatgaggccatttactactatagataccggtactataggtaccgaaaatgcacaaaaaaagcacctataaaccctttttcacctccgtagtctgaaaaacaaaaaaaccagcaccactaaacaactataggtgtcggtttttcaaaaactgactcccacagaaaccaagccgagcgggcagccggattttctcattagcgcggggggatccttatccatcccatctctctctcggcccctcatcctcacattccctctcctcccccctcgactaagatgatggtgggcggagccgcatccggcgatatggcggcctgggatccggcggcagcagtggtttccgtggtggatccgacgtcagcggcagccgttcccgtggtggatccgatgtcggctgcgtcggcggtgagcggggcagtattggcggccattctcacggtggagacggtgtccttatccacactcgtcaccatctcgaccaaagtctcctccctttccatccaaatcgaaatccaagtcctagccctttcaaattgaaatcccacgtaggcaccagggctggctgctctgcgcgtgccggttgccaaatccgacacccatgtggggttggcaaccggcacctaaagttggttatgtagtattgagtttagtcggttgctctattaataaattgattaatataatattgttcatagattgcatatatatactttatatatagttgatacgcataagtaattgttagaagctaaagctcaaaatacaagtatgctatctcattaccaactagcaattagcatcttaaatttcatacaagacacatcatcttatctccatatatatcatttttcataacattttaacatcatcatttgttcaatatttcacatatatacattcatcaattccacagcaaagcgcggggtatcacttagtatatctatatctctacctacttaaaaaattatgtaattattctagaattttttcgtccgtcctgctccatcagtgcacctcgtcccatcctacgcgcagtgtgcctctagccctgcccaggctaaaccctagcatcgctgccatatcgatctacctccatgtgcatttcctccaaatgattgtaaaaatcgattgcctactccttccttaaaatttaccctgcgatttccctttcaattcggttttaattcgtcatatttatttgatttcaacgatagccgacaatgcttccctcagccgtttttatcctgaattttgcgtattcgctttgattttgggaaaaaaagaagcaaagagtatatcgagtggataaaaaccctcaatcaattttgaaagatcgagaaagattcaaccggatttgggggaagatcggctacaacatcatacgggcatgggacaggactgtcttccggaggttgaagatgctagtaggctgtgctagttgggctttcggaggttgaagacgctagtaggctgtgctagctgggcatatgactccatttatgggctgggccaaagaaagccagatcacgcgaagggaggtagcgggttgggctggggctaaaaaaggaaggaaaaaaaagggattttggctcaaaaccaagcattgttattattattatttttgactaactaccaagcattgttattaactttttcaattataaagcgatactaatgtttcaatttattactcacctcctaatagttgttgcaccactggaaaattacctgttgcaatgcatatgtatttttagtggtatatataaatatataataattcgagcacattgtcccgtaggattaaggctgaaacacaaacaatctgtcccaatataacaatcgatccatgtgctaactccagccgtccaccaaaattgaacctacatatctgttctcctcttctatctagtggttgttgaaatttccctaaaacgggaattttaatttacacaactgttaatatatcggataacgcatataaggatggtaagaatggatcatttgttctcataaaataacttggacttgtatagttgtataatttcttctacatgcatattacaattaagtcagcgtagcagtacaaactagagtaaattgcgtttagggctaccttttattaccaaagtttcactttggactgaaactttggaccaccctttaacacatttttttactttgggctaggttactttacctttcattcactttgaaccaccccatataaactttttaggaatgcataaatgacttttcctactttaaagacatcagcaacccgtaacccggtaatctttttcaacttacacaggcaattgtttacaacattatagagtagatgcagctaaagaaaataacttggggtggtccaaaatgcaccaaagataatattacctaatccaaagtaaaaatatgagctggaggatagcccaaagtgaaactttgataacaacaagtggaccaaagtgcaattaactctataaaccataaagcctgcaactgccagtagcaaagtgatgtttctgcagtgaggtttggcattttccccagaattttgtactacaataaaaaaattgaaaaagaaatcatggaaaacacttaggctcggtcgcccgacacagaagaaaattcggtcgttctgacactggcatgcatgcaagattacatatagttaggccttgtttagattttaactttttttttctttgaattttcaactttttcgtccatcaaacttttctacatatacaaacttccacattttccattcacatcgttccaatttcttcaaacttctaattttggcgtgaaactaaacaaccttagttccttatctttctctccttctcactttaaatattttttctcctacattacttatggtctgatcacaccgatatattcattgtaatcacatgattatattctgatgacagaaaaacatatgtatcaaaccgtcaaaatgcaatgtttcatatgtgatagcgacatgcttcaatgtgtttcacaaagttcaaggaagtacatgtcactactccctctcctctctctctcttcacaacatccatgcatgcattttagcaatatttaaaatgatttttttcctaaactacttatccaatctacgatccactcacacttttgtatttgttttaactgaatctttatcgtacgactatattttgatgaaaaaaacatatgtttcattctgttaacacttgttttttatacgtggtagtgacacgtttcaatgtgtatattttctgtgtttcacaaaatttttaaatgttttagttgctgagtttttttattatatataacttaatattttatttgttgattaactgaaatatgaccatccaatttttttaagggatcggacgatccgtagattccacaaaaatcatgcgtgatccttacgtagtcctgagacaaccctcggagtttcattatttttggacttgtgtagtgacctatagaaattccaaaatgatcctgtctagaaatagtcgagctggaccccttcttaccaccaggaagtataacgaaacacatcaaactgggcctgtttgtgcgacacacgaataacaaatatcaagcccaagaagaacggagcggggatccaatggtttatagttgaattaacgtacgaaaccatactcggtgtgctggcccatggtgaggatgctgctgccgaaggcggtgaactgcggcaaatcgctgactgtcggacgctgcagccggaggagcggcggctcaggcagccgcgggagggtctccggccaagccatgtcgtcgccggcggccaccttcgatgtccagcttgtggatgctgtacgcgtttcttccggtcatcgatcgccaggtacaggtgcttcttcgccacggtctcgccggcggcgccgttgtggcgtccgaggcgtacctgatcgtggg

SEQ ID NO: 62596 - DNA, 4148 bp, Oryza sativa
aaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccaagaagaaaattgcagcggaaaataaaatctagcgaagctccggctccactcccacaggcagctcaactggggtataagccaaacgtcttctccttctggatcctttttcttcaactgaggttgattgattattgcaaggtgagcatatgacatactcagcaagccacacagcaaatatgcaagtgcacaagaataccaaaggatggcctaatataggctcatttgcaaaagcagcattcagcaaaacatttaagagaagtaaaacagtggagtaattaatcagaaattttaatcaacactgaacagcacacccatgctgcacaggcccaaccatcctgaacaaccatacccggctgtacagatctaatctccaaaccaggagctaagcaaattattatcaggtataacatccataattattgtgagaggtgtgagactaatcacgaaaaacattgctcaactcgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgctccgtaatgaatcatgctatacaaaaggtaaagccgttgcccacgctggcttgtggttggcacggttaatgtttcacaatagtagctcgcgaaccggtccttaattgtcatgagcacgactctcaaaaccatgtgctcacaacccaccattatcaggttttagttggcaagtaattaattaaccaatcacgattgaccatcgtgaactatcattaaaccatcattaaataataatgaatcataagttatcccaatagtgtgctaatgtttctgagcatggctaagcaatcacatctaatatctagttgaactgatatataaagctcaactagtcaaattataataaccctaggtatcaaggaataaagtaatcaagaacaaaagggccataacaaagaataggttaattccacccaatgacattcgaaaataaatgcacagttgaaataaatagagaatttaaatataggatcaacatgttcaaaggattgtgtttaggatctgtgtgacttgccttgcaataatcggtcttcaattaatcttcttgaacacttccgacgcactcgcgaacctttggaacgacggaaacgacaagctaacacgcaaaacgaagaaaaagactaataaaaaccaaataaacaatacataaaaagtaaacaaacatgtaaatcataattttagatgaattatgagacttgaacggcctcattctgatttcatatgaatttattatgaattttataagattaaatctatttaaagcccatttaaaaagaattaaataaatttaattcaatttatggacaaatttaatatgtagatctttattttataatttttgcaacttgaaccacattaaactgagttcaaatgaattagttatgaatttttaaagattaaatcggattaaaacctttatatggattttaattgaattatgacgcaataatgaattatttttgaaaaggaaaaggggatttattgcgtcagcggctagggtttgcggtggaccgggtgcacggcagcggttcacggaaacgaacggccgagatcaaccctatccaaaacggacggccgagatcgaatgggtccacggcggctcacgggagagggcgacgatgacgtcagcgacgacgtcaccgacagcggcggcggctcggcggagcgaacggctcgggcggcgcacgctcgccggcgaacgacggcgcgacgacgcaaacggaggacaccaacgggtagagggcgacgcggcgaactcaccggtgaccaaaaccacggcggaagagcaacggacggcgccggcgacgaggaagaagcagcggcggagatcgggtcgacgacggcgacggtgctccggcggtcttcggcggcggcgaaggggcggacgaggacggcgacaacttggcgatcccgatggtggcaacagcgaccgacgacggcggctgcaacggcggcgcggcgcggctgaaccgacggcaacgacggcggcgactagggctacgcggaggcggcgctagacgcgacggcaggctaaggcaaaggaggcgacgggtagaggggagctcgggggtccttttaaaggggctagcgagcggcgacggaggcccacggctgccggcgacgagaaggaaaggttagggttcgggagggagagaggaatccgattcgatctcgaatccatcgagtttccaaaccgaattaggcgatgattccaaaagagaaaaggaagaggagatctcaaggatcatttgccctcaaacgattcagccggagaaggaaagacgcggccgaatttggaaggagacggcggcggcttgcgctagggtttcgggcggcggcggccggaggaggaagacaagcctgacagacgggacccacctgtcagcggctgagagagagaggagagcggcggcgcggactgggccgacttgggccaactggccggggagggagaaaaggaaagagagaggttttgggccgactttcggcccaaagccaaaagaagacttttaaaaacatttttcaatttaaattatttcttaaatgcaattccatttattaaaaatacttccttagctcaaataaatcccagaaaaatctaggaattatagaattaagcaaagtatttaatgaaattttatctatcccaattttatattgagatttaacaaattaaaattagatcttctcttttaggcttttaaaatcatttctaataattccttttaaacaacaatttataatttaaggattttaaacaagaaaagcacttaacaattataattagatcattaatgatcaaataattactgaactgttctttgtatcatttaggaattgagctctgaaaaatccgagaaaatttcagagagttgacttaatcatggagaatttaataaaaaaattaaatccatccatgctttagatttagaaaattttatttcccacattttacttcacttgtaaattaaagaacacttaatataaattctattattaatttattaaataatttataaaccctgaaacaaaaatcaggatgtcacaaaaaacccttggcggctgcggacacttacttgctgtatgcttctcttctttattacttaagtcattttttaaacccataatatttctaaacattgacttattttttttcttttgtgttgtttccttagattaattatcttgatttcaaagattttggatttagaaatattccaattggtccaccaccaagaatctctgtttggaaaggcggaatgataaaagagtattcaaaaatggatgaatgcaaaacaggagattttggaaagcgaccagtaagtaaaaacaacagaaaaattttattttgtgtcaatttgtttcatttttcttagatcatactctattttttttcacatatcaaagcaatgaagaaattaagttatgacgcaatatgttcaggggcccgctgcattgagtaacagggcaacaatagcaacatgtcatgcagcgatgctctccagcaataccatagcaaatcatttaacccaagggtaatttttttgctcctccaaatgctctgtttttttaaaaaaattgttttcctagttttgtatatgtatgctccaatatagtcactcctattgtgttttttttttaaatgtagctcattgatgacatttccacagtttgcaagtggttcacaagagaactttctgacacaacatacggaaaaaatgcacaactagctgccaaggttttggattgcgtctacatgtcaaaagcaagc

SEQ ID NO: 62597 - DNA, 2175 bp, Oryza sativa
cccagtctctgtgatggcacaggtgactcaggcggaaaccttagccgccacagcctaccttccccaacctctcccctaccttgtgccacttgagcgagtggccgtaaagtcggtgcttaaagctggcggcctacgaggatgacgacggtggggctcgcggtggcgaccaccatagatccggcgtgggcgaatccaaggtggaggtcggccggaaagacgtcggcattgaggcgggatgccggcgcgcggatgacggcgacaaacgaaggtggaggcggggaagggagaagatagcggcgaggtgcgaactgcatgggggggtggcggtggcgacgacgatgccaaatccgcggcgggtgctgccagatctagaggcggagatggtggaggtaggggtggaagtgacggggtcgtagtagggtcggcggcgactacggtgggcgccgccggatcaggtcctcggccagggccgattgccgcccagtacgagcagttggcgtgaggtggcactggcgtagcacgggtaggctgaggaggcgcggcggctggcgatggaggacggagcaaggaggtttggccgtcggtgacggaggccgccacggtgcatggaggtgcagccgacaacggtgcgaggtcgtggctggcgtggaggcgcacctagcacgcgtggaggtgaggccggcctggaggccgccgtggaggaatgaccggcggcatggaggtgtggtgcagttgacggcaggtagcatcagcggcaacggtacactagagcgggtggcgtagctggtgaggctagccgacggtgggtgccggtacagcagtacccacgcactgacggaggtttgacagggaaggagcaatgtagcatcaatggtggataggcaggcggcagacgatgggtgaaaacctagcccggttttggccgagccgacaacgacggcgtttgcgtcacattccctcttgagggcattgtcatgtcgtcccatcgcctctaaggagtttgtcgggtgaaagcgcagtctccatgacggacggccgcggcggtgtttctgtcgctcctctccctggagacgttgtctaggcaacccctggccgaaacctcccaaacaactggtgcaagctcgctctagatcttggttctcttgtgttggcgccctagcttatacaaaatgaccatgtcggagggcctagggggagaaatggcggctggtctggtgttagccttctcctgggttcatgtgtcagagctgtcggtgtgtgggtggtagcaatttttttcttcgttttcctggttacgaccttacatggttataattttgtaatttttttctactctatcattatgaacttcgcactgtttggcgcgagtcgttcaaaatatatatataagggtgtatggttctgaagcaagacaaacactcgtttagatttacagcgtcagaaatacttatatttactgatggagatagtgactttcatattcttatttttaatggtctacaggccaaagttgagaattaagagtaggaaaaaaaccctccaatttctgtagtactttaaaataagatattggtggtgaaagtgaatgtgccattcatctacttccatagtaaattttacaaattattccttgaatttcttaatattaaaacacaaccataaacgaataaccacacaaaaaattaaattgaggtgaatattccctatggcaacatgaggacgggtaatatatttcatagaaatattttttatttattttggaccactataatatattttctatcggaagcaaattaagcacagtcattcagctagtaattttaaagttcaacagtggccgcggcttataagacaaagctcaaacaagtggggaacacactatacatggtccatatgactagcggcaaagaagaaaaataggtagattgaatcaattattaggtactttgtatataattgaatcttctttatattgctactgtctgcaaatgtgttgtgaaagcgttcagggaaggaacacgactcgtcatacatttttcacttatgggaagcatggctgttggcctgttgatgccacagttggatagacctcttgtgtcccattgttatcagatctcttggtacgatggtttttggttggtatatgtggccctaattaaattgccaaaaatcata

SEQ ID NO: 62598 - DNA, 2495 bp, Oryza sativa
aaccacaatttgttttagcacaaacaactagtgtgtcatgataaatgcatgatcttgtttatttgaaaaatgagatggccgattggccattaggtccaacaataagtctccattaatttgagaaataaaatgaggtaaaatcgtcatcacctcgaggtcatctatctcaatggtaaaaatgagaaactgaattatactataaaacatttcgtacaatagattacagactacacaaattcttttttccgtttcacttgttgtcagtgatcacctaatttttttcttacttgtcagtcacttaagcttgcacaaatatcactaacttgcataatttagaaaccttacaactttaagtttagaaaattgagggaattttacagcgctgtaaactcttcaaaaaatcacactgtaaaattcttaggcaatcagtgcaaatttaaaacttccaattcgagcatacgagggcattatgtatgaatataggtgctaatctattaccaaccagcatttaagaactcggcacattgcggtggcgacggcggcagcggcagtggcggcgacgacgctgggtggactggctccaaaggagatgacgttgagatgaggatcgacagtgatcgccgccggcgtctcaccttggctccagtttcttcctccgtggtacgtggctctcgttttgagtgtcttttgcaggaaaatcgggatggggacgacgacgatggtgttaatacctcgcatgagattgccgatgaggctgtcatcgaaactaggcagagtgggagagacaatggtggtcacaggcaagcaacaagtgatggtggaggccatggacgaccggctcgatctgatgaagcttcgctagtacaggagttctggagcgaggttggttttccgacgccggcgaaccgctggtgggaaaaacaacccgagcctccctctcgctttcgctctctttcaccgaagcttgctgagaaagacaacgctggcggatggaatttggtgtcttacagtcgatcaggaaaagaattcggtcctgctatacagcgtcgacgtggatggctgattcggccatggaaaggtcctcttccccgtccacgtccggcgacggtagtggtactgggggatttcctgccggcggcgacatcaaaccaagcgacaatggtttcctcagattgcgcattacaaggatcgtcctcagatcacgcgctttcactaggattgtttcaaaattcgaaacaatcttttgtgggccgtgtgatgggcccggtcggcatgcgtccttacggcagatcgagatatgacttgcttcgaccatcgttgacgcaatctgccatctctttcattccatcaacatagccatctcgccctagttacgctgcgatggcggcgactgaccctcctcgccacaaccagcagcggccgctagcaaatcatcctccccagcaacaaatcaatagaaccaacttgcaagaacaccacggcggccgggttgcgcagcaaggccgttctacgcagcaaggcggttggggtgcacatggtggccgagttgatcatcgtgatcaaagtagccggggtgcacatggaggctgggatgcaccaccaaatcaaggaggacatggtgctttaccttcctacagaaacaacaaaggtggacgtccgggatttggtcagcgcccatagggaagaaacttccggccagggttccagggccatggccgtgatgagcaacctcgaagggatgcaggcaatcaaggtgtccctgttcatcaagccctaatagaaagtactgtaaaacaagacattcaagccggccgaggagaaacagctgccctttcatccaagaatagtgtggaggtaacaacggcaaaagccaagaaacctcgtccacttcactgtttcaggtgcaagggtagtggccattgttggatggctgcaaaactgtccttgactgttttatatgtaacaagaaagatgcacatgtgccgaatagatgtcctattctaaaggaaccaaaacctactgctgctttatttggattcagtgaacagaacatgggtttcttgccgatacaggagtttgatatgaagttgaagccgccgaaacctgcgccaatggctttggtgaccattctcggtggtcatttagcagctagtgccgtgcagaatgagttggcacgcctcatccgagccgattggaattgggaggctgtgccacatggtgacaattcataccttgtgactttcccgtctgaggaggaactcaaccggatggatgatgttgaattcaggttaaagaatcacggtgtatctatcacaatccaacagtggcagcaagattccgatattataccggtgtatcagctcgacgaggtgtgggtgcacatcactggagtgctgcactcttggcgacactatctttgtttctgggctttgggcactgtagttggaaccacacaagaggtagatatgctgacctttcgtaagaagggcattatt

SEQ ID NO: 62599 - DNA, 2469 bp, Oryza sativa
cactgagagcgaatgccaccgaagagagtcgtgaaggagaaggttgctaggcggaaggaaagcgacgccggaccgggcatggccgttgaggaaggagcagagccatcggcgcccatggccgaagatggaggaggacaagcaccatcacaaccgccttcggcccctgcaacctccgtgcaagtgacgaacgcggccgacgtggtgaaggcggctgcggcggcaagggcactccagactagggcggagatcctttcgacaagccaactggtggtgccccaagccgctccatcgcagccggtagcggccccaactgcgctcgccgttgtgcaggcccaagacagccctgaccccgaagcacaagccgaagccgacatggaagccatgcggcagaacatgacacggctccaagacatgcttcgccaaatgcaagaacaacaataagcatacgaggcggcaaggcggaccaaggccacgtcgactccaatccttcagtattcggcaggatatgtcccatctcaagtccatccgcaagtgacgacccagccctttccgccacaagccgcacaggcaccggtgtacttcgacgggcagcaatcggccgcagcagtgtattcggcccctcacgtgcaactgcaagctccagtcgctgcccaagtacaccatcaaccacctggtcaagcgccacaaacagtggcagaagcggcttcggctctgcaggcgcaactccaagctttccttcagcaactcaaccaaccccactgcatttcaagtacaaccccatcggcccacccggaggagaatacaagtcaaggtgcgcctaattggttgccaccgattcagccgggcctgggagcttcgccatggaatcaaggaccgcagttcgacttcatcaatgctgctcagagaccaaccgttcggcagcaagctccaggcttcggaacaaaccaagcaccaatccaagctgccacgacgtggtcgcagccaatttttgacccatccatggcggctcagcaagtacctccagttggagccaggcagtcgaatgccatggcacaacctcacgcacaagatgcgattttgcccttcgccacaccgtacccgcagcaaagtgcagtaaacagggcgggaggcgaaaaggggctaccgctgagcgggggaatcaagactcgtccaatcccaccgcagttcaagttcccacccgtcccacgctattcaggcgaaactgacctgaaggagttcctctccatctacgagttagcgatcgaagcggctcatggtgacgaaaataccaaagcgaaggtaatacatctcgctctagacggcatcgcccgttcttggtatttcaatttaccagccaatagcatttactcatgggagcaattgcgtgatgtttttgtccttaactttcgaggcacctatgaggagccgaagacgcagcaacacctcctcggcattcgccaaaggccgggggagtccataagggagtacatgcatcgcttctcacaagcctggtgccaagttcaagacataaccgaggcgtcggttataaacgccgcttcggccggtctgctcgagggcgaactcacaagaaaaatcgccaacaaggagccacagacgcttgagcatctacttcgcatcattgacgggttcgcaagaggcgaggaggattccaaacgacgacaagctatacaagctgagtacgacaaagcctctgtcgccgctgctcaagctcaagcacaagttcaagttgccaaaccacctcccctctctgttcgccagtctcagccggcgatccaaggacagccgccaaagcaaggccaggcccccataacttggagaaaaagttcagaacagaccatgcgggcaaagctgtgatggcggtcgaagaagtgcaagccctccgcaaggagttcgacgcccagcaagcgagcaaccatcagcagccagcccgcaagaaggtccgaaaagacctctactgcgcctttcacggacgctcttcgcacaccacggagcaatgtcgaaacattaggcaacgtggcaatgggcaagacccaaggccgcagcagggaacaactgtcgaagcaccccgcgaagtagttcaggagcaaacacccccagccgaacaacgccaagatgtacagcgaagtgtaatccaagtgattacaagggctgacccgccaagccagttgtccaaacggcagaagaagatgcatatccgtatggtccacagcatcacttcggcgggtgaaggggcgccgcagtatctgaaccagctaatttcttttgggccggaagacgcagaaggagttatgtttccgcatcaagatcccctggtaatctcagctgagatagctggtttcgaagtccgacaaatcctggtcgacggagggagttcggctgatgttatcttcgccgaagcatatgccaagatggggttgcctacccaagcccttaccccagcaccagcat

SEQ ID NO: 62600 - DNA, 3939 bp, Oryza sativa
  unsure (1)..(3939): unsure at all n locations
aagaagttgagagtatcctagaggtgctcaaaaagaacatcgatatcttcgcctggagccctgacgaggtggggggtgtcctggcggatctcatcatgcatcacctagcagtcaagccggacattaagccaaaaaaacaaaagctgcgcaagatgtctgccgattgccaagaagcggcgaaagccgaagtacaaaaattgctcagggcgggggttatccaagagattgatcatctggagtggttggcgaatccagtgctggtgcgaaagtcaaacggcaaatggcgcatgtgtgtcgatttcacagacctgaataaagcatgtccgaaagacgacttccccttgccgcgaatcgaccaactctgggggcgaagaggggcgcgaagtatcgctcgaactcttagaaggagtaagggtcgaagcgctcgagcacatgcacaagtacgccacaagcacttcggcaacttacaacaaaaaagttcgacccacgcagctgatgcctggtcatcttgtcctaaggaagaaggcgaatccagtagtggttggtaagcttgaatcaaagtgggaaggaccatacctcatcaaacacaagtctaggacgggatcttttcgcctagcgacactcgaaggcgaggagttcgaccattcctggaacgccgcctctctcaagcgcttctatgcctagaatgggtgtcacccaaatcgccaacttgtaaaaatgtacatacagttatgtaagcccttcggcaccatgtaagccattcggcactatgtaagcctttcggcaaaaaaaaaaaactggatgtagggctattatccccatggaggcccaaaccagtataaattctctgtgccctccgccttctttttatttttcgtgtgattgataatttgtgaaaaaaccccaaggcaaacgcctgatcagcgaaaaaggccagggggagaaacgaatcggtcgaagcatcgctcgccgaacgttgaaaccgcaacagcttgtctcggaaaataactagccgaacgacgttacgattcgatcaacataaaagcaaaagtgtctctttcgacacagaatgctacaggtcgaaaacgaacgacaaaaagctgaaaagtcagtacacctatttcgctaatatgcgcataggggccggcatgttccgacctaacaaaagcacaaaatgtgacaatgcgaaaaatagcgaaaaggaaataaagcacgttctttattaacttcgaaaaaataatcgaagaatacaaggtctacaacacgatacaactcactttacaagtaaattacatcttcgcccccgtaatcattatccctccctaaggaatggacagatgaactaggttcgtcatcactactaatatcatacacaaccttaagaggagtagggggcgaaacgcagaccaaactgtaacgacgctgaaagatcatttcctgacgtttagttttctgatggtttcgccaaaagcgagccatatcctccaaacgtcttgaatgaataagatcgtaatcttctaaggttcgcccggggtgcgcccgcagccagtcggcaaccttgaaaaccttatagctgcgaccgtttatctccatttcgcgataaacagggagaaatggacatcgcacctttggtaggtccttcaatgccacaaatttctcgttttgacttcgccagctcccggaagggggccgaatgcacaactttcggtgaaccccctgatagacaacgcagaaaaagcaaaacacagcttacatagtaagaataggcggaaggagggggaggtatggcataatgcgagatgagcgaaataataatttgccaaagacctcgatcatcaaaaagcaattaagattgtgtcatatattccaaatgtacaaaaaagcctttttaaggttcggcggcagcctgccgaatgtacatcattcgccttctccaggcaaacgcaaaatcgggaggaaaactacaaaaatcaaaggaaagggcggagggcctcacacctctaggtgatcctgggcatcgcctccgaccccttcgcctaccgcgccctcttcttcgccccgatctgccgcctccgccttcgccagttgctccagaaagcgcgctttggcagcggaccggccatccttctgccagaactgttttcgccacgcgcgaagagcgggcgaaatgttctgcgcactaatctcccagtcccccttcgcataggtagggaactcggcgacgtgctcgcagccgaactgttgcaaaaggcctaaggtaaaggccgccgatacgcgtgcacagtaatcgccgtacgcggtggcacagtccgaaaccgatccgccagcctgctgggtccactcggagaagtcgaaggctgaggcatcctcggcagggaccccccgcaccttcgcgcccatgtcggtaagggcgaggcggagcgtttggcaagccgttctcgcggattcggtggtcttcgccatctcccgtgaaaaccgctaagactcctccgctgcgctcgcttcggccctgccagccttctggcgaagagcctccatcttcggctctgtaaggttgtagtaatcaatgagcaccgccgaatgggccttctccttctccagttcggccttgaggcgatcaacctcggcctaggcctctttccctttgtccaattcggactgaaggcgtttgatttcaattttcgcctccttgagggtgtgggccagggactccacctccaagttcttgcggcttatttcatcatccttggcccgaagacggctcttaaaatcgtcaaaacgggcccgcacggttcgctctatcgaacagtgagccgcaagaatctagatgaaagataggagcgggcgaaaagaacaaaaggttaattgcgaaacgtaaaaaaaagagggaagaggaaaacgaaggaagagaaggcatacccgaaccgccaaacttttaatggaggaacaccccttgttgaactcgttaagttcggtgaacaggctcggggtgccggcgggcaagataagattacttactccctccacaaagggaaaaaggttcgcccgggtctcgaagtcaccaggggcgaagtggggcgccgcgagggaatactctgaggcagatgcttcggcggccgcacacttccccttcgccttgaccagcggcgaaatagctggctcgcgcacagggctcccgaaaaccctcgccacagccgacacgatccgttcggcggaggcggaagccccggcggcggcgctacgcctgccccagcaacgctgagcggagcaaggggagcagtcgaaaaggtccaaactgcggccagcaggtgaagtcggagtctcgtcagaagactcgtcgttgctaaaaacgcgagcgatgtcgacgagtcccttcttttttgagatcttcttgaccagacctcctttcgccgccttgcccgacgagaacgcaactaaggccttcgccccttccaaatcctttcgtcgaaggggggagctgttcgactccaccccggtctcgttgtgacctggacttggggtaggagtgtagccgggggtgtcgacgtggtcttcgatcgcctcgttcacggccttatcagccacagcctccacctcctcttcttcctctccttcctcctcgccgtcacgttcttcggaatcatcctcatcatcggcatcagagtccgacgaagcaggaacccttcgcttcctgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62601 - DNA, 1483 bp, Oryza sativa
  unsure (1)..(1483): unsure at all n locations
ctcgtcgccgccgcgacgtagttgcacggtttccctcgtcgttgtcgccgccgccgccgttgcgtcgccaccagcacaaccacctctcaatcaggatcacttaagaaagatgaagggagatatttgtacgtcaagaaatcatattatggggttttctataaaatgagataggtctttcgtgtcaatgctaatgtggcactttcgctgaggtggaacaatggcgtggcaacttttgcaccatgagcgcacccacctatccaagttattgtaccgctacgctcggttttcaagtttttgcacctaatcgcacccacctgccaagttattgtaccatcaacgcaatttactctttgtctagactagtaaaaaagttgttacggaacttagaaaatcacattggcacttggcaaaaaaaataattagggaatttagagcttaattttaaattaaattatattttttatcattttatatttgacgtanaatatttcaatattgcatcattactgcgtaataactctatctttaaaaaatagaacggctcgaaaacggtaccccgttcagacggatactttaagtaatggcgtcatattcatgtcaaaactgacgtcactctatacttatgtggtatcatgtatgatatttattggtaccgaacatgatacccgactaccaggtgtgacacactatatctaccacatcaatgatgatgtcaatgttatggggatgctatacaatggaatcctgtttgaacgggattataccggttaggtatcaggacatgatacttctgaggtatcatgtgtcctgatatctaaccggtatcaggtgatacctattagatatcaggcgatttctactacatatcaaatgatacttgtgaggtatcaaacgattcctataaggtactatgtgatacttacaagatatcatgtgatacttataggtattggctgattcccgctgataccatcggatactcatcaatagtagagcgatacctaccagatatcaggtgatttctactaggtaggcatcatcgtcagtggccgtgtcctccgcgtttgagcatgtccttcaccgtcactccacatgctggagctcggtggtggcggccctacatcccatgaccgagatcatcaccggtgcagccacatcctccgccatccacattccacgccagagctcgtcaccagcagccgcgtcctcctccaccacgctccatgccaggctcgtcgccggtggccgcgtcctccgctgtccatgccccacgccggagctcgtcgctgaggctgcatcctccgccgtacacaccccacatcatcgagtgttcgcatcagcacggtcataggcggtagcgacgagcaagccacaaccgcgaccatgaagccatcatcatatcgtcttgtcaccgactcgccatgcgcatactcattctcttgccgtctcgccccgctgggcatcgtcgacgctcttcatcgtc

SEQ ID NO: 62602 - DNA, 7248 bp, Oryza sativa
  unsure (1)..(7248): unsure at all n locations
gtatcccgtggtataacatacaagtatgtcacatcatcacccacaagcaattactattgtatagtatattaaatctcatacaaacataacacatatctagaatacctcgtggtatctaaatttttcactaaacattatgatatctaccaaatttcacagtaaaaaatgtagtatttttgggtaatttcttaatgatgataaaattgcttatgctataagttttgtagcaacaaaattataaccatatgaaagtaaaatgtcaattcaatgatattattttcagcaaacaaaattcaattcatattatgatagttgttggttaaatattttaaaaagttgagacttaaaatgtgtgtgtgctttatatgattgggtgtagggagtagctatttgtattctgcctttgttgcaacgctagttgcctgttaaatgaggctggctcggtcggatgtgctactataataataataaattaactagaataataatgttcatagattgcacatataaatggtataataatttcggattttcccaaaaaaatttatttgaaacacaaacaatctatcccaatataacgataacatatcggttttgaatttgaagtactaactccagccgttcactaaaattgttcatacaatacaatatgtattcgcctcttctatttagttgccgattgacatttccccgaatctgaaattttggaatgccatattagccccttgtgatcgaaataacaaccttttctacctagtctcgtatataaatccttgctcccccattgcatgtctcgagacgtttttgctgcatgcattagttcgatttttcttttgcgtcaatttgggcaaagaagatgatgttaaccaataaaatttggggaagtcgttgatatatgactctaccggtaagagttcaattcttggcgaagtcgttgttatatgactctaccaataataatttaaattttgatacgtacatataaaggacgtaactacacagctaccactaagtttgtctaaaccagctaccactctatctatagagacaccatccacatgtacttcaaatacaattttctcttaaactactcatccgatctacgatccgactacaccgttgtgtttgtaacaattaaatctttacaacaagatcttacatgattatattttgatgaaaaatcataaattacttttataatatgtctaaattacttttagattttactaagttacttcttagatatataaaagtaaattcagtaaagcctaaaagtaatttacatatattatataagtaacttagaacaaaacgaaggtaactttgccatgtcatttaaagtaaatctgttggagagataaaaacatgactctatctagaaattgaattaatcagcacaaattatggaattaactaaaaacaataataaaagtaatcacctcagagcattatgaatatataggaagtattttaatcaaaagtaacctatatatatgataattatatatatgataatttgttcaatgaaaaaaggaattaattaaagttactttctttttgttataagttagttctataatatatgtaaattacgtttaggctttactgaatttacttttatatttctaagaagtaacttagtgaaatctaaatgtaatttagacaaatcataaaattaatttgtgatttttcatcaaaatataatcatgtgagatcttgttgtaaagattttaattattacgaacataatggtgtaatcggatgagtaatttaagagaaaattttatttgaagcttagatgataggaatattttctcaacttacttcatggattagtgctatagtaaagtaagattcttcaagttagcacatatctaaataggggtcactcgttatgactaaatcgagagtgctctcgatttagattttgcgacataaaaatattactccgtacgtgaatttgccatttagtaactaataacaacaattgggctgggccatcttgggccagagggaaaggccgagaggtagaccaaagcccatcaatcatagaggaggccacaaaaacatagccatgagatcgaatggtgtcacgcatggtgtacgtaaccctaagcgccggcgcggtcgcggacaatgtcgcggccgatccttcgccggcctgcgcagccctctcctctcccatctccggcgccccgtccgccgccacgacgccaccgacgtcccagcatttcttcgtccccgccacctgatcataggcccacgatcaggcaactcctcggatgccacaaacggcgccgccggcgagatcgcggcgaagaagcacctgtacctggcgatcgatgaccggaagaacgcgtacaacaggacatctctacgacggcggcgacgccgtcgacccatggtgttggcggagctcagagccgaacacgcagatgtcatggagtcccgtgcgagaaaagcacgccgtacgtgcaccccgggggacgcgcctagcttcttcctctccgcgatgaaccagtttcggtcgggcggcgtcgacgtcgaggtcaccttcttctacagcaaggacagcgacgtctgctggacgcgccgcggcgactggctgctgccgttcagaggccacggccactacgacggcgagctcggctcgtgggtcggcctccacactactccgacaccaacaggctacgcaccgacgggcgcctctgcgcctgccacgtcgtgtccgcctccgccgaagcgagcggcgagccggcgccagaggtgaaggtcgggaaggataaggtgttcgtccaggtccctgcaggctgggtgcacgaagaggccgagctcgtgtacatgggtaagcgagtactgcctcgttgcgtggctgcgccccgagggcgacgacgaggaaaagtgcctgtgcgacggggacaagtgcgtgctccacctgaccagggttaaacatatcggtttagccgatttgatcggtgctcacaaaaatgctgaaatttaaaacaaaatttagttgaatttgaaataatattaccaaaattcaaacaaaaaaaatatggccaaaataatatcgtaacggagggatccgaaatgaccgaaatttctaaaattttgttctggaatttgcaatcctacgcctgaccacgttgcaggtggcgtacgacggcgacggcgagctcaccgccactgatcgccggctcgctggctgctacaaattctccaagtatgagatgaactcccatacgagcgttctggatataacggacagctacgagcctacgacagttcactaaagaatttagtagctcatggtgaatctgagggttcaaaattccgaaacgaaatttcggtctattggatccctgatatgatattataatggacaaaaaaatattttttttaatttggcgatatttattcaaatttaactaatttttttataaaaaatcaaacaatttctgatcaaaatttttgaaatttcacgatatcggcacccacaatacatatgccgaaaaccagagattgaaccctaatggccatacgtgtatgccttatttgaagagtcattttagtgtcaattaatttgtagcagtgatccagtcaaaaggaacaaaaatttgcatagaaaaacaccattatggatccttattcctcagatcaaaattgctctcaggggcccaccattttagcaccctgctgcctgctggacctaggccacccaggctaatgttgcttgagttgcttgcttcctcgttagcttccctggagtttgtgtttttcctcagtagctctcttcgtcttcgcacgcagccacgcaccgtgtgtattcgttcctctttttttttttagccggcagctggctggttgtaaactagtactccctctgtttcaaaatgtttgacaccgttgactttttagcacatatttgaccattcgtcttgttaaaaaaaatggtacatgaaagtatatatttaacaatgaatcaaatgatatgaaaagaataaataattacttaaattttttgaataagacgaatcgtcaaacacgtactaaaaagttaacggtgtcaaacattttgaaacagagggagtatttgcttccttctaatatgtcgacacgcaagctttttgcacgttaaaaaaatcaaagttactctagaacaattaatttatatttcatcatttgttactaatatttattgacaaaacaatgagtgccagcctcctaccatttaggtgattcctaaacgcattctacagctctttccggctcctctccactgaattgccccctattgtccttctaggttcccacatgcctctctttcatcgaatggcatagccaggaatatagaggccctagcaatagatgggtgcatatgtctctcctttgtttagtggcaaagcctacgcatagagcccccgactagagagggacacctagagagggagtactccttccgtcccaaatataacaaattttggtcggatgtgacatattctagtattacaaatctagacatgacgcatatccagattcgtagtactaggaattgttacctccaatcaaaatcccttatattttagaacggggaaagtataacggaaggtgatacctgctcatatatgttagtgcctcaaagacaccttatcattatgacaaaggacgtgctcctacaagcacaaccaaaacccataaaagctagccgccaaaagcgaattcctattggttatcaatacttttcactgcaattgtaatgcataaccatttgggtggccaaattctttaaacgaatgaaggaaattttataaattttaggctcctaaaataactttgagcgtaccgtggccatggcactaaagttaaaagtaagttgtagatgtgaaataaaatcttaattataaagatttgatttgaaggataaaagtaaaccataaatagacaaagaatcccccggagatcaaaatacatagaagaactgatctccaaaaataagaaaattgagattatgccaacgtaaaaaataggctttgccaaaatgccatcctgcaaataggattggataaaatgttgtgaacagggtgatttcaccaccattccaccatttcatacaaattaataaaatgattttgctttttttttacatgagaactgacaaaagtgcccctctctccctatctattgtttactctcattgtggccgagaaataagctagactattgacgccacgtagcagcgccaatgctgagtcgccgccaccactcagcaactagctcgtgcagaatgtagacgagcacatcatcctgcagtaggttgagcttgtcaatccgtcactcctcggcttcttccatatgaggcttaaaatcatcagatgacaagtctgataaggagctagggttagggtttgcgactacaaattaagtagtgtcagcattaaggttgttggggttaccggtacggtggtggtgaagctgaaggagaatgtgatcaacggtcacgtccgatgagcttgttggtacaaggcagaggtacgcggttcctagcttcactacgtacaaggtcttgcggtctcagttgatgtcattgcgtcacaaacctagaaaatgatctgcttggaggtcccataaaaaaattgaccatgatgaaggggcaataggaatgggacggcccacgtttatgtggcatcctcacaagatttccacatgtttgaccttgatgacaatgatataagcccatggcngtagctcatgcctcccttcccgaagctcatactcaagctctgcgggagcttagacctagttgaaaaaccattttaattggaaagaaatggctttctagcgtagatgtctagccgtttaggttgttaatactaacattttatccaactctatttatggaatgatatttacgtgaaactcaatttttctaggcaaaatttgccacagggcatccaaaaaaccctgtaattagctggtggacaccacaaaaacacgaaattgctgtcgggcaaaaaaaactggtaattagctctcggacacttatggccttattttattattttcggggaaaacggagagagaaactgaggtgagagtacgattctgcccctgtgctacttcgctgaagctggtcgtcacaatccatcgccgccctcaccgaagctggtcggcagtccctccgtggcggcggaggtggcagcaccgaggccgtgagcgcgaggatggtgtggcggtgagcggcgccgcgggtgggaaggccttggtggcggcgcaccggaaggcctgcggagctcgtcggcgaggtgcggcatctccctctctttctccagctcctcctgcgcccctctgggcctcccgcctcacctcctcctcgcctcccctgacgtcgtccacgccgcaggcgaggccgcccctgacgagcttgtcgcagaccttctccagccgctccctcgacctcctctccctctccagctccctccgggacgccgccagctccctctccgcgtcggccagcgccttcccgagcttggcgttcaccctctcggcgcgtcgcctcgacctctgctcaccgtcgagctccgccgccgccacgcgcaccatcgccgcgaccttctccctctgctggctcctccactcccgcgcctcctcgacgagctgcgtcctcatccgtgccgtctcgtcgccgtgccgccggtcctccgtggcgaggtgccgtacgtgagcgcgtgccaggtcgagctcggcgcacagcgcggagagcagcgacgccgtcgacgggtttaggccatcgtcagggccccagatgccgacaagagccttgacgagctccttggacgtggcaaggctgctgcatatctccttcagttgcggcacatctccttggacatgtaatctaaacggcggcggcgacaggcgctgcactcgctggcgtgcggcgcggtgaggaagcacaggctggaagaggacaagaaaagaaaataggggagaggctgacatccttgaccacatagggcaatctagtctttttcgattgtttctctctccattttctccgaaaataataaaataaggccgcgagtgtccgatagctaattaccagtttttttcgtgcctgacagcaaattcgtgtttttccggtgtccactagctaattacaagtttttttggatgccccgtagcaaattttgccattttttatgtggcgtaattctaaataggattatcttaaaaaaactgctgcaagttttt

SEQ ID NO: 62603 - DNA, 3941 bp, Oryza sativa
acaatatagttatagtgtagttacgtggtagttataatataactatactatataattgcattgtagttacactataactattactatatttatatttgaaaggttttttttatcaaaaaacttgtgacagttttttaataattccgattctaaatttctccaaaaaatactaaccagctcgcaggagacagagacatgacccatgcgcagaagatctccaattgccaggtcagcctcccacggccccatccaccacgcagcccccaccccgactacgttcctagaccctgtcttccacgtgattcagtgccccacgtcactgatagctgggccccacccaactgtcggtccactgcacccgtggacgggtaacccgcagccttaaatctcggcttgtgtcagagccgctccgaaccccctctctcccatcgccgccgccgccgccgccgacacagccgctgacctcgccgccgccgacgccgatggagatggccgcccccgtctcccccgcgccgcgcaccgtcgaggacatcttcaagaacttttccggccgccgcgccggcctcgtccgcgccctcaccgtcggtaagtaataacgacgaacacctcgcccgcctctctctctatctctcttcggttgtctcctcttctggatctaacgagctcgccgcccgtgcggggggtttttgtttgtgccgcgcagatgtggatgagttctacggattctgcgacccaggtaagaccgaaccggatcggatctgatgagggtagagagagttcgggtggtggttttgtgtgtggggtttgatttggggttttggggatgtgagcagagaaggagaatttgtgcctgtacgggcacccgaacgggcggtgggaggtggcgctgccggcggaggaggtgccgccggagctgccggagccggcgctcgggatcaacttcgccagggacgggatgcaccgccgcgactggctctcgctcgtcgccgtccactccgactcgtggctgctctccgtcgccttcttcttcggcgcgcgcctcaacggcaacgagaggtaccagccacacgcttttcctccattagatctcgtgaaaattgaccatctatgaagaagaaaagatcacttacttggagcgtataattcgatgggtgcaagtgcaatcgaactctgttcttgccttgtgggttgtgggtgcagtgtaatgccgttcttgtgcttgccccgtgggggtttatggatttgcatattttatttcagctcaactggtccatgtgtgcgcttgtgctgtgttgcacatgtttattgtgctttatttcaccattcttttttctctttgctgtgaatgggggccatgtttctcactgtgtttgctttattttctctctttcttttcttcgtttgctgaattgattttattttttgccataaaattgcaaaacagtgctgtgtgtacttggtgatgattattactcctaccagtagtaattgcctttgaaataagttcccgggctgtctgaaaatttgatctttcacttggaacatgttttgacagatttcttttcagttttcacatccttgtcagaagttggggggctgacggtgataggctctgtgtacttcacagtacattgaaactttgaaaggtctcagtgtctgcacaaatttttgtttcgtgttacaattcgagtgttgtgctatatggatgacctttcatcataatgctttttagtcatttgggttttggataccttaattcatgtttttcaagagtacctattttatggaccatggcagtaaaagtgttcgcaaattaggatacaactaataaacaatcaaatgggcaagtaccattcttattcaacttaacatgccataaattgaattctttctttctattgagcttcagttgtgtttgctctgttccttcgttcttccttaagaaactttgggattacaatttgctttgtgtccttaattttcaagttctgcaaatactcgttgaatatttttctcgctacattttaattcctaaaatgcaatgtgtcatatggagtcttttgatggataaccaaagggtagatgaagttttatgtgcctaaattattagtactgttaggttgaatcattaattggcctctggtccttttttaatgttttatgcaggaagttttgtgttttttgctttggtctacttgagtacttgactgccatgcaaaccataagtcgtaattctgtgatattgcaatttttttcttagcaaaagttatcttgtttattctgtttttcagtttgattttttttttggttcagttaatcttgctagtttcctggttgaactttgcatttctattccagccatttttctcttctcttttctccctgagatgaggctttgacgctttgtgagcttaagtttctatcattttggcatagtaattctgcctgctttcattgtactctagtatctattttcctgcacactttccacttctatttgaatttatttttcttctgtttcatcttactatctgttactgtatcagggcagtagagtgctaaactgtgaagtgctgccatctgttctttcatgtgcttcgtttgtgttgcacaaggagctaaatcagtcacaaaatttgtattatcattatgtaatgggaagcattatctgttccttatctgtttgtttatgttgctttcatgtttgtttatagtgtttcgttgcttatctgttgtctttcgaaggattcatattgtacgctggattattttttaactcccaaggaaatattgggtcatgcctcacaagtgttttctttctttatgtacaaattctattttatttgttgcattacttcatggatatcttgtttccatatttttgtctatcctgcccagggctaacctgttgaaacataaaacttgtgccatgtgtattggtgtcttggattcatattctgatttgaacatccctttgcatcaaccattatctctgttaagaacccaaagtatcatatcatggttaacaaaatccttttcctggatccaatgtgttgctctcttgattgtcaggaagcgcttattcagcttgatcaatgaccatccaaccgtgcttgaagcactgtctgataggaagcatggaagggataataaatctggtgccgacaatggcagcaaatccaggcactcaggaaaggtgccgtaccagtgctcttagtttttattttcatcatgaaccatttctgaactgtgcccatttgagtttttacgaactgaaagctggctttgttatgcagcgagcaaatgacgtgcagacaaaaacctcgaggccagcagttgttgacgatgggtacgatgaagaagaacacagtgaaaccctatgtggaacctgcggtggccgctacaacgccaacgagttttggattgggtgcgacatttgcgagcggtggttccacggcaaatgcgttaggataacaccagcgaaagcggaacacataaagcactacaagtgccctgattgcagcagctccaagaagagtaggcaataaaaaccatggagctgctgctgtggctctctactgctgactaagctgatcaatcaaatgatacttgccatccctcttccagtcccaagttggcggcagatgtgaagaatttgctctagaacattgcgcactgttgtggtagatgctggaaaacaaaaaagaagaaactttacaggatagtttgtttcataaactggtcggttactgttgtggttgttcatttgagatatggatactgttacattgtagcctttagaggaaatttgttcatgccttgtttctaatttggtatgtccttcccttgctgcatgacattgatttctctctacaagtttctgtctgtcactgtgcatatatactgtggtttgtctcggtgtgtactgtggacagtcctgt

SEQ ID NO: 62604 - DNA, 1761 bp, Oryza sativa
atctttcccaaaaatttgttttggttttctaaactgaaaatatgaagcaaaataacttattaaaagcctaaattttatcctcaaaaattaaaagtggaccattatgttaaactaccaacatgatttccgttttcctccgtcagcgcactacctcctagcactccccctaagggcatctacaatcactaactgagggtactctaggtgtactcacatctacaatgcaggccatgtctggtagcccaatgagtgtcccaacccaaaatagcccatttctctcatcctcctctctttcctattctacccctctcttccctctctctctctccctccgcacgaccgcatgcgcattcctctctccctccacccgttgttccactcacagcctgcttccctctctcccgccgctgctcccgccgccgcctgccacctccgctcgtctccctctccctttctctctctctctctctctcactaccaccaccgtctcccgccgccgcccccgaatcgagctcatgggacggaggcggcagtcatcatcgtcatcgtctggtagctggagcagcagatccggggcggaggcgaccgacggcgagcggcgcacggggcggaggtggcagtcgtcatcgtccggtggccggaggcggcagatctggccgctctctccctctctctctctcccgtggaaggtggcggcggcgaccccggaggcggcagatccggcgccgccgtggccggatctggccccccggcggatggagtggcgccggccgcgccgcatcgagacggtggtggtgccggtggtggccgcatcgacgatggcaccgtcattcttcaccgcactcgccgacgccgccccctcctcaccctcccttcttctctctgacagcgagcagccgcatcgagcagacggtggtggcatcagcggtggctgcatcgatgatggcgccgtcgccttcttcaccgcgctcgccacctcgctcctcgccctcccttcttctctccggcggcaagcggcaccttcgcctcgcccttgacgcgcgggccggtgacataggggagaagggtggaagaggaaatcaaagctctggggtgcgtcgcctcaagaacctacctacgcaatgggtttcttcgccccgtccccctggaaaaagcgagcgagcgacgcgtcccccagctagggcgcgcgtttcatcccaggggacgacgcagacgaaaagcctaatggacagcgctagggagacggaccgaagcactacattggtgattgcctaaagccgcgccgatctcccacgtgcgggaaaagcgctcccccctaaagccatgccgttcgcccacacgtgggaaggagaggaggaagtacaaggtgggagcgacgatattgggagtgggcaagggcgccgttttctctgacatatcaacataactccaaaaatcatgtaggggagtaggggatctgttggagtgctttttttttcactaaaatacctgaaaattggttttggagatgaaataggaggaccattagtgatgctgtaagaactttaaaaaaattacgatggtcaaggaaaatatagtttatcttaaatatagtttatcttatggcaataaaatatttaaattaagttgagttgtctctacgtatagcttaaaatgatactccctccattcttaaatatttgacgtcgttgacttttttaaacatgtttgaccgttcatcttattcaaaaaaacttatgtgaatattattcaaaaacttga

SEQ ID NO: 62605 - DNA, 5129 bp, Oryza sativa
ataaacagtgtttaaaaaactttctatacattaatttctaagaatattgttttaaatctattttctatcttcataacgtttaattcatttatatcctcaaataattataataaatcattcgactattcggtcattcagcataaaagaatagagccgtggacatgcgaacccacatgctgacatgcatgaacaataatctttcatcaatttgtgttatttgcgaaatcaattaaattttatccataagatgactagtggcagctgtagatacgtggtatggtctactctcttgcagattgcgaatagtttatcattaggtattaagcttaataaagggctgtttagattatagccaaaataaagtttaccaaattttgtcattaccaaaagtttgataatattactaagttttggcaggatttcttacgtgtttaccaaagtttggtaaaaaaaataaatagttgcatatttttggtaactttattacaaattgatatagttaatctgaacaacctctaagtcaatgcttgcttcacgtgttttacctgcaagttcacacacacacacaaaatgcatatttgtatctcaagttcagtaggcatgcaagtcaaaactgaatccctccatggtttaaactttaaaatggcatttataattttactgctgtaggttggcatttgttatttgcaatcgctttcatacggtcagagatgcttgtcatattctaccctttggcctccatctgtttctcgttttgctttcgttacggataatatgggaatattttagaggacaaagtggccatccggtgagccaagtttcataattgtttaacccgttttatggtgtggagtgtacccttagcattgcgacatgaatggctgaaaaatcatagttagatttttctaaaatgcagtttagtcatattttaagcaaacagccaacagaaaagacatgtgaaaatggaaattttaatatccactcttcgaaaaataacatgtaaatagcatgggggttgagctgtcaacagcagagagagcactcccctgttacacccataaaaaattctatgaaaaaaagtaaatattattgttacatccgtcccataataattataactgtaagattcaaattaattctaaaatagttattacaatagagtagtaattatcccatcaatcactctcattcaaaattttcactattttaccatcattcatcctcccagtcctacctatatatattattaaaccttaatatatattaaacaacctagaattaaaattattttgggatggagataatattatacgcgtgtaaaacctcaaatttaaatttaacaattttaagagtataaatctatcataattttatcttttttctttctattacgataaatttcaagatgagacttagatgcatgttacttgtaaaaacaaatataatttttattgatatctgttaattggtgtaaagtttgtgcattcatgatacattccaattttgtaaaagcttactattttactcatgaactttaagcagcatatatgaagggtgtgtttagttcacgttaaaattagaagtttggttgaaattggaacaatgtgacagaaaagttaaaagtttgtgtgtttaggaaagttttgatgtgataaaaaagttggaagtttgttgaaaaaagtttggaactaaactcagccgaattttagggaacatttggtttggtatgaactttggaattcatgatccgacccgtttgttgccaattcaggtgaccaaatttcagtacgccaaccatttgcagttgtttttgacgaacctaacttcaaacaaatgcaatttggagcaacaatactattattatagccactatcagagcaaaaacaactactaccttagatgaggaattaataaataatccaaactggtcccctactgctaggttgctgattaagatgagtgattaagcatcaattaaatcaagacgactagctccccactcactgccaggtgggcccaccttgtcggattagaggaaagtccctcactgccatacacaaccattgccggattagctgtccatcgattacaaaaatcccaaatcttttggcgccgccgtcgctgtcgccgacgacaccaccgccgccgccgtcctcgtcatctccagatcgccctctccttgatccccacttgcatcgccccggaggcgcggtggacgagacgacggcgatggccggaaaggatgaggcggaagggctcgaggcgaggctgctgctgctgccgcctgaggcggcggcggaggagccgacgaggtgtggcggcggcgacggcggcggcggcgggaggaagcggaagaagacgtaccttgatgtccttggcgtgtgctgctccgcggaggtcgcgctggtggagcggctgctcgcgccgctcgacggcgtccgcgtggtgtccgtcgtcgtggcgtcccgcaccgtcgtcgtcgagcacgaccccgccgccgccccggagtccgccatcggtaagccaccgcgcgcgcgcgcgccattaatcctccacgcgattctcgcgcgagattctcactgaatcgagtcgtcgtcgtcgtctttgtcttggagtgcagtgaaggcgctgaacaaggccggcctcgaggcgtcggtgcgagcctacggcagcagcggcgtggtcagccggtggccgagcccgtacatcgtcgcctccggcgtcctcctcacggcgtccttcttcgagtggctcttccctcccctgcagtgcctggccgtggcggccgtcgtcgccggcgcgccgccgatggtgcgccgtgggttcgccgcggcgagccggctgtcgctcgacatcaacgtcctcatgctcatcgccgtcgccggcgcgctctgcctcggcgactacacggaggccggcgccatcgtcttcctcttcaccaccgcagaatggctcgagacgctggcctgcacaaaggtaggagtacatgtcaatgtcctcttcaccaaatccatggcgatcttggcacgaacccggacgaacactcacgttgcgaggtgtgcaggcgagcgccgggatgtcgtcgttgatgggcatgctgccggtgaaggcggtcatcgcgacgacgggcgaggttgtcagcgtgcgcgacgtccgcgtgggcgacgtcgtcgcggtcagggccggcgagatcgtccccgtcgacggcgtggtggtcgacggccagagcgaggtcgacgagaggagcctcaccggcgagtccttcccggtgccgaagcagccgcactccgaggtctgggccggcacaatgaactttgacggtaaacaaacaaacaatcaaaaaaatctctcatctcttagtttcagagttcccaaatgtacggaactctgaaacgtccgtgtcgttgaattgtccgtcttttctcatcagcttaagttctggtaaactgattgacgcatccaactcaatagtcacaatagcacacatttgttcatgtcatgatcaatgggattgagaggctgtcacgtttcaggttacattgctgtgagaactacggctctcgccgagaactcgacggtggcgaagatggagaggctggtggaggcggcgcagaacagcaggtcgaagacgcagcggctgatcgattcgtgcgcaaagtactacacgccgggtgcgcaatcggcatcgcctaaactctcaacatctccaattttacaacacaaaattcatcagtaacaaagacatttctgttcttggtgcgttgcagccgtggtggttgttgcagcaggagtggccctgatcccggctctgctcggagcagatggccttgagcaatggtggaagctggctctggtgatgcttgtgagcgcgtgcccctgcgcattagtgctgtcgacaccggtggcatccttctgcgcaatgctgcgcgctgcgaggatggggatcttcatcaagggtggagatgttcttgaatcacttggggagatcagggccgtcgcgttcgacaagaccgggacgatcaccagaggagagttcagcatcgactcgttccatctggttggggatcacaaggttgagatggatcatcttctttactggtaagactgagaaagaagatttcatttcagctcttggaatgcagctgctacactgaacaaatttgacagattttcaactgttgtcggtttacgacttgtcgaaaaatccttagtacttgtgatggtttgaattgacttgaacagtgaaatgcttggcacaaattatgtctttggttattgcaggattgcaagcattgagagcaagtcaagccacccaatggcagctgcacttgtggagtatgctcaatccaaatccatccaaccaaacccggaaaatgtgggcgattttcggatatatcccggggaggggatctatggagagatccatggaaagcacatctacattgggaacagaaggacattggcaagagcgtcatcacctcagtcaagtgagcaaaacacatcatttgtagtagtagtacagttcctgacaattaagcttcagaattagctgatcagctgaagctgagctgactgaactgaaatctgtgacgtttacagctcaagaaatgggtgagatgatcaagggcgtgtcgatcggctacgtgatctgcgacggcgagctcgccggcgtcttctcgctctccgacgactgccggaccggcgcggcggaggcgatccgggagcttggatcgctgggcatcaagtcggttatgctgaccggggacagcagcgcggcggcgacgcacgcgcagggccagctcggcggcgtcatggaggagctccactccgagctcctcccggaggacaaggtccggctcgtcagcggcctcaaggcgaggttcggcccgacgatgatggtcggggacgggatgaacgacgcggcggcgctggcggcggcggacgtgggcgtgtccatgggcatctccgggtcggcggcggcgatggagaccagccacgcgacgctcatgtcgagcgacgtgctcagggtccccgaggccgtcaggctcggccggtgcgcccgccggaccatcgccgtcaacgtggccggctcggtggccgtgaaggccgccgtgctcgcgctggccgcg

SEQ ID NO: 62606 - DNA, 786 bp, Oryza sativa
tatcggttccgtcatttagtccgcggcaactggagagaaagacttaggcggaagtttaaatttcctgtgagtacacatgctctacatttatatttctccgattaaaatacatacaagtgtatattaattagatctctcgtcgtttgtcttttatttatagtgcgcaaagcaaaagcagggaactaacttgtgcggctactacgtgtgcgagtattgccactgccttgcagaccaaatcatcaccacaagagagctcgatgtacgtacaaataaattcaaaatttcattacgtatcgatttgttgtttaattactaatcaatttcatacattcatatagtttattcgcatgagggataacctgatcacacacaaggaatttatcgcggtggttcaagaacaactcatgggattcatcaacgaacaaatccttaatcccaagggtgaattctactaggacggaaacacaattcataggttcttagcttttgagctagcgactactactacgtcgaaatcgtagctagctagaacatataatggattgtaattaatacatgactatgtttttatatgcatgtatacacattttctataatgtaaatatatattttggtcatatatatatatatatatatatgcatttgcataacatatatattatacatctacatatgtattgaaacatatataaatataatataatatatatatatatgcatggtttatatatatatatatatatatatatatatatatatatatatatatatatatatatatatata

SEQ ID NO: 62607 - DNA, 1420 bp, Oryza sativa
ttggtggcatcggaggaggaggcgtagccccgtgagccaatcaggcggaggaggcgaagaaccgccttgtcgtcgtcggtcgcgtcgtggccacggcgccggagatgggagaggagagtgcggcgaggctggagaagaatcggccgccacattttgtctctgcggacgctagctttagggttacgtacgttggttcagctgcacctgcacgacaccattggatggatccatccttgttttgtatatgggccatcgataccatctcgatccgttcttcctgggaaaaagtacaccgaaggtctctcaacttatcatcgagttacaaaatcgtcccccaaccgcaaaaccggatacaacgcatccccaaatttacaaaaccggtgcaaactagatgcctcggcggttttgacccggatttgcctgacgtggcggctgagtcagcgtgggacccacgtgggccccatatgtcaggatacacgtcggcagccaacctcttacttcctctcctgaccgggcgcatggtcggaccggcacagtgggtcccatatataagtgaatcaaaggtaaatgggtggatttaacagagaaactaggcatggtggggcccgcatgtttgtgagacattagagtgagattagggaaggattactgtgcggggtcggcatcctggcggcggcgctcgccccggcgcgccagcggcggagagcgggggaggagcggcggcctgggaagggtgtcgccgcggggccggcgatggacggcgcggtgcaggacggcaaccagcgtcgcaacggcggagggcgacggagcagagggggcgcgggaaggagtcgacgcggagtcggcagtccgcgtccgcgaggaggagcgcgtggaggccgccgtcgcgtcgcccggcccggcgccgccgcgtcgctacgccaccccgccgcccgtccccggcctccctttcctgcctcgccccaccggccggcccgcacgaggggggcggggaggccagtgagctcgcgccgccacctcgcgccgtgggcgccctagcgtcggcatccccatgccccgtgcgagagaagagagcaaatgagcactgcgacttgactgcgatagatatgcattaatcgatctatgcatgcatatgcgacttgacttcgagagaggcattcagaattaatctgtttagcactcatatatagatatgtgaagtaaaccaaacacacaacacaccaattacttgatgatgtttgattaagctattgctgatatactacacacaactgctagagaaagagaaatatatatggccctggcacttgaacctctaaaatttacctgtataaacgtagttatagcttggatcgatcttgcattatattggctcaccttttgttaataattaattagctcaagctggctggggtgcagg

SEQ ID NO: 62608 - DNA, 3887 bp, Oryza sativa
aacggttttgtaagttgagggatgtcatatgtctggttttgtggttgggggacgattttgtaactccacgacaagttgagggaccttcggtgtactttttccttcttcctgggcagcgtcggccattccactcaggcacaaccgcacaagccggcccagttgttcattaatcccttatgtttgctaatttgtttagagtagtataaaagttgttaaggaacatagaaaataacatcgccacgttgaaaaaaaaagaattggggactttagagcttaattttaaattaaattatattttttatcattttatatttgacgtaaaatatttcaatattgtatcattactattactatgtaataactctatccttttagaaaaagagagcagctcggaaatgataccccgttcggacgggatacttaagtaatgacgtcatattcatgttaaaattgacgtcaccttatacttacgtggtactccctaacgttttaacttttcaaatttgactaagttacaaatataataatatttataatgctaaattagttttatcaaatcaataattgaatatattttcataataaatttctcttgggttcaaaatgttactactttttcccataaacttggtcaaacttaaaacaatttgactttgaccaaagtcaaaatgtcttgtaacctgaaacggagggaatatcatgtatgatatttattggtacaaaacatgatacccgagtatcaggtctaatatactatatctatcacgtcaatgatgatgtcaatgtatacgtatgtcggtatgtggtaccatgtagtatacttaatagtaccaaacataatacgtgagcaccaagtcttgtacctataaggacccagtacaagacatatatgtaccagccgtagtacatgagtaccatgtctgatacctataggtaccaaaatatcatgatgccactaaagtatcatcgcaataagaacaaaaaaatcatatatttatcaagagagaggtcaataaaaaccgacaaaataaatcaattatagaaaaaagttgccatagctataaaaacacccatagaatatgtaaaaagccccaaatcaaacaccaaaacaaagccaacatgagtgctttggggtcatgagcccaaatctgtcatacggatccacacctcgagaggccttgtccttcatgtcagtgatctcgtcgacgatggccacctcctagaatgtggtgagtagcttcgcctccatcatttgcttggccgggcacctaccccacaaacagtttcacgatttcctcctttacacccatgcctccaccaccagcagcgacggcggtgacggtagctttctccacgcccaacacacctccctgcatggccagccactaccattgcctccgtgcacatgatagttgaagagagagagaggaggaggaaaggggaagagataacatagaggataagattgaataggtggtgtgaggataacataggccggataagattgaatagatatttacgagtattggtagttattctgtatttacaggactccgttccttagatttcctgttaagaaaacttgcatcatcagccgttcataaattctactgtatatttggttttatatataagagggaaatacatgtgggacccacatgtcatagttttaagagttaacattccattattcacattcaaagtacatatgcttttcgaagaaagtcacccaccgttaggaatcgacttaaacatagtaagaaaataaatttagaggaggaagactaaaatacctatatgggattgaaatctctgggcgctcgctgtcttgacttcaaccagaacactcaaagcatgtacgctagggagggttcgaataatggcggcggcggcggcagaggcgtacgtgcggcagctgccagcacaggtgcagagggaagcgtacgagtggcgaggagattgctctcgatcggcggaggaaggcctgcagcgaggagccgatcgaggagagagctagctaggcattcggcacagggctcggagggatgtacgtgtgggtgctcaccgtcgtcggccgggtgcagagggtggtgcaaaagctcaccgatgctacgcgcgtagggaggcgccacaagcacacctttggcgcagacaaatccagccgccagatccgacggctgcgacaccggccgttgaggcaacgagaagctctaggtctgatgcagatgtcatcggtttagaatacaaaatacaaatcaacttgtagatattatttcatatgtatcgagggtattcatctaatatatggaccaaagagggactacttcttctggatccaaaattaataaaataaacaaatcattttttttcaattttaaaataaggaatagatcatgtatacatctaaacaaccctttcataaatccaagcaaacttttcgtaaatctaagcaaccttttcgcaaacccaaacaaccttttcgtaggcgtcctcggattggcccgggggatcaaattaattataaaaacatgagtttaattaatcgatttattgaacaaggaaaaatattatcgagacgaataaatagattaatcttgaaacaacaacaattaattactcttgctataaaacaggctcgtattttatctttcgtactatttcgtaactagtttcaataattacaggtcctagacctagaaaaaatagacatattcctcaattaacacaaaagttcaattccaatggaaacttaagaaactctaactagactttaagaaacaacaatcggtacttaagttccgattgttgttgttttattcgaaagggccagagtatatataaagaaagtaatccaatttagattcttgggcttgttataagaaagaacaatagggaagaaaaaatagtttttttttatttattgcaacatgctggttgattcctaccacttaatcttaatttattgtatcttcccggagtaactctccgggaattcttttttaattattcttgtatattactttttttatctctttaattaataatctttattttattgaaatcgtgtaaagcttatttggatttaatatagcttacttgtgtaaggattttacgattaagaatccattctttcttgtaactcaacggtgctttgcacagaggattataaagtgctaattactgtccaagttgataaacatatccttatgtttgtatttgaataggatctgttagagtgtgcagcccggcccaccctccgtgggccacccaggtttacacattggacctgctccaccacatgtccaaccggagccacaactttagttcctaggcctacacaaccaaaaaacctagtctgatgggtgaggactgcccccacattttaagtcgtgctccacacaacccaaaagactagtctgatgggtgaagactgcccccaccttttaagtcgtgcccccaccatcaattaccgatgtgggactaaacacaacaatctcctccgtcacattaacccatgtgaccccgaagacttgttacctggcctccccaccatgtaacccgtggaaattgttctgggtttcatacctgggctttgataccacttgttagagtgcgcagcccgacccactctccgtaggccacccaggtcatattgggcctgctccaccatgggtccaaccggagccacaactttaggttctaggcctacacaacctaaaagactagtctgatgggtgaggactgcccccatcttttaagttatgctcccctatcatcaattactgatgtggtactaaacccaacaagatcaaatgagtaaactttaaaaagtcaatgtttgtctcaacaatgcaatagaccctctcgctaaatgggttctatatata

SEQ ID NO: 62609 - DNA, 2057 bp, Oryza sativa
tgtgtcctattctgattgggtgtggttggtttgattttctgttaagcaagctccaaatgatttttttctcctaaaccgtttatctaatttatgatttgattacaccattatatttgttacaattgaatctttaaaacaagatctcggatgattatattttgataaaaaaaaatatatatgactgttaacaaccaaatttggtaatatctgtgtcaggaaagaggatctgatcaaagtggagtcggaggtggagatcgagtttggaagcagagcaggaattggctggaatccagatcggctacagttaggatcggctggatctaagtcgggctaaataagccgatataggcgattccgacaatacaacttgtacgcgacatcgggttcaagttaatgtatttcaaggtgattgccacgcacagatagagtcctaggaaggtaattgtatctattaattagtatatcttatgtaaattccttatagataaatgtgggcaaaagtctgccgcaaagacttatagtatcttagagtttgttatagataatggtcgtgtccggtatgggcatatcttgtaattctcgggtataaatagaccccgagccctatgtaattttttaacacacacgttcaatacaatctcggcgcatcgccacccttttttgctttagttttgttttgacgaattcttgctttcgggttgagctgcatcgatttcgatcttcaacaagaggtaaaattcgttatgacggattgcgttcttaggattagtgcttccatctttatgacactctaatcttgtttatgtaattcgtcgagttatcatatgtcttacataatctctagcaatatcgccatctaatctactatcggccaatatctgtatgcagaagacagctgattaggttagatcttgacgttgatctagattatataacatatctaccattctatgaaacttctagcggcttgattgtctaaatatcactcttcttttcatacttaatacttcatcagttgagtttgatctattaagtcgtgcttagaatatcgatctctagcctgccttctagttgccgattagaatagcattggagtttcagccgatcgtatctgatttaactatatttgttttatatgctttactgatatgttaaatctgccctttatatcaagatattgttgtatctaagtatgttaggcctttgattgatatattatacctactttaatatcctgatatagagttgtatcggagtattagccgatacatgctagatctatctgatcagctacgctacaaacatatatagtcttgttattgatatatatttcgatctaggtgatttatattgtctcggtatggtgaccgatctatcccaatcatttgatttaagtatatatcaacataaggagtatatatcgttaatatctacagccgatcaagtagatttagttcttcttcacttattcatgactgccgatcgatacacggatgacatcggcccaaagataaatgatatgtcatcggcatatagccgatcggctatcatttatagatttaaccacggtttctttgcttctatttcttgttgattacaggatcaaatcaactggcacgctaatacatccgaaggcaagcttttgacctgcactggagttaagcagatctcccaggccacgtgttttctgtcaacacgcttttggcacgcctggtgggacctgattagaagtcagacgtcagttcttcctcatggccgataaacagccaccaccaccatcaagcccaggttccattaaaggcaaggcattgaagctgggattgactgacatcattgatgacaacgtcatgccaatcgatccagagaaattcacgcctgagcagaagcaggagtttgaagcaacgctgcagcaagcacgagatcagttcctgaactcgttcatgcaaactcgcaaggggacacttgttcagaagtataaaataaaagtggttgctaataatcctgggaccggttcttctaaagatggagaggttaaacaagctccaggcggctcggct

SEQ ID NO: 62610 - DNA, 728 bp, Oryza sativa
cctgcagcccgccttgttgtgttaaacaaaaagtgataaactttcatttggtgttaatgcaaaattcagctgctcctaccacttcaggattatcatacaaaatataaaatctaaagcaaaagtgggaaattagtgcgacatgtatcacttcagctgtgcatgttcgactctgtgttatgaacaacgtttgtaaaaactacagaaaaacaccccacctcccattcctttttaaataaaaaatgcttgaaatgatcacaaaatctaaaaaaagcaaatgtaaaaaagcaaccattataatgttgttttgtgacacttactttttatattgttgcgtctcaccaatgctgagtatgttgttgtagtgattgagttcagctgccgagatggtttggtgccgtgtgtagttgtcatatggtgagctcttgtatttacttggatgtacaattcttttagggcgataaagattgtgtctggtaccagaacagttgccagaagcatttagtgagtcgatgattcttgtcattgaatattgtctttcttctgtttgagcatgttgatttggttccctcatttatgttattcttggagaattcatacctatattaagtgatgattgtgaactctgcattaaaaataaaacaagtgaaaaatgggaaaaaagagaatttattgtaataatgtttaagagtataagacatagttttatgtcatgctgattgaaaaaaata

SEQ ID NO: 62611 - DNA, 768 bp, Oryza sativa
ttcctgcagccccacgcagcggcacaaatcagatgagggcaagctcgcaatagtcgatcaagacgtgtagtcaagctctttgtcagggcaaatctacttagagcaatggcctcaacaatagagaatctgctcgagggcgcggtggtatctatggaggatctgcccggacaatcagatgactcaccacctcatcacattgtttatgcccctatcttcttttctccgccaatcatagttagaggcaaacaggagccaaggctattggtctagttgctctccaaaagttcagtggatacgtatagagagcacaaataataggaaaaggaaaacgagagaagatagagaagagaaaagaaaagaatgcaatttgtacctgtatctcgcttaggctgggggcactttgggtccccgtaactgcccctatagatcaatctctccctgtctttctctcgatagatcacagtcatctctgccagtgtgtgtgtgtagctcggctccttttggagaacagtggtaggtgcctgtgaatggcgagaccggctttcatcactcgagtactagctagctaccccccctatctagcgtcgcatcggctgaccagtgaccaggacgccgtacgccttgctcttgcaggggtttggggtttgggttcccctttctctttgagcagaggcagagtcagactgtctcagagactcagagtctctcagacccagagagagagaggtggtactgtcctacgtacagtattcatgtgagtgatggaga

SEQ ID NO: 62612 - DNA, 1278 bp, Oryza sativa
taaatcgatatgagataactacccatctcgtgggcaaaacggaaggtttccaagacaaacctacaaagaggtgtcgcactctcgcagcagcggcggatggtttacggcgcaaaccgacaaagatggactaaactagggtaaaatagaaaacatagtaaaagaacgattcaaatagattatattcgggggttttacaatgaaccggccttgtcccttaaataggggttggtcttgccctctacaggcccttctccacgtccaactcgggatagaaattaaaggaaactcgaaacatgcctttccgagcaaggaaacccgagacccgacgaaaacatactcggactcggaccctgacggtctgaccgcccacatacctgcggtcagaccggccctactggccggtcagaccgcccacacacctgtggtctgatcggccctgtgaaggaaacccgtcactttctaaactttggcaattttcccctatttcgtccataggtgccaaatttgggtataaacaagttgcatgttgcaaacttgagacgataattatgcaactttttatcaattatggttggagattcacaaatagacttcaataatgtgttctccttattttagattcgttacttattttgttcattgggtgttttcaatgatttgttgaactacattcttgtttaggtgcttctctataataattggctgtaactctcttgagtaaagaccgagatgttatattccattatctaaaaaaaatacaacagccaatccgtctaggcatcgatcgatcgttgatgctgcgcaatgcaactgtaattaaagagcacaaggaaattaaattttccatttaatttggtctatttaggtggttgcaacttgcaacataatgtcatgtgttcatgtatacttgctgatcgatagttgatgcattgatctatgctagctcgatcgttttcccatgctttgctgggagggacgtcgacgggccacgggagcgcacgtacgtgctggttccagcactactaaagtactaactagcgtacgtgtacagcattattgcataatcaagggcatattcagactgtagccaaaataaacctggcaataccaaaattttggcaacatgtcaatattgccaaaattttaccaggatttattagtatggttgaaaatggtatcaaagtgaacatgccctaagatagtaagatgcatgttactccctccgtctctaatatagcaatcaagaatcggacgagatattttataggggctgcagga

SEQ ID NO: 62613 - DNA, 776 bp, Oryza sativa
ccccatgcgcacgatatgttcggtatcttcggtgaagtcagttcacagcggacaaaaaccgatctatacatggacaccgatatacataaaaataaatgcaccaaatccaaaaacgcgaaaactagtaattcggttcgattcggtgttcgttttatttgtgcccatacacccctcaaacattttttaatataaattgtgagcgtgttgggattaaacactagacctcgggggttaaaaccacatacccttgccactgcactatcatgtgaattgattactacttcggtttcaaccgctatggactcatcggaaccaaggccatcaccaccccgcatcgcttgagcgcacagaacccctctacgtggcggtgcatgcaacaagaaaaaaaaaggtgagacgagaaagagaaagaacgagagggatggagaagcgatgagaggagaggagaaacgcccatgcgagacccccaaccctgatagtcgccagcaccgccatctccgccgtcatcgtcatcggccgcctccgcaaatcgaagcttcatcgttcaccatcgctgcctttgcctcgcccttcccccagccggcgatgggtaacgaaggggagagagggagattgctgaaacaagaaatatacttcgcatgtggggcccactcgccacgtcggctaagaacagactctatactggttaggatctcgagtataccagttttgtaagttgagaaactcattatatcttgtattgcagtttcgaggacgaaattcgaactcagcaacga

SEQ ID NO: 62614 - DNA, 948 bp, Oryza sativa
ccggtagaggcgccgctggtttgcggtgctgatcggcgtgggagtacggtgagcagaacgcacgaggaggagaaggtcgagccggtgcgatcgactacttcctctacatcgacgtgcgctacttcgcgagagttccttcgacttctcagcgtcttcttccgctgtgcagcgcgtcgagtggtaacgatctatgatctaatacttgcatggttcctggtttacgcgatagaaaattttgttttatgctatcgtagcctacgcgtatcccaacattattacaatgcaatgaagtgatataatggtactagccacgagattggttgtactgtaattattggtgtttcctgtagctgtatacgatataagagtaacattggcaatgataaattcttgctatatgtattttgtacccttatgagcataatataattagttcaataatctgcaaataatcttagtgtattattttccttatgcgggtataacacatcaccaattattttgtattgcaggccatgaggaggaagaattcacaattgaactgcatcatggtgggtttttttgtggagttggcagtagcagaatttatttggatgagaaggtggactggtttgatcattgcgacactgacacatggtcttccttatggcttgatgattttattgagcaactaggatatgataattctgagaggaaggttaaggtttattggttattgcctgggaaaacatttagtgatgggctaaggagaataaattctgatgcaagcactaacagcatggttgcattagtaccaaggttcagatcattgcttttgtacatacacggatcatcaggatattgtggaatcgattaattgggatgatgtagctctttcagccccaactactttacctattgtggctagtcccagagagtcgcaatgagtcagaaggtttgtgatgatca

SEQ ID NO: 62615 - DNA, 1712 bp, Oryza sativa
  unsure (1)..(1712): unsure at all n locations
cacctcaacttccatcaggacccttatgctgagtatgatttctggataaacagcatgggggtcgatggattgttcactgatttcactggatccctgcaacgttaccaggaactggtagcatccacnatgcgatagtgatgaaactgcataacagtcctcgctagctaaaagattgcgtcagaatggattctcctcatatactgaaaaggatttcatgaatcaatggtttgtccaattttgttcgcgatgtaatcgcatcattgnctgtattattactacgnctatctagctgcattcacatgggatgtaccctctgtaattgcttcacatgtaaccaacaataataaataagtaagaaataatagctctgtctttgctgtgtcggtctagtcatgttagcaaacggtatctgtagcacatcctgctattaacttatagaatctcctgtaattngcgggtgagtaatatttcttacagtttgctaatatattgctctcttaaacacagttgtatctgattagttccttgaaacaaagttcattgatgggtacattgagatggagctgtttggacaagttgtcaggaactcaggatgtgtgcatacctaccagtgcagatgtgaaaagcaacaacaggaagttggaattggtattgagagttgaaatgcaaactggaaatcagtaatgacagtgaacacagctgacctctgctataataaatagtcgtctccggtctgccacttgtgcagtggcggagaccggagtgatcaggcagccgatgtgtggtcggtagtcgcatttcaagtccctttctgttctcactggaagggaaccaagtcttctccttttgataactggtacaactcaccaatctcaatgcagatggtagtgagtaaagaagagccatgaaggataaggcattcagctaaagcttttgaagggaagatttcaggccacacaacttgagcagaggaaggatggaagcggcggcggctgcctccaccggcgaacttttgacaggtaaccgcagctctacccactcctgtcctctgtcaaaagctacgagaatgccatgatgcaacactttgatcttcttcgttgtgacccgggtcagtttgatagtactagattagtagattgtgctgtgagctccagtgttaggtgataagatttctgagaattttttttattagtatcttgaattggtcatctaatcaacttctagagaaggaatatgttcatggcaatagaatattgagttctagggacgacgactttgaaggataacgtgccaagtgcagccaatatttcttttctttctcacaccccctttgaccaggacaatctagctaaacaaaaccaatatgctccagtcctgcagttcaagtagaacatgactgcataaactacatgtcttggaatttggaacagcaaccactaactaaagttcagtcctagagtctttaccaaactactactactactactactactaaaaactcttactgaaaaatatcatgggtacacacctcacggtataatagtaaatactgaaatatcttggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62616 - DNA, 723 bp, Oryza sativa
gactctcccaagatattcctgattgacgatttctcagtgagaacacaagatacaaaccaggtactaatcttgttaataaaatgtttcatatccattgacttctttctttattctggaaaaggttgatatccattggtttcaatgttacaaaaatataatgaatctggctggataatctacatctgaatgcatataacatatgtttttttctgatgcagtcatactgggacatcacttctgatgactacctagcatatattagtaactatgttgttggccttggtccatggaaagatacggttgttccagcagccaaaaactatacgatggcaccgactgatcttgttgcaagagcacatgctcataatcttcaggtatggtatttgtttatattctttacagttacctggaatagcatgtttccatgagctattgcctacttgtgatataatccgtacaagatgcgataagttttatgcattaatttccatacttcagggttcataacaccttcagcatattttatgtttaaatctattacggttgatttgaataacgagaagaatggaaacattatcgtcattgtccactttttggtctcatgtgtcatgcaatgagtattgcacattgagtaactgaatgatttgaacaaaatgcatagcatgtctttaaatttcacatgactctttgtacatcattaaggtgcattaactttctgctgta

SEQ ID NO: 62617 - DNA, 1911 bp, Oryza sativa
tgacttgtcacaaatttatctcataataaatatattttacatgtacggcacctatcgactgtgacatggtagtcacatttttgtgagacttaactttaaactgcagcactggcgtcccattaaacttttgcaaacatgtatgatactgtagctgacaaaaccatcggtaaaaatgctagacgtgggcccgtccatgtctacttaaaaaccatccatgtctacttaaaaaccattggcccctgctatctgtagcctgtaggagtcgtcctgatcagaataaaaaaagaataagtccactttgactctcttaaaaataactcgaatctaatccgtgatcctcaactgtaaaaccggataggatgactccccgaactattcaaactagtgcaatttgactccctcagtggttctggatggcggttttgctgacgtggcgttgacgtggcgatgttgacctgatctgtgttgttgatgtggcacttatatggcactaaaataaaaaattatgtgggctccattcgtcattcacatgaaaatttttgcgaggcccacatgtcatcctctatctatcctccttcctcctctctctctctctcccttctctgtatatttctcttcctccagattcagtgcggaatctggagcggcggcggcggcagggtgagggccggcacgaaggaaggaacttgagcgggtcgagcggcggcttcggcggcgacggccttagctcgccggagaaggcgggggcgtccggtctgttggcctcccccacgatggtgccgcgctaggctggggcgaacgagagggctaatgcagaaggcaaagcctgagacgccgctggccccagccgtgcctcccgctctgcgccggcagggggtgccgcctctgtttctttctacccggagaacatgcatgtgcacagcgttgcctagcagatgcaagtgcagtgccggtgtggggtagcaaggcgcagccgccatggaatccagtcgaattttggcaggaccagcagctgcaggacgaatccgtcctaccagcgtggtctacccgagtcctacagatcttgaggtcgtggactggtctgattttattctttgtggtcactgtttgcaaggtcttgaggtcgtagacaatagctacttcatcaccaaggacaacgtcggcatgctgaagctcgccaaggaggctaacagcatcttggttcgtcgatcagcgcattgactcatgttaccaattcgcctatgaaaattgttaacatctaaccgtgacatcctgtgattaattggtacaagtagtttgactgtcgtatcccgcgccggagacggtgggttgcgcagtggcgcactcaaacggccacaccacggcggccatgtccatgggcgggctgataaacaagatgaccgggcgcatcggcgactcgccgttgatcgggtcgggggaaggcaaggccatcatacgctccacgctggcgcgtgacatcgccgccgtgatggagtacaggggcgccgggctgcaggaggccatcgactactgcgtcaaggaacggctggacgaagggttcatcgggctcatcgcggtgtccggcaccggcgaggtggcgcacgggttcaactgcaccggcatgttcagcgggtgcggctgcaggagaaaagagagagaagggagagaggggggaggaagaagggttggagagagaaaggatgacatgtgggtcacacaatatattttgtgtgtaaatgacagacaggtcccacagaatatttttaattgtaatgccacataagcgccacgtgggatgaagaccaggtcaacaccgccatgtcagtgccacgtcagcaaaaccgccatccaaaaccgttgagggagtcaaattgcactagtttgaatagtttggggagtcatcatatccag

SEQ ID NO: 62618 - DNA, 4050 bp, Oryza sativa
taaaaaattggaccaccatatccctcaaaatatagatggccatatcctatccagccttgaccacgaaccaaacacacccttaagatggttgggaactccttctccttgcacggaaaacggagcggtctattagcgcatgattaattaattattagcttttttttttgaaaaatgaatcaatatgatttttttaaacaacttttgtatagaattttttttaaaaaaaagtaccgtttagcagtttgaaaaatgtgcaatgtgcatgtagaatacgagtacgagggagatgggttgggaacattgagaaaaaaacacagccttgcctgcaggcttcaggttgggcgttccttatttcagtgaggaacaactctcatgaggtgatgtatccaatgtttgtcatgtgcagtgcgtggtatatactagcatgatgaatcgcccattgacctggtcttggcacgacaagccgatgctgcgacgaaagtggaaagaatcatacatgtacaaacaggacaatcacatgcatgtaaaaaagagaacaattatacttccatccatcgagctggctctggctaaagctatagttagctcgccagtttcggcagtgcgggtaagtgttttcattgcttaaagggtattttctaatttcttgtgtaccatttaaacagtaaaataaattttaaaaaaataacaagatacttcctctataaaaaaaaaacttaacctaggacccctcctagtacaatgaattgaactatatttgagatttttgggacggagggagtacattaatatgagatatatcaatccataaacatgcaagttcaaattctagatagattttttttatttgtataaatcaaatttgacattgcatgtttgagagatatatttatattatatatcgttaatttttttttaatttttttataactacttagatgatataaaaaaagagataaaaatccatctcctaatatgttctcttgatgttgatgcactgctaaaaaagacatgtacagatcggtactataggtgtcggaacaggtaaaaccggcacctatagtgttttcccacctacaaagggtaaaaatataaaaagcgacacctttaagcgattataggtgttggttctatagaaaaacgacaccaatattataattgtcgttttttttaaatccgacacctataatttatcataggtgccggttaattaaaaaccgacatataatatatgatagtgcccctaaaaaccaagccgaaccgaccgctcgttcttatcctcccgagcgcccgagtggatcaggagaggaggaccgcgtctctctctctctctctctcctcgcgcatgcctctctctctcgcggcgccctcccctccaccagatctggcgggaggagaggcagccgtagcggcgtgtgacagctgtggcaagtggtggcggaaggggaggtggcagcaagggcgacaccctcccctccgccagatccggcgggaagggaggtggcggcgccctccccaacatcagctcaatattggtgtttttagtgttcttagtgttcttggatgttcttaattagtcgggggtgaaggggagcttatcgatggatcgggtcgaggttttgttttattcatggaaccttaaaggtgccagtttcactagaaccgacacatatttcccctccacatcagtgtcgtcttttaggtgtcgattggaaaatccgatatctttgtagggttctcaaccggtatcaattaaggttttcgtggttgtgatgctttgtagctaccaaagttatgcttttggcgagtctattgagctatgatataatataccaatggcgtacgatcaaatcatgttatcattaagctaggttcttaattacttaaggtctggcttatacggctgcttcgtatgtagattccaaatggagacagggctttcatgctgaattaagaaaggtttcttaagactaactatagattctgttgatttaattaatcttgtctatatatgcagaagatcttttcttagaacttccccataaagccatgacctgttcatacttcatacacatcaacgcgcgcactgtaccacacacgtgcccacaacacaagtgttcccactaccactaacatacactccacccatcccagctaaagccttaaaagcttcatcgtcatcacattcgtcccagtctcgaaaagacgcctccggccgagcccagactccgccggagacggggagccggtgcacctaacaaaagatcgatcggcgcgcgatacccctcctgctacactgtgctacttcgtacgttcgcgcagtaactggtccatgtcgatatcccctgtacgtgctgttaacgttgatcgtttgccgcgaacaccctgccagaatttaggatcttgtcaagctccgatcgagcggccaccgtcgcgtctttgtttgcttttagctacgtctttgtttgtttctagctacggagagtctcggaaaagtgtcttgaagaagatattctcttgtttcttaccatgtctaaaatatttatattttttataaaaataataattaacaatatagattattttaaaaatatcacttcacaaatatgcaaattcaaatttaatttctacgagttatattaaaataaaaaatttaaatttaaatatgcgttaactatttttttaatgagttccttttgttaccatttgtacagtttgaccactcatgtttgtaaagtgttatatatcatattaattaatcttatcaatttttttaaaaaatactaattatttagatggtccaagagaaacgagatgtgtcacatctcttaggatgaaaatccttctccaaatgtatctgagagtttcagtagcctcgccgatcgacttgccacaccgccgtactacatgctttgtcgtctgttcgtggcagtatatatattatccccttgctgtgtccgtcgacataagtggagtgtactaggtagacacactagctagctagagtgatccagctagcatggaggcctcagccatggaggaggccctctcgaagaagacgacgagcaagggaggcctcaggaccataccattcatcatctgtaagcgaagcgagcctgcctgcctgcatgcattccatccatctttcaccctgattttgccggcatcatctgcacgccggctttgcacgagacatatgtacgaggctggctggcctggatcgagatgcaagtttggtttactttgtgttgttggtgtcagcgaacgaggtgttcgagaaggtggccacgttcgggctgcacgccaacatgatcctctacctcaccgagaggtaccacatgacggcggccaccggcaccgtcgtgctctacttctggaacgcgctctccaacttcctccccatcttcggcgccgtcctctccgactcctgcctcggccgcttccgcgtcatcgccctcggctccgtcgtcagcctcgccgtaagcacaaacaccaaccaaaccatccatccatccatcggagtttcttgcgcgatgacacgttagacgtgcgtgcgtgcaggggatgtgcctgctgtggctgacggcgatactgccggcggacaggaggacgccggagtgcgaggcgaggcgggatgactgtcagctggtgccgtggcagctgccgctgctgttcgcgtcgttcgttctcatgtcggttgggtcgggtggcatccggccgtgcgcgctggcgttcggggcggaccagctggaccggcgcgacaacagcgcccggaacgtgcgtacgctgcagaccttcttcaactggtactacaccgtgctgggcctctccatcgtgctcgcctccaccgtcatcgtgtacatccagcaggccaaggggtgggtcatcggcttcgccgtgcccgtcgtgctcatgctcaccgcgctcacgctgctcctcctcggctcgcccttctacctcaaggcggaggccgacaggagcgtgctcgtcggcctcgtgcaggtgctcgtcgccagctacaggaagaggaggggtcccttgccgccggag

SEQ ID NO: 62619 - DNA, 8278 bp, Oryza sativa
ggctggagatccccgcggcgtcgttcggcgtcttcagcatcctcacgctcaccgtctgggtggccgtctacgaccgcgcgctcgtccgcccgctgtcgcggctcaccggccacgcgcgcggcgtcaccctgcggcagcggatgggcatcggcctggcgctcttcgccgtggccatggccgtggccgcgcgcaccgaggccgcccgccgcgccgaggcgctggccgagggtctccgcgactacggcccgcagtcgggccgcgccgtgcgcatgtccgccatgcggctggtgccgcagcactgcatcacgggactcgccgaggcgctgaacctgatcgggcagatcgagttctactactccgagttccccaagaccatgtccagcatcggcgtctcgctgctggcgctcggcatggggttcggcagcgtggccgggagcgccatcgtcggggccatcaacgccggcaccaggagcggcggcggccgcgacagctggctctccagcaacctcaacagggggcactacgactactactacctcgtcctcgccgcgctgtgcgttgccaacctcgcctacttcgtgtggtgcggatgggcgtacggcgaggagggccagaaccgggtgaccgcggaggaggaagcggtggaagacaccaagaccaaggaagaacagcagcagaaactgtaaaacctttttagtgaggcaggctgctgctgtgttctgcttcagctttctacttctctagttctctcttgtgaaaattgtagtaatatttacatgtatatgttggtgcaaaaatggatggttcgacctcgaatcctatcagccctccggatccaaagatcctacagggcacaggctgctacctgcaacgttaaaatgctagtagtagcagcagtttttttttttctgttacttggatgggttgcatataagtagtgataaaaacggtgacagaaattttctaccgaccgaacatcgttttggtaaaagtagtatggttcgattctactgtagtaaatataaaatttgacttttctaatttcttttaacccttgttcggttaatcctcatgagggaggcaatggagggtatttattccacacctatttgtggtgtggaattattcccccttaatcccctccaaaccgaacaagaccttaatgtgatattacaatggtggcaagtatagctaatgtttttcacttgtaaagtttactcctcctctattcaatgaaattggcagcttgccgattcgttcaaaaaaaaaagtatagctaattctcgactgaccgataatcgtttacatagagatacttccattttcgatcctccgtagagacctactcgtcagcagtcgtcagcattcgccagcatcaaacggacatgataagatgatcaccgcttctcttgcagccttcagcattaatgctgcttgagtgcttgttgctggcgccaaaatgctgatgaaccaacagacaagatagctcccgctaaaaccagttacgcactgcaatcaatatgcagttttgctcgacgtagcgcatggatcattcagtggttgaatacgatgtagacaaaattcaacgaggcctccttgtttcccaattctcatcatggtcttcatcagtccaactgttgctgaccatcataggcattaaacacttaaatgctggcgttacattttgtttgcttgccactatttctgccgatttcccgataagaaagccataaccttggagacttcggatataaatctcttctccctcaggtgctatagcaaattgttgcttctctgtgtgctccgggtaaactaaggtaactgctcgattccctatccttttccttagcttatcttctcttctcttcctcttagcgctatcttgtgtcacgccaactgcaatagtagtatagtactccaccatttgcatcggtagatgattttatagcttgttcttaatttcaagaatacgttttccttgatctctatgggaaaaccatgtgttgagctcggtggttggggtcacgagtttgatcactatctcctaccttggatcaaagaggtgcagtggtttctctgttgcaagatcctttatgcaattttcctggaaaaaaacaggtcccagaaagagtgccctttttctttgctgttcctcaaagttacattttcctgctaggcaacagacataacttgtacattatagcctctaaggtaaacattaacggaaacaaacacataagaaatactgttcactgatagatgcatctgtataaagcgttgcccatggttaatcacctccacccacttaccagctactgcccttttagctttgcagaagatggaagctcaagaaggtgatgtgaaaagctgtgaggcctccaaagtgaaatggaaaggtggatttgtagccctaccgttcatcataggtatgttaccattttttttcgtcttttatgttttacttcaagggtatcgttggatggcagaattttcaaaggaattttggaggattctgatactaagatttttttttcctgcaatagttgtttggaacatacaaacgaagcaattatattctgatgaattggtttcatatgccctaaatttaaaagcaaatattgtacagttttcccccttctacaatacaaatacaccccgtggggtttcaaaaaaaataaatttaaaagcaaataaatatgagctcaaacacccatgtttttactttctaaagttcagtgcattctatcttcctctcttttgactctctattgaaaaaacaaatatactttcttatggattcattatcatttgcttgttggcttatctagtgtagccaaaatttgaattttcaaacttaagttcaaaattgatttgggggctttttcgtcatagactattttctagccaaggcttttagactgctaataatagagatataaaagttttaattataaattattttttgtttttgtttatttttctataacatatcaatcgtagctcaaccgatcagggccagccaaatgactcccatattcatgtgtcctgaaatcttgtgggataaggtagcatgtccaaaattattcatgggttttcccttttcttgcggttttagaaccgtgcattccagtgaggcccttatctttcttgttatagttagatcacctcaaattgcacgcttgaagctgttagatttagtaccttcattttatacattcgttaatttactagtgacttcaaatggtttacgcaattacgcgctttattttccagtaattaatgtactcgattatgtatttcctatctttgaatgtattgagcactgcatagcttgccatgtcctcctacaaggaacaaaactgaaccaagcgccttggacacaccgagcatttccaaatggaccacaggtagaactgtcttgattatcggtgtggcagtggcagttcagtggcactgcggtagaatgacaaacctagaacgatcgctggcgataaagctgtcactttgagggcaaatcaagggaaaatggtaatgttcagttgggaattctagaaagcaaagccaccgatggagtactagagagattttttggactggcagggaaaaaacggccatcttaaattgtgcgctgccgaagattgcaggagagatacatatgtgaactcatctgcatttcagaaatagctaaagcatatcatcttagttattttcagcataagtgctccaacttagtcaagtaacaggtaaactgaagattacagtgacgcatattcacatgctgtgttccggaagaggcgtttccctccctactaggattcctacttgctactgctttgcctagattaagagctagtagtagttgtccaccttatgacctaactaccgtctaccggttgatataatttaacgaggttatgcgccgtggtacaagatcctgccactctttgctaaatcctgtaggcgtagcaattagcatttcatttctactgcgccatggagcactctcttgttgctgaggctgaagcacaagtgttcttcaaggccaaggccaagggtggtttcagagccctcccttttatcatctgtaagttcgaactgaaattcatacaaatggatttcagaaaccactgatcagagtatttatgcaaatggatttatgaaatccttcgtttctttcttgttttctttgagatgacatgagtcaagttctagaatctagatgcatatgattggcctatgatattcatatgtgaactttttcaggatagtgatgtccatcaatggtgactgtgcccttcaattgagtaaattcaatctgacggagtttcttgtttcctttgcatctccttagcaaacgagatactggagaaggttgctggattcgggctcaacatcaacttcatcacgtacctcaacatgcagtaccacctgagccatgccaacgccggaagcctcctcttcgtgtggggcgcagtatcaaacttcgcgcccatccccggcgccgtcattgccgacatgtacctcggccgcttcatcgtcgtcgcgatcggctccatcgcctgcttcgttgtgagtgcaaaaagaagatgagatttccattgacaccggaggagatcgaacaccgagctgatgtgctttgctttgcttgtttcaggggatggttttcctgtggctgagcgccatgatacccggagcgaggccgccaccgtgcgacatgagtgcctcgccggagctgtgcgcgccgccggaggcgaggcacatggcctggctgctggccggcttcgtgttcctgtccgtcggcgccggcggcgtccggccgtgctcgatggcgttcggggccgaccagttctccaggcaccccaaggagaggaggtccaggatcctgcaggtgtacttcaacgcctactacggctccatcggcgtggcgttcatggtcgccgtcacggtggtcgtgtacgtgcaggacaacctcgggtggaaggtggggctcgccgtgccgacgtgcctcatgctgctctccgctgcgagcttcctcctcggctccggcctatacatcaaggacaggggctccaagcggatgttcgccgggataggcgccgccgtcgccgcggcggtcaggaaccgtagggcgtggctgccggcgaagaccgaggacggcgtgtaccatcacctcaaggactgcaagctcaccgttccgacggacaggctgaggtaagcgacgatcgatcagcaatgcagcttgacaatggtgcgaattgctgttcaaagatgcatgattcgaagttcatgtggtgtgatcgatctgttcaggttcttgaacaaggcgtgcatgatcagcaacacgaaggaggacaagtctggtagtggcggcgcggacggcatcagcgacagagggcggctgtgcacggtggaccaggtggagcagctcaagtcggcgatccgcgtgatgccgatctggtcgtccaccatcttcctcgcgcaggccatgaaccagtacttcgcggtgccgcaggccgacgcgatggaccggcgcgtcggcgccggcgggttccgcgtgcccagtggcacgttcgccgtgttcaacatgctcaccatgtcgctctggtcgggctgctacgaccggtggaccgcgccggcgctgcggcggctgacgggcaacccgcgggggctgaccatgaagcagcggatcggcgggggcctggtgttcggcaccgcggcgatggccgcggccgccgtggtggaggccgcgcggcgcaggcaggcgctgggcggcggcggcatgtcggcgttctggctcgtgccgcagtacgcgctggcggggctcgccgaggcgttcggcgtgatcggggtgatcgagttcttctacaccgagctgcccaagagcatggccagcttcagcatggctctgctctacatggccctgggggcggggagcctggtggggagcttgatcatcaagttggtccacgaggtgagcgggcggagagggaggacgagctggctggcggaggacttgaacgccggccgctacgactactactactggcttctcgccggccttggcgccgtcaacttcgtctacttcctctggtgcggctgggcgtacggcgaggaggggcagaacgtggagtgggaagacgaaggtgagggagagacgactatagcttagtagttttgtgctgaagcatgcatgtggattgctgggaacttgtgacaatgtggaacctttcctatggttatgctaatatgaagcctatggtttggttgccccatgaaaatagcagtttgcagggttgattctctggaccatacgcaatatcgtcacgttgatcatctttgtccattgcagtggcattggccaaggaaaaatatcggcaactcagttggccatttattagaaaacactatatctatgaatctcttatttggaaaataaaaaaccaaatctatgaatatatctctagtgttttgctagaagtgacttccttttggttttggttattcagcaaaattatcaatgcgaaaaatatttattagctaaccattacaatgtctgccttcctggaaccacagctaagctcctaataatttcttcagctccttcttgttgacctgataaaagcaataggtaagtaacaaactcaacacaactgcaaagaagaaaaaattttcagcccgcacctttcccatggcattccgaggaagcgaatcccataagtacaacctcgtaggaatctatcatgcatagaaaaagaattaactccagcggggaaaaagatttcagttcgggatcagataaaagctaagctgtacgtgttaatataagcaaaggatatgtaaacttaaccagaagtggttgagaaaaacatgagtcaggaaccatcccttgcgcacgcaaaatatgaattgagaacttcatagtacttccaaggtaatatgtgtaacttttgtggatggagggagtatcacgcaacagtcaaaagagaacactaaaaaaggcaacctcacaaataaggccatactgtaaagttgctagggaaagggggaaaacatgtagaaaatcaaaccttgtatggagcaagcttatcttttgaccaacttgtcagtgcttccaaggtcagtgctggtttcgagtccagttcagctcttttctttgagtcctccttaggcacaattattgcacagataatctctccataagcttcgtcaggtaagccgagaacagcacattccaggacaatttcatgctaaacaagaaatcaaaccagagtaaacaagatgagtaaccttcaactaaaccattgggctgtcttcaattagataggtttacaaagtgactattggaaactattcaagtaaaatggagattttaagtttttacctttattattgtctacctttattcttaccacaaggaaagtactacgtatcagcaagttctttcaaggcagtacgtttgctaataatgtctagtgtggggatatttacctgtaacagcactgactcaatttctaatgcagacagcttataaccaccaactttcatgatgtcagcatttgtgcctacacaggataatacaaatgagacagataacccaaaacgattacaaatagacagtagcaccacaacttaaacaaaaaaacacaactagtggaaaacgatgaagtggtccttacgccctaaaattatgaaatatccttcatcgtctacagttactgtatcaccagtcttgaagaacccaccatcaataaatgattctgcagtaacctgcaatacaaattaactgtgctgaacaacgaaacaaagacatttgattctcaacatgcacccttcatttggttccttagtggttagcaaattctgctaagtttgtatggtgcagcttagaagtcatgtcaatcacaacacccacaaaaggaatgcaccacactggtttcttattaagacacaaataacaggcaagagcataccaacaagtatagtccatattaacaaagaacaggctacagagttgggtgaaaaaaatatgaagcaacactaccctttaattagcaatctacaacgaatgggttttagtaaaataaggatgcaactcatggagattatttacaaataaataatgtacgcaatcaaaatgaaatgtataagtttatttcttgtgcatcattcacaatagataaaggttgactgttgggagaattagcaaatgattgttttaattgacgaggaaaatactttatcaatcatagacttcatatttttgtttatgaaaacacaa

SEQ ID NO: 62620 - DNA, 13640 bp, Oryza sativa
  unsure (1)..(13640): unsure at all n locations
tatagggaaatctaatgcaatccattactataaaacattgtgctaagtacttaaaatagcatttagcattagctttttgtggatatggtgcagtgggagacagtgcagaaattgatcttcacttcgatatccccatgcctctgacagaatttgaacctgccaaaccacatgaaccacaaatacctttagatcagtcaaaagtagataagcagtatcgtgaaaggtggtaaaatatagaaataacatcagtaaagtgaaaattgctaacttcattcagactgtcccaagaggcataatctattaaaagttagaaaaaaatgcacctgagagactatccccttatgagtgtggaccactccttttggtttaccagttgtcccacttgtgtaaaggatgagagcaggatcatctcctgtagtatcaaaccccagcatggttaggcagctttggaattaatattgattattgagaaaatcaatgattgaaaatgacacaaaatacagtatagaaaagtagcagcagaaatcaataggtatgactgccacgaaaaacagaatcactcacctctgatttcctttgaactgtcaatctcagctattaagctagaaatagacgaagtcacttcagtacttgatggttcttggcaatctatatttactggtatacttgtcacagatggaagaagagaacagtgagcagaacatttggtagagatattctccatgatgtcttgatgctccttggtgcttaaaatcagcgaaatgtcctataggtttcagcagttagaataaaagggacatatttcaaaatttatagtaaattgcaaatgtatgcccttgtacaaaaaaatgttgactttgtatttgtgtaagaaggtgtctagactgtcccccagtggcccattgaagaaatgctgcttgctgcgtggccctttttaaacatctatttctaattttggctcagtttacaatattaagatgaaaagaagtgcatagcaagagaagtaaactcgtgatgtgttttcctggtgttgcccctcctctttttttcttaccttgctgctttctcattgaaactggcgttttttttgggagagagagagagagagagagagagagagagagagaggtgtgtagtatgatagtagaatggcatctttcttgtgtaagtacatctattgcaaaaataaatcactgcaacaagttttagaacaaaccgagtcattcatgacatgaaggagttcagcttcaggatagctaagtgctagaggcactgcaactccaccagaaagccaggttccaaatatcccggcaacaaattcaggagaaggtttagccactatgccaatacgagctccaccaaggaatccagttccatttattcctttgacagatgaacctgtacttccattctgtgtcatctacaagaaaaacagcagaagaggtgatcaggcatcatcaacagccattgatcaggttaagataagatcgtgataaacatattataatcacataacaggaaatctcaagtgaacgaagataaaacaacatacagagaaggagagcggtggtacatttttattgcgcagaatattgtagacatccagtgcagatgcaatgagctggacaaggttataactcttttggtcagatctgatggctgcatggacaccttgtgtcgaaccatgcttaaggacttcctgaacaacctccatgaacgtactagtagtattttgtgtggtgttgtaagctagtaaaacacaagatgaaagtttcaatatcagaaaatataaatgcactagaatttacagtaaaatagtaattgctaattaattcatatggttcaccgttctggccttgcatacccaatcggcagtagctcctcgcggaacagaccgaatcaatatagaccactaggtaatccataacacctctatgaggcacaaccttaccggtgaactcaattaagcacaaaccaggaaggagtggttatgaatcgtgacgtatcaatgtcgatgtgattatcaatgactagttggaagtggctcggctgttcaacaataacaattcactaatcagtaaccaccgaccaacccatgcgtgctgtacctactaggaatattggatatagagctaactgcattctgcgtacgtagcatcgtaggacccaacagacaggtttagaagcaaattcggaccactcctccatgataacgcagattgtaccactgatcatcatcgcagcagactcatcaggtagccctttagaaacccactaggaccactcttccatctccatgaggagaggacgcaacttattcactgatcaactcgagctcgaccacttgcacaccgaatccctcatcaaaacaacgaaaacgaagcatgacggggcacaccccgagagaacccgcggctggatactgctactaggcgagacaccccgccactgaagcaaaacagcgaacacctcccgatcgtgaacccagagcacggaggagaaacagagtcccccctgaacgaaaacaaaacgcgggtgcggcaaaacgacgaacacctggcgcggcagaaaaaagaggagaggaaacggggagactgacctggcgaggaggagcgggaggaggaggaggaggaggaggaggcgaagtggcgtcggaggcgagagaggagggaataagaggagcaggggaggaggagcaggtggtagggggaggaggaggcgtgggccgcggggcaattgaatggcgtcatcaagcgcgccaccgccccgcgcacccacgcctgtgcgcgcatttacgggcaggctgtgccgggtaggtgaactcccctggccgcggcactgttccgtgctcgtactcgtaccacagcagcggactggcggtaggttgctcgctcgctggtggccgcgggccggtggcgccccgcgtgttcgcgcgaagggggaaagaggaagagccggacggacgggggcacggggccgtcagtttgctcggttttttcggtttttcctttcctttcttttattttttccttctccggctgtactggtttggtcgtcgacggcgtacgttggtacggcttgtcaatcgactgctatcggcgccacagcgtcgtggttgttgtctgacattgcaacaactcaatttgctataggtgtggcatggtaaataaaggggttgtttggttcttaactaacattgtcacaatgttagacaagtgtggcttgccacactttttgtgtcctataaattgtaagccacacttgtgacaaagttaggcaaaaaaaattaagtctatgacatgcgtagtaagatgataagaaagtgtggcttgccataactatggcaatgaaccaaacacaagactaaagatgtgtggcagcctaaagtgtggtgtggcaagttgaagtattgaaccaaacagccctaaagtgtggccaacaatttgttagccacaagtgtggcaatgtttggctagaaattgagtatatgacatgtaggcccatggaacaagaaagttgtggcttgccacaactgaaacaagcaaccaaacgttaagctaacaatctgtggcatgtctaacatgtggtgtagtaatatgtggcaactaaccaaacagccctaaatgtctgctgaagattatcaatgtgagacatacatctgttcagatttattatactaaaatatatcacagctagtcctagatttttttttcaggatggagggagtatgttctttccttgtttatccatatctctaataaagcgttccattttttttataagtttattagtttaaatttttaagctattttttaatgattttatactttaattcaaatgtatagttctactctaattcacataagaaaaaaaccatttaaacatgcatatcatcatcattagtaagatgttttttaaaatcctcaccgctatgctgggaggcatgacgttggcccattcctctcgcccaataggatacgtgtagccaagacctatatagaaagctagtgaagattggtgatggcctgtactatctaaaactacatacgtggttgtacccctcactcgaggttgtctaggacctacacatagtcgggtactcgggtggaaccatttgcacgaagacattctgcaaggtgacacagtgtgcttagggaagtccaaaagtacctgcgagaagactatttgagagatgacatgtggcagtgattgagatagcccaaaggcgcccacgaggaaattgtcctagggacaacacgtggcgaatgctcagggcaactcgggagcactcgtaaagagattatcccaagaagcgacgcatggtgatgcccgagccagcaggtacgttgtgtcggtattcttgacactcacacatggtgtgcccttgcactagggcgtaggctcatgcacgagaaccccaataggggaaccacacatacctatatcctgacaccaaggctcgcatgtcccatcattccatattaataagtgcactcaaagtcggttgaggacattaaatatgggtgattcagtgaatcgcacctccccaaaccatcttttctttgaccgatccattatgttaagagagaggcacggtcaatagcatgtttgaggcggggctgcgtagcatgacatggaagaatgaacaagggatagacggtatgacagcaggtacagtgtagatcatgatgtatatctacagtaccttagcaacgcacccccccttcccccgagttaggtagaccttgaaaggtgtataaattgacaagggattgccaagaagaaggttgaacacagttagatacacgataatacacaaaagctctaggtgccccagatttagccgaacttccacatattaatcaagagaacgggactacgggagtagatttattgttctccggaggcccaaacctgtataattcgttcgtgtttgtcaaatcttgttctatctgctattacacgttgacaatagcttttgacttaatagtacaagggtgacatatactttttaaaaaattgttgggtctctaacatagaactaagggcatgtttggtagagctccaactcctaaatttagctccaggagttaagtctagagtggggttgtggagctgcgtaaacctagctcacctatctagtttattttgtgatagagcttcacccaaacctgctcccaatttaggtggagctgaaactatttggctgggctccagtttcaagagaggtggagctgaagctagagccgtgccaaacaagccctaagaccattagggttgtttggcagtgctatttgtagccgtcctgcaacaactaaccaactgaatgcattgaagataaccatgctacacggctataatgcggcgtggcctgttgcagccagtgttctcgaatagccccattgtaaatgaatggataagcttaaaaaaactcgtgccttagaaatacacgagtcaacgcccttggccgtcaactcaaaaccttggttgaattatgcctcttcttagttgccactttaccaatcacctcacttgtttgttggattatcaaacgtaaacggaattttaaattctaaaacttaattttaagtatactggggattttgtttattgcagtctactttcaatcttagtgtttaaactgctaataaaagtttcacttataaactattttggttgttttgttattttttaagctcatcaactgtaggtgtctttactgtgaaactttatgtgttccgtatcatacatctattccaaaatacctttttcatatgcgatatctgaatatacatcacatagtgctatcctagaaactaccagtagcattttttgaaaagcaaaatatgtgtcccatggctcaaaatatgcaagccttagcccatccaaagaaaagcctgcgaacctaatacggcgttaacctcgacggaatcaacaagtgggcctcaaatgggccttactgaaactgacagaactgcaagtcacatctttcaaacccgccacaagagattcagcataacgcacggtgtacatccctttcatctatttacaccaatgacaggtgggtacatcacccgcgcctggtcccacccgtcatggagaataacaaacccaccagcactttccagagaaacaaactccacgtgtgacaggacggatcacatcaacgacgccgacgccgcaagaaggcccgatctccggcccacccacgtcaccccacccactggctgcgcggccccaccgaaagctccagcgcccgtgaccccacgcgtcagccgcggtggactcggcgagcgacgcgtaacgcgcccacctcatcgcgaagggcggaagcattcagccacccccccaccccgtcgaatcgaacggcgagcggcccaacaacctaacgtctatgaattcgagccgcaggatgtggcccggccgcgctccgccgtccgatccccgcacgcccccaggatccggccgtagaatatgaatttgatttcgaaagcgaagagtgggaggagaaagaaagggggtggagaaagaaagagagagaagagggggaggaggagagaagctgcagcaagagggaaaatccactaatccccaactcggagactcctcctctctgaaatccgccattccctacccctccgccgcaaacacgcgcgcgtggggagctcgcggcgaatccagcctcgccagccccggccgcgcggggacgccttgcccccgatctggcgacggcggccgcgatctcgccgcgcgcctcggcggctgcggcgaattgggggtgggggtggggtggagtggagtttcgataggtgtggcggggagggagggagggagaaggggcggcgtgttgatctggtagcttcgtgggggttgggtggattagatagatggcggggaaggagcaacaggggggaggagggccgccgccgccgccgcgggcgccggtgcccgcggcgtcgtcgcagccgccgattaagaagctggtgaggcagctcgacttcacctcggcggcgttggcgggtaaccccgcgatggcggcggccgcggccgccgtgtccagggcgctgcagccgagggcggtcccggtggggttcccgcagccgcagcaacttagggcgcacctgccggtgggggtgccgcagcagctgcatccccggggcctgccggtgatgcggtcgcaccacgtggtgcatgtgccgctgccgcggccggcggtggccgtggcggtgcccgtgccacaggttcggccggcgcagccgcagccagtgccgcggccaccggtcgccgttccattgtgagtgtgccagtacctagatttatgtttagcatcaagctttacatttttacttctcaattgggtaatttctctcttctaactcctttttggtgattcatttcatcggaggaagactgtttttctttttctttttgtttgtaagccaaagtttcaaacttggtttcgattttactttgcccttatctttccttggaaatggaaggatggaccctttgtttttttttttcacttgcatctatatttgatattaccctcgttcttattacgatcttagttgatgcaaattccctatttctattttttctcttgttattttgcgtcatgttccaagatgttcttattgtgctttgaatctgtattgtaggaaaccagagtcaccaaagccaccacgggcacggctttatgaagggaaagatggcaccccgacaaagaagaagtgctgcaactgcaagcactccaaatgtttgaagttgtaagtcagattacatgccttagcttgaaaacggtgcaatgttgcaactggagtacccttctgagtaactctagtctggataacgttggatccaaaagagtttattttatttgctacagatgctaggacatatgtaaacttgtaaagtgaaattgtcttgagtttcttttaatccaaaagcttatatagatggatgctcaatccttttttttaataaaaagctggatgataatagcatggtcccaaacttgaccaatagcattcacagtgtgaccaaatacttgatcttatggtattgtaagatttctctagtatatacttgtcgcaagttagctggtctggataattataaaatgttatattatatatgtatccggaaaaacttatgggttagctctgggctctggcttttaccatctaagttccaatatgcatccaaaacgatgtatactagaaatgtggttcatctgattcacggtacatgaacatgatttggttctgcagtttaatgcgtttctgttcgatttccactgtagactcaaaacgcatacctctgttgtctctggtacctctttcactatgcttgtaaggttttgtgtactgatagttgatattatcaatctggatctcatggttttctatgtttaggtattgtgaatgctttgcatcgggtgtttactgtgatggatgcaactgttccaactgttttaataatgttaagaacgagactgctaggcgtgaagctattgatgctacattggagcgcaaccctgatgcattcaggcctaagattgggagtagcccgcatgctaaccggaataatatggtatgttttgagttccatgtcttaaatgagtagttagatatacatgctaagggtgttcaataattgatgcccgttacttctggagtattaatgattcatacaaggaatgtccgtgcatatggtgcaatcacatgtaattctcatttgaaaatcgaaatgaagctataaactaattgaatgcaaatgtagaacaggggaaggcttgggaaattacacaagttcaatgaggaactaaattgctactctctacaactaagaaatttacagtttggatgccatatttcagtaaaagggcatgcaacctagtagttacagtgctcaagtagcacctctaggtcctggattcgactccccatgggagcgaatttcaagcttagttagaaaaggtcactcattggcccctcataaaaacgtgttaagaattgacctatggaggacgagcatgggttaaggaccaatccatagggagcgagtccacgtgtggggggctgggtttagtggcctttctcggtcggattggttgaagcttcttcttaatgaaaagctgtgaacatggtctttccccaactggtcgagtattttttggatgccatgtttcatttttgtacatctcattatctgatttgccctgctatgatgcgtgtacttaatgttagtccctgaaattgccaggaggcggctggtgatcttccattagttgggaagcataataaagggtgccactgcaagaagtcaggttgtctcaagaagtactgtgagtgcttccaagctaacatactttgctctgaaaattgcaagtgtatggattgcaagaatttcgaagggagtgaagaaagaaaagctcttttccaaggggatcataaaaattccattcacatgcagcaagcagcaaatgcagcagtaaatggtgctattggagcagcagccttttcttctccttccgcatccaggaagagaaagcacatagatccttcccttgaccactcggccaaggaaaatggagctcacaggactaatcatgtacctcaggtaatgacaatttctagatttcagcaggcagttcagtttttccctaatacctccgtctgtgcatactgcatagctttgtgtttttgaggtattgacttcagtgatgggtggaagtggtctgctccatcaaaaaaaaattatttataccatgcatacaagtcatctgatgaacggtgtttcagatgtgtggttctgagggataggatagttattgactagcgctattgcttttttgatcagaaaggaaaaggactttccgtttgtatcagtgccgcacgtttacaacgacccactgttacattacatacccttctaattgacatccccatcagtttagcacaactaacacaatatctacctcactcttgggtttgtaccagcaatttatgcactggactgctcttttgaaggggccaacaactgtactatagataaattttgagttattagttctccgtgatacagaagtggtaactcctcatatactgctacttataaatgagtatgcaaatattttcttgagggatacaaattcctctacaacagattcaccaaaaaattggactaacccagataatcataagctgctaatagcaagagttatttcagggttctggtagggttttttgtatactctttgtgatttaattaggttttttatcagaagaatggaatgccatccgatggcccgcttccaataaaccagcctgtgcatcctccaacattggggccctttaaggtcacctacaggtaactgtcaacttctatcacttttccttgagaagatcaatcatacctgtttttgttgatggctttgtacccttccattataggcctcttttagcggatattgtccaaccaggagacgtaaaggaactttgcaagcttttggtggttgtatctggaaatgctgcaaaggcatacgctggtattgctggtcttacattttgggattttattaatttgcttgagaaagtattcatgggcatcctgtgctgcacataacttaatctttgttagaggcttagagccattcaaacaacttgcattaatctgcacatccttgtttcattttaccattccagattcaaactatgttttacttttcttgaaaactaagttgcactagcacataagcttttagttcaactctcatcttttcttgggcttggattttggatacctacgcagtgaagatatttaactatttgccactcttagatgcagcatttaacaatttgccacatgggcccacatatcttagacaaatgagggcccacatatcatagacacatgagtggcaaattgttaaacggcaaatctaaaagtggcaaatagttaaatgccccatctgttggtcactttgaagagagaaaaaacccaacactatagggttccatgtgctgcttcctctccattttttgtatttcaaataaatggttttataagatttcttttggaaccctaaatgaatatgaagctattccaggcttgatttggtgcatgatgcatcccattaacaccattctgtaacttccaatgttatcagggttaatgtcttttccctgttgaaaccatgctgtaataggcgtgatggttttatcatagttatgcttgatgtttttaaatgataaccaagtctttattagcatgttttatgtttgttaatataaggcatgaccacattcatacattgggaactgtctcattgggaaacaggtaagaaatcccaggataaggtggtagagaaggaagatgagatgggagggaagagggaaggtgagattggaggttccctagcatcgacaaaccatgacagagaagaaaacaataatgatccaaataatcaaaaggcatcagctgatgacccatcaactggaggaactcgtgcaggcaaagcttctctagaagagtctaaacatgattgcaatgatgatcagaaatccaataggccaatgtctccaggaacactagcattgatgtgtgatgaacaagacacgatgtttatgacttcccaaaatgtagttccgcagcagccagcacctgtcaaccagaaccagtctgaattgtatgcagaacaagaaaggtgtgtgcttacagaattccgtgattgtctccataagcttgtgacattcggaagaatgaaaggtacatcgaaatttcccatgtgtcatgctaatacagaattattgaacttctccattttttgctttgtaaaacgtgtacagtttgatcctgatggttcttccttgcagaggagaagttttccatggcaatcaaatctgaagtgcctgcccatcccatgcaggcgaatggtgtttcacgaataccttattcaaaagaagtagatgtacctgttgtaaaaacatttctacagagttccagtagacatcctgctgctggaaactccgcaactgggcatttggacaaaaaacccaagcatgaaaatacataggtgtccggggtttgtattttgggtagcatggtcaagagaatcatgttttctccctctaacatgttgatcagaagcttgtatcagtcttcattcttgtcttaggttcaagaaagctccaatttgttctcattggtaaaaataagtgtaatgttggatagttagcttagtcataaatatgcatttagcctttatcttagtgtctacattgtttgttcctttacctttaccatttccctcgtgaaattttgccaatcaccatgctagtattttagatgagattattccactttacgcgattaattcatattggttgtggctggttgtaaatggtaatagttccagactggttcacctacgcttcaaactttttgtgaaagtgtgaagccatacttcatcctattggcaactaccagaattgcagaattgcagaaccatcttatctccaaatttgccttcagttcatactgtaacactcttttccgatgaagttattccgctgcaatgtgccgcaaaacatggatgcatatgagtactggaaagtggagacgtctatttcatggatttatccttcaatatcatatcgatcagccgcaattttctgttgaaaataatgcagggagcagggatcaagaaagactttttttttctattaatagaacacttgatatcactctatcctgtacatgaaatggacattgcttcttgagtggacaatggcgaaaacaagcttctcacattttgcacatacagttaaatattcattggtttctccaggcctgaagaaagcgaatcacgacggcaagagttaaggctgcttgtgctccattttcgcctcaaattactgccccaagacgcgagatacggaactcttgatgttgttcagaaacttttccctgcagaaaaacaactgggctagtaaagaaagtgcaacaaaagaaactcttcaactatggtgctcagaacgataatacagatgtcccgagctgcattataaagtgtcagtacggtgccagttcaatatatatccagtattctcaatgatgcaggtatgcaggcatagtgcagcaaaccaaaaagaaattgacgttatgttgtgtgtaaatgtgaaagttccataaaacttcatcgtaaagtatatcaaactatcagtatcttctcatcaatgattcaaaaaaagtaagatctctaagggcttgttaatgatacaaagcaagttagatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62621 - DNA, 1180 bp, Oryza sativa
tttgcgagatttattaaggtccttaacttcaaatttacatgttcatggcctgttcaatgctctatttgcacccctctattctggatcagtggtaattgaccttacttttactaatatctcaaatgctttattcagcatgtgcatagtgcttcacttgatcgattgatgttgtgattttgtttaaatgaaccagtcttttgtagcacttgggtttcctttctggtcgtatgatgtgttactttaagcctttaattttgttttaggagtcacatacaatgcatcttgtgtcaaaatttcttccatgctaatatatattctctgaggttgcaggttgagttcatgccgaaatttagtgtgaggggaatatggcagaggtggcgtgagtcatatcccaacaatggcagtaaaaatgatgaagcaattacagtatttactggagtacggttctatgccatatatttttggttttttagatttatgctaaactattacctgtccttaaattgctcgaggcattatggttattcgatacttttggactaccaggttccaacaatgtacacacggctattgcaagggtatgatggtatggatcctgaacaacagtctgcatcttcctttgctgcaaagcaattgaggctaatggtcagttgtatatatatcttgcaagtaattgtattgattcttggaccttggttagactaaacttcacgcgtcaggcaaaattacaactcatgtgtttcagtccgtactatgttcctgaaaagactagtagatagttactatggacaaaatctgattactatctgttgaaaatgtgcaaatatatgtatgttatatggtagtacgatagatagatcaagggtcatgaacccttcaatcctgctattcaacttgcaaagtccaactggttcattggccatgcttgctcgatcaagcactaaagtacttaattaagcacctcaggactcaatatatccgataactgtggtctcactgactttaggtttctaacaccacgataacttgaaaagcagatgaagtttcttgcatgatgcctttgtgagcttgcaatatgcatctatatttattttaggtgttttatttgattctgctgggcactgaagccaaatgactttgtttgtattcaacttttcgagctctaggtaatgatgtatag

SEQ ID NO: 62622 - DNA, 1123 bp, Oryza sativa
gctagaatgacttacattgtgaaacggagggagtacgaggcaatattattcttttgtaattaaaacacctgggcagctgtatttttgcagcatataactttttttttgtgtcttttatgttatgttgtcatttacaggatttatcaaagctaaacagaaatcccgcacaagtcatttatatcagtgggcatgctctggaatcatgcctgcagcctgaaaattgtgttgagatcaaaccttggaagcttgaaaatgatgacactcaactgcttgatcttattccctttcttgaatgtaagacttttaatcaatttctcttattatcctgtcatccagttattttttttttccatttttgtggttcttaggaatgcaagtgcattagccaactaacccctcatattatttcattcctgtggtttttgaagcatgcttgattgccccacttgcatccttggtatttctgtttttcattcttgtcaatctgtgcggcagatgttgctatggcaagaccttcggatatcagggctgttcttgcgtcctatcaaggccgtgatatacctgctgagtttattgagcgttcaaaggagcaccagaggtaagcagatgctttccataatcttcaaatagttgtagctgatgctaatcttctcaagtgaaagtaaatccatggattgcaccagaataagccacgccatcaaacaagtatgactcatcagatgcacaattgaaatgaaaaaagaccgttggatcgaagagagcaggagcagtcaaaaagcaaacattaccgttaaaactctggacccttccaacactcttgagaatgagaatagcaggaagagtacagaaagaactatatgtacccgtacccttttcaatttttgccgtatcctactccctccattccaaaatataagtcataaccacccttaacccaaaaaccaagaaaataattattatcatcttgtagtttggattatcctaataaatacaatgcatgcatccaatagaattagagaacatgagagtggaggatttaaaaaagtaataatttaatggagaaggggtcataattaattgcctacatgcatgcatttcttatactccctccattttttaatag

SEQ ID NO: 62623 - DNA, 1155 bp, Oryza sativa
accttatctaaaccaaattaaagtattttgaggtaaaaggcatatcagctgctgctgcgtcattattcacatgcaatatatattcttgcagacagaaaaatagcattaaatattaactcaagatttatgacaaaaagaaattcttgacagaactaaaacatgttttcttttgctgttcatgtgtaaaacactatgtttgttcctttggttttcttgcaaagccgggtaatgcaattacctattctcttaaaaataacagaactaaaacatgaaattcaaagcaatacattaaagtccacatgattcatattataattatttgattaacctgcaaaggtatgcagctagacatattaaaatcatttcacagaaaatttctgcataacatgtaagcacaaatttgtgctggaaaacacttgacaatgatgtgaattttaaatgttgcttcttgaggatgggggaccttacatgcttgttgataaaaactggatctttcatctctgggtatattccgacagttctgcttgcatccaaggcaatagaaatgaattcttcaaatgtgataattgaaaacttgcctgcaccatcagatagaaaaaaaatagtgttaatcctttattcacaattatatgccaccagaatgtgcactcttacaaacattggcagttaacttccacatctgtagaaagactggtaaagatgaagcccagcagtatcgcattatcaataaaaagaatgcacgtgaatgatctttaaaattataacaacatgacctatagaagagagtaatgatattgtgtctgacaatcatgataatacaaagagatacaaaagaaaaaagatactcaaagggtatatgaccgcataccattgtattgttggtctctgaatgggtatcgctgattgactttcagtgttttaagttcctcaagtgtgaagtccactgcatatcaacacatgtatatttaggatgaataatcaaaaagatatagcttcacaggtttatcatcctcatcagtcccaccctagcaatatgcagtttaaaaacatatatcaaccagtataacctttaactaatttagaaaaaggaaaggatatgacaaacataaaataaagggagaaaaagtaagtggaagaaataaatatggatatatt

SEQ ID NO: 62624 - DNA, 10074 bp, Oryza sativa
caacacaataagactataaattcaactaattcccgaacttttcattagtaaccatgtttggttatctcaggaatatttttcaatgtgtatatgtgataccatgccttaacatgttataagaaagttatctggtcaaagcagagattctatccaggaaaaggtaagtgttctcaatttaccatcagtgataagtacaaaagtcacagagtcctctgaataccagtaattaaattgttaaccatttaattttgttttaagggatcgtgtactgcagaaacctgaactcaaggttaaaaatggatagattcagacacattaccaaatataactttttaagacaaatactcctacaaaaatagcttacagcgcaaagatgtcatcatctgctcacgaatatggtctattgctggaaacaagtgctgcagtaatcgtatggttttcaggttggatgctacatggagaatataagatgaactagaaaattattgagctgctctcactggtttctgtttcttcattatatatctaagaacaattgtacgtgcacatccaggctatgaatacggccaatgaaagatttcttttttggacaaaggaaaaggaaagattcctttttgtccaaaagaagaaaaatcatcgccttttattttgtgtcaatttccatgctattgcattgtgggcctgtttagatcccctggcaaaattttttaccctgtcacattgaatgtttggacacatgcatggagtattaaatataaacgaaaaaaataactaattacacagattgcgtgtaaattgcgagacgaatcttttaagcctaattgctccatgatttgacaatgtggtgctacagtaaacatttgctaatgacggattacttaagcttaataaattcgtctcgcagtttacaagcggaatctgtaatttgttttgttattagactacgtttaatacttcaaatgtgtgtctgtatatccgatgtgacacgccaaaactttacacccatggatctaaacaccccctgtgttccaagattagaattcatgggactgaatctgaaagtttctaatactcattcggaacaacatacgtcacacctaagttgttctctactcccttatcccacaaaaactcaacctagtactagataatgtaggagcacatatcaaatgacaaaattagataacaactaacaactctataagaatttcccgcctccagggctccagtataaaaatagcagaatgttggtcaaatttgcctaaccaagccatcatttactcagttccatggcaaacaattgctaatatattggtctagttagaccgatcaatccacaattccacttgtaggagcagctgcgctaaatatagaagatatctcaactccatgttactatattcctttcacctagtcataaccaaaaataaataaatattcacacccggaaaagtactagtagtagtctactactccgtaccaacttgatcggatcaactggcacagagatacagaatcactcgtaagttcgtagtagtagtctactactccgtaccaacttaagtcgtaagagctaccgctaagcaattcagaagcaagttcgttggttactacagctcacttttgcataatttcacggttcttgcctcaacaaacagcaaccattgcctctaactccgtgtcaagaagacaaacaacccacctgaagaagcgccattcttgtgccaggcctttcgaatgcaacagatcgaaagatttcacaaccaatcgcaaatgcaaaatcacccaaggggccggcaaaatgaccaaaagagagagacgatctgtttccggtgaatcggagaaaaccggcggatcgatcggggaggagagagaggaggggacacttacggagcgaaggccgcatgctgccgcccgctgcttcggtgctccctctccctctcgatctctcgtccctctcggcctctcctctccacttcgctccccgcaccagcgagagctcgaggaggagggggagaacgagaaggcctgggggagcttggcttcaatggagaagaagacggcgcagcggcggattctcctctccactcctgcttttttttttcttttcgtcacgccattatttcctcacccttaccaagcacgctacgctatcccaaccaataatgaccttccacgacacggtagcgacacctacccgtcactgacatgtagggacacacctccgcgatgctgggacatggacccacctgtccgcgacactggaggcgttccgcttgttatacctggttccagccttgtggacggaatattcgtgggattacggcgggttttccgaggattttggatgggcgaacaatattcgtgctatacgctggctgacatgttggatagagcgatggccgttgccggtgctcgttttacatgcggaagggattagtttctttttttttttagggaaaccgaaactttatataactgatccagctaaatcactggtcaccagtcgttccatcccagtgctgtggctatcagaacggcaaaggagaagggtatggcgcgagttgaactggaaacagattccctgatgctgtgcaatgcactccagagtaactctttcaacttatcagtgatgggtggagtaatccttgagatcaagcatgtgattgctagctgtttttattctttctctattaattactgcccacgaaactgtaataaggtagcgcatgaattagctgctttgggttgtaaccttcaggacgtttcctcctggaaaggattagtttctaagatcaaagaacaaacacggtctcggtggtgttcatttcgacaggagagatggacaataataagctagatgatggaaaagaaatataaagtaaaaaaggaaactttttaagaaatttcggtaataatccataaacttagaccgagacatccatagacttataaaatatacaactaaatccctaatcttgatttaatatgtcacatgtggtccatcataaatagtcactttatgatggtcagaattttgtatttaggtctctccactgcaatatggcatttccagatccactctccgatttacatcccagttaaagtttatggaacgaccatgtattttatttgaaatataattatattcatgaaaacattaacaataagttttattatataaatcaaattctatttaaagcttattggtcttataaaatttcttatagctatttttgttgaacccacgcagattcgagggctcatttgatttgaagaaaattcatgggaatttcaaatgatagcaattcatatgaattatcgctatatatgttctttttaacaaaggattgcagcattccaaattcttttttttaactcataaagttttattgcatattaaacagagtacatgggagggaacgacattccctgaaacatcgttttgcaagaaattgacaacaacaaacgttaaggaccatcttcctgaaagaaggtaaagattgaatgattaatgattgaatgaaggagcattcaaaattcctttgagatcaataggaaaaaagcacatgaactcaatcatctttttatcatttctttgagaagtccaatgcaacttttcccgtctctcttctctattaaagcacatccaaaatcctttgttatttttatgtgaaccatccaaacacgttactttttgaattcatgtgttttacgtttctatagaactagttgataccccgtgtttttgtcgcggaatatgtgaataaatgcatgttatacattataaaaataatatacgtatgaaaaatgatgtggggataatgatttgacattgattgcggtctcgttattttctccaacaagagttggatgaagattaagattttcgtggcacgttttccaaactgctaaacagtgcgtttcaagcgaaaactttctatatgaaagttgctctaaaatatcatattaatttatttttcaagtttataataattacgaagtaaaactcaataattatacgttaatatcacatcgttttgcctaaaaaaacttaatattcatctccatcttcaggagaaaaagaacaccacctgcatattgagttctaaaaacacaataagattgtaaatgttatgtcatatttgtatgatatttaaaatactcataataattgctagtgaatgatgatgtggcacacttgcatgtgatttaaaatactctagtgaagtgggtgatgatgtgacacacttgcatgttgagcgttagtggacatcaactttatagtaaaatataattcgcacctacgtgatatcctaacttcttctcattcttatggatcaatattttcgctttatgcttatgcttactagtcaaaatttgaattttcaatattaaatttagagttgatttgtttttttatcgaagtttattttttagcctttgcttttaaatcgctaagaacatatatataaaagttttatttacaaactatttttagtttgcaaatatgcagtttcgcttatccccaaataagcgaaatgttggggcctttatatttttgcaaaaaaaaacgcgagtgaatttcatgaacgattatgctttttcttcttgagcctttctacatcgatcagacggtccagaacgcgccacgtagcgcatcgaagagatccagcatcttctccacctcgctgtatccatcggccgcgttcttcgcatcggtcgatctccctcctctcctcctccgtcgcgccgcagacgccaaccccgatcccgatggccgcctccgcctccgccgccggcgccggcgccggcaagtcgctgttccagaccttccgcaagttcttcaagaagccgtgggagatcaccggcccgtgcgcctcccccgagtaccgcagcgcgctcccgggcgccctggagtaccgccaccgctgcccggccaccctgacgaaggacacgatggccgtcgtgcccacctccgagcccgagaccgtctacgacatcaagtactacacgcgcgaccgccgccgtgaccgcccgcccgtccgccgcaccctcctccgcaagcccgacctcgagcgctacatggccgccaagcagttcgaccccgccaaggacttccccgtgccttacgtgaacaccgccgtggaggaggactacgacgccgtcggcggcggctaccagaagtgatggtcgaggtgaggaaatcctttgctactttacctttctagatctaggattggacggacctagggttccgtatctcctcgttgtgttgccaaatttgccatacgaaaacagttgtgcgaaacgttaccatacaggcatacggtttcaatctccccgttgaatccatttgttttcctttatgattgaggatatgatttagatgcatgtagactggaacgaaaatgctgtgaaatgaactattgctagattgcaaaacagttactcaaatgtagcggctcttgaatttgcttgcaaaacagtgagaatcgtaataaaatcagaatgaatgattctgccgctgattttgaattctaacattttgattttattaggattttaattttatgggctttcattgtcaatttattatcttgttctcttttcatgattgctaagatgacaagtaaaaaatctacctaaaattattcttaaaattcaaaatcactttgcattagtccgtagcagaaacaagaagagccaccaaatgctgaccttgttactttgcctattgtttttatctttggactggatttggtggaatcttcttttgagtttttgatgcgtatagcgccttcaaatgttgttactacctctggatggaataatttgtcatttcagacagtgaaaatgacttgcacttagtagtatttggctgtctgaaatcctgacaggagggagtatgactaactagtcaattctcaatgacatctcaattaaaatgagacttatctgtcgggttgttctattttgtcggatattagtacagaataccagttctttgctagaaatacaactccctgcattctgaatatagtagcaactttttctttcattttgtgatctcatttggttagcttctttagagattatattgatacaaatttgatctagagataaaaattaaaattggtttcatattcatcagcttattttggaagtattttgttttcctcttaactgatagcaacaacatcagatgtctgcttgcaatagctagtgtttgcaaagtgcaacgatctgtgttcttaggccctgtttgtttcagcttaagattattgtaatctagattattgagccagattactataagctggattataataagccgacatagaataagctgttagctgtttgtttctctagattatttgctgtttgttagctgttagcaacccaataatctaaaaaaagcacctttagagtggattactagattatagtaatctggcttatagattgtaataatctattaaaataagctatctgtttgtttcagcttactactaataatccagattataataatcctaagctaaatcaaacagtgccttagtgtagctgccgcttagctaatatgaatcaggcacagtgcactcaacttaatttggccatttgacctgactcaagggttcactcacattctgctggacgcaacagagccacagaggtgtgtgccgcagcaggaaaaaaaaattctataaagatgtacacctgtgagtccataccacatacaatgtgttctcatagaagtttctttccctatcaaaagctttgcggtgctgctgctctattttcatggttaggccttgtaatgtgaggtctggtttaggttcttccctctagttgcagatgcaagcatatattttattctaaatttcaattgatctttttttacaataaaacaatagttagtcaccaaatattccgggtaagaaatggatcacttcccgctattgagttctatgacttctatcatctatgcacgatcaacattataaggaaatatatgccattgctagctaaaattgaaaagaatttccaatagctaaaattgaaaagaatttccaacttattgggatttatggacgattaaaccgattaaattaatattcaattatgagccattgctagctaaactttgtaagtattataattttgaggctaacacggtgaagataggtacctgaaatgactctggtttagaatgattggaccagggctattgtgttgcctgagctggttaggacttaggattggttatggaatttgtacttattgcggtgacatgttgtgatgtttgcgagcagggggccctagactagaagggcataggcgtgctcgacgggagggcgaggctgctcacctcgccgcctggagccgtgatggtggcgtcaagctagggttagtgatggtggtgatgggtaccgtcgagcaggtggtagaacgccagccacactttctcttccttcagcgacacggccccctgtaaaattgctcgcagcggttgagaaaatgaatcgggtcacccttacgatcgaactttggaaagtcaagcttgtggtagcatggagggcggtcgccgtggcatccctcacctccgtgccccagggtgaagctgtcgctatctgcgtcacagccaccgtggtgtggagcgttgtcgttgccagcccgttccaggcgctggattgcgacgtggtgcgcttgttgttggttgttgaggtctgagatctggccgtggatggcattgaggcgttcgatcaccgcagcaagtcctgtcttccagtcgtcggccagcgacgttggtgacggtcgacatggcgcagcatcagcgagcatgaccgtggtctctagataccaagatgttgcgagcaggaggaggccctagactacgaaaggcgtaggcatgctcagggggaggtcaaggctgctcacctcaccgccctggagccgtgatggtggtgtcgagctagggttagagatatttcttggcttgctttattgattgaatgaactgcccatatataggcttacaaattgaactaatctgctgattgaagggaaatactaactactaacaactcatatctttaactaactaaaaacctaatttgattgcaagccgtaacaaccttcctacacgcattctgcttcttatccttccaccttcactgcttctgccacaggctgcctccgttgcatatacatacgttccaccataacatgtgacctggggtagattttttaaaatgcattaacaaaaatgtttatccactattttcttgtaaaatcacgtttctaagagggaaaaagttttcttgtatagagaaaactcagttgcatttgggtcactattatccagaccttcccttacagctgcttggctattgtagttttgagtgttgatactatgttgtacaacatatcatgcattaaagaataaagagaatgctgccttatattttctggctaggaagttttagataaccttgccatacaactaagaacccatgttgcctctttgtgcatggaagttcgacattttaaactgcccctaactgatttattttgtatgactaattcagtatcccatgtggactacaagttttctgttgcatttctgacttgtccagaagtactgacgctctccggtgctttgcagtatctgtttcacactgtatttataatctgacagctttcatgaaaataatcctcccagtgcctgtcctttttgtttgtccaacaagtgcattgcaaccccaattagtagcatctatttctgactctgtcatgcattttgtgtggcaaattgtgtccaagttactcccctccagtcaatattagttgacgttgggagaactgagttacgtcaaatattttttactggaaggagtatatgctagtactccatttataggcacaggtgcactactacgtttagaattgcatatactatttagtcatctctagatttctggtaccttcagttcaaaatgagatgcagcacttgaagcgactaggtggggtttgtgacttttaactacctaattccagacgtgaatctgaattcttgcttaattatttctgtcttcatgaattatcattgtaaaaaaggataatgattcgaccattcatcttttttttcaggtatctacctttcttgtgcttgcacttcgtcagaagttgcattgtcttcatttgtgcccttgaaatccattttgtatttcagaggaaaaaaaatctggttgtaagagatgatggcggcaataatatgacacctgtggactttgctgaatgtatctttcttgtaagttgtatcctaaaacttggaactacctgatgctgatgctttggtagtatggttcaatgaaagatgaaatgtttccttctgtaatggccgcatcatctactcttactgcaaaattattttgactgaacgaatcgattgaaaggttctcttaggctgtgtttagttccatgctaaaattgaaagtttaaagaaattggaacgatgtgatggaaaagttggaagtttgtgtgtgtaggaaaaattcgatgtgacggaaaagttggaagtttggagaaaaaagttagaatctaaacagggccttaattgaaagtagtagaactctactactcaacatagaccgagtttagtttcaaactatgtcttcaaacttccaatttttttatcacatcggagttttcctacacacaggcttccagcttttccattcaatatcgttccaattttaaccaaatttttaattttggtgtgaactaaacacacccatagtatatcagtatggctaacaagttttggcatacgaaactttttacacggttggctcaatcgtggcgaagaacttgccacatgaccagctagcagcaactggtaggccattactgaacctgcacttcgtggaattgtgcagatagccgaaaaaaattctctgccggcatgtgctgaattgtgtgttcagattaatgaatccagttaggcttaactactactgatcaggataaaggtgtcaggggtctcactgatttcatgccagtaataaggct

SEQ ID NO: 62625 - DNA, 38055 bp, Oryza sativa
accggtgtgacacaactgaataagttagaagacttaaacgagtgatctgcaagtttagggaccgggatgacacggttgaacaagtttgaggactaaacggtcgatttgcgagtttatggaccgggatgacacagtggtacaagtttagggaccagtgatagactttattcttttattttttttttgataaactggcagacgcatcatattttgcttggacttccgacttcttacatggacggatgcatatgcagagtacttctccggcaggctaaaaattgtcgctcgatctatgtacgcaaagcacgacgatgaagtagtcgctactggcatcgctgtctcgtggaaaatgtcagttgttttgtctacagatcgttacgcattaactcatggccactagcagtcaaacgaccctctcaaaaatgggctgacagaggcaaggggaccccctgggttaactttgtcacgttgcttctgcaacagtagtccacggtaccaccaccaccaccacgccaaaatttcttcgcattggaagcagaaatatcttcgctttccaggcttagctacgttttttcgtcgatcccctttgaaaaaccgatccgaacgtgtctgtctagtgtataccctcgagaccttgagtttcccgtttttacggagcacggtacagtggcgaggactacgaccgtgcaccagaaggaaaaagaaaaaggaaaaaaaaaactccgtccgtatcgtgtcatcagatgtgctgtcagcttcgtgcgcccttgacccatctgtagttaagcgtgtgccgcagctttcatgctttcattcaagcagcatgaatgaatgcactgcatgcagcaggcagcaacaacatcaaagaaaaagaccgcgcgcgatgacgtcgaaacgcacaggagatgcatgtgttgatgattggtactggagacggctgaactcttctcgtctggccaccggccgcggcccggcccgcgacacatgcatgcagtcagccacggtcacacacacacctgatcgacctgccgcctgccgtctgcccgtctgccgcgcgctgcttctctctccgtccgatggcgcgtgcagtgcgtcccattgccccctcgttaattttttttttcccgctcgtctcgcgcgcgctacaaacgcgaacggtcccacggcggcgcgcgtacaggcgtggttaattcgcgcatgcatgatttgtaccacagtttgacggttagcctttgcccatactcgctctatcccaaaacggcacaacctaatttaatcttaagacaattattttattcggattaggtgtactagaatagatcacatcttattttagattaggtaattttttttaagacgaagcgagtataattttctctcagatcgaggatcgagctgctccttttgctgctatgttagtactttgggttagagactactccctccgtcccagaaaataaacatttttagagttggacacaattattaagaaagtatgtagaagtgaatggtggagggttgtgattggttaaatagtggtggtaggtgggaaaagtgaatggtgaagatttgtgattggttgggaagagaatgttggtggagaagttgttatattttgggataaatcttgagggctaaaagttattatattttgggacagatagagtagctagagggttcacggtcgatctgattgtctccctccgtcccataaaaaaccaatctagtactggatgtgacatatcctaatactataaatctggacatacctctgtctagatttgttgtactataatgtgtcacatctagtcctagattcgttttttcggaacggagagagtacgtagttaaagggggaagaaaggcgttaggctgatatgtatatatgtatatgtatgccatgctctaagaagacgcatgggtaggtgtgcttttgtttcagaagtactccctccgtctaaagaaaccaacctcgtactacgacgtgattaggatgcgtcacattctaatactaaggttgtatttttttttttgcggaggaagtatatggttcgactaatttctgtgataaggtagatttatgagtgcgatctgatcaggcgcaatggtgcacacacagttgttgcatacacatatatgtgtacgatggatatgccatgtggtgctgatggcgattcgtgtctcgatcgatctgtgccagggcctgcattgtgccggccggccggctgcagcgacgaccatgcgatgcagggcagaataagcgcctttggagcatgcaacctaactccagcttgcaaaaagggcgtggcgacaaaccgctagcggagatcgaacatgcaacatgaatgatcatgcgcgggggccatttcattgtttgatcgtgcgtgcatgcgcgcggttgcgcttggaccggccggccgagcgcctcctccacccatcgatcgctttctctgcagattggaagcagactttatattaatttgtccctccagggacatcacatcgttttatatatggcgttcaaaaataataataaaaataaaatatttatcaagatatatcaatatatgatatatcttttcgcaaacatacgagttaaattttgacttatacaattcaaaacaaaaataatatgaccgtgaattacacgttctattcgtagtcaaatttattatttttatttctacttatataagttgaatttgaattttttatatttatgaagtgacatataacatattaatttatcctactatatttttttcaattttttttataacctaaaaatggcccaaccatcatcacgctcatcagctcatgcattgtcgctcgataggtgcagttgggagacagtagtagagattcaggggaattgaaacaacatttacaaacaaattaagtgcaaactctaaataatgagatctgctttaattaacgaactactccagtatttaaccgtatgacgtcatacagtcgactgtgctagcgatattttgctagcggtgcttccatatttagccatatgactttgtgcatagttagggcaacgctctaaacagttaatggaggtatgtattattcatgccacgttttcaaaattgcgctttttgggtcaaacaaaattcctacatccacatttgttatatttataatatttaggacctgttttagatccctggcaagttttatcaccatgtcacatcgaatatttaaacacatgcttgaagtattaaatatagacaaaaaaaactagttacacagattgcgtgtaaattacgagacgaatcttttaagcataattgcttcataatttgacaatatggtgctacagtaaatatttgctaatgagggattaattaggcttaataaattcgtctcgcagtttacatgcggattctgtaatttgttttgttattaggctacgtttaatactacaaatgtatgtccgtatatccgatatgacacggcaaaaattttcacccctggatccaaacacagccttaatctaatttacccgtatatgagtaactttcatccagtcataattaataaatcaattcccagttagaagaagttggtagaatagtcgatcttagggtaaatttaagataagctgaatctatcgtcatttctttactcatttggcattctaagattataacttaacaaacaactgtttgagataacctagctaattacttcctccgttttataatgtaagtctttctaacattgtttacattcaatatatatgtgtgtctaaattcattaacatccatatgaatgtggacaatgttagaaagtcttacattatgaaacagagggagtatatgatttcaaacggtaatgctacataacgttatctcattccaaggcatggaatgagatgctcttatgctctttcctccgcaaatgcgagggaggggcacgccttgccgctgcatggttcaaccagcgaaaccgcctaccgccaacactattgcctcttgctcctcttcctcctccgcagatcctcgccaccgtccccatctccgcatgcgcagtcgcctccctatgtccgcctagcaccgccaaacaacgagtaatacacaatgtgacgatgagcctgagcggcatcctctagagtctagacattacggagcaggacaccaaaatgccttgctacagttagagagcttaatttgccaatgacttgatgtcctcctcctcttccacttgaaagaagtttgcgatggacatggtagccatgagcctcctggattgattttgatttgagtcgatgtatttgctacatcctcttgcttctagaatcaatatacttttcctagattccgagacaactgtatgggtacgtacttgtcattgttgcaaaactgggctaagtatgcaaggtggctatatcttgattcatcatggggtagtgctctcttgagaatttacacctgattccgagtttccgacatgtattaggcttgatacacctaggtatcgatcggcctgttaccggatgatatcatttttgtactgatgggtatcacttggtacaaagagggggtatcagatcgatctggtaccggattggcgagtagtactattcaagatgctctagcagtcccctgattcaattatgcagttagcttgtggaaacactaccaaactctcctcttttaaacatgatcgatgaagattcacacgcattattatttttgaacagtattagagcatctgaagctctgaacatgtatggttcatcttcatccgtagcaaatgcatgcacaggagttcagctacttccttatttacaccgttcctagctgtttgaagctgcaaatccggggctggcctgtatagtactacacatatacaccacttggtgtccattaatgtcgaagcatgcgtggcccatttgtctccgaccatgcatgcatgggtactaaccgtgctagcagaggtagattaatggaaaggccagtatatatagcagagtgtgcgtacacatgatcagacagaatgaatgcgtggtcggtctcgacgctgcgtgtagttcctttcaaagttaaaaatttaggttgaaattggtatgatgtactgagactgaaaagttgtgtataacatgttgatgtgatggaaaaagttggaagttttgatctaaagacagccggagcttaatttgcatgctcttcgctgtcacactactacacgtacgacctcgctgaacaaccttagaactgcatgtgatgaatatctagcgagccatcatgccagtactgtgtaccgtagcctgaatatatgcatgcatgcatgcctgacgagctgagtgatcgatcgatggcagcacgttgctgacagcaagcatgcatagacgagatgcatgcatgtgtgatcgatcgaggcgctagctgccgcggtgatagcgtgcatacatgcatgcagtagtgcagagtgcatgatcgaggtactcactccgtttcaaaggccaatatgaacattttcaggatttaaactttattaccacataatagcattttctaacacctaagacattaattccaatatacaaggtgatataatcgagggaaaccaagcaaatcaaaatttaaaatttaaccattaagatgactaatatagtacattttaagctttacctacgctaaacaatatagaggtgtttatatttagaaacggagggagtataagcatttataggatatatataaattttgtaaatactattaagtatttttgaaacattaatttcaatgcacgggattctaagcattttttaactaacaaaatacaagtgttcttaggggtgtttatgagggaacttaggcaattcaattttctttaacgaatcagcacagaccgtgccaatttcattaaatatagagggagtaaaaatttatgtacacgaagtgaaaaaaatatgagttgtacaaagatatgctagggcatcatcaatgattaaggtcgctaaaggaataaggtgggaaccaatagtcttttcttgatcttgagctaggacccactgataaaaaaaactctattcagtagaaataaaagagcatcatacatgttgcaaaggcgtgaactatttttttttattttttatgatctaaccttaagcttaagattgcccatagcaatattccttgctttgctactctcctaataatgcataaaggtagaacaaaaatactactttattccttaaggttactttgcatccagtattagcctgcaacattatagatgccctatgactcttgctttatggtattagctgcgctagccgatctttacaccaacgagcacccaagttttcccttcttccttgattttggctagaagcgatagcataaacaacctcttttgctaaaaaaattctcttgtttcactctttccagatttttagcaaccttatcatgtttgtctttaaatttgttcaacgcggtgactgaatattttcctttatccttaatttttggcaacctaatgatgctttatgttttgaaacgttgggagtagtagctactccctctgatcccataaaaaaccaaactaatatcggatgtgacacattctaatactacgaacttaaatatacatatgttcagatttatcgtactataatatgtcacatccgattctagattcgttttttataggacagatggagtacgtagcatgcaggatgcagccaagagaacccatccgtggccatcgctagatctatccattaatccatgcatggatcgatcgatcgatgtgcagaggctgcagacatgcgtacgatggcagaaggacacccaaattaattaagctcgcgcgcgcgatcgatcgacgatcgatcgctatagctactagctatgtggatgagagcagaaatcgataattaattatgacaattactactgggccggcgacgaacagacacagagaaccacgcatatctgcagctcgatcgatcacactgatctgcatctgcatcgatcgcgatcaatcgatcgatcggcggacggcgtactgccacctgctgctgatcgaactgctgatatatgcgaggccattgcgcctacgtacgcgacggcatctcatgcgtcgtcttggctggcctcagctcaaatggggcgggagctactgtcttggcctcaggccctcagctgaaatggggcgggagctactgctagctgtgagggtagtagcttgattgctgctacggatagttcagatgatattgagactggcagccatgcatgctgctgctctgctccctgcatgcatgcccaagggctgcatacccctgcatgcctggccggcctgtatacatcgatctatccatatactacatgcatttccatttcagcttggtttccaggggcagcaggcaggagagggaggctgctggctgctgctgcagctagcgccactgcactgcacacacaaacttaaaggtggcctttcattcattgcccctcgctagtggccgctgtccccaacactgctcctctgcctgcctccatcctccccccccccccccaccacacacacccaaccacaggaccacctcttcgatctctctccctcctttttcagctgcaccagctgcaactctctcctctctctctctctcaccgagctgcattgccgcagtggtcactgctcagatcagagcggtgaagcatgcaattactggctgactagctagctgctgaaacgagctcaaaaggaaagagctgagctgagccgggcgcgcgggcgaggcagcatatgcatgcatgttttgtatgatgggcaatgaaacactgcaggggcaggcactagctacttgcttgactgtgcctgctcacaggcagctagctgtgcgagcctgcatgtcttctagtgtgcctcagcgaggaacagagatatggatattactcgtaaagagattggtcctagaaacagatcgatctgcatgcatgcctttcaaaccccaaaacaattgtttgcttgggttgcaaccatatggtggaaagctgtcatatatgctagtattgctcatgtatgtttttctcacatttgcagcaggatatcgcaggtgtttccatggccaatttctgtgtgtttcctacagcaattatggacttacagcaggtgtacatgtgcgtgacccagttcttttttaattccatcaccaccgccctcttcttatattcattcatccattaattcctgtgcttgctatccattggggaccttcagttagtttgggccctctgaatgagttgtcccaaggaacaatctataatgatgttctgatgactgccactgcatgttgtggtgtgtgtttgtcgccttgatgtgtctgtgcatgctagtagtagtagtatattgcaataaaccttttgcacacaagaaaggggagaatgctctgaggcgagacatggatgatactcctaccgaggaggatcatattcataggttttgtgcggtgcagtgcgtgctagcgcctgctgcaagcaggcatgtatcaagattcaagatatggcatgcaagatgctttgcacttttttactgtatctgggatgatactatatactcgtactatgcatgatcgattctcgcatcgcatgcatgcatgagcatgactttgccaatgggatgtcagtgatatatgcatggctagctcatcgcttctgggtattatgttgcagtgatgcagccttgcttgcacggcccaatgcaacggaaagatcagaatatactctctccatcctaaaagaatttctatcctggctatgaatctgaacacacaatatgtctaggtttctaagttaagattgattttttattggatatatcattgatctcctttcacatactcctacctactcctgaacaggcacaattaaaaatggtgagaaagaaagggcaagatcgcaagaggaaatgtcaattaactaaataaataaatatataatcatcagtgtcatattgtgtgtgtatgtgtgtaagaggaagataagggggagccgtggaggcacaggtgagaactgagaactatgctcgatctttgagaacgtgagaaacattgcaaatgatacactgctgattctgatgggtatcatcgtcactgggtggtagctactattcatatggccaccgtataaagcagctagctagggaacattgttctgatttatgacatgcaccagctagctagctagactgatatttactccatccatatatgttttcttcatccatcctaagatataaagctgctccctctatccgtgaatataagagattatactttttttttaagaattaaggaagtaagaaaatgacatgtgatgagataaaatgtgatgtgtgaaagaataaagtagtactctctccgtcctttaatataaaatcccttatattatgggacggagggagtataaaaattagtaggtgggagaataaattagtataaaagtagatggtagatgaataaattagtacaaaagttggagaacatgatgctgtcttggaattctaaaaccccttatattttggaacaaatttgataaaaaaatctcttatattcatgtatggagggagtatacctctgcagctcaatatacatatatatttcgtaagtacatataacatctctctaaaagtgttatatataaaagtttgatttattttaaataaagcaataataatattgtacgcttattgaggatacattcaaaattcatccttttgtgtcgaaatgacttcaattatatttactcctccgcttcatattatttattgttttagctttgtcctaagtcaaatattcctaagtactttagctatatattaattttagatattcatatagtttataatatatgaattatttatgtaatgaaagtatttatcatggtgaacctaaaacaatactaaattttataaatgttaaagtatataattttctaaaaaaaggtcaaagttagtaatatttggcatatataacaaagctaaaaacaacaaataatttgaaacggatggcataaagtattttaaaggcaaattattgggtaattaaaaatagtttgacttaacataacgggagagatattaattagtaattaggatagcttgagccagcattatgtatttgatactgctaattagctagagcaatgaacaatcaaaatcaaacaactgaactgacctattgctgacagttttctgtgagcatgagaagatgatactaatcccaaatccttttccttttcatagaaatgatcttatctgattatttctcccttttttgggtccaaatttatgtctttactgaggataaaagtaggtgtggtcctgctagctactagttgatgctcaaaagatggatggtccctagactaaactagcctcctagatttcgatgttgaaagatttgtaaaggtactgtattttagtgggaagaagaatattattcaacaatctaacaaaattcaaaatcaagtatacatactacctgccactaaatgttgatttttttagagaagggtatttatacccagcctctaaatccaaccggatatatgcagcctttttaatttagaaacttagccctcaaataatccaatctaaaatttgcttctacgaaaatttgaactcagcatcttgaagtgctacttagttcactgcaaccactagattacgtgccctttcacaccaaatgttttgatatataacatctaaggatcttcctttttgcaaacaactctcatcagctttcaagaccatactaattcaaagaaaaacaattaaaattccagctgatatagctatactcatggaacactaaaaactctttaattagttcaacctaattaattcaccagacgaagttagtgtaatccgaggaatagaaggtgttctatgaaattaagaagcatatctaggcattggcatccttgtatcttgctaatctaaccccatgttaatgctagtagcactttgatttgttgtccactgcacacagggggtgctagttgattaattaggtcaagcgtagtttatttcatcgtttgtttgatggcttatatatcaaccgcaacaaaatttaaattttaaaaattatttttaagttgatttaagttttttttactatagtttattttccagcgttgtctttaaattgttaattaggaaagttataaagagttttccctcaaaataatagttataaagagttttctcttaaaaaatagttataaatagttttatctataaactattttttattgcctagtcatagatcgagcaaacgatgcatgagaggtttagccaggtcaagtgtacatatgtaaatttaggaaagcatgtatatgcccgtatatacactccgctaacatatggcattgagcttaatgagcttatcagctcgccaggtcagctccgatcctctgctggccaaattgccaatatacgatctatacgatcgatcgatcagggagagtgaagtgagccgggggagcaacaagggagagagcatatggtggtaaaaggacagtgacgcgacagcgacgacgctgatcatttattcctcagtgtaaatacccaccacaaagcttcacaggtcgtcttccacatccttctctccgacgacgctacctagctaagctgctgctctgtagctggcaggctagggtttacgctagctgatcggagctaccaccaacgccggtggttggtagctcggcggcggcgggatcttcttcttgctcgggttaattggcgagctatatatatatctagctcatcggcgggaaggggaaatctcggctgacttgaagggatcggaggaggccatatatatgcatggctgagttcttgtaagtgtttctctctctgaatacatctggagccggtttgggtgtttgatttgttaattcttggcgattattctatggatttggggatcacaaaattatgtgtgtgtgtgccttttgagagtttttaatctccccagctttccgtggtccttgattaggattttatgctgtggatctgagcccagatttgttaattcttcttcaattattttctgtgagactgtacaattccctcttggatttctttcgtacctgagttccatttctttttccatggaaggtttcttctctgaacctgcagtactgggtcgccaaccaaataatctttgtttcaattgcaccggatcgcctctctctgatccttttgcttccggaacgacctggttgatcgatctgtcaatttaattatccattttgcccactgctcttcatttttttcctttttttttcctgaatatagtgttcagttctaggaatccccaactgagtaaattaatcctctgtcaagcctccaaaaaatttcacctttttcgctcgccacacaaatttcctccctcgatcgattggtttcaaagagcacaatttaaaagctaatgactgctacagttaaagactgggtgcatgctgcaggccctgcaggattagctagctagcaaaagctattcgtctcggcataaaggctagcactcaatacaaaccccccgacccagccttctcctgttcctcattcccatgggcaaatagtgatcctttgtacgatccaattcatagctcttcttcccaccggcgagacgaatcatgcatggctgctcgattcaatcatggaatcatatcattcccacacatagtgccactgctgatggctcgcatgcagctcacccagctagagctgcaagcgcagcagggaagagccggtctttcgatctcgatctcgctactagctactacctaggtagatcgattgataggagtagagatatagctagctgttgctcgcaaatacgcagcgaataaagctggctcgctttccccattccccaatggaacagtgacacaagcagagagagagagagagagagagagagagataatccgtcgagatcgggtggtagacccttccgtgcacaggagagatttatttaccccgggttaattactagtagtgctggttgattatggcgcgaaatttatgctaatcagtctgcatgcgatgttactcctaattaattaggtgttgttgtgtgtgtaatgattgggtagctagctagctaggtggatcgaggactgacgatgggaggatgagctcgaggaggcgttgataaggatgatactaggaagcaaccaagcggccgccgccgcggctgcggcagctgcggcggaggaggaggcggcggagctagcgaggaagcacacggcggcggtggcgacgtcgcggcaatggtcggcgcagacggagtcgcggatcgtgcgcgtgtcgcgggtgttcggcggcaaggaccggcacagcaaggtgaagacggtgaaggggctgcgcgaccggcgggtgcggctgtcggtgccgacggcgatccagctgtacgacctgcaggaccggctggggctcaaccagcccagcaaggtggtggactggctgctcaacgcggcgcgccacgagatcgacaagctgccgccgctgcagttcccgccgcaggaccacctctgcatgggacaccaccaccacctgccgtcggccatgccgctgatgcaccaccacggccaccaccaccacgccgacgacgataagtaccacgtcgcggcggcggcggccgcgctggccgcggagaaggaggcggcggcggccggcggcggaggaggaggagggggagacgacgtcgacggcgggggcggcggcggagcggcgcacatagtggggaggttccccgccggtggctaccaccggttcatggggctgaacaacccgctggggatggtcaacagcgccgccggcgccgccatgccgttccactacgccggtgagtcatggaataatggcagcgtgcaagacagcggcgccggctcgccgcaggtggccgccgccgcggctcaccacacctcgccgttcccttcactgctttccttggctccagggccgcatcatcagctggtgttctactcctccgaggccgagcagttcacagtagacaaccttggctcgcagggcttgtccctgagctcggcgagagctttccatgatcagacaggaagctaagcaagctcgatctacacagtacacacactggaacaacactcttcgatcgtcgacaaggtaaggatcgatgagctctaccaaaagaacaaatctaagctagctagtgcaagtgtgtgcattgctttgatctatgtattaatttctttcaagggaacaattaagcttgtgggttaagatttaagaaggaagatactgccagctagctggctgctaatttcttttgctctgaaactagggcaagaaatatgcagggctttgctgcatatgcctgtgtgcaatacggatttgttacttctttttatatgcaaagaagtaattgatgtattggcttgtgtaataattaataagttctgaattttgaacctttcagttctgcctagccttaattttctttattttttcaaaagggaaacttctttgtgtgtgtattcagttttctgacgccgttgctgcatcccaagcttcctggctgtacacaaaacattgggcaatgaatatctggttgacacactgcatactgaggaagtatgtccctttttccagttcattctgcgaaatataaatacactccctgcaaaatactaatttccttccaggtatatgtagactgaaccctgaagtatacattatttatattctaaatgtgaaacaaagaaacttacagtggatatttcttaatgttggaaaaaaaatgctggtttcttatgtgaaggaagcatatatatacacatgattatttttcttaactgtcccaataaattaaaatggtatttttaaattatttcagaaacatggaaatagtatagtgtgctttgatgtttaaccctatgcttgaatgtttttcgaggaattaaaacttataaagggctacaactcacacaaagtaaacaatttttcacctcatgcatatatgagcttgggtaatagtcaatccatgtgattccacaaggctattaattgcagtcataatatacataatgcaatgaaatatctatatatgggttaatggatatgtatgaataatacatacatgcgtcgtcattgtattaatttgagatctctaccagtacaattaatcttacgtgtacacatcttgttattttgaacgacacatgaggtcacatatatatagctagatatataccgtgccaaagtaacaagataaggttctatctgcaggttaatgtttattaacacccaaacatctttacaactcctacctagctaagtttaactagagaaggaacctctttacaactcttaccctagctagttcagtttagagtttaggccgcttagggacatggtccacatgaatatatagagttatgtaaaatagtaggcattcttccatgaaacacattgatagtacatgcctacaattatgaaaacggcaagcagctcactgaagcatgataggaagataaacataatctagctaagcatcatcttattgttgtacgtacgtgcaagtgtagcattatattgcctagtcacaaataaattaagaacttaatttagaagctagtagcaaagtaaattcgaagaggatgctgaagtacccaggaaaaagtatattgaggctaggaaaggatcagcacaacgttgcaattaattgtgaaattgtaaaaatgcagcaaaatgattttcgatccatttattaattaggtcaaagatacgtataaccgtaccaactgatcaaattgatgatcagattgacatgtgaaaaaggaggatcaataaattatactcctagtatatgtattggggcatatatgttttcacttgattgataagccggctaatcctatatagcttaagaaatcatcaattactatgttttctcatacgtattattgtcaaattaatatatatgtcaattaagttcccaaattaactttctcagtcaaattgatctgctcctcactaattaatttgccaatttgttatgaaaaaaatgcatatgctttacacttttcatttagtatataacatgattaaaggcagattttaccgaaataataaattaaactaggtacaggaaatcatatgactgacttgagttgatataaattcaaataaggaaatattggtcatgtttatttcttaaaatacggacatgtttaagcaaagattgtgcttatcacatggaagatggaacttccttcaagaaaaaaataattaaacttaattaatggtagagctgaaaatgcttttgaagttttatgcggcttgatcgatcccatagaaaaaaaagaaaacaatatgattgtatatatatatataccattctttcattactctatatactatatctggtttcaaataattgtcactttgagtcttcgatcatcaataaatttaatttaatagttagattatgatgtacaaaagtttcatgaatatatttaggatgcaacacactttgttcatatggaatacttctaagcatttaaaaattttcttaacaaaagatgaatggtcaaagtttgaaaatgaatacaatgacaagtatttgaatactcatgaagtatatactccctccgtctcaaaataagcgcaaccataaattttcgcgtacaattttgatcgtccgtcttatttgaaatttacgattagtatttttattgatattatattataaaacatgaacaatactttatacgtgacttatgtttttagtttttttttcaaaaaaattttaaataagacggacgattaaagttgggcacggaaactcatgattgcgcttattttgggacggaaggagtatatgggaaatatatacattcttcatttcatatgaatagatatgtgcacttctggaaagtcaaaatgacctcagatccacaccagttctacaaatataaatatttatatatagtagaaaagatgcccgtgcgttgcaacaggggaaggttttttcatcttattattgttatacagtttagttaaggtaaaattactgtgcggattcgcttggatatatatattttttagaaaatcatgagctacagttaggatcgtctcaagttagcatgtgagtttttttaatgagatttcttatacgacgaattctgtatttccaaaagcgaacgaatttaaaaactgactcaaatacggatatgtatttttaaaaggaaacttaaaaaccaactcatacacagatgacgtaccaaaatactggtaaaaacattttaaatttttataatagtagagaagagttatacgtacttgtttttcggacaatccggttttcagagccagctagtacaaagtatttcagaagtcaagacctgtcctcagatgactacactcattatatattttgttcgtgcatgcagaatgcatttaattctagacgattgttggcgaaagaaagacaaactgagcagctcaaacactgttcacaccatacactcctacctgttgggactagctagctagttagatggtcacagctcacaaaacataatggtaaagtagcgatgtaaagagagcagtattaccgaccagctcgctagcacattcaactcgaccctgtactgatctgtcctctatctctctctctctggtagatctctgacccgtaaacatcatcctgcgtcacccccaccagcaacgggatgcccaaagaaaacaacaaaataagacacggtggacacactttgttggcgcagacccaccaactaacgcacagccagctagctgctagcttagcacaaacctaattaagctagaggctagtatagacaacatgcatgcatcaacataatatgcatatcacttttgtaaatggtaacatgcctagatagctagcttacctagctagctaaaagtaccaatcgtgtaaaaggaagatcatcagcagaaaggcatgcacagttacacgcaagaaattatctgttaatctaatcacgggtactgtatatgcatgacaattactacacaaccacctaacattcttaactaagaattatccgcagcagcagaagcagtggtaatatcctactccctccgtgtttaccattcgtcttattcaaaaaatttaagtaattattttttttttcatatcatttgatttattgttaaatatactttcatgtttacatatagttttgcatatttcacaattttttttgataagacgaacagtcaaacatgtgctaaaaagttaacggtgtcaaacattttgaaacggagggagtaattaactagtactatggatattccacaacgatctggagtagttgttttagacatatataggctgctccagtctatatagggcccatttggaatgtaatgtattatatatacaagaatttggatgcatgtcatgcatggctagtttaatcatacaagaattaaacatgaagaatcgtttaggcactgaaatttgcagaaattcttaaagaaaaagtctgcacaatttatcttagacacacacacacacacacagagatcagaaagatcagaatgctctgaaacatctcaaaggaaatgaaaatatgaggtctcagcatatgtttgaagtcatccaaaatatggaggaaggaaagggattccatggtaattttcaatctaaaaaaatccgataattcaaaaaggttctacaggaaatattctatatagtttaagcctatgaaaaaaactacacatgcatctcttaacaagtcctaagttttagaaatataatgttcctcattgttggattactactgtgtaataatgtaaagttttctaagaaaagcttctacacaccattcattaaattgagtgggtaatacacaaagacctagctaaccacaaaatttaacagtatggtgtacgttaagaagcaatggcaaccaacagaccacaaataaattaaaggagaagagaacaaaccgaacaagtgaacaacagctataagatctcgaggcacacatcaaagatctccatactgaccatatatatgtagccaaaaatggaggcaatgaacaactcccactgtactccaaattaacaccggagcagatcaacattctcgacaactttggaggattgattggtacgaccagtaaattatggtgaagacaccctctcatgctttaagataatcggtcccatatttgccaagcaaccttggtgaaaatcataattaagacgtactatcaactcgcactgaagttcttctttgaaaattctgtcttacatgttgagccaccaatatccatgaatggagaatcaccgtgcggcataagaaaatcattcctgagacaagaaagctagccactgagatactagaatacattgacaatgtgtatgtattagattaatattattcaagcaaacttaattaacccaacatgacagttattcttcttgttgtcagtcaccaccaatatttgaccgatcactaattggtaattaagtgagattattaattagcagaccaaacagcagctaagacctgcgtatcagcggttcattctgcgtgccatcatcctacccatttgaccaagaggaaagcgagcactgcgtacgtgggggtcactatctcatcttgcgtgccggatcgatcgattgagagcaatatatcagggctaggtagatctttttccctccacgtacgcacctttgccaaagctgaacccaaatcccaaagcgacctttcttttgtgcactgatctaacaagctatagctactcgatcatctgcacgtatatgtgcttctctgcttatttggggaaaaaagacgctgttcccctgccttagcagcggctactactagctagtagagccgaaaacatttcctgacaaaaacccttccaaacaactcctgctgtctaccgtggacaagaccctgcagggtcaaagacaagctaagagtaattaggactttgtttcaaaaagaaagccagggttttgaagatactacttcgtaattactaggacttgagccttaggagttaggctttagctccataatcctatttacatgctataaaaaatactatacaataattcaaaacataaattaagaagtagctaccaagggcacattagctctgctctaggttcagctctacacccctgaataaaacatgaatatctgcaaagacattgcccagctgagaaaagacagccttttggttgatttgtatatgtacacatgtatatacagaggcatatatacacacacacacaaccatgtcttatctttgaatggcatacctaaaacaaaaggacaagcatcttaagtttgcaaaaattttgtctccgtgaccaccaatcatctagcctagcagttccccaagaaaaaaagaaaaatcaagctgctatagctagcaagcagcaagcgaagggaagtgaccagtgagtggggttgatgagtagtaaaagaccagcagtggggctggctctgtggctggcctggcctggccggggggctggtctttggaggcgagctgagctaggccccctacggttaaagcgctctctctctctctctctctctctctctctctctctctctctctctctctctctctctctctctctctctctgcgtgcactgtgtctgcatagccctgtagctagggtttgcatgcatgcagcaagcagttagctaagcagatgtacccttcgtatcttttgccacggagagacatggaccaatatataccctttcacatgaatggtcccctgaggctaccacgattcctccccacatttttcctatcaaactcatcttcctttcatctttagtttcatccgtttgttaactttgagtatagctaactagcttagcaacaaaccggtaattagctagactagctgttctcatgctggaaaagtaacctagcctacgcatctagtaattatgtaattatatgcatgcacacacatgaaccgattttgatcaacaatgtagccaactagctagagcaatagattgcacgctggctatccttaggtgtgaatatatggtgtatggcagttaaggttgattattattaagggagatgatgatgaactgtgtagtgtgggctgtggcaaatggatgtgtcttgcatggtacgtgacagacgagcaaattggacacacgagcaatgatactctcgtaagattatgctttggagagcagtataggggagtggcctaccaaatgcatagcctgtaccatgcattatcctcatttcgttgatcactctttcgtttatctcttctgtagcatgactaattctatagtaggtacgtgcgctagccgctaggtacagatcgaaccgtgagtttcttaactagaaatggggagaaaagaaaatcagctaccttaactagctgctaccaacctaaattctgtaagcagatgcatgcatttcattaattaacagaatgcgatcgatgcatgcaaagggcggttgctcctcgcggtattttagtcgtcaaactgattctccccatgatctattgcatattttgagctatttttcaaaaaaaaaatcacaaaagcttaattaagtggaacacaaaaggcgaacatattgcaactgcgttaattcgttttttattaagaaggaaaaatcacttgaatgtcttctgaaggccgtcgtacgtccatatcgcgaaaaatcagtgtgttaaccgacggtcctgacgaattctacctgtgaaggaaaaaaaacggttccaatataatgtagtgattgcacgtgtacgtataactactgcagcatacagcagacccattgcatatgtacaattaacctggcgctacagtatgcacgggtattacttcctccatcccacaatataaacatttttagagttaaacatggttattaagaaaagtaggtacaattgaatagaggagagttgtaattcgataagtggaggtatgtggaaaatttgaatggtggagggttgtgattggttgagaagacaatgttagtgtaaaaattgttatatgttgggacaaattttagaggctataagttattatattttgggacggagggagtacctgacggaggattaattggaccttgttcctttgcagctgacgcatgtgtgtacaatcaacctgtcgccggcccttaagaggctggtacatctgtgtttgcagtggacttcgagctgggcctgcagcctgatgggccgacttataggctcatcaagagaacatgcatcgatggttccatccatgccaggcgaggcgactggcaaatggtaatactgatgcgtgacacagccggccgcacagcacaggtgtaccgcgtgtagcatcgcattatcattgcaggatagagcagtagtggcgagctaaaccctctccaacgcagtcggaccataataaaccaactgtgccatctgcttggagccttcgatcccgacctcccgttccctggcaacttctgagcttaattactacagtaccatctgtccagctaattatagcacccgcttgcacgcgagcagagacatttctgcatcacacatgttagtatgctattgacaaattgtgatgaccagccatgaaaatgcccttgcaatccaccacagggataaatgttattatgttaaggatggtttcctgccaatcagtcaacaatatctagtacgatgctaccgagatattctccaggaagtttttaagcattcctacatcagagacttggacgagtcgcatggtccatgagtaactcgtcaaatgacatgttgcaactatcagcccaccagatggagtacatgatcagatccaacccttcctgattcgagcccatgcaagagcagctattagggcaccacctaaatgagaagtacctgatacctgaccttgcctctaaaaaataaacagatatcagcctctgtacaactttttttggggaaaaggaagtatatatataaaaagcataaattagataaatgtaatcatcaagaagaaagatataaaacatagaatttcaactagccaggaaaggctagtacattctagaaacagaaacatcacatggaaaaatcagtaaaatattcctagccaccctaaatgtgaatatcaactttttaaaaaatatcaggttaatttaagaccagagctactgcaggcaggaacttcacagagtaagcgattcacaaaaatcccaaaattgaaataaaaatgaaagtagcagtgtccaacagctatactgtaatgcatctgctgaaccagcacactaccacagtcaaaactcatggaaaagcaacagggtagcaccaaaaaaccaaaaggagcacttattacattagcaaatccacatgaaaagaagtcacattttaagttactgcataccttcaccctcagcaaatcagcaccgatcaaaatagccccctgaaaagtcaaagagtttttgttttacatcatagcaaccatgcttaacagaaagttttgaagaaaaaaagcttctcaccataattgcagctggaataggaatgaagaagtaaagatagactagtttctttggatacaaaaagatgtcaagaaggataattgcattagcagcagcacttgcaccctgattcacatgaatataataggttatgttttgggtgtaacaagtaataacttagtactagtacaggtagagatggcaacgggtaatccccgctggggaatacaacccatccctatccctgcgggccacaaatttccccaccctcgtaaactgcaatcaggaacaattttcccatcccaccccacgcggggaattaatcctcatggagggcccgtttaaaacaacatatacatctcaaatcgaaatgtaattaacaaataatatccacactttatataaatatactagcatatatccactaatccacgtgacaacaacacaagatcttcatccactaattatggctcgattggacctttaggcctacataatttgcaatggacttggatccctatcccgatttttaatcgggtatcctcacgaaggacagggatgggcaacagaagatcatccccgcccatgctagacccaagggggcataagtttttccacatttaatttcccgtggagaatcagttgcaaccatccccgtcccctgtggaagaattccctgtgggggaacagggaacgaggctccactgacatctctgagtacagtagcaaataggatatccctttgttggctatatatacattaaattaaactatcatagcgattcaaatttgcagtactgctttttaattaattatttgggtgtataagatgaacacataataggtaggtgggaaaaaatcgctgccatcagactactgatgtgattatgtcataataatgcttgttttctgaataccagcgcgaaataaagtgaactgcaagaacaagaaatcaataaatcacatacaagcgcaggagttcttgaattgtcccatccgccataaaactgcaaaataaatattacatattagattagggagattattgcaaaatcataaatattgaacccttttcatgcaggatatgtcccacacgagtgccaataccaagaggctggttggcatctagtagctagcagcgaactaccaggtactagcattttcacaggttagcttttcttaactagaaatcacgttgacataggattttgtttcagaattggatgacataggacatcctggtccaggattagaaatcctggttccctgatgcataagaattcacatcatatccaggcttacctgtcttcgtggagctaggaaggctttctctagcaagaagaatgcagatccagcaagtgctcctgctacgtacaacttcagtagaaaagcaggaccaaacatgttggaaatctgattcacaaaggaaaaaaaaagcaattcagcacatgcaatataagtaataaatggccaatagaaaatcagagtacaatatatatactagtcccttcatttggagaacgaatcttaactacactaaacatgataaatagaaatactaaaattagaagggaatagttatatgctattgattttgtttttataaaatggataaaccgtatctagtacattcaaaccatggtagacattgaattcccatggcaaatcattgcaggatctctctacctagctggctatttcatcagacctgaaaaacagcctcacatcttctcctgcatggtgccttcatcagtcatcaatacgtacaactctgattggctcggttgaataactagcacaggaaatgtcaataacctctctgtgtgtctctggactgatggaggggggcttggcaatgaagtattataactcttcattacatgtgacctttgcaagaaactaatgaaacaaagaattgttttacaaacatcaagccaattttaattttttttactagagaaaaaatataatcaaaatttgattggtcaaattcaataatgtcaaaataaagaaaaattgctagatcaaattcaatactccactaccaaatatattactctttcttaattttacacggtcaagttcacccagcatgaatcatgccaacaagttgatggtaattcagacttgcttgaaatattcaacaaaagatgctggaattcagatgagcatatattatagcaacaagatcatgtcttggatcaagtgttagataatgtttttagtctacactcaacttatgattctttgactgatttgataattcaaaacagctataattcaggtgtttcagaaagcaaactagtaatagtaatgatttccactatattgacaagtcaccatatccattcctttgtttctatttaggatttgagaatgcataaagttgcacataggtgcatagaaggacaaactaatcctttttacttgtcgtttaggacatcaacatagtcaccaatgcacttgtttgatcattgttttttttaatcatatatttataaagattatcgaagataactacatgaaaatcatgaaaatctgctgatgtcatttgcacacattaaatcttaatattttgatattaaaatgttatctatttgataatggagggagtacagacttctgcattgtaataacaagagagaatggtgagcagctgaacatcttacacttgatccgaagaagtagagaccgatcatattgctgatgaggtgaccactctctgcgtggctgaaggcattcgtgagcaacgtgtgtaacctcccgcttttgaagttatcaagagaaatctgctcatcaaacaataatcaagccacacttaatcaaccacttctgaaacaaaagcagaagctcttcgactgatcactaaccataaaatgcctcctcatgaagctaggatcagccaggtgccatagcatgaacacgcccacattggcgcccacgagcatcaacactgccccatcggcggacggcaaccacttcgtccttcattgaacatcaaaaccaacccaaaaaaaaatcactaaaccaccacgaaaatcccccatttcaaaccatacgaaccgaaacctcaccaggacacgccgctaaggaacatggacgaggaggggaaccaccccgaggacctgcgccgctgcagcgagaagagctcgagcgagcccgcctcgcgcgcggccatcagccaccgcgccgcggcggcccgggcggctgccgccgccgccgcggccgccgccgcgctcaccggcaggagcgagccagtgctgcgccatagggggaggcgggagggcgaggcggccgcgggactggatggggcgtggaggaatcggtggggggggtttggttggggtttaggtctcggggcggcgcggaggcgtagggcttgctgcgcgaggagcgactggaactgcaggaacctcctccccgtcgccattcccgcctagctccccgccgcctactcttcgctccgccgccgtctcctccgcctcgggctttcgcggcggcgcggccggtggctttgcgctctccggttgatcagctccaatttctcaacttccggcttcgggaaggacacggaagggggaatcgctgggcctactgcttgggccgcggcccatcaaacgtccacgaccgctttccccgcacgtaggccgttgatttctcgatcgaacggctgctgctgtcgcgattgcgtagccgacgcagcgagaaggttttaagggtaggcggcgccgcggcggaggggggctcagctcgaggaggacgacggaaaccttcccggcggcgcgcgagtctcgcggggggaggagagcgatgtcgaagcggcagggtcccccgaagcatcagaaccgctacgcgtggaagcccaacctcgggcagaagatcaacgagaccgtgagtcctcgagccgcctccctctccttctttatcctctttttttcaaggcctgagtctcacggctggaatcctcgccgctgcaggagcccggcggcaggttccgtcctttgtcggagatcaccggcgtctgccagcgctgcaaggaccaaatcgactggaagagaaggtcgggagtccccttctgtagtcgtcgttaatcttagctcgtaattttagcttcttggcctctcggtccgatctgtttgtctcttcttggcagatacgggaagtacaagcctatcgttgagccggcaaaatggtaccttctcttgccctttttcgtaattatcgcactcactcgattgatggaactatggaggagtgggcagtgatggatgctgatagttctcgtttggtttttgcagtcagaagtgtgggaaacggaacgtccgacaggcgtatcacaacgtctgcacgggtgaatttcggctactccaccatgtcgtcttttgctatgatggtgttgatgttgttactgatttctctgttgcatatgctcaatgcagcttgctccaaggaccttgggatttgcgcgaagtgctgcacttgtgttaaagcgcttgtcggaaggtgatccctgcttgtttactatgttgtggtactagtattagcataaccaaatgatatcctaactttgaaacttaggtggctaacaattttctaccattttctagggatcttagtgaacaggagagtgagcgcaaggaactagaggaggtttggttgtgctatatttgaatggagattgttgtgaacgttttcttttgtgctgactattaaattattttgtaggccataagaggtgctagggagagggagaggcgcacacttcttcgccttgtgagtacttactatggcatgtttttaatgatatatctttatctgattaggtatagcgaatgtttgtcttcaagggatgcctaatcacaatatatgtttcccatgatatctgaaggcagcactgcaagaaattagaacaaagattttgtcataattgtattgtttgatttatcatttgaaaataatccccagttcaccacagtatttcgcatatacccttgaatttttcccttttatgtgtttctttggatgcatcgttattttggacaacttaaattatggagatctctaaattatgtgtattctagtattaaggtgccactgcctttgtttcgatgtccaagttgaatgaattaatattatgcaccttctcttcttgtgctattcatggtttttgttgttccaatatgtagcattaaatgtgaatagaactttgattgttttaaattcttgtacacaattgtttgctctggcatcagtggttcgtttaactgtaaggattctttacaggtctttatctggagttctattatattgctatacattaaatctgagcatgtgaatataaatggctggtccatgttctaaagtttcacctgtcttgaaacattttgacctgtaattactaattagtagtatcagttaagattgttttataccccgctccctgtagaatgtaaatatgatctgttaatttagcttttcaggtatggaaaaagaaaaacatagcatgcttgcttagaatggttgcaatatcaagatccatagtacatgagatgtactattattattattcagctttggaacatcaattcttaaacaaactggttgccaaacttttgacttgaaattgtcgagatgaaagtgcattaagattccaaattatcatggtaccttattggaactgaagccttagcttattattctaattttcattttggtaaccaaatggaaatcatttttttagaattgctggtccatttagttattcacgtgaactagtaattccatgcatatttattaacatcaacattttgttgcagatgaacaaaggtggcggggagagcggaccgtcggttccaaagattgctgacagaagtcgtgaaggggacattttccctgctgcatcccttgacgaatatgctgaacaagctagacagcaagatgattcagatgaagaagaggccagggattttgtagaagattaattttagaactcagaaaccttttcttttgcaaaaggatttatatagccttatgtggtgatttacattacatggtgggtaatcccacccactgcggaaaacaagtgtattagttttggcagatatatttccgtctatcagatgtttatcagtgtgtgctcccattccgtctgtgcttgttcaaactgaagaattggaaagtagcatatattgcggtttttccggtttacatgtcttttccccataatgcagcttatcggtgtgtccggaactccggatcagcttttttttattattattccgaggaaaagctcttctattattctcttttttaccaacttattgcgtgcatgatgcccttgaagatgttctctgttctgttcttccctccatgtcaagcgaggttgttttcttcatgtttacggttttatttagcgggctgccaaatttttcgtatacattgaaacgttaaaaagtatactattgttactaaggctgtgtttagttcacgctgaagtttggaagtttggttgaaattggtacaatgtgatagaaaagttgtgtgtgtatgaaaggttgatgtgatggaaggttgaaagtttggaaaaaaaaactttggaactaaacagggcctaagagcacccgctatggtaaagtagggtgctctctataaaacatgtacatctcagcaatagactagattaatagtaaatcacctcaatagtatgtctacataggtatctatagctctctcatgcattgcctcgtttttctctatagactatctctaatctagtagatagctttgctctctctcttcatttaatatcttccaagtaggaaaatatgctgacattgatctcttatagatagcttatagataaccattgtgggtgccctaagagcatgtccaatagcaggctataagccagctgcaaacatattttaaggagataaataaagagaaagaagagcagcaagctacagatttgtattttaaggagataaataaggagagagaagagcagcgagctacagatttgtagctagctgtagcacggactctaagacgcaatgtgtgtttgacaggtgggaccaggtattaatagtgtagtatgtaactattgtatggatgagctattagattggttatagatgaattgtagctactacttagctatactattaagcttgctctaacaggggcttccttcttgtagctcgggttcattaacccaaaaatcttgcccacgtttgctactgtcatgtcagagcatggccaggacatcaaaaccttccataacaaaacacgcaaaaacagtaaacaagtgtctcggcaattcggcatcgtccgccgcccggtgccgttgtgtgcattcgtctcccatgatcccatatcccgtcggcgtcgagacatggaccagactccctccgccagtgccgcacctgttcctcctccccctctttcaaacaaaagaaaacaaacgagatctcatccgaacagtagaacccaccacgtaacgttactctcatctcgtgccaaatcaaagcaaggcaggcaagcaagaggccgttcgagctgcggggacgatatgcaacggccggcccagtcgagatcgggagggccggagggggagtggtgcggccggcgggtgccctgcacgtgagcgacgcagccgcctgcgcccgtcacgcgcgctcccgcacgttcccgacgttgtgccctctgcctgcggccgcgtgtctcgccaaatgggccccgacaaatccaagccgctgatacacaccaatcgctttccccgaaatgccctccccaaagttggaaccctttttggttgccggcacactgcccgcaccaccggtggttggcacgggttggatatggaccagctgtgactattccggcgatcgagtggtgttcttgattataaaccctttgtgtttcaagaaccttttctttttagtttataaacccttagtacatgactgaagttttatgatgctaagcgatatttgttaaaaataaatgatgctaagcgatatgactccactagtatacgagtgttgatttaatgttaaatattatagttaacacttaagatcttaacaagaaagaaagggattgtttagtaggcggacaacggcggctatggctatgccgtcgttgtgtgcgtgcatggcactgttgatgtcgagtatagtgcagtcacaaatctagcagccgaacaaacaaaaatgataaatatgcatccgtgcattatgacagaatattttaaaaaattataacacatctaaaaacctaaaactatttaattaccaaactattcacgtgatgagatgaaaagtgctgagcagtcaactatatcgataatagactataagttttgcatggattattgccccataagcagcgatggcccatcaccgtccaaaaagaagtttttaaagtagtgatataggtttctagttagagaaaacaacaaaggtaatggtcacatcgttaaagatttcataacgatatctttattttttcggcaatagatataacggttacaaagtcatttaataaacattttagcggtaacatggttcacgtcatcttattttgcacttcaatttagcgcacaaataatacacgtggatcaaattacttggcaaccaggggcagcataaacaaagctgactccagagtgagggcattttggtaaactccggacagaaaggcaggcggagtcatccacagtccgcaccattcccccggcgctgcaagcaaaaacatgcccaaaagagcacacaaccttggctggaggcggcggcaggccgaatctccttatcagtccgggataaccccaagctctctctccccctccatccctttccccactcaccagtagccaccaccacatctcgcaaggccaaaagccctagccaccgtagtagtagctagtagctatagcaaggtagagagagcgctctagatctctctctcgcggggcgctgggcagatcgacctggcgatggcgaccaaggggaataagctcggggaggtaatgtgggagcaccggctgcaggcggcggccgtggtggcgctggtggcggccacggtggtgtcgatctccgccatcgggcccaggctcggcgccgtggtctccttcttctggccgctgctcgtctccacggggttcttcctcgtggccgtggccgtcctgctccggatctcgccgcccccctccagcaccatcgacgagtccggcaaggagctcatcgacttcgtcgccgggtgccgcccggagcaccaccccccggaggcggcggaggccgccgtggacgtgcctccggagccggagatctagaaaatcgagggtggcgggcgtggcgcgggcggccggcggaatcagcggcgcctcgtcgccgggcggcggtggggttgtgtggggtaatcgccagcatgggcccacctggaagtgcgtgccacccccggtgtacggtgcggccgtgggctctgtgttagcgtaggattccgcctccgttgtggtccggggtgtacaataccattctcaataaaaacatggcataaattcgtcctagtactactcggtatcgacttccattatgatcgcgtcttgctttgagttgatgcaacgcaggttcgctgtaacgccatgaagatgaaggcgagagtcttaagcagttaagctatacttacgctcgaagaatatgcgagtctgccaatcctcctcgagcctcaaaattctcctcttcatcccgctttagaaagctagattcactcatcgagagctgaaagcaaaagaaatggtgcaattgtaaatctcatttcgcatcattgatgttccgtgagaaaagctataaagacggaaaagagaaatggattgatagtagcgtggtagcaggatgccctttcggcgtaatcggagaccgacactctttcggtgttaaggagttgctaaaccggtcactcagccgtccagttttgctcgtacgcgacgccggttcggacggtcacggacgcgcgtttctcccatcgttgtcgccgtagtaggaccccgtcttactaattctcatctgttatcgagcggacgcaggcctgatggtcactgtcacgaggctgaacttgatacggtttttataaaggaagacgaggccgtcatgctatattctctggtgcataggtcaatgcgtctgacgtggccaccgcgtggtctggtcgggtgcttccatggtgctgacgtaatggtctctttgagctttggattccatggtgacatttcttggcacaaatgaatttagttggggcatttcttttcttgaatatgtttttttttcttgaacaggttgaagcaggttttactagctacgtagttatatgctaatgagccaattctattgattaactgacatcgagaggacgataggagaagaaggtgaccggacaccgaaaaatgcacaaacatttttgtctcgaatggatttgaatatggtcatgatggatgtgaagttctgtagttagtaaatactccatctgttctaaaaaaatgaatctagaactgtccagattcatcatatcctagtacgatatttgatttttcttttggaacagaagaagtatgtattttccaataacttgaaagacacacatgcacacacgtcatcacgcacgcacatcacagtcacacatcctcgcaaacacgctaacacacgctcaaacagaagaggctaacggcgtaactgcgacatcaataataaattctaattgataaagctacaacttgtgcacaatatctatggacgttaggatttaaaaccttagcagacaagattatgcacctatgacatcactaacacatcatcgatggttcctagttagaaaactatcaataacatagcaaacatatttttgacaatgttatcctactaaattttggtgttacttatggtgcttcacagctagccaaatgctacctaaatttccaagaccaccaaatgtattttacacagtgatatcttacaaaaaatgataattttgaaaatgtccaccactaaatatagtactgcaattattaaatgttctgaaccagatttaccgaaacacgtactacttgttgtagcagtgaggactaggtgtcatacctcctattcgaccaagacacgacttcaggccttgatgggcatattcctgagtttcaaagcaggtgacaaaaaaagagttcaagttgctatggacggaaacatgttaattgggcaaatagtattcaagcttgttatagaaaggcaagcggtgcgtggaggatggagaagaagcttggcggctacgttacccagcaagaatattctcttacaagttccctagggtttctagtcctttggattatccatgtaacttcgcatgtaactaccatggctatataagccgatctaattatatagcaacacgatttatactttactgaaatagcgatcatgagtgtcatttgactcatatcaagctcatctcgttacaaggataggcgagggaaacacttcctcatctatccccattatgttcatgacgttgggtcacaacttagggaagactacgcgtcggatgtatggagaattaaaaaaaatcggacataccccagtacctaccattgttgcatgcaccgaacgaatctgccctatcgatttcatcggtgcttattcctacatgattactctcttcaccactctctctcctctatgaccactttatcaacaacctataaacaatttttcctcttaaattctttatctgatctaccatctgattacgtcgttatacttatagcaattaaatctttacaataagatgtcacatgaatatattttgattatatatatatatatatatatatatatatatatgttccaactagtgaaatttgatgtttcatgcgagggaagcaaatgtttcacatgaaattcgagtttgttgcagattttaagttttctttgttgcgatatttatttaattttaatgttgcacatggtgttgtttggatggtttaataactattttcttatgtttcacttattcatttgaaatgttgcacatggtattcttgggatatttcaacaaatgttttgtaatgtttcaacaattataagtcgatgtcatgtataatgtaaaaatattttagttaggatttaacaatattattttccttatttatttgttcttctacatgtgtaggaacatgtatacgtaaatatctagatcgttcaattctctcggccaaatagtgtcgatacgtgcaacacagtaaaatgcttgttgaaacattttgctcatatgcatgaaacatcaaatataaacaattgaaacatatacatactttttattagaatatagtcaaacgagatgtcattgtaaagatttaatcataagaaacataattgtataataaaattatagattagataaattgtttagaagaaaaatcattttaaacaaggaggtgggagagataaaaagctaatagttggttacatcatatccattgcatgctgcagctcatcacatcacatccttccatgctttgttgcatgctgccattatctccaccataaataatccattttcgtgctacgttttgcttgctccgacggaatgttcgattttttgtcgggcgtcggatgtctgataagaagcattttcgtcacaactcacaacacaacctaaaaaaaatagcagtccaaaagtgtaccataatttagaaaggaataagtccattttgcctccctcatctcttgcgcttgcgtgaataacatccctcaaccggaaaaccgggtataatgcctccttcttctctgaaaaccagagcaaatcacctccctcggcggtttcggaggtggttttgtcctacgtggcgggttgacttccatatggcatcgacgtggcgcttacgtggcactaaaataaaaacaaatgtaaataggacccacatgttagtgagtaaaacaataaaaataaaatattgggcccacatgtcagttacctttccccttcctctttatcctcacggcaagcgagatggagagagctagctcggcggcagcaggacggcgggtgctcggtggagcggcggggcggcgggagcttggcggagcagcggggcggtgggagctcggtggagcagcgggagagtcggggcggcgggaggtcggtaggagctcggtggagcggcgggagaggcggggcggcgggagctcggcggagtggcggaatggcggggcggcgggaacgacagggcggcggaagctcggcggaatggcggggcgacgagagcggcaggagtgacggggcggcgggagctcgctgcctcccctcccacgcccctcctccgccacctcatccctatcctcgcctcttcggcctcgccgccgcctcttcttctccttccccggcatcctggcgaagatggacgccgacggatacgcaaagttggcatggtaggatgcagcacaggggtcgtcgaccacgcgtcgctagtccgacgtggacggagccagaacgccgccaccatgaccttcccgcgcttcggcgtcctccatccaacattcggcactcttctcgctgcgccggcagcgactggtagtgtcgccatccaatcttgcgttggggcagcaggcaacaattggccgatgacgtgtgatcatcgtaggcgcgtcctcttcgtgtcacggcgatcctcgtcgccgtagtagccgtaagcagcaccacaacagccgtaaggcacgccgtagtacatgtaaggatcagctccgaatggcacgccgacgccgaagaaggggtcgacgtagcctggcgccgggccgaacgggaagccatagctgccgtggtgatcgccgtcgacggcgagggctccatattctgtggagtggtcacccgccaccgtctcccacgcctttcttggtccgaggacacctgatgagatcgtggcgcttttcttggaagacacgttactgcggctcacctgcgaagcggccaggctctgcggcgccgcctctgtcgcgttgctgctggcggagctccttggcttctcggttccacttgaaacgctcgctgtgccgctggtggtggcgagaacgttggcgatggtggtgcggagcgttgggttggggatcaggtcgtcgacgcacgcctgcgccccgcacgcgcacttggacttggcggcgatgtggtcccggatgcaccagtcgcagaagctgtcgaagcagcacttgctcgccagcaccgcgtcggccatcacgtttcggcaaatcttgcagtagagttccgatgagatgacgccgctagatcccccggacggcgtcctccattcggcactcatctcgcagctgccacgggggatggaaaagataatagaggaagaggagataagttgctgacaagtgggacccacaagttgactcagctgccatgtaggacaaaaccgtctccgaaaccgccgagggaggtgatttgctctggttttcagagaagaaggaggcgttatacccagttttccggttga

SEQ ID NO: 62626 - DNA, 4666 bp, Oryza sativa
gcttaaaccctctattcgtcttctccaagcaaaaccaaaacccgagcccacccaccgaggtcctctccccctcctctcgctgggccaccacgccatggacggcgtcgcgaggtcgcgcctcctcgtcccgctcctccccaggatctccgcccgctccttctccgccgcctcccccgcgtcagagccagcggcggctgcggcggccgtcgccgcctccgacgcggccgccgccacggactactcgtcctccgcgggcgatccctcgtccgcgccgcccccgccggcccgcaagccgctgggcctgctcaagggcggcgtcctcgcggttgtcgccgccgcgttcggcgccacaggctacgtcagctatggtgcgatctctgatccctaaaactcctagatgcctctcggccctgctacttcgcattgcagtgtttctactaccattctcaattttaaagtgggaggggttcggtttggtgctgtgcgtatgattcgtgctcgtgtttttgtcttgtgtagcttattctctggatgaaattgatcagaggacgcgggagttccggaagaactcgaagcagcccatccgtgatgacctgtccggtttcgaggtaatatggtagcatgtcaatatgtcatgtttgggtgtgtgataacttgtcgctagctggttagtagcgtgactgcataagtaagcagtgatgcccttggaaatatgaccgcataattctgatttcctgtgtaaaaaaacttggtttcatggggtgaatatttgtacacagctatagggtagttgagatttgggcatctgaaactaaaagttattctagtacgacacaatatgttctattgtagacctgcattctgagagtatggataaaagctaaatttctgaattgggttaaagaatttggatttcagccatgtctaatagacgatttgcttcctctctgcagaagtttcaggctatggcttattcagcagctatgaaaggttctgaccacatgactccttcattatcttaccatattacctcgggattatagagtttcaacatgtcatgcatacctttcttcatccacatcaggagcaatttaccattacatgttattttttctttgtaaaatacttgtttgcagccaaccttagggaaatttaccctgcttcacagtgaataactaagccttgtcactctctgaaatataattttgtatgcactaaagtaatggtagtcagaaagatctactttactgtatgcatggtgctgttgttaagctgacaataaattccaaatatgtaacccaaacttcacaactggaaaaaaaaactaggggtactataatctcgtgtaaaatagctagggaatacccactttgtgtaacaatcagttagctagagcaactgtgatctaaccattatactatttacatgcgctgcacctagttgctacggagggcatgtgtctttggtacaaagctgtttgttaaatatctagtaaattgatgcattgtctagagcgctctatggctctagacaaacatacaccacagggaagaagcatggtatgagtgccctagatagcaggggttcgtcatttaaccctttcatgtactataaattgttatcctcctgtttgcatggcataattattgttgttccttttctttgcgtctcaattcttaaacacatatgttttgttttgcagttcctgttgctgctattgagttctatttggataccaggagccaaatagaagatcaaattcgggtcagtaaaaaatattaaatcttttgttctccattatccatgttggctattgtgaacagacgtgcagatcatgctaatactcatttttattaaagggctttagtgaaccatcatcagataaacttcttccggatctacttcctcaagagcagcatgtcttcaccctagttctggatctgaatgagactcttgtatactcagattggaaggtgaacatttatgttttctacgaagttacttatcttggtatttgatatgtagtccttatgtagtatacaatatgacccaatcctaacagttacgcaaactcttaacgctctggcttccccgtctctccacaaatttgcacttgaactttaccatctgtgctgtatggcataactcgaaagtgctcatgctgattttgttttggatctctgattctctggttttaccagaactgttttgttacacggatttgagaacctaatgccttattaaatttcgtttgggacacataataaatatgttatgtgatccaaacaaagttttaggttgttagcctctaaaatcttttttttacaagatctagtcttggactcttggtacaaccagagatccaaacaggccctaagtatcgtaatccccattcagattgatctaaaaagggatggttatttaaaatggttttacttatttgcttgttcgattggaagcttgtgatcatttttcttcagttcactcatctatcaattgtatctctgttctcctatatcaactttgatctaaatttaaacttcctaagaaacaatatataccgtctttttgtgctctctctctagagaagggtaatcactttctgtatgtctactgcaaaattgccaaactattgtggaagtccttatgttttctagttaagttttcaagcatgcatatcatatagtataaaatgtttatgacccttgggaggctgcttgacccataatttcttttatgtatgtatagcgtgagcgaggatggagaacttttaagaggccaggagtggatgcctttttggaacatcttggaaaattctatgaaattgttgtgtactctgatcagctgagtatggtaggtttaccagaatttcctcaacaatttggttgtttctgaaaaatatataaacccagatgaactttttttacatggacagtatgttgatcctgttattgaaagactggatccaaagggctgtgttcagcacaggttatcaagagttgcaactaaatatgaaaatggaaaacactatcgggtatggtagtcttatgctcttatcatctgttctcttagttgtattatacactggttgaaacagtttcatatatttatcctttaagcacccttttggtaagctaagttgcacactagcttgttctatgtttttttggatagtattgtgattattgagtaactaactgtatgctacgcatatgtatgcatgagatggattagaatgtgttttatgttcttcaaataactggcaggagtgaaaattgatgttatgacaaagttgtttctgtccatgcattaagcatataccactttgtccactttgctctctgggatctggctttcatgaccgagagaacacatcatgttttatctgtatagtttcctcttatacagtaaaaatgtctacaaatcatatcaatccaacatgatgggtttatattgtattgtaaataattctggttttttttcgtactcctattaaaattttccttccaatgttcattgaatgtaataaaatctttgaattggagtagtcatttcttatctgcatcttggccaaggcctttgcccttctcctgtgaagtaagaagaccagtgcggtgagcttccctaaatgcttcggtgcagtggaaccttgatagccgtggcatgcgtattaattttatggtgggtcattcaaataactacttaaaggggtgttatatttttatggattacagaacaaaacaattgcttattttcgaacattactgtagaagtaaagaacaaacataaggataaagagaggctttatcatcattagtcgaaagactggacagtacatagcagcaaaacaattgcttgcaatttatttatttagttattctttatccgcaagccgacctaagaggattctgccgcattataaacgtcttggtagctcttgtattggattggagtgaatgcaccgaactcatctcctctattatgcttgagcctctgagcctcttctcttgagatgcgatatgcatttgctagaacatcatttgggagagcacggaagatggaactctttcctgcaatgtggcttaccatagagttaggattggtcttgaatgcaatgtaagcacatccttctctttgtgccttctttacaactgcatagtgttgtggtataataagcagctgtccgcggcgaagctcgccgttgaacactgtctttccattgttgttgacaacttgaacccgggcacggccttgagtaatatacacgacgctgtgagcgttgatgttccaaaatggtgaaaggagtgcattctgcaatagaaaaggtgcacatcattagcatattgtgtgcattaaagcttttaccaagaaaaaaatgtgctgttcattttacctggtatagatttactttgactgcactcatctgtacaagactaagaatggggaaattctgggtgttgagatttgtaacccttccagctcttggattgtatgtatcagcacggttaggattatcgatgttttgccttaccctcagggtgcaaaaggtctcatccaaaccgttagagcagccacttccatattgactttgctgatattgtccttcttgataacgctctcttgattgcacttgtccttgttcctgctcctgcaatgatgcatatgg

SEQ ID NO: 62627 - DNA, 2663 bp, Oryza sativa
taagtagttcagtgctaaagccactaaatatgttctgtgaccgctcctcaacctcacgcctgtatgcttgagggtttctcttatttccagctaacaagaaatcctaacagttgattaaaaggctaaatcatcatctaagataagtggaataaaaatatcaaaatagtagtaaaaatgtttagctttggaaaagttctgcttaattaccctttgcctagggtcaagttgattagcaccgttgttgagatcagtgacatatatggcaacaactggcacttcaccatcattgtagcaccaatgagctacaccagcaggcaatgcaattacatctccttgtctgaaacggtggatcttttgatgttcatccttgaacttttgactttggctttgactttcggtcaattgggcttggcctgattgttggaactgttgttggtaggactcaggacagcctgggaaagttggccctgttatacctctccctgaaagtatggcatgcatgttaattacaagcaatataaacatggaagctgatcattaattcattatgcacttaaattgttgcacgaaccttggatgatatatactagagatgcaccattagtgtaatggggtagtagaaggcctctaggttcaataactcgacggacaacagatactccggtacattgaaattgctcattagagacatcgaagaactcagttgtgccagcttgagacctcacactccgaattggctcaaatgcttgcaacctatcgaacctgcattctcttggacttccacgacgagaactctgccattgactagtgctctggcctaatagctgctgggctagagagccattgcacaagaggaacaagcaaactgtgaagaaaactatggggcgatttatggatgccatgttgttgtagtactaatgaacttgaatggttttgtgagaaacaatgctaaatcattgtgcatttatagtgagataaagtctcatgcatttgaatgttaagatagagtttgttaatgtccagacatgaagtgactcatgatatatgaagtgtggtacacggaaggtggatggataatgatggatgtgtaattgacacatcatttgtattgttctctctttctttcttttgcaatatgacatggatgatgttaaagattatatccatgcatgcttttgctttttgttgctgtgccatagctttctatttctttttgaacatggttgttggtgatcatgacttatatcttgaagctctgttctagcaatactttaatatttagtgaagagtttttagggtggtcacatgttgacacgatcaacaccgagacctgtgagtttttggattgttgcatgatatatgggccacagtaggcatgtgaattttttttgagtcatggcttgtcttataagctctcctcttttcgcaacatgacatatagctctgtagttttatgtacacatccttttgctttatcttgcttgactctctggtttgtcatgtgttacacccaattgtcatcagttatgacttatgtatgggaagttctaacactttagcttaagatacttacctagatgactagaaatgaataggttgacagaggcatgaaatgatgcatgacttgctatgtcatagattatatcttcttttgcattatgtcgtggagaatgccaactttgcacattaaacgcttgcatgtttcattgcttaagggtttcttatcctgggtgataacattcaaggctcattgagaacacactgctcataaaaatgttctttttttatttcgtggtcccataatgctcacacattactcataatattgtttcattttctaacaccatcttctttcattactttagtttattctgtactacagaatacaacaaactgtcttgtgcatattttggtgtttcatttgggttgcctacaccataattaacttctcattgccatgtgcaaaaatcttcatcctactgctaactaactctttgaactgcacggcacctatcgaaaagctccctctccttatgacatcgtcagttgttcttctcagcaggttgctgtcatcttagacttttcttgcaacaaatactttacataaggtgtgaactagtagctggtagcattatttggctggggtaaatatcattgcatgttctattgctcatgactgttacttaaagttaacagtgtaagtccaaagtctggatcaccctgtatctacaatttcttcaatggcctttaatgcttttaaacttttggaaatttgcagtataaggtttccttccttgagcttgacatgtattggtcattgttagctattacacaggcatttattttctaagctgtttaactatttccatttatgatgggcacggtgaataggatcagcttgcagcctactcttgattatggtgcttttgttttgcgcttatttccaccatagaaatcaaccatggaccatgttgtttatctaagtgctgataagctgctcaccgaacagtttgctgacagttaggtgttcttttttccttgacaaatcctactttgaatttgaacttggatttgttttcttaaaactaaagtatcataaccaagaagactatcttttagggatgtaggtagtataatctacttcctccgtttcacaatgtaag

SEQ ID NO: 62628 - DNA, 4883 bp, Oryza sativa
ttgtgcctaaataaactatttttatacattattcgtaatctatatccatattaatataaaaaaatatttatttattttatgcatataaatctcaacataggttatgtcaacatttatgtataaaagtaggtttattttacgatgaatgtactacttagctagccagctcgattcacctgcaaaccaaataaaattaaaaaggaagagaacagaaaattaatttttatgttgatttatgtagttatatttagttagcaaatatcaaatagatcccctacattgaataaaaaaaattcttatgctctgcttttacattaaaatatttattaaactgaccttccatttatattcatatcgtactatcccaaaatgttggcctttatatttttttttctcatgctaatactcaaaattttaaaaatattaattaaaatcaccgtatattttatatgtttttcacacgatattattcttcaatattgttaatatagagttatagttgtgcgaatgctcgaatataggaaatgctgttatgcttgtaactacaagacatttttctttcttgtttggcaacgagcatttcgttgtggattctctgatgtaaacgaacaaactatctgtttcacattaacctggacatggaaaaaaatgtgttgcaagccacatttttaccacaacctaacgaacataatctgccatttttgtaggcgcatgcaggagcaaaagcatcagggccgcttatggcggagatgattatagatcttttggaaggaaatctgagtaatctacaacactttacaggcacgacacctctgttctgagttctgagtgagccttttaatttcggaattgtaattttgtcaacttgggtcccagagataccttttactttgatagttattgcacgttcccccccccccttttttcttattcgtaccgagggataggtatctaaccaaattacgctggaattttatgatcaaagcacattcgatcaagtgaggaacatgtcattaaaagaattttgtttggtattcgctcacatgagttccgggcgtaataatattttgttgattgctgcaatctcgtgcggcgtaacaaggtgaactctacaactcgggaatttttagttttatctggaattgtgaatactcctatgtagttatggacttgtgagtaagcaaagtgttggcaaaaagaatttttttaaaaaatcctcacccctcgccaagcctcacaatgtggataaatttgatgttggaaactcggagtatttatggtggatagagtatttatcgtggaaagaagcatcgtgtggtagaggccatagagcctcgctcccggctagcactgccagaacgaatacaagtggacgctcgcccgaccaaccagaagcagagcccgtgcagattgtggcggcgatgcggcctcgtgcttttgctcccccttgcctgccgggcagtggcccgctgcctggcctggcggtccccgggcgcggcgacctcttcccggctgccggcagcgtcgtcggcaggagggccgctcccgctcccgccggccggggcgccgtcgctcgcgcagtggacgggccgtccgccgctgcggccgttgccgccgcggcggcgtccgccgcggcggacgtcccgcccccgcagatcacgtggcagatcgtcgtcggcgctgtaggtgcgtccatgttgtcgtacgcttcggttcggcttcgcttcctcatcacttcccacaaattgtgatgtgcttgatcatggtatggtattgaccgggttttgtgcagctggagtgactcccttcgtcgtcgccggggtcgagttcggcaagagaattgtgagtgttggtttactgtttccttgctcgctagtcgctagctgcatgaaatctgctgagtagaattgcaccctccagactccagtcctctttgctgcccctctaaactgaacgcaaaaatactactccctccgttccaaaatatagcaacttttagttagatgggacatagaggcatgtccagattcgttagtactaagatttatcccatccaaccaaaagttgctatattttgggacggagggagtacttatcatgaaagtgagggttatgcaatagtgacaaatatttgggaacggatggagcagctagttgttagtactaatgttcattaaacagttcttattgacagtttgacactgaaatacgagtgtgaagaggatagtgcttatcgatcagacattcagagtttcagaccattccttaccaagttttactgtccttcacttgattattgtcttctcctgtatttcagattgcacagaagaaatgtgaaatctgtggaggctctgggcttgtgatgaagaaggattactacgttcgctgccaagggtgtggtacgtactgaatcctctgtttcagtatgtttgcagcagcaatttttcaggacttgaactgtgtggtgtgctgacagtatgataactgacaatgtgtgtcgccgtgtttcattgacaggcggttttcttccgtggcagtcatggagaagattcttcaccggctgaaaatcgttaatttgaatcgtgttgattaacactagcactgcagtttgagttggacaaggaggatatggcatgaccagaccaggtcaatattgtgtttatagttgttgttgttggaaatatagtcattattcggtatattttaatccaagaaattgaaactatgatcatggcataagcagtgtagggtgatcttaacataaccagtagcatactatgcgcatcatgaatgtcagaaacaggaacataccagtaatgcgataacatgctagaggcatcatgtagaacaggaacaagaacatagcgcacacagtatagcgctaacaatgggaacaggagtagcgctaacagcagtagaaggagaagattataccccgagaatggccctccgctggatggtgaggcagaattgcctccgttgttgtagtcgttcacggcacctcctcctggcgcaccagctccggatccagctcctgtcggcgtcggcggcggcgcagctcctgtcggcggcggcgcaccaccgccgccattgttagaataattgggctaggcccaacttataatattaaatctcaaaggcccataataaatgttgaggataataataccacctctggatttaagcgagaaatatctcaacctaaatagggagttattagaggctccctgttgaccagttgaggtgggggtcggaatgccacacgcgcgcgcgcgcgccgggccgtgggcgtggccgaggcgtggcgtggctggcggcgggcgggtgtcacgtcgctatccttttgcagccactaacccacgttcccacgattccctccgcaacaacgcgtccacgttctttctcctgatagataaggaggccgcgagtccgatccgagttcctcgcttatttcccggtgttagtttctccttctccgcgcctgagtgctctcgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcatcgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatctatgccatgatcatagtttcaattccttggattaaaatatgccgaataatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggtaaacgaagtgaaccacctctttctcctgaggaagaggctaagttcgaggcttcggattgcctgttccgtggagcattgatcagtgtactcactgacaacatagtggacgtgtacatgcacatgccttctgggaaggacatgtgggatgcacttgaggccaagttcggagtttctgacgccggtagtgagctgtatgtcatggagcagttctatgactacaagatggtcgatgaccgttctgtagtagaacaagctcatgagattcagatgctggctaaggaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggtgagggcaaaggacgtccggggcaaaaaggttgagggaggttctagtgccaatatggtacagaagaagaaccctcatgcatcccacaacaacaagaaagtcaagcctgatgtcaaacccaaggctgcaaccaattttaagaagaaaggcaagggaaaggcaaagggagactgctttgtgtgtggcaagtctgggcattgggccaaggactgtcctgagcgcaaagaca

SEQ ID NO: 62629 - DNA, 13860 bp, Oryza sativa
acaaggcatctgaggcgaggaatttggcacctctggaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaatgagtttgcatccttttgcgaagagtttggaattattcatgagatgacgcctccctattcaccccaatcaaatggggtggccgaaagaaagaaccgtactctaactgagatggtgaatgccatgttagacactgcggggctttccaaggaatggtggggtgaggcagttctgactgcgtgtcatgtcctgaataaaattccaatgaagcacaaggaagtaacaccattcgaggaatgggaaaggaagaaattaaatctctcatacctacgaacatggggctgtttggccaaggtaaatgtacctatagtcaaaaagcggaaacttggaccaaaaactgttgattgtgtgtttcttggttatgctatccacagtgtgggttatagattcttaatagtaaactctggagtacccgacatgcatgctggtacaatttttgagtccagagatgctactttctttgagaatgaatttcctatgaaatatacacctagcacttctagtaaagaaactgtcatgccccatgagcactttgcaccgatagaacacaatgatcaaacgcctgaggaaaatcctgaggaggacaacattgtagatactcgcaagagtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtcgttgagcgtccatatggatgtaagcccgtaggatgcaaatgggttttcaagaaaaagcttaggcctgatggtacaatcgaaaagtataaggcaaggcttgtggccaagggttatacccaaaaggaaggcgaggatttcttcgacacatattcaccagttgctcgcttgactacgattcgagtactacttgctctggcagcctctcatggtcttctcgtccatcagatggacgttaagacaactttcctaaacggagagctggaggaggagatctatatggatcaaccagacgggtatgtactagaaggtcaggagggaatggtgtgtaaactattgaaatccttgtatggcctcaagcaagcacctaagcaatggcatgagaagtttgacaccacgcttacatctgcaggctttgttgtgaacgaagctgacaaatgtgtatactatcgctatggtgggggagaaggggtgatcttatgcttgtatgtcgatgacatactgatctttgggaccagccttaatgtgattgaggaggtcaaagactatctgtccaagagttttgaaatgaaggatttgggagaggctgatgttattcttaacatcaaactacaaagaggagatgagggtgggattacacttgtgcaatcccactatgtggacaaggttttgagtcgctttggatatagtgactgtaagccagctcctactccttatgatcccagcgtgctattaaggtaaaaccgaagaatagcaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatctaaagggcactatgagctatggaattcactataccgggtatccaaaagtactagaagggtatagtgactcaaactggatatctgatgctgatgagataaaagccacaagtggatatgcgttcacacttggaggtggcgctgtttcctggaagtcttgcaagcagaccatcttaacgaggtcaacaatggaagcagaacttacagcactagatactgcgacagttgaggctgagtggcttcgtgaactcctgatggatttgccagtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaaggggctaccacgtaatgtgatagacagtgcatcgagggaaatgggcttgatacccacctaaggttgcataatagtggaaacctgtccattgtgatcggagatcccgtgaatttggatggtgaaacaaattattgtgtgactgagagaagagactcttgaaaggggctcattttcatgatgtgcttctcttctttcctgcatggtaggatggcttatgtcttaatgtgatccgagtggcttttccaagcagagatgttgacctgcagaacatctcagaaggaacacacctatatgagttcgactgctagtcacagtctatgaggtttgggcaatctctagatactcatgaaaggcctggagtttgacttatatgctccaaacagaggggatgcgaacggcagcccagtaccagtcaaggttctgagtgaaacctgatcacacaaaacttacaattcaaggcatagtccattgttcagttgtggtctgatgtagctcatttcctaagtggaagttcaacttaacagtctccacaaaaactctgatatatcaaacaggcacagccttgagaacatttcttatgagccttgaaatttggtggggattgttagaataattgggctaggcccaacttataatattaaatctcaaaggcccataataaatgttgaggattataatgccacctctggatttaagcgagaaatatctcaacctaaatagggagttattagaggctccctgttgaccagttgagtgggggtcggaatgccacacgcgcgcgcgcgcgccgggccgtggccgtgggcgaggcgtggcgtggctggcgcgggcgtgcgtgcgtgcgtcacgtcgctatccttttgcagccactaacccacgttcccacgattccctccgcaacaacgcgtccacgttctttctcctgatagataaggaggccgcgagtccgatccgagttcctcgcttctttcccggtgttagtttctccttctccgcgcctgagttgctctcgcttccccgcttctgatctcttgcgcgcacgagagattggaagaagcagtgcctccgaaaccacaccttcgcctgagatctgcaccgggtaggcgggtgatcaggtttttggggagtgcctcctgcacgactgctcattgccatgtctggagttgctgccgccgctattggcggaggtggtgcgccgccgccgacaggagctgcgccgccgccgacgccgacaggagctggatccggagctggtgcgccaggaggaggtgccgtgaacgactacaacaacggaggcaattctgcctcaccatccagcggagggccattctcggggtataatcttctccttctactgctgttagcgctactcctgttcccattgttagcgctatactgtatgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaattccttggattaaaatataccgaataatgactatatttccaacagttgtctataacatatctccactacaaatggccaaataggttcatcgagatgtatcacaatagtacactgtaatcatggtcatggttcttctgtctataccatgcatatgacgcagcatatgaccatcctctgagagtctatcagcccaaaatctcatgggacgtgcgttcacgacaactacttgtggtcttctggagctgtaaacaagaattatctagccatcaagctaaactataaccttccaaaagcggcatacacgtttcgttcgtcatgtatgcaagatctacttcgtgatgcctcagtttattcgttcgtcaatgcaaagcgttttgatcaccgaacaaacccatgtctgcgatatgagcaaactgagtctggcctcgaatctaaatactcctacataggtttcatactttcatcgcaaggactataataactggagtagttaggtttatgtttagttcaacttgtctttcagcccagaagatcacatatcgtctccacgtgtgcgtctggtttgactcgaggaccacgatacaagatgttaattgttaaatgggtcacttcctcatctctctaggctaatgtaaaatggtatgaggctgacaccaaaatccaactaaatcatcggatgatctcacagagtcccgtaatgagccttttctgattaaaaattgtaagttggtgttaccaacacaacaacacttatcaatttatcattttgagtgtgagattgtaataattggttgtaactctttaaaaaaaaaggccgggacgccccatttcattatcagaaaaagaaccatggtgtgttctgcggcttctgccatctactcatggcaagatctacttcctgatgcccaaactgctggtcgcgcccctgacatcaatcgtcgcaccatccattcgatcggtttagatccggcgcgcgccggacgcgcggttctcttcggttccaggcagccggcgcgcccatcccgacttggcgtgattgccgcggatgcagtttagttggttccgtcgcgtaacctcccttatctcctcgcttcccattcctgggctctgactcggacgcccttttgtccccacccgccgatccgccgccgcgagcccgcgaccgcgagacgagacgaaaccaactcgtccccctcttgatcccccgtctcgcttcgctcggcggccgcgccacctccaaatctccaagctccccgactcggcgactcccacacgccatgcccatcgcgcccgcggcttgcagccatcaaacccccccgcgctctttcgcctcctgagcccgtccgctcgcccgtggccatggacgcgatcagcagcgaggcgccggtgggggtgttcgcgatcggcccgtccacggcgctgggccgcgcgttggcgctgcgggtgctgctctgcggctccctggggcggctgcgccaccgcctcgccgcggcgctgcgggccgcgctccccgtggcggcgggctggctgcacccgcgggacaacacccgcgggatcctgctcgccgtctgcgccgtcgcgctcctgctgcgggtgcgggggcggggcggcgggcgcgccggggtccgggcgcgggtgcagtccgcgtaccggcgcaagttctggcggaacatgatgcgcgccgcgctcacctacgaggagtgggcgcacgccgcgcggatgctggaccgcgagaccccgcgccgcgccaccgacgccgacctctacgacgaggagctcgtgcgcaacaagctccgcgagctcaggcaccgccgccaggagggctcgctcagggacatcgtcttctgcatgcgcgccgacctgctcaggaatctcggcaacatgtgcaactccgagctccacaaggggaggctgcaggtaactgctctaatcttaacctgtattacgcccgcaaatttgatgcaattagatggttgttaggagttaggatagctaattctcagaacttcagcaatgcttctactttccctttgttacaactgaagtaaagtaattccattacactaaatctgcgaagtggatccacttccattacacacaccaagatagtcttggaaatttttttcactttgttcggatgatttgtttgtgttatgtcagtacggcaacaaattatacgaagtactcatattcatagtgatagcctgataggatccccttttgatgtccccattggagcatctactcaaatgtctattcttatatatcactatgtcatattgccaggtgccgaaactcataaaggagtacattgaggaagtatctactcagctgaaaatggtatgtaattctgattcagacgacttgcctctcgaagagaaacttgcatttatgcatgagacaagacatgccttcggtagaacagccttgctgctaagcgggggtgcttctctaggttgtttccatgtgggtgttgtgaaaacattggtagaacataagcttctgccaaggataatttcaggatctagcgttggttctataatgtgctccatagtagcaacaaggtcatggccagagctggagagctttttcgaggagtggcattccttgaagttctttgaccagatgggcgggatctttcccgtagttaaaaggattttgactcatggagctgttcatgacattagacatttgcagacgcttttgagaaatcttaccagcaatttgacattccaagaggcctatgacatgacgggccggattcttgttgtcactgtgtgttctccaaggaagcatgagccacctcgatgcctgaactatttgacatcacctcatgttctcatctggagtgcagtaactgcttcctgtgcttttcctggtctttttgaggcccaagagttgatggcaaaagacagatttggagaaacagttccttttcatgctcctttcctgttgggcttggaagaaagagttggtgctacaactcggcgttggagagatgggagcttggaaagtgatttgccaatgaagcaattgaaggaattattcaatgtgaatcatttcatagtaagccaagccaatcctcacatagctccactgttgagactcaaggaaattatcagggcttatggaggcagttttgctgccaaggtgcgtgtcaaaaacattccatattgcattctttatttttgattgtttatttacttgagctgtctgtgatataacttgatatcgatttcatggtgggaaggatttttattttcacttggattgctacatgatataactttcagtatttcaggcatgtttgtggcttagtagcctagtgtagaactatgctcagcaaggtttagttcactgcagatattagttgaattttatgtctgatgaataattcaatatactaaaactgctatgggcaagcaggggaggagacaagcctagggaaattagggtttgaactctaggcttgtctccttaatctcttcgaaatccatttaaaaagtgaaaaaactatgtaaaagtttgaaatttaacaaatcagattagttgagccctaggcttatgaatttccttgctttgcctctatgggcaagcatgtatttaagtgctttgttgtatgatctcatagattcttcaatactatctgtatgtagttggctgaacttgctgagatggaagttaagcataggtgcaaccaaattctcgaacttggatttcctttaggaggaatagccaagttgtttgctcaagattgggaaggtgatgtcacagttgttatgccagccacgcttgctcaggtctttaatatttcccattcctttctttcacaaatatccttggcattaactggtaaacttacaaatgaattctttcttgttatcatcagtattccaagatcatacagaatccatcttacgctgagcttcagaaggctgcaaatcagggtaggcgatgcacctgggagaagttatcagccattagggcaaattgtgctattgagctggtactagatgaatgtgttgccctgttgaaccatatgcgtaggctaaagagaagcgcggaaagagcagcagcttcacaaggacatggtcctacaatcagactctgcccatctagaaggattccatcatggaatctcatagcaagagaaaattcatctggttcccttgaagaagaattccttatatctcctcgtacaaaccatcatgcagatggaggaattgctggaccatctaacaaaaaccatcatgtccaacaaaatgtacatgatggcagtgacagtgaatctgagagtatagacttaaactcatggacaagaagtggtggccctcttatgaggacagcctcagccaacaaattcgtcagttttgttcagaatcttgagattgacacagagttcagaacaatttcatcgagggaagacagaactgatgttgtaacaccaaatgctaatttcttggtttctcaggcaattggtagagaatctgttgacaacagtgcaatgcctattactcctgataggagcttgggcaattcaggttatgatcctcatgatagtaatgtccctagatctccatttggttgttcaacaagtatcatggtttctgaaggcgacttactgcaacccgaaaagattgaaaatggtattctgtttaatgttgtgaaaagggatactcttctaacacctacaggtggagttgagcttcagggaacatcgcaggaaccagacgtggaaacaattcagacagagtgccttgatgatgcttcggatgacgacgatgtgggattaaatgctggtgatgaagcagcaattgaccctagagcaaacatgagcagccaaaatacacaacaccaggggtcttcactagaaaatataaatctgtcctcttcagtagattgtgaagctgaaacaattactagtaaatcaaagggttcatctctttttgatattggtatggagattcgtccaacaatcttgagcacggaaagtagtatgtacgagaggtcttctgcaaaaataggactgaggacagtgcatgcagaatttatcagcaatccaggtgctgggaagggagaagttgactcaggggctgctaataaagaattttcctatttttctcaaacagcagatactgttatattttcagaaagctgtgaaactgggcaacatcatgaagtgaatgtagaagctttaacctcataccctgtttcagttctggaagatgataggtctggtggcttcaatttgagtgaaataatggctacaactttcattgccgaagctgatgctccaatatctagaagagatgaagttgagcagcataacggatctccagtggaaacattcctggacacagaaacggtacaagctgggccttgcagttctactttggagggcaacaacaccaacaattccgaggaaatgcaagttgtttgcacctcaggaaccaattagaagtcaagacaagaagggaagttttggatttatcatatgaaaaaacaacttcagtgctcgttgtaaatcatatgcagatgtgcgccatgttctgttgtcgatttaaattcgcacattacggaatatcttgttatgtattgtaggttagtgaactagggaaagaggtcgctgaacttgatgaaattcctcgtaaataggaaaagaatgtcaatggttttgttgaagctgctgcttgacaaaagcaaaacaaattccacttctgcgcagtactcgctcaccttatcactagggtgatgatcagttcgtacaattgtggaagattaagcatcatcagggtgatgattagttggtacattgtactagagggagtaggagtactaggtttagagatacaaaaactaattagttgacccgggacttcaggtgttgccgaatgtcaccgttgcgtggtcgtttcttggagacgtcgtagacggacacgatgatgctggcggtggcgggcggatgagcaaccctgggcacgacgaacgcgtagcagtcggccggcaacgacccaccgtcgagggccgtgctcctcaccgggaactccgacgacgaccgccaccccgtggcgcggcagtggaacgcgacgtggcactcgaacttgggcttcgccttcgcgccggcatggggatccaggaggagcacggcgccggcgaggccggcgggtccggccggcgcgacgtcgaccaggaacaggtggccgccgtccacgtcgcggaggacccgcttgccctcctggacctgcaggtcgaacgccctggcgcgcctgaactcggtggcgggcggccagccgtggccgccggtgaagtgcgcgggcagcgacgaggtcgcgccggcgaagccgcacccgggctccgggcagaagcacggcgcgtgcgggcacccgtcctcgtggctgtcgctgtcgtggtaggccgtcttggcgtcgcacccgtagccggcgttgcggcaaggcaccaggatggacctcaggatttgctccacggcgaagcagcggttgtacgcggtgtccatggcgcagacgtggcacctgttcttgtccgggagcttgccatggcaggacgaacaaatgacatgcccaactccacactaccaaaaaaaaaaaaaagaggacccgaaaaacaggttaatcaagatcaatacatggtgaatgttgctcatacatccatggtagaaagacagaaaaggaaccaattttacaatattagagacaaggatgattgagtacctgcaagactggaggcttgaggggatgacagcagacggtgcagtcgagtacctccagatcgacggtggcattggtggcgacggagctcctctgcccggcgctctgctccatcgctattcgctccctctcttcttcttgattgcaaatttgctgcgcaacggctaaaaactcaaaactttctttgcaaccttttcatttcgtcaggctaggtgcagtaggagtgtggtagtactaaaactggtaagcctgacggatttgacgtttgacagaagccaacggcttttgctcggagggagctgcattttgatttttgaaaacgcctttcatttacctttttttaaagtacattggaacacatgtactaggttaaatcaatattttcacttaacactatactccctccgtaaaaaaaaaaccaacctaagaagctaaacggagcctaagaagtatgggatgagatataatctagtacaacaaatctggaaagaagtctgaccaaattttgttgtgacggagggaatacatctttacataagtctccagtttggactccgggtgatcaaaataagcgaatatgtgagagaacttcatatgatttacacacgtataattataaaaggcaaaacattttatgttttcttccttcttttcggtgtgagcggtaattaactagttttaccttttcttaagtaaattttacattgggccatatgttttgatcaagattttgttataaactagggttaaatcaatattttcacttaacaatatacatctttacataagttttcagtttggactagggtctaagggtaatcgaaacaagggaatatgtgagagaacttcatatgatttgcatacggataattataaaaggcaaaacattttatgctttcttcttcttttcagtgtgagtggtaattaactagttttattttatatttttatttaaattcaaaaataactagttttattttctattttatttttgttcatttgcccctacgtatagatcattttgtgccacttttaaacatgttcacatcattattttagtgtgatttgctaaaaaaaagttgttttgtgatttgcaaatatttttttaaagatatttatcttaatactatggcactatggatgatgatttaaactagcttttctctgacaacttcctttgatgtgctcatcccaagtccaaagtgccaactagtgcaaagatatgtaatgttaagtgaaaaggttgatttggccatttcccattgtgaaactttgttaaaaatgtatggtgcaatgtgaaatttacttcttggtttaggactttttccttcccagtgtcttattgccactttgtccaccaaaggttggaagtgaatcatgtgaagcaatttatcctactagtgttcacccgagaagagaacagaaggtgcgtcccttgttgccttggcacgtaatttagcctctgctaaccaatgacctagagcaaaggtataaaacaaaaggcgatacaatggcattgccttacttactactaggtgcaactaatttgaattcaaatatgcgtagcggtttctacctgttcgagattattgactggattattgttgcgggctatctactttattctgggataaattaaatatttttaatctaaacttataaatggcttagaataagtggtctaagcaatgcattagaagaaagtttttttttaaaaaaaacatattctcaaaggtgtggaacaaataatccacatcaaaaatccagtgaagtagaaatgaacatgttttataccacttatttctctgtcgtccaaacacccaaagataataatacccttgctataggaaatcaatgtgtattttgtctagaagtccaattcttctaagctaaatggatgattgattatctaaatttatgatgatattccaagatataaagtatgaattaactattaccaagttgaaaagttgtttctaaaaaaagtattataagaaacttatagatagaaaacttttgcaaaaaatgcaccgttggggagcttgggaagcgtgctcatgataatcaataatccaaggaataagatcgatcgtgtgtttattggcttatcagctgcaaccaaaatttgaatgtttgaaacttagttttagattttagagttaattttcggatttattcatcatagtttattttgtagtattgacttttaaactggtaataacccataaattgttttggattacttcattcttttttggagtaaaatatgggtactacaatacatgatgtaaactacgcatagtgagtcaacttatgtgattggtttgtgcatgctcaaatccaaaattttggatacgtgttgttgcttttgacatgctgaactcttgtgccacaagcagtcaaagccacagtttttgtggtgctcaaaagactcgccaaacttttaatggaagtccaactagtgatttgagtgcctagccaacttttaatgtatataatagataagtgatatttttttatatgatctacaaacaagctaacacgtttcaatatttgaaaggtttcaaagttgtttgcatctcaagactttaaccgcgttcatagaagtgatggaaaatattcctcacatgttcattatgacatatatgcaagtcactctatctcttacactcctttttatgctcctttttatggatcacaaattaatatttcttgaaggcacatggttatatatgtatcgattgttaattagataaatggaacttgtgtactcataatatttaatatagctatttagacgggaaacaaaattattattgttcttattccaaccatccaatattacatagctacaataagcatgcagtcttttatttcttgtaatttatttggaaaccatccctagcaatccaagcctatactataatgatgcagtcatgatatcttggaagttactgtaggcatgactaggagtgaacacgcctgactccactctcctgttgtgcttgagtctcctagcttcttctcttgagatacgatatgcatttgccaaaacattgttaggaagtgcacggaagatggaattctttcccacgatttggctaacaatggaattagggttggttttgaatgcaatatataagcatccttctctttgtgctttttt

SEQ ID NO: 62630 - DNA, 1158 bp, Oryza sativa
tgcaacaacatctccctatctgaaacgatggatctgttgatgttcatctatgaatttataattttggctttgtcccttgaatgattggttttgcccggattgttgaaactattgttggtaagcctgaggacatcctgggaaagttggtcctgttacacctctacctacaaatccaggattccacattaataaaaggatataaaagcaacaattatccaatatatacttaaatagatgcacgaaccttggatgatatacactagagttactccattggagtaatgaggtagtagaagacctctaggttcaataactcgacggacaacaaatactccggtacactgaaataacttattagagatatcgtaaacctcggttgtatcagcttgggaccttacggtgcgaatcggcttgaatgcctgcaaatgatcaaatctgcactctcttggatttccacggtgagaactctgccattgactagtactttgacttagaaattgggctaatgagccatgacacaagaggaacaagcaaatggcagagaaaactactgggaatttgatggttgctatttttcttgtggactaaactcaatgctttgtgtgaaacggtaatatattttggtctttttatactgatgtgaagtatcttcgttcaaaagttaagataaagtttgttaatgtccagatgtggaatgactcattagatagtaaggtacacggaaggtggatagatgagtgtggactcacaaacatgcatgagcggcacattgttattttcaattttcttttcttttccttttattttatagggatccttcttgtcatgttctacaattaaaagattgtttttaatctggaccgcatgttgtgtattgctttaattttgtgatgaaatgttttggttgagcatatgatttaaaataatcggttggatttattagtatgttttggagttacgaaagataaataagtcgtaatctcattatgtgatgtaaaacaatcagttgtgcctgctatgtggtcacggaaggtggataaatcatagccacgtcatattacctcttgtattgctacatgacaaacacattgttgtttgtttatgaaaatatatactccctccttctataaatgtttgacaccgttgacttttttaaac

SEQ ID NO: 62631 - DNA, 4681 bp, Oryza sativa
cccaaaatcagacgtcactcatcctaaacttttaataccggacaaattatccccttgacccaattcaggacggtgttgtcctacgtggtgtaagcgtggcactccagtcatcatttttttttaatggtggggcctacctgtcatatatactctctcccctcctctttctcgctgaggaggcgagaacgcccgagagaggggggaagaggagaaagaggaggtgagagattatatatgataagtaggcccactattgaaaaaagaaaatgctgactggagtgctgtgcatacgccacgtaggacaaaatcgtcctggatgtcgagggcgataatttgtccagtattaaaagtttaggatgagcgattctgattttcgggtttaggggtaattcggtctgggtaattagtacttttccaatcatttatgatccgtctaaacctgagcacgaaaccgtgcctgattccgtggttgcatgatggaaacgtgtaacaccaaaggtagtaatctcagtgccgattgcgacccaaaacgcccggcgcgtcgacggccggaccgcgtcgatcgatgacggttactgcacacgcacgcacgcaagcatgcccgatccctggaacccaaccgcgcgcacgcgccgtgttccgccggcacggcgacacgtaccacggctggccgttcccctgtctgtcaaccaccaccagccgatggaggcgacggcgtacgtcacgcgccgcggaagacggacacgcggttgcgctcgcgtagtcacgccttccgcgcgcgcgcgccgcgcagcccggccgcctcctccacccacgcaagcaaaagtactaattacggccacggcctccctgcagcgagggtggtttatacgcgatgcgacgtatcgctgcccagacggcagctgtgataggcgtccccgttgggccggcatgggcaagctgatcggtggtgagggcgtgaggccgtggcctctcgcacgacgacggggcacgtacgcgcgcaggtactagtcaacgggaccgatctggtaacaagccggccaccgatcggggctcggttgttgctcacctttccgcgctacgggaaatgctcatagctagaaagagttatagaccagccaaatttgattctgcgtatttccatttgaacggtctttttactccaacaggtcatttatattacatctttcatattatatatacatcgttcaatatctatttagtattataagttattttgatttttccctaattattttttagcgagtttataaacaaattagtaacatatataataccaaattagtttcattaatctaacattaaatatatattttaataaatatatatattaatagtatatttgttttgtgttgaaaaaaaatgtcactatattataaacttagtaaaactttaaaaaaaacttgaaaaaaatcaaagcaacttataatatgaaataggggaagtattttctaactttcataatgcctatattttgaatgactaaattaagaatagatttttttaaaacaactatatttgtacggatatatattttaaggatggataagtttttttatgactcttaattatgtatgcaaattaagcaatctaaattatgtctgcaattgaggtcaccgtagccagcttgaatcaaggatcgaggagggcggggcagcaaggacgcagttgtattcgtcagtgctgtacttgaagcaaggagcgcgggacagaaccatagttggctactgatatatgggtcctgtatttttttttttttcactgaccgaactactacctccgtcccaaaataactgcagccgtggaaatacgtgtccaacgtttacccgtccgtcttatttgaaaaatttataattttttttaaaaaaattagccacacataaagtactattcatattttatcatctaataataataaaaataataattataaaaaaatttcaaataagacgaacggtcaaacgttggagatgaatagtgcaaaactgcacttattttgggacggagggagtaccacagtagatgccatagaggaaaaaatagtgggttttgtaatgagggggtaagttgaacgattttgatggttgaggggtgttcgattgttggttttgaagttaaatggtgtatttttgacacgtaatagctgagaggtgtaaaatagacttatctttttttcgtaatcgctacattttgaaagactaaattttaacaactatgttggtaatggatagatttttttaaacaactatatttgaacggatatattttagaatggatattattttagtggttctcaattatgtatgcaatctcaattatgtatccagtctcaatatgtatgtaaatctcaattaagtaagcaatctaaatgaggtatgcaatcgaggtcactgtgggcacttcaaatcaaggagtgcgaggcagcaaggacatggtggtattcatcggtgccatactcgaagcagagaggcgcatgtcagaaccgtagtggaatccagcctctctcctctggccgttgttgctggtcgaacttgagtggtttacctcgaatggtagtgtagctctggaggactcggtggcagcggtcctcggggaggatctcggcaacaacactccacatggaggactccgatggtggcggtgatcctgtttcgctatgcatcgcagctcgcgtgaaaggggagagatgagatcgagagagaagagagaaagaggatggattaaagagatattgttagcaacttacagatggcccctgtagtttctttacacttttttcgcctaccgaattgccatattggaagcaacatagatgaaaaccacgagggggtaagctgaacggttctgatacttaagagctatggacactcggttttgaagttggagggtgtattatagataaacataatagttgaggggtgtaaaataaatttattcttttttatatcaaaatgactatatgttgatagaaaacacgaggcctgggagatctgcttaactccagtgcaggtccaaagctcgccttcgaatgtatgagcgtgccagttgatttgatcctgtaatcaacaagaaatagagacaaagaattcgtggttaaatctataaatgatagccgatcggctaggtgccgatgacatatcatttatctttgagccgatgtcatatatgaatcgatcgacggttataaataaatagtaaggaactaaatctattcgatcggcagtagatattaacgatatatagttcttatattaatatatacttaaatcaaatgattgggatagatcggtcaccatgccgagacagtataaatcacttagattgaaatatatattaataacaggattatatatgtttatagcatagccgatcagatagatctagcatgtatcggctaatactccgatactactttatataaagatatcaaaacaaatataatataccaaacaaaagcttaatatacttaaatgcaataagatcttgacataaagggcggatttaacatgtcattgaaacacatagaccggatatggttaaatcagataaggtcggctgaaactccgatactaccctaatcggcaaccagagaacaggctacagattgatattctaagcacgacttaatagatcaaactcaaatgatgcagccttaagtatgaaaagaagaacaatatctagacaatcaagccgatgggtgtttcataaagtggtagatatcttatataatctaagacaacgtcgctatttacctaatcggctgtcttctatcaacatatgttagccgattgtaggttagatgacgatgttgccaaagattatgtaagatatatgataacttgatgaattatatagacaagattagagtgtcataaagatggaagcactaatcccgagaacacaagccgtcataacaagttttacctcttgttgaagatcgaaaccgatgcagctcaacccgaaagcaagaactcgtcgaaataaaactaaagcaaaaaggtgacgatgcgccgagattgtattgaacatgtgtgttaaaaattacatagggctcggggtctatttatacccgagaattacaagatatgtccataccggacacgaccactatctctaacaaactctaagataccataagtctttgcggcagacttttgcccaaacatatctctaagaaagttacataaaacatcctaattaatagatacaattgccttctcaggactctatccatgtgcggtaatcatcttgaagcacctcaattcaacccaatgtcatacaccaaattatactgtcagaatcggctgcatcggctcacctagtccgactctgacccagccgatcctaattatagccgatctggacttcagccgattcttgctctgttctcggatcaatctccgccttcgactccaccttaatctaatctccttttctgatgctgatattaccaaatttggtcgttaacactataattcaacgactaaattttaacggctatacttgtaacacacctatatttgaacggaatattttggaatggatatttttttaatggctctcaattatgtatgcagtctcaattatatatgcaatcttaattatgtatctaatctcaattatatatgcaatcttaattatgtaaggaatctaaattatg

SEQ ID NO: 62632 - DNA, 997 bp, Oryza sativa
aaaaaaagtagaggggggggaggggggctcagctgcaccgagtagtgatgacaacaacaatagacaaggcgtcgtttggtcaatccggatatgggcatgagctcggtgcagaaaaaaagggttgcaatatggcgtgaggagagaattagaaatgctaaatttgtcgcttctttctccaggatatagcagacgcactaatttggaggaccggatggtatatgtgctcgagccggttttttctctccccccctacccccctacactattttgttgatagaggacgtgatagatgagctgctgctgggaatgctctaaagacacacgatagcatcgatctcagttgatctgatagcacagaaacgacaacatatgttacagtactactggattatttttaggcagatgtctattttatcccaactgctccagtgcgcggtgcgccgtctaagtaaaattagacatcattccaaatgtctcaacgattgtgaatgcctcaaatcagctatttaagcagtgttttgctccaacgaacgctatcgacgacaaatcacgcagcaaaaacgtacgacgtgtaagtggatcgatcgaacgtctggtcgatcgttaaagtgggccggatcttttcttctccgatcgatctcatgatcttccctttagtagcgcatgtacctattctcggctttatctttacgtgcctatcgctcaatgcggttcagaggggacaacaacgtatcgtcctggctcctgtgcacatcttttttctcctgttgatacagctttaatcaattttggtgtaaactggtaccccttggtggaatccacggcatgacgggtcgatgcttctgcagttctctgtgctgtgcgtttcacattatatggtaatacgtccaacggagagagacatggaattctgcgttattttagggtgtgcttggttggagggatatccctggatgggagatggcgatttagtttttgagtgtgtttggttggtggg

SEQ ID NO: 62633 - DNA, 727 bp, Oryza sativa
ctagccctgtctcgcagccatctttttcattcttttttgttcttcttttcttgaatgaaactgagttgaaccctttggagcctacaaacactgacccacaagctagtattgcaagtgctccaacgatcaaacactgaaaaaacaaaagagagttgaggagcttgctttgcacaagcaaaacccgctttcccactcgctaatctcgtgatgtgtcccccacttctcatcagacaatgtactactagaatacaaaattagtacgcattgcagcggcaacaaaaagttcatgatagtacgagcacttgcagatcgattagttaatctatcagtttacctgctcatcgccgacgtgatcttgcagatcgtggcttagcacgtacgcggatttagacaacgtgctgcatgcataatctgaaaagaaaataaaggaggaaccctattcactatcctaaccctgaaggacatgcactttcgtgtctaatctttgtcatcttgtcagtggaacaagagctggcagtaccctttgattaatcacgttgattagctctgaccccatcttaattacttaactagcatagcgacccgcacagattgtgcggctagcatcattatattttcttttatataatagcatatatgttttctcattatattattaaaatatattacaatgacaacataattttaaattttacaataactttacgaaactactaatgtgtaatat

SEQ ID NO: 62634 - DNA, 21244 bp, Oryza sativa
ttttgaatttcagtcatttcctaattgtatttctatatggactctagtctcctcttctaatattccttatttgttaatttcgaatttcaactatttctaaattgtatttgtagatagactctagtctcctcttctaatattccttatattttaattccgaattttagctatttctaaattgtatttctatatggactctagtctctttctaaattgtatttctatatggactctattttttctttttcttcgattaatgtgagaatttctaggccatgagagcgaacgtgaaggctcctttttctattcctttaataatataatagattaggagtcgtgaacattgtgctaataccaattgagtacatgcttgtgttaattgcttcacggttggttgagcctggatttttatttttcggtgatgagcacttagtagcagctattagttgtagatatagcaattaccaaaagtagatgggttttcgttcctacaaagaatgttcgctcactcaaataatcataattattttaagatagatcaatatgatttatattgttttataaatatataagtttaaatgacttatgcactttttttaaaaaaagaaacaaaaattgaatgcccgtgttatagtttaatttgttcttttgttataatgtgcagaagtcaaatttgaatttgtatatttgtagaagtaataaatcacatattaatttatcttatcaatttttaaaagatattaataattatttgggtgacataatataaacaagggaatgtctcgaaaaaaacaataatttccctatagaaaaacatgtcttaccatactgcatgtctgcatactgaacactattttatcattttttcgtcgggtcgacaaagaacgccgaccgtaatatattaagaaaatagagaatgtacagggatggcgaggcttcacagccaccgcctatttacaagatgctacaccacaaacactattttatctgagattctcatccccaacctcgaaaatgcaagcgtatctgcatatatggacacatatggattgaacagtacagtggtctgcatatatgagtcaactcgaatacacgtatggtaatccatagaataattcccatttaaaaacccacgaattcagagaatagtttgacctttgctagcaagcaaacagatttgcatatgcatgaacaggaacatgtctattaatctggctacctagctttggcatttggcaatggaaaagaaaaacaataatgtcagggacaatctggcaatggatggacgagaccacggcacttgatcgattgtatccaataccagggactgatcatccaggtcagtgtgtgtgtgattaagcagctgcaattctaaatgacagcactttgcttggacttgatagagatccctgtgacagatcagaggagaccagagtctgcgagtttgacaaaattgggcaccctagctgaaaaacaattcaatccaaatgctcaaatttcaacgcgcggtgtggaacctgaccataccctgctgtactgtatttgtatttgtgattgtttttggttttagaatgatcaagttggtaatttagttagcagaaattgggttgcaaaagattctgatattagctcaagcagttgactgattgctcataattgagtgacaaaatgtgtactagttgtatattgtattatagtaccagttattttcagtagcatgttgacaaacttggctagatggtgtgggtgtgttcatttcaagtttcaactctgaacagcacataaatctgataaatctaagctaaaatgacagccacaattaatccggccttgtcaccatcaaaaagcctaattaaattaaggctaagaaagaaatctatgtcctgatcatgcaaaaagaaaagaactaaattatattgtgctatgattcagaaaagtctgaatttttttcactgaagtagtacaaatcaatatcgatgtgaaactaatgaaagtacagtgaagttggcatatgtgagacaggcaaactggatacagagacagacaaaacagagagagagagagagagagagatttgggaaggaagtaaggagataagtcagaggaggcgtcaaagttgacgtgtgtgggtggattagcatcgttaatgtggtgttgtaattccaaaagataaactaatcacgcatggcatccatggccagctccgtcgctttaggcttttggaatcgatcagagcacagcagctatctcatcgattaagctaattaagctgcttgattgttagtaattttcttccaagtccacacatgccattatcatcctctcctctcctctatatataaggccaaagcccgacccgagctctcccgccattttcctcaaacgatatagctagctctactacacacttgctctgcccgatgatgatggcgcgagaggtgagcagcgaggaggaggctggcggcggcgacgagctccggcgagggccgtggacggtggaggaggacctgctcctcgtcaactacatcgccgcccatggcgagggccgctggaacgcgctcgcgcgctgcgccggtaagcagagcaattcttccttcttctccgatggatcgatggatggatagatgaattgagttggatggtgcatgcagggctgaagcggacggggaagagctgccggctgcggtggctgaactacctgaggccggacgtgaggagggggaacatgacggcggaggagcagctgctgatactggagctccatgggcggtgggggaatcggtggagcaagatcgcgcagcatctccccggccgcaccgacaacgagatcaagaactactggcgcacccgcgtccagaagcacgccaagcacctcaactgcgacgtcaactcccagcagttcaaggacctcatgcgctacctctggatgccccgcctcctcgaacgcatccaccgctcctcccaatcccaatcccacgacgccgacgacgccgacctctccgtctccgccgccaccagctgcatcacctccgacctcgtcgtcgacgcgcatcacccgccgctcgccatggccgacagcaacgactctgcagccatgtggcagcaacatcaagcaccacagatgagcgtcgccggcgcgccgccgccgacgacgacgatggcccaacatgtagtactgccgaccgcggcggcgtcgtgccaccagatgcaggatcagttcgtctgcgcgcgcgcggcggagacgacgacgtgctgctggtccgagtcggagtcgctgccgggtctcgcggggctgtactacgacgacgcggcggcggcgctgccggagtttgacgtggagaccatggccatgtggggccctgaggacgacccatggtacacgcaaatgcttggcttgtgaaaaccgttgaccaaatatgatgccttcctacctacacctacacatttgtgtggattaaagaagaaggagatgcttattatttggaggttaatttgatttgatttaacccccaataatctcgtctccagttcttaccacatatatcgtcaattctcaagtacagtacattagctacactttagtacagtagtagtattttggaacatgcatggagtaattacttaagctacacttggtagttttcctcctccatgatcatcaagtaaaagcatgcatgcatgatcatggatggagataaactacagtgctaattaaattagtctggatgtacggttaatcgatcgcttggtttttactatactgcctgaattactccattcttaatttctcgggacggatgaaacggattggtttaatttgtttgtaataatgtatatcaagctagctagctagcttaatttggtgatgatctggataccacaataagacttttggaactccttgtgatatgatggtgaggtgtgggactgattaagaaatctgtatctatgcatatgtgtataagcaaactcatggatcggtcactttcttgtctgatcaagatccagataattctatctcggctttcgttattacgtgtttttcaaactgataaatatatggttggtttggtttgtgacctaaataggccttaccaaattttgttggtgtcaaattttagcaagttttggcatgactaattttggtaaggcaaagttgtgtttggattgaagccaaaatagtctaagttcactattaaaatggcctattttcttaggcatgtcaaaatttggcttcaaaccaaatagacactaaacactattgaaattgacaaatattggtaagcctaatttaggcctcaaaccaaccagcccatagtgtcttttgtataaaagttttctatgtaaaaattactctaaaatattagacaaattaaaattttgaacttgtaataattacaacttaattaattaagtaataattgttttcaccatgtcttaactttatttttatctttagcagaaaagaaacacctcatcaatcaccaacaattccttcattactgtacaaacgaccagccaatataatattagtccattaatcagtagtgatatttgcaaacttgtttgtcctggtgacggtgccgattgtgacacatatctctcagagttgttaatttgcaattataaaatacaactgacttctaagtattcgaacattatattagttttgtttttcgttttaaacaaagactgcattaattaagcacgcgtacgtttgtgatgctacacttttctcagaggctaattgcatcaacctcatctagctagctttagcacttggtaacaagcagtgtcaagtgatgtaattgcagatgagagatcagcagggagcagcactaagaaccaacaggaaagggcacgttatgattagcaacagggaagaaatgttagctagtggggttaactgtgcaagctagctagcatgggtcgcttttagctagctagttagcatgggaaaagggacaaaaaaaggatgcattattacctgcatatattgctgcttcttacaaaattaatgcttttggttaatttctctgtcagctagcttagctggggaatcagaacattttaatgaggatgatatttccgaatcagaattaaaaatgagattaatttgtacgttatgggagtaatattccagctgaaagctaattaagcaagtaatactactagttgctagtgctggacgaaccgatcgatccatgagattcaggcgtcacctgaggaaagagagagagatatatatatgaaaaagtagttgctagcttgccgccacacatggatcatcgaattaattcgtgcgattagaatcattccgttcattccctcgcggtttgcgtggctagatagctgggcccaaattaatcgatcgacaatatgatcagctagctagtttgctccggccaataacagtaagtaatgattatatcggcggtcggcggcggcgccaattcaagcaagcttgttccttttcagatcatcgacgcagcatggtccaattatattagatgctgttaatttacagcagctgcgacactgatcgatggcgaagcgcattagccgactatacgtacataagtaatagtgtacgtctccaaattaatcatcttctgttctgatatactccttccttccctaaattttaacgccgttgactttttaaaatatatttaaccgttcgtcttattaaaaaaaatttgtgaaatgtgtaaaactatatgtatacgaaaaagtatatttaacaataaattaaatgatagaaaaagaattaataattacttaaattttttgaataagacgaacggtcaaacttttttaaaaagtcaacggcgtcaaatattttaagattgagggagtatatagtttttagcctcctaaggagggtggctaatataattagtccatctacagttaattaagtcattttaaaaatactctttaatatattagaagaaaacataattttagttagacagcacaaacaaccaaaagactattaccggggcaaggaaaaagcaacaaaagaaacccacaaaagttgctaaggggaatctaaaagctaaaaactgctcttataggctatgggtggcggttgtgccccactaaatcccaaaagccacatcactcgcagttgactacaggcaaccttcctaaggataaactccaaaaccactgaaaccgatgagagagatagtcgaacactctggagttccgctactttcacagttaccagaataccgacaggattaacaaatcgaagccctagaggtcggccaccacacctggagcaagcagccacggggagatgcaaggtctggcaagccaggaggagacataaaatggtgcgagacctaacaggtgaacacatagacgagaaaaatgtggttcaccgtttcaatctcttgggtgcaaaaagggcaggccgagtgactgtcaatgccacgctttttgtagaagatcgatcatccaactgcggtactggaacacaagcacaagccataggaagaatttgcatttagcggggcctttagcccgccaaagcagataagagcagagggtcgctagccaaggaagaaagcatggtaaacggagcgagccaaataacgctggtcgcttgtccaacgccagataagacggttcaccgtactcgaagagaggtggatagaaaataccgtatcccgaaccgccaggaattaagtcgatcgatcggcttgttagaagcaacagcgacatccacaatgccagtatatgtatcgtgcatacaagtagctagctagcttgattgcagatgctgatcgagatgcagatacatatccacaaatagctaccgcatctttcttaattactgtcattctaactctatcgataatgatcgatcgagctagatctcaactaaattggcaagaaattaagaggaagaataaaccggccatgctttctacatacgtgatccttatgtatcgcctactatatagcgctaatggactagtatttttttagtttatttaagagaattttaagtcatatgcatgcatcttaattgaagctggcttgtaggtagatttgaggcaaatccccggccgatcaaaacgcacaactaactacctttaattgactagtgactagctagtgtttccctgccatacatttcgcaatcatctgtctatgtatctctgaattaaactgtacctttggtcatcaatcatcatatgcatgtgtcgtcgtttcagactttcttcagtaattaaccggccggcttaattgccccatggaatatattggccacgaattgcatgcaggtgacaaaagtgcatctgcaagtcaatcaaaagcaacgagacgacttgaaaagtgcagagctgaaggcgaaagagcaaaagtccaatgcatctcatccaatctcatcctctaatcgaatcgagacacacaagttgtagcgctgttgatgtactgcttcgatcttgcacggaacacacactgctggctatgtacgcctttttctttcaatcattcaatttatctcatattcctcaacgcgcatgcatatttgtcccatttcgatcgaccattcgagcatgtgtcgtgcttacctcaaattgtctttcctcgataaactcctttcaagcagctgcatgattgatgcatttatatatattgcatccaccaaattcttgcaattatatatattcgcaagatatgttactacagcataaggaatatgcgtgtacatatatcctcaccaatcatatcttcagttatacattaccatttttctttcgggaaatgaagggatatatatgcatggttctcctgagaagatgcaaacaaccacagataatgcatgtacacatcttatccaattccaaacgaaagaaattataataaacttgcatgtgcatgcataacctgagcctaactatgttgggaacaagtagttgtcgatcaatatacaggaacgtgtcgtttgagaatattggcatatgcaacttgcatgcatctctctgcccatgccatatgaaagtctcctttggaactcaccagttcagttcgagccatgaattgtcaaaatggcatgcacttgaatcaagcaagatcgatcgaattgaagcacgaggtgaacgacgagcttagctttcggtttggttagcttccatcaacccagtgttgttgaaggtgacacttaaaaaattcagatacacacttagaatttacatacattaatatcgaccacgtcggtaaattaaacaaacatgattgaggctgtatatttttgtgtgcctactatatttgcttcaattgacttcgatcgcttcaattgacttggatcgagagagatgcaggtttactgattacggtcgtacaaactcagatatcttggatagcgattgatggaagccaacacgtagtgtatgaacggaattgatggtttttgagcgaaacgtatcgctcctaacaagtcataagttgatcatatcttgcttagccatgaggttggcaacttgccatgatgcatgcaacacgaaccaaaactagattgtgccactagcctctgctgacgacaattgtgcaggtaagtacagtaccctgatatggttgtgttggtcttggactcttggtagtagtagagatgagagtatctcaggtcttttcatccactgtttagtctcacactgtttacagcgagaaaatcttgccccaaaaaacagtcatgccttcattctcttttcaccggacaagggaaattaagatcaaattcctgctcaaacattcacaaaaatttcattagtatataatacataaattgtagtaatgttataaattcggcagagtgacggtttggcatgacaccaacgaaccagatggttacatcttacaggaaggaagcattacaagtcattcgctttcatttgggctggccgatggctctgttggctgcgcagcatcttcagatgccgtctccacggtctctgcagagtcatttgaagttggtaaatttgggtcatcatcacttacttcctcgtcccagtaaccctccagcaacttcatgactaacttgtaaatggcatcattgtcgacttcctgcagatcttccagtttatccaaacccccacattctaaaataaactgtgcatacgggttcaccgtggaaccctgcccctgcttccccactgcacccgcctgaagtatgttttgaagaccttccaggcacgcatatactaggtcagcatcttggtaagtgagaacattgcagagtggctccaaacatcctcgactcaccaaatatctgtggccaaatagagaataatcattgcagagcaccaggttcaatttcattgacacaaaaaaaatacattaaacatacatttgaatgtaaaagaataccaagacaattcctggctagaacttactgaatttgatcatttgaaccaccagacgcagcatttgatatagcccaagcagcttcctccttgatatccttctcggaggtctttaataggaaaatgagagggcttataacatctgcatcaattactgcctgttggaagaattatggtcaaaacatagtagtacaatcacttaatgtagggcatggaagatgatgcagcaaaaatagacatggacattatccttgctgagaaagcacaaaagtcagaaaacacttctacctgaatattatccttgctgccagtggagatattagaaacaattagacaagcttgcttcttgatgctctttgggtaatttcgtgctagcaacggggccaaataattaagaatgtcattttctactaggacctgcaaaaaattgcctcgtaggctcaacattaattccagaagataaggagaaaaacatagcagaatataagaactatcagtcaagtattagaacaagtacagaagtatacaaagtatatttacattgtcatttctacaatgtatactatcctggaagataatagtatacattggcatttctatgatggaggaatacacatatgaacaaagagaacacacgatggcacaaggtgaccacaatatgagtttcaggtcataaaaagattccgagctttactgcaaacttccagccactccacatatgtcttctagtctaattgttgcacatcattgctaatccatagtggtaaaacaaagaacagcgacaggtaaaaacaatatgatgagtaaacaacctgcacttgagcatcatctccagaagagattctcgcaagtaccgtaatgacaggaagcaggatattagctgatgcatgcctaaaatcatgaaacaagttaaagtgttgtaacaaagaatatttggaagttttccatacgcaaaactgtagtacaaagagaacccagaaacttacatcaaaagatttacaagttgagggcaagcacccgcatctagcacatgttgaattccgtcagatacaccgtcacatatataacaaagagcccagcatgcatcacccagtatcttttcgtcgactgaatgaataagctggctgattatatccagtattggcttcacctgcaacaatcagcaatgacagctcaaattatattccttttaaatttaatactacacacgcagtagtcattcagcaacctacttgcacttcagctggtaattttccaaaacaaaggtttgacaacgcccaagtggcagtcctcagaactggaactttcatgccttctctaaattgggcaagtaatggtgtcacagcaccatgatcaaggacgatctctctgcaggtaggcacgtctgcagctatatttccaagagcccagatagccttttaactcataagaagccagaaccaacaatatcagtaaccaaaccattacaaaaacaagtagcatagagtaccaatctttacctgatgcctgatattagcatttgcagattctaagagctcgaccaaccttggaacagcaccacattctgcaactagcaatgtatagtcagatgcagctatgttggtaagaacccatgccgcctccatctgcaaaacagtacatgcagaataagaacatttacaaatggaaaatccggaaaggggagacagaagaagagaaaaatagactaaacatacttgtagctgaggatgctcatgtcttgagaggaaatcagaaaaccttggcaggacatctgctctgatgatttttatcacggttgggttcttctctacagagagaacaatgatgataagggggatattaatgaataaaaagagcaaaacaatatcgcatattaaacatgtgaaataccatctgaaaggagtctcctgaattggatcgtggcttctaactgactagtggtatcatctgaccagaccttctccaccatttctgataggccttcaagctagctggatagaaaagacagaatgagggaatttgaaaggaaacggaagaagagcacttcacaatgagtttgtgaaaccaatggaagcatttcattgtcctagcaatgtcacaaaccaaagcttttctttagacttcacaaaccaaagtatcgtggtaaacaattggaatgcaattgcagtttcgcacaccataagaggaacgcgacatgggttatttatgtttcaaataacgcagcagtatacaaacttagcctacatctatctacttctagtgagtgtattcagccaatgacagcagtgactagtgagagtgagaggcctttttccttgaatttcgttttgcagattgcctacaatacatgaccagaactcaaacatacggtgggaaattgcaggtttctttacatagaatgagaaatttgactagctctagtatatgtgccagaagcgagaacagtcagatactccgaaagtagagttaaaaccctagagtaagcacgcacctcagagtcggcggcagtcggaggaacggattcggcgggaggtgaggacgggggcgaagagggtgcagaggaagggggagaggtggcggtggtggtggtgggcacatcatcggcctgagatgagggggtcgcggccctcgcgggcgggatgggagtgggagtgggttcgtctcggcggcgcttgaagaggccggcatcgcggttgctgcggcggacggcgaggaggcggtcctcgcggcggcggcgcgagcgggcgacgtcgacgccgggcttgtaggcggcgaggcgcgcgtcctccgacggccgcggaggtggggctcgcggcattgcggcggccggcggggtcgggcttgagtcgagcctgcctggctggtcaacccggtcggtttggaacggaagttggggcataaatccgggccgttgattctaagggggtgtttggtaactctgtgataaggacttatatttttatgaggggaaataaagtttagccccactttaatctctccaatcaaacaccaccttgtgtagtccaacggtccgggttcgactcccggcaaacgcaaatttatgccttttgggccaatggcacatcggcccatcccatcaagggaaatgtcttggcccaataattgttttgcgcgtgtactatctggagtattttaaatgaatatgacatatcatgcatttaagggttaattggatccatgccactgcaattttgccatattagaaaattgccggtactatttgcgaaatctgctgagtgccactggaattttgtaaaattggatccatgccaccgccgtcgcattttccatccatcgccgtcactccagtgtgggacccacacgttagctccatcctcttcctccatcccctctcttctcccttccccgtctctcttcggcaaacagcagcagcatgtggtcggcaaacagcagcagcaggtggccggcagcagcatcgatcaacctccaacgcccttcatagttgtctgcaccaaacactcgtgctccgcagctctttgcccaacaccaaaaattaaatctcaccgccgccaagaaatccaggtccaatctcttatttgctttgatgatttgcaatcacgtggatgttctttgctaatcgtacgatcattgactctgctgttcgagttggcccacgacgacgacagccaccacggcgacgacgaccacgatgatgacgagggtggcgctgcaagaaagaagcacctcctgaggcagcgacgaagaggccgtcgaccagctggtggtggccaccacgccggcaagccagctgcagatggactacaccatggaccagctttggaacgacatcgcggcggtggaagctgacacaagctacgacgcggcggcgacggtgatggcctcgccgtcatcgccggtctgggaattccgcggcggcgttcgtggcccttgccgccgtcgtcggccgactgctgccgttgccgccgccggccacctgctgctgttgtttgccggagagagatgggaaagggagaagagaggggatggaggaatagggtggagctgacgtgtgggtcccacactggagtgacggcgatggatggaaaatgcgacggcggtggcatggatccaattttacaaagttccagtggcactcagcagatttcgcaaatagtaccggcaattttctaatatggcaaaattctagtggcatggatccaattaaccctttttaaaactcaatatataagcaatgtcaaatcattatttccacatcattttcacattatttaatcatatacgtttatcatttctataactagatgaatatcccgccgcgttgctgtaaaaaattaagttacataatatgtataaataagatgtaatttgattataaaaacaaaacaatttgatacaattttaagactaaaaataattgagattgcatgtttttaagagagaagaaataagagataatttggaccgtagatctatcatccaaaggttagaaataattggagtgatgtggcttaatgggagaagagagaaatagcattaactacacttagtggggatgaactatataagtatataggatgtataatatgtatttatccacatattccgcggcaaagcacgaggtattaactagtaatttaaaacggtaaagctctgatatttagatttagcataaagtgtgggcccatatgctaacttagccgattgaactacgtcaacgagccacatctgcgaaaaactatcctcaaaactcattttgcactggtttaaaatatctagtattgcggttaactgacacgaattaggccttgtttagctgataaaattttttgcccagcgtgtcatatcggatatacggacacacatttgaagtattaaaacatagtctaataacaaaataaattatagattccgctagaaaactacgagactaatttattaagcctaattaatccgtcattagcaaatgtttaatgtagtaccacattgtcaaatcatggcgtaattaggcttaaaagattcgtttcgcaatttacacgcaatctgtgcaattagttttttcacctatatttaatactccatgcgtgtgtccaatattcgatattcgatgtgatagataaaaaatttttgttttggaaactacattcgatgtgacatggccttagattgaagctacattttgagggagttaaagtgaacatattccgcgtaaaaagccttgggctgggcgctcacagaaccttctggaaggccgggccgaaccaacgcaacgcggtccccacagcccacacgcacacctcacttggtgctggtggtataaacccaaaccaccgcgtctctcccgtagaaaaccccgcgattaaggaacgaaaccttctccgccaccgccgcggacatcaccgccggcgaccacctcacctcgccgccgcccccgcaccctccgatcctcctcccctgatcgcctatggcttcggcgagggccactgacccgctcgcctcgcgcgatcccccaaccttgccctcgtaccttcctccgcctcctcctcctcccttgccctcgccatcgccccaccaccgtctcctccccgctcccatggccccgatcctcctgcacctccaccccgccttcctcgcccaaatggactcccgccggaccacctccctcctccaggttgctacatctatcaccatgctttcttgctcctgcttccgctgtttattttttttcccaccaattttgggtcactaactcgctcttgttgttggattagtttttgaaggacgaggggggcatcccgtcgccggaggcggacaagaagagggagcaggtcatccgcaagctcaacaaggtaataaagcttcaatattgcggtgcgcgccgcgatcgaatctctatctcatccgcgctgctcttcacagattgtgatggactgggccaaggtggtggcgtacgagcagagggtgcccccaaggcgagcaaccgctaccgttttgacctatggatcatacacgttaggggtaagcaaccaacacacaaaatatctgaatgattctttccaattgttgcttccgatatattgtgtgatatgttcccgacccatgctgctacagattagtacactatacttattttttgtgttgtcttcacaaaatcaccacacacattaccaattataagcacaactatattccacagagaggcagtttactaagcgcttaattgttactgggatagtgcaggatgttctaaggaatatatgcccaaccaactttgctgcattgttagttgtgtggtgtctggtgtatgtatcactgtaaagtgcactgccttgtcacctttctgttttcattaccttctattctaatatacttgtctcctattattgagccgggctggcctaagataggcggaccaaatttacttaagaaaggggtatgtacatatttacaaggttccaacttcgacaagaggctgtcgaagtaaaaggatgttgtcacaagggcaacttcccgaaagaaaaaacaattacatcatgctgttgttactctcctaaaactttgaaaaccccggcttctttccagaccacaacctcctctttaatcaaagcaaagaggctacccgctgtccggctctgactctggaaaacacgtgcgtttctctccttccaaaccatccaacagacaagcaaaactagcgtgtcaaaagcgcccctgcagctagtctgaactccttgccatgccaagagccaccattcccctagttccaaccctgcttcagccggcagttggacgccaattccagcccaacccttaatcatcctccatactctggtggcagtctcctattattgcaaaaacacatccatggcaatgaatgaatttccccctttgctcatctaggaaccaacttgcgcgtgttttaagaaaactcttgttggtaatggagcatcaggtggttgcaaaataggcactcaatgtgcatcaaaagttcacacttttcattttaaggggggatcatataattatctggcataagaaaattaaatagtagttgccatgactcatggacaggatcagaaagccaagaatgctcatcttattaggctgcaaaaagcatgtgcattatgcagtcattatgtagtcaataactcaatgtgcgcattatgtgtttaatattcttattcaagtcctgagggttaataacatatatgcatgtagattcaacactgagcaagttgacctaaacagtaatctaaattaaagctttgttaatcctttctttttttttcctcatgtgtatgaattaaagctttgtgtaagccttacaaattgaatcctgtagaacaaatgacaacttgtagaatataagatggcacaattccgcctggctttgacttattgagaagatttggctaacaattttctgtttctgaaggctcatggacctgaatctgacattgatgcactatgtgttggtccttgtattgcaacactgcaggtgggttttgttattattattttcagttctccttcaacctgagatcatggcagggtatttaacatgtgttgattttgcagtaccattttttcattgttctgaggcaaattcttgaagacaggccagaagtatcagaactgcagactgtcgaaagtgctaaggttccattgatgcgatttagattcagcggtatttctgttgattttacatatgctcagcttccagttatcgatgcatcagaggcaagtttattctgtaatcaatatgtagttacaagggtactcagttattgtactcgataaacaatctgaatttcatcgacttcctttatcctgcaggctataattacatctaatcctcatttgctccaaaaacttgattcgctgagttggagaagtttgtctggagttcgtgttaacgaacaaatcgtccagttagtaccaaacgcacaggttgatgactaatctaatttaagttaccagcagcccagcatcctcccttatattctcatttgctacattaagtcgcgtttagatacacttttctctgtattttcatatttgtcctgggtaccttccatgtacttatgttattgccttaagactgatctgtcactatgcagatttgttcatttttcttttcccatagaacacctcaaaatattttgtttcattttgtcagattccgcttttaacattttatctctgaaaatttgtgatgcagaagtttcaaattctgttgcggtgcatcaagctatgggctaagaggcgaggaattcactgccatgtatgtggtttaatatgctttaatggctgttattcagctatatgaccttcatatcttctttccgctctaactgttgtattttcacctatgatggtgttttttcagttgctcggcttcttcgctgggattcatttagcgattcttgcagcttatgtttgtcagagatatccatatggcaccatcaatggtctgttcaccatattctttgatatatttgctcactggaattggcaaattccagtaagcttgcatggtcaaccaactaattgcaggcgtcctgatgggtctttcatgcccatactgttgccttgtactccaccggagttttgcacatccaatatgacaaaaggcaccttcaagaaaattagagaagagcttatgcgtggttatgctttgaccaaggtcagcttagatccagttatgcttctctcatttcttgaacaataggagatttttagtgttgggtgataactgtgatgcatagttaaaaattgcaactcttttatataaccgaaaacaaatttccgacattcctatgtcatactcctgatctcttcgtgcatgccagtttgtcgatatgcttattcctgttctgatttcttcgttgaaccacaaatgatgcattcctccattcttgcatacgctcatggcttgcgatattagccattagtctgtactaacttgacacatggaacctatctcattttcgttattatgctttcggtaactcaaagagtgtcgactctttctcatattttgataggcatagctcattgataagcataggagcgacctcatctgtcgaaaaatggtcgaatctgtaactcagatttaaatctccgtgtacagttttcactgagtagtgattgttctcctctgcattattactagggtaatgtatatatcagtgcttgagtgcttggatgttatttgatcatgtcacagttactttgtttatccaatgcaggagccatggaggcatgattttgagtgggtctggctttttgcaccgtttccatatgctacaaaatacgaagaattccttcgaattgctctatgtgccccaacgtctgaagagctacgcgattgggctggttgggtgaagtcccgcttcaaccttatcctcaaggttatttcttggcttctgtcatgttccctttttttgttcctcaactgttctttactcattctttatcattgggaatgttgagcaagaatttacatgctatgttaacttcctcttttgttctgcagctggaaagtattggtgttgagtgtgacccagattccacagaggaagttgatcatacagtcttcgagccaagcattgtatgccactggggcctcatatataaaacaagcacccatattgatattagctcactgggagaagatttcatgaaggatgtcatcaatgatgtgtatggcaaggtgaaaggtacacattcaaagctgacaatgtccatcgttaggtcatcacagcttccgaaaagcttgtacagccactctgtgtacactccatacattcctcaatatatgctgggctaccagactccgaccgactacagtggcgcagctggctaggacttgtgtggatcatcgttatctgggacttgttgtgcgaccattggatcttacctgacgtttcatccattgtcggatatcctgaactggggctattcctactctctgttctgttgcacctatcacacacactatcagagcagatctggagatcagagtctgctccctttgagcttgcagttgcagtgtatatatactgaattcatgagaagtgtgaagtttccggctgctcgatctgacggctgcacaagtgaacatatggtagcgtgcggcagctagaaaaatgcagcaaaagcggtggcagtaaagtggtcgaggatattgtacgctgaacatccaaatgagttgcatttggactgaaaactggtgctggggtgcaggtcatgaatccaatggtgaatgcacagtggatttttcatggcagatctgaaatctgaaggatagtagattttcattagcatcatttgtggctgtgatactgctgatgtagggcctgttcactttgataaaaaaaaccttaccaaattttggcattaccaaaattttggggcctgttcactttgttgctattttcaaccttaccaaattttggtaaagttgtaaaaaaaaatggctacatttagtttgctgccaaatttttgtaactatattagaaatcctaccaaaattttggcataccaaaattggtatcaaagtgaacaggcccttagcaacttgctaaaattttggcaggatttcttatatagttatcaaaatttggcagcaaaataaatgtagccacttttttttggtaactttatcaaaatttggtaaggttgaaaatgacatcaaagtgaacaagcccgtataatcagaatacatctcctacgttcatttgtaacctgtagttgtaagggggaaaaagggttgtactactactacgaggcatcagagttgtcgctattggtttgttttgcacaaaaaaaacattgatgctatttttgttgagttaatcagtacatatatactagtactgtagtaaaatactgttgggtaaggactaatatagttgatccgatacagaaacacgattggcatgtgaagtgcaacgaaaagatggaatggcgttgcctcgttgttaagtctctcgtgggtcgtgtttgatttggcaagaggctgaggatgattgtgagcgtgccacatggaccagatggagctagatgatcgaaagggagagaagaatactcctactcctactagatgcaaacatttgggagtactacctcaaacgcacgtgacaaggcattagataagttaggtggacccgggccctcttaagcaatgcaatggatacaacgccacaaaaagctgagaaaaaaaaagagagatggatcgaccagcaaggccaggccaggctgacatacagctgagctagctaagctgcatatgcatatgcagtgtggtgattagcattatcagctaattaatgacaccacacttttttgattagttggttgatggagggagacatgacacgtgtgggtgtcatgcggacgcatccatccatccatctcgcgccaaaggctaccactacacgacagcagcaagtatagtgaggtttctatggtgcgcgcacacgtcagcgcagatctcttctgggccgtgcgatgcaaaaccgtccgtacgcaacgtgatactgtcatgtgggccccaccccacccctctcgacaggcaggccccggcgcccatgtgccgctgcctccgccgtcgcgtcgcgtcgtctagcgcagccgcagccgctgccgctgggccccacctccctgatcagccacgtgccgttcaatcctccccacatgcccccttccgctgtttaccaccaccatctcccccctcccttttccaaaccaaaattaaattgataattactcctactagtaatcaattaatctcaattcatttcaattttgcgaatagaacattttattgtcagaagaagcaaaagcatttctcaatcagt

SEQ ID NO: 62635 - DNA, 3579 bp, Oryza sativa
caatgtagtccgacgcctccgccaggagcgccgggaacgccagcttccggcacccgggcactagccgccccagcaccttcgccttgctcgccagcggcggccgcgagcgcggcgccggacgcgcggcgggcggcgggggcggcgcgccgaggcgcacgcggcggagcgcgcacgcgcgcgcgcgggaggcgaggatggcgcggctccaccgcgaccgccctcgcgccgccacggcgagggcgcggtcggccgcgtggcgcacctcgcgcgacgacgcgggtgatggtctgccgctggcggcgcggaccaggcgcagcgcgtcgagcagcttggaggagtagctctcctgctcccgcctcgtccgccacctggctgccggcgaggcggcgggatcgagcttgcggtcgtgtggcgccgtggaggtcggcgaggacgccatgggcgacgcggggttgtgtaggtgagggagacggcaaggcgagctacgagagaagagaagagggagggaggagtttgtagagtagaggccgagggtgggtgatgcaggccaacgactcaaatttaaaggggaacaggattaacaccacgattactgcttaatcacccttgtgatttccgtgccctaatctctcactctctgtctttatataaagtcttttgcatggttgacactagtagcattctccttgggataggatcaataaagtaatttaattgaagtggccaatctgctccatgtgcatacatatgtacatgggtgttctttcttatttgaatagaaattgtatgtggttaaaagatttttattatctatttgtcctctttggacatgtgttaaaaggactgtattcgtgattaatgtacataatatatttttctcctatataataaaaaaaatctactactaacttcatatttttaatgtatgacgccattgattttttatccaacgtttgattattcgtcttatttaaaaaaatttatacaattatcatttattttattgtgactcgatttatcatcaaatgttctttaagcatgatataaataccttcatatttgcataaaaattttaaataaaacgaatgatcaaatgtttgtcttaaaaaaatcaacggtgtcatacattaaaatacggagggagtactgggcaatataaagtactccagtacattggcagtgttggcacatacgagtaggtgattggtgatgatatatccagcgcgacaatggcgatgcaagcatgattaggaggaggagaacctgagcctctactctatgcagaggagagggaggggctcctcatctgatgagcagagcaacaccatggccatgccactatgtcacaggaacgaagctagtagctgactactctgaatgtcacaggtaagaagaagagtagtagtacaacctctgtatgactgtattatgtattatgtaggcatatgctgcatatgcaattcacatttttggtccgcacaattagcacaaatcatgtaagttaagctaagccaccacctacttccacatggaaccatcattatttccaccaatcttcttctctacctagtactccacatggagcacttagcatgggttacaatatcgcgtgattattgctcgtggttgattctcagtttttctcagttacctaaccgcaatgcttttggtagcggtaaactctaaaaaaaagatagagaaaaccctgatactacatctgtttttaaatatatgatgatgtgtgatgtttatcatctgtcttattaagataatataatattatttatattgttgcgatttattttattattaaatgtgctttacacatgacgtacattacatatttgcaatccatgtctaaataaaacgaattgttaaacatcatatttaaaaggtaaagtgtcaatttgtcatataggagtgtttagaaattgagggaatagcttaccttccttccttcctcctcttcttgatctcttcataaaaattcaggtttcacaagtaaagtgtttgcataagggataggattgctcaccgatttcatccttggcggctgcagaggacttgtgaaaggtcaaatgtgacctaaaattggaccttctctttaattggtgagggagtaaacaaacaccacgtatcctgaattcatgatacgaactggctagtacaacgcaaggcctggtccataccatactaatcaactaccatgttgaaatgatgctttaatttgcactacaattcaggcacgtttgagttgaaagcttctcattacaggctaatttggtggtagtaggaggttgcttctttgccttgacagcctttgcaatgagtactctatgctagtattaactaattaacctatagctagtctataattaagccaccacaagataagcatcaagcgccgacgcacgaagcaggaacaaggacacgtgagtcgtttgactgttgttgatatgatcagcggcggtgcacagtttgtcacctgaagatcgatgaaaaatgaataaaaacagcgacacgaaaacacacagctagcagcacagaggcttgcccgcctttgaaattcaccaagagaagaagatgcatgcagcagcaggcagcatagtatgataagactatatgcatgcatgcatggctccatccactgtccactgctgcctgccttgctgagcctgaggctgagctgcagtgcaggttcaggatgccaaagcaaagcaggctactgatgcgtcctcttgttaacaacactaacaatcaagtgtgtgtgtgtagtatgttaagctgcctttgtggatgccagcgatgcgacgccaggtgaacactgtacctacgggcatttacacatgtttcagagcttcaggcttgttgaggcctcacaaccttcaaattccacagaatctagcctgccagtgccatatcccatgccatacaccctctcgaatttactgcattatcctactagtattatctactcctatatatcctctaatgtaatgtatcctagctacctactactgatcgagtaattaatctaatctgctcaacagggcagagattctagttaactataaatctgctccgtgaggccttatatatccagacgcaagaatcacaggacaaagctatgcaagaatcacagggacgaagctaagcaacacaagatctgattaattatcgtttcgacaatgcagagggccggccatgtggatatcagccagcagagacacttcgattgatcgcttcccatcccataaataaataaataatactgatccattagacacgctgacgcttgacagcctcaccacgcacgttctccagtccagcgcatgaatcactcatcatacaacatctcccagcctcaacgctcagagatgatgattcatagagtatatggtagcatgggtgaactgaagaaagcctgtaacaataatttgcattttgtaaacagagtttttaaagtgctcgctattcaggcacatgccttggccttgttcattcagcataaacatatatggatcctgatcctggccatgacaccatgaccatcttgcttgcacttggttatggctgtca

SEQ ID NO: 62636 - DNA, 26111 bp, Oryza sativa
  unsure (1)..(26111): unsure at all n locations
aattaaggatacatatagagagagatgtggtagggatacacatgtagaccactatttgcaatgttaggtcccagaaataatggtaagttcatcatcgtgcatcgactgattgccccgtttgatatgaacaagagtatatcaactagtatactaatacgccattatattatatgtgtgcatatatatataggagtagtaaccagtgaaccactagtagcaataaaaatgatgatgtggcccttatttttaagattttttttagtagaagtagagatttggggcctgttcattttgatgttattttcaaccttactaaattttgtaaagttgctaaaaaaagtggctatatttagtttgctgtcaaattttggtaaactatataagaaatcctgccaaaattttagtaactatgccaaaattttggtatgttttttttagcatcaaagtgaacaggtcgttggcttgccaggataatgaatgaacatatgaagtcgatatctatagtagcgagacaaaagaaatgaaaagggggatctacctcgatcgatcgattgaccgatcgtagatcgcctagctagtcgcaaggaacttgcagttgcagtagcctccaccgcccaaggagcccgattcgccgtccaaaaacgcggggaagccatgccgggccgccatgtgaccctcgagacttccgtacggcccatttcggtttgggccaaaacgggattgacttacgtgcggcccattccggttccgtcacaggatctcgattacgtgaggcccaataacgagaatatgaattattgggccatgaagaatataatagtaatagtaggcctgcgtgatggaaaggaaaggcgggcgataggatgctggatggttcagcaacaaactgaaatttttactagcatcaggcattagttacattgtttttcctctcattctcaactgtatcgttatcatgttgtaccatcccgttcatgtggaagcttgactgttggagggttctgagcaaccatggcgaattgttggtgcattttactgagactctactaacaaatggagaggctaatttgcttaagaaaggaaaataaaaagaagaagggaaacgagtagttgaaagggaggcaagcagcatcgagatccagaccatcagcgcagcagagttgtttagatggcctcttgccggcatcggaaccaagcaagacaaatcacttgtcttgttggaccattagcagggtaaaaatatgtctaactgtagcaaaacttcagtttgtggttggaccatccaagacaagaagaaaaatgtcatgcacaactgagcttttagcctgatggatggtaaggattttctacagctagatgccatggtacctatcaattacatgcgactcaaaatagttatagaaaaatttaaaaaaaacttagtaacatcaattgtgttgatataaggctacacacaaacatgcataactaaatttgatctacaactagagaaacaaaaataataaagtcggatagtgaatagtacccatacaacgcagataaaatttgttatttttgtttcttcatatttcgatcgaatttagatttgcatgtttgtatagtgttttacattattgtagtctatcttactaaattttataaaatttttatatagctatttaaattacatgcatatgccacggtaccaccctgatggactggctggctgcaaggtgtgcccaatgtaggctattactagtagaattcagtgattcaccgattgatgatggatgccaccaacaaacaacgctccgcgggctcccttgcattcactctgatagtagtaccagttgtaacttcaccttgaaggtttgttcgagggagttttaattttcaataacaaccggtgaaaatctgaaaaagctagaaaaaacagcttccagcttaatatattttatagattttttttagaaatttattttatagattctacaattacaactttcagacactgatgtgagcttttaattctgaaaaaaacatgtaattggcagaaactctcctaaatagatcctcagtctctcgtgttgagcaatgatacatacgcaccgtacacataattactcgatcaactacatgtattcatcttaaaaaaatagtacccaacaactcaactgattttttttaaaaaaatttaatttaaaatcaaactctttcaaaacttatttttaagatctaaatcttttaaccatgccaccgaactgacgtagcaaaatgacattgtcgcacaggtctagctagcgtgacaactttatttgatcacgccacgctgactggtgtgacatgataaaactatcacacatgttgtgtgtgacatgtcagtgttgttttgtcgcgtcaagtgggttggtgtgaccaaaaggttcagattctataaataaatttgaagtgtttgtctttaaaactaaaaatttaaaaacttcaaaaaataataaaaaaagaaatacaactcaattatatattgagtatctagcctgcataatgtagaaacgtaaatcataacaatatataataacactataaattatttgatatctcatatctggattatgaaaatacaagtggtttgcatgctttacatgcacgtactagctagtactacaacacaaaacacaagtccatctcttacgaattaactcgatcatcgtctcggatttgtccaccgcattattcctcgtatcattcgtatacattcattcattcagactataaacacaaattataactagtactatctaggaatatataatacatgctagttttttaatgacactgactagctagcttgccggctggttcaaaccttgcaaacggtacgcgccattatttgaactcaccgcatgctcgtactactgtccacctccgatgccacctccagcgcctccgccaaatcctccgccgccaccggcgccgcctccgcctgcaccatggccgccgccgacgcctccaccgaaaccacctcccttgcctccgccgaaaccgcctcctgctccagcgccaccgccgccaccgaatcctccgcccgcaccgccgccaactcctccgcctttgcctcctccgaagccaccaccgaagcctccacccttgcctcctccgaagccaccgcctgcacctgcgccgccgccaccgccgccaccaccaccgaagcctccacctttgcctcctccgaaaccaccgcctgctccagcgccaccaccagcaccgccaccgattccgccccctccacctgcaccaccgccagcgccaaggccaccccctgcaccggcacctcctcccgctccaccacccacaccggcgcctccacctgcaccacctccgagaccgccgcctccgccatggccgccaccagcaccacctccgagaccaccgcctccacctgcaccacctcctgctccgcctccgagaccaccgcctccaccggcacctcctcccgctccaccaccaacaccggcgccgccaccagcaccacctccgagaccgccgcctccacctgaaccacctccaagaccaccgcctgcacctcctcctgctccacctccgagaccaccgcctccaccagcaccgcctcccgctcccgctccaccaccaacaccggcaccggcgccgcctcctgctccaccgccaagaccgcctccggcaccgcctccccctcctccaccaagaccaccaccaccacctaggcctccaccttttccgccaccaaaccctcctccaacgccaccgccatgtccgatccctccaccaacaccaacaccaccacctaagccgccacctttcccaccaccaaacccgcctccaatgccgcctccatggccaagaccaccaccagcgccccctccaaatccaccacctcccccaaccccaacaccaccacccttaccacctccaaacccgatcccaacaccgccgccatggccaacgccaccacctccaccaaagccgccaccgccgcctaagccgtccttgtccaagcggcgcgcctcggcggccactactccgagagctaacaacgacacaagggccaatgccgcggctcgcctacccattcccattaccatatatatttccgacgtccagtagtcgtcactcgctcactctcactcaagtgggtgatgatctgaagctcaagcgtgtagaaggtgggtttatatagggaagaaggggaaggctgctcctatcatatgaagcgtacgaagaagaaggaaggctagtgcgcaatgcatgtgcagtgtaggtcgagtagagtaaatgcagttagttggggagcctatgcctgcctatctacactccagagaggagaggagatcgagctgtgggctatggcggtggcggtggcggcttagcttggatgaggaggccggccgacacagtgagtactagtagtgcgtgacagctgctgcatgaggagaggagctggataacgcggtaggaataggatcggagaaaggaaggttacattacaccatcgatttgacgtgcggctagcgagcgaggccatggatggccggcgagatgcgcgcggcgcggcgggattgggttggtggtgtttgtgaaccggtggcatttatgcccacgcgctctcgatcagctggagtagactgcactgtgcagccggattttctctctgcacatctttaaccaaccaactgcatgcgcgcccgcggttgcatatgcatgtagtattatgtatggtccatgcagtcaagtgatcgagtcagcactacacatggactgggatgacgtacgtatgtactagtacgtaggagcgaaactaattactaaaatgaaaagctatgcgtgcagcgtatttcatacgcatatatgaatgcacaacgaatgtgcaattgtactgtattcatgtcatgtgttcttccagctgggaccgactttcatttcatttcattacggcttttgtacccctactccacatcaaaaatattagtaatatcactatatgcaaatatagtctccagctgagctgtactgaactattgctagtcatcaaactagtaatactagtatttattggactagctcgatctgccaataaattttggagccaactctgcagcttgggttgacaaggattccactccactgttcaccattgatactcctgtatgataacagccagtgtgttttcatgttaaaattggaacgatgcgacgaaaaagttgaaagtttgtgtgtgtagtaaagttttgatgtgatggaatagttgaaagtttgaagaaaaagtttggaactaaactcggccacggccagatatgagtcgttcgcttcatttctaggctctggcctgtgccaaactttgatttgcagggcaaattacaaactgtggatttcgatgaaaaccattctgcaaggcgcatgcagctagactctctttcatgtcatataactgcatgtttaaccttctccacagtttttatcactgataagagtgatctatacaagtatttaaaatgttactacatgaattccgttctctatttctaaccaaatctagtaggaactcacttgaaaggcggcagttcattccatcttccgcttgcaccgacggccggaacgcaattatctcgtcaattaatggaaggatgaatcgaatcaatcgatgataacaacaatgctgcgacaaattaaggcatacacgataaaaaggctgcctgcatgtcacataattgtgcgaaagcaaagcgtcaggcacaggatcacagcatttaatctcagcacatggtgatgccctgttgcagcacaccctccttgcaggccagcatgtcatattagggcagatcttatcgacatatgccactgaaacccgatgatgttcacagtttcacacaggacataaatcagaattacaggttgcagcagaaacaagacgatgacattcctccaaggttttttagaatctagaattacattgccaattccactctcatctcttcagcaaacaacaagctaattctaaagggcgttttacatccgcacaaatgctaccgggcacttgtcctaatccccacgatgcacagcgtggggatagctttctaaagggtcgatcaccgatgggtacatcataagagcaaatcgctagaggtctcaactaaactcttccgtatctgatcatcggcttttcttcctggtgttagcaggagaattattctgctctgaaatcatctttaacagattgacaagtgaccgcaatctgtcccacacactaaggccgtagagagtttcaacgagcaactcttggaattcaaatccattctcggagacaggatactgaataaagatcattagctgagtatcagaacaagtagtaaagccatacaatttttttcagactacttatctgggaattaacatacctgaataggttttgggatcatggttttaacatatggccaccatctatcttctacaactgccttgacaaggcagcaagcccgcaaaccttccacaccagcaaatcttccaaatccactatctttgacaccaccgaatggcaaagactgcaccaagaaagagaagcatacttatataggcaggataacaccgagcaatgaagaaaaacatgctttcagtaatacaataaatgaaatgccaaacattactacaagataagcatgtgagctgcaagagatctttccatggttagagattatcatactggtgttttctgttgactatttcaaagaatataacacaaactagaaacttctaattacctacctgacacatataacttgaagcaaaatcattgattgccgcaacaccacagtgtagctgggatgctattttgatggcacgcttctggttgccagaaaagacagcacaaccaagaccgtacttggagtcattggcaagtttgacaacttcattcataggaattagaatattcaatgaattagggcaagaaaagtaagggatacacaaagaatagtcacatagataaaaaatcacaagaacaagagagaaaggaaaaagtattgcgagcaaaaatcaaaacgtaaaaagtgaagaaccgattattaatggattaattcccaaaaaaaaaataagaaaaacagatggaaaagagaacagtgtaactatataacaaggagactatancctacttgctttgcgataatattatcatatgtgatgattaacattcaccaggacagttggaggaaagaattgatctactgcatcttcacccagatggccaaagctccctctgccagcaatctcagcacctttgtcaacagcatcattaacaagattctgaagtttctcagagtgctctatcatacagatagcacccatatcgtatctgccagataatggaggaccctaggaaaagacaaaagagcaatggagcaaaccaaaagataagcgctgaggcaagattaccagcatgaattaaaaatacgttggaaactaatatctgaaaacttaaataaggttgttaggacaccttaagaaactaatagcttaatatacatatttcagatagctctaaactgaaaagattcagaagatttagccgtgtgaatacagtatgaagttatacagaatgttagaaatgcaaaactacactgccaggttagctgttaatctgcaattttgcacttgcaagatgaagcacagtaacagtatccaggaataatttgaacatacatgaatatgatttgccacaggtctgtaatcttggtcaaaatcaaaagaaaggcaatacaaattgcatgtcagtaccgacttaagagtacaattttgtgtacttacgacagatatagatttgattatcttcaccacttgggaaacaaatgttgaatagatatccttgtgaacataaaatctttcagcaccagcacagttttgtccgctagattgcagggcagctctcacagcaacttgaacaaccttcaagtaattaagtgccatggtttagttgcagtgctcgttcagaaaatatggttctcaaaagaaatggcacattgttgaagaaaacatgctcttcatgacaaagaaacactaaattacacttacactgggtaagtctacatcttcacatacaataaatgcatctttaccaccaagttcaagagttacaggtattaatgtatccgatgctctgttcatgatctgtggcaagcattaaacagaacattagaacagaggacagtaaacgtggacaagaacttcaaacaagtacataaacttcaaacaacaagtaggactacatttttataatgctccctgaatttgctttagttaaaagttatatgctagaagacaggttgattccatatacaaaatagaagcacatcagttctgaaacagaatctgtagctataaaatgcataactgaacatgattaattgatttagtgtcccaaagtgagcaaaacaacacttctcagcacatctacagcagtataaaaattggccgcagcatgagattaagaaaccactagttcagaggaaagctataccatccttccaacaccaggtgatccaacaaatattattttgtcgactgaagatacaagagcttgacctgtttccgcaaaactataaacaagccaaaaaaaaaagagaccaagtaagccatggtaagcaattatcctgaatgctaaagaaatgcagagtagtattcatacccagttattatatgcaccagattatctggtgcaccaacagctgcaagagctgcttgtatgatacgaaaataaaagcagcctgaccaacttgcatgctctgaaacctataaaagggcatcttgctgatcaaatatataaatagagttgaatagtatttagcttagataaaaaatgaattccggtgattaaaatgaaaagtagttcttatttgcagcaaaagacaatattcatatggcagagtagtgttgcagatgtttcgcttagcatagcaaaaaaatgttaatgatataattagtacagtatggttatgtgaatatgctatctcttagatgagaactgttaatctgaatatctctatcagtgttcaaagctgaggacgtttgaccattcaaattctaaatgtcatatgtatatgaacaaagggagtacaaaaaagcaacatctgatggcttacctttataactgctgcattaccagagaatattgcagccagcattggattgaatacattgtggaaggggtaattccaagacacaatcgcaccaataactccaagtggatagaactcaacttttgctttcttgtgaagcattgatctccacaggacctgagcagaactaaaattaaaagcaagtaggggaatgcttgtatttaattaggataaggtaataattgaagaaagcacgagtttgttgggagaaaacaagctcgggtctgtgaggatatggggacttggatccaaaccaaaattctaaaattccttgagtaccatccatcatccaaacacgctaaggtatcacctcaggtgtaaagaaaggaagacttcagcaatggtgccacagtacctaattgctaacttcctatgttacagaatattaatgtgtggctgcatgcataaatgaaaaggcttatctttcctgtgaaagaactaacataagttgtgagtcaatgtctgtagaattcccaactattttgaggttttaaacttttaataggtagttcattttgtattcaagaccagagttcatttgctgtgtatttccaatgctcacacctgttgagctaccagacggtcccatataatcacatcctattgcacatcgtaaagacaaagtggtgaaaacaaaagtaagctaacatagaaaagttaatataatcattgacacaatatacaaggccctaagttactctgtctttcaaataggaatgtttctaagagtctaacctgtattcaggttttaaccacttctcaccctcatccaaaagccaggtaatcttctcacaggtggtcattatctcacctaatgaagcatcaaccatagtctttccagtgtcccgggatgatatcctgcacagcacaaaatgtagttaccctcagatattccatgttctggaaaatgttatcaggtgcaaaggtgcaataaaagaagaaattgatcaggccttcatgaacagatgcaagataatgaaaatagaaagcacaaccaacagcgtctagactaatttaaagataagatgccattttgaattatgtccttactcgcatatcagatcctgatgttcaagtatatattttagaaggattcgaagaaactggcgtctttgcttgaagctgctttttgcccatatcttttgtgctttcctggcttgcgcaacatgctccttaacctgattagtcaaagaattaaaggcaaccaaaacaaagtaggatgtcacgctaatgaagttacaagaaactgcagtaacaaaaagatacaaaatttatttgttccttgatcactacttcagaaaatcaaaatcgattatgaacgacgaactagatctcagttaataatccaaaagataatgacccagacaactaaaccctacattatatgttgtatttaaaggacctaacaaaagcaagccagcaatatacctcatcaggcgtcaatgcagggaagtatcccaagtatttcatagttgctggctcatagcattggaccttgtcagtctgagctcctttccccttccttggtggtatctgcaacagaacataaactgaatgtgttgtaagcctgtaatatcaaagcaaccatgtggctctgctagctctcataaatcacatgccactgtgagccttattcagctggagtgaatcaatgcaactttttttttaaaaaaaaaaagaaaaggtgcctagtgcttatctgaaacctctatcagcacaaatcagagttgactcgtagcatcaattcgaagaattcaaatagcactctgttcaagaatgcagttcatttacatgttatcatcttactgcatctggccattttgagcatgggaatttaccaaattgaagttggagtatgtaacaacgttttaacacttgatgaccgcacacactgttgcctgttgctttctcaaaaatttaataaccacgcccctggaatttgcttgaacataatctcaattttcacagaaatagcaagattgtggtacagcattggaacaagtcgctagacttaaaaatctaaaactggaaattccaggcagacagtctttaaacatttgtccactaacagtaagatagccatagtacaccagacagtaccaactcttcagacctatgagcacctgaactgaaccgaaatagtgaaacgcaatacctgaaagctagacgcaatgtgcgatcctatgtcattggaaatctatgtggaagaagccgaaacaagcaatggcagcagaatgggccggtttgcgcatcaaagccaaataagtggagaccgagggtgaatagacaaaagaagcagagtgcagatgcatatgaagtagtgaatcatcccagggcagtatagaagtggaaggaaaggggaaaggggattagtaagtagttaaacttacgtagatgtagctatcctccttgttctggttggcgtcttcgagcactgcatacaatagaacccgatccgatccgataccattagagtaaatcccacataaaccccatgagccatgagctatgagcagagcaatctcagagggaaataaaaaataaaaacagtaaaacctaagtaccgtcggaagcgtcgacatcgatggaggggacggtgggcgggatgagaaagaggaggatgcggcagagcgcgtaggcggcggcgagcaccaggagcggccaccacaacgccatggccggagactggggcgccaaccctaggtcgccgcgcgcgcgtggctcggactcggagcagcagcagcagcaagggagcgagttgaggttgaggaacaacaaatcaaaatcaaaatcgaaatggaaaaaaaaatccaagggggatcgatcggatcggggggcgtgctgtggctttattcgtggagtgcagcgcgagcgtggcgagatgcttctctctcagttcagttgcaactcacatttcgactcctctcgtctcgtctcgtgtcctccgccgtatattatactggactactgcccccacattcacagaaaattcatttaatcgtatatctagttatctactccctcatccgctttaaatttagggttaatcgaattcgtgctaatataatttatatcatttatgtgattttggaaacgttagatcatattattggtagaaattgagggtttgtcccatcacactttttttaaagttttttttctacttctgagaccttttttttggctatgtgccatggacaaaggccgaagatgtgatacatttccattatctaaaaaaaataatttatatcattttaagaaacatcattttaacttatataattgaaacgatggcattataaatttgtgccgctatttaacccttcgacatattttctaacaaaaaaaaataaccatcttggcaatctcttcctccatccccctctctactattctagtggcggtggacatccaaatcatggagcccctccaacacaaccatccattagcactgcggaccgacgagaggactaaggaggaggcgatgccccgaggtcgactttgccacggcacttggatacccccatggcggtggagagggacgggacacggacgggcttgacggctgtagccataggagagagggacaggcctggcgcacggcccttctaccgccacgacgaagaaggcacactgaagtggccccaaccaccaaatccacatacacgtgggtatggtgagaagtagatgtttgtgtagtagagacaacaagtggagctgcatccaccacaaatggctttcctctgaaaacgagccaaaggccacagctcggctgttggtcgctgctgattgtcaccatcttaggcagttggggtcgctggctgaggctactatacgtggtctaagacgccacacaatggtatacgcgagggaggaacagaggttggaagggaagacgaaccggtaaacaatggcggcgatttgctgaggtaggtttgcagcctgccaatgcttagaaaccagatcaagagatgcaagaggaaaatgagtggagaggacgaaggtacaagataaggggcaatttggtaaaaaaaataatgtcagtgcatcatctccggtatcaacagatttataatggcatcatttgagttagtgaattgtaataggattttccaaattaaaacaggaaaaattatgatggtatgaatacaattaatcctttaaagtacatgctattgtaactttgttttaattcaaaaatttttatctttaactattgatttctaaaaatccgtgttgttgaacaatatatttctcatggtagatctattaaaacgtaaatcatataaatatgaatttataatgtttgacttgagacaaaaactaaaataatagtaatttgagactgtggaaattaactcctcgtgttcatgtatagttttgcatgtattataccaatcagcacagtcacgcgcggcagtgctttcaaacaaaatgaactgaaaaaacattcataagaccataacaagataagcagagatgtggtttttggtttcacatgatacagcaaaagaagagaaaaatgggaaatcagcgattattaattatctgatcgtcatacaacagaaccatcccagcttagactgtctccaacaagtgacctataagggcacccaaacccaaaatgggtctctgatagtactatttcagcctccaacagagtacctatacagaagacctattttacgtgctataagacacataacctaaatttgagtatcctctcttctgaagacctatttgcagtaagggttctcttttaggtcttattgttggagaagaccaaaaataggtattgaactctttgactgtagcgctatgcaaacgtgaaatgggtattgtattttgggtttcattgttagagaaagccttatctgatcggaaacttcaccgaaactgaaactctgaaagtggtagatagcatgcacgtgcatttgtacatgctgtgcagatcaatgcgtctctctttatgagaactaattataatcagttattatcaatatactataataatgttgtgtcagataacagatttggattgacccaaaccgagttcatcctatccgtgacaccgtgatagctaggataatacttgcgtgcctcaaaatcatagaaagcgctccggttggcgtctccggcgtcgttgcatcctccaaactttggcaaatatatcctgttacaggcaatgtcccgcggcgccggcatcatgatcgcgttccagttatcaacgaacaagacggcaccatccaacctctccaatttggtccatgccatctcacacctgttgagcctgaacacgctgatcgccccatcgctgtgcggcctgaaaacccatgaactccagcagatggcagtacatgtcacctggaatcggatcatcaccaaaattattgccatccacaagtacaggcgcctccggcttgtcaagaactctccatgtcgtgttgttggggttgaagacggcgaggccaccacgggtccccaagcagtagaactcgccgtcgtagaacaccgggttgcagtacgccgtccggaacggggtgtgatcgtcgattcgctgcatcgtccactgctcgtctcccgcgcgccacagcgtgacgtagacgctgcggtttcgccccgtcggattccggtctttctcgacggagaacgcgatgcagtcaggagacgtcggcgccgcagacaagcatatgccgtcgaactggttgtcgacggggaacgtcgcctccgggaactcgaacatttctccggtgaacgggttcgtcgcgtacatgtacttgtcgcctctcgtcgcaagcacccatccgtcgtgtctcgaggagaagagcagcatctggaagtgatcctgggactgaaccaggcctgcacggttgttcttcatggttgtactcctgctcgacgattgggtcgaacagcttgtagacgccggtagaagtggagcagatgctcatgagcatcgggtacgtcgagtatctctgcgcgtaatggatgggcttcacgatggagctccatcccttgcagacttgtcgcagacggaagtagtcgatgagtgatatctttgacacgatctcctctaccatgtcagtaggaagaccacaccagcatggtgatgcttgttcggaggcgatgtcgacgacagagataccatcgccattttcctgatcgattttgctgcttgaatgtacaatggcgcctgaataatgttgagttgtgtcgtcgacgatggagctaattggtgcaggaaggagccagtagattgaatcgttggaggtgagatcgggcagcagggtgaaggtggtagtccgatcatccaggcggatagtgtagaggcgaacaccatggcggcatcgttggtggaggaggtagacgcagtcggggcgtatccctgccttggtggcgtcggacatgacgacgcagttgtcagcgacaaagatggccctgtcgccgatggtgtccaccttgcgccacacgtagtcgccgccgtcgtcggtggcgtggacgaggcgatgcaggtcaatgtcgaggagctccgagtcgcgggcgccgtagccgtagtggcgcagcaggaacacctcgccttgtgattctaccaacattgcgttggccatggagtggatgcagctgggctctggaatgcctctccgctcgatgtggggagggtaggaggagacgtcgagcatggcgatggagctcatatcggtgggcacgtacattttaccttggcaactgacgatgtcgcccatgagtaggagttcgtcgtcgtcgtcgtcatcggtgtcgagctgccaccagtcgtcctcgccgggccgggtgtaggcgagataggtgtccatgaaggtggagaagacaatggtgcagtcgggcgagagcggggacgaggagatggcacacctgcgaagaggctccaatggcgtgtccagtgggggcagagaaataatggtcatgtcgtcaagaggagagacgaagaagcagtggttggaggaggcggcgtccaacatcaatagccattggccttgcaagcaagccaagcattgtttacccttgagctccagcatttggtgccgccatgccgatgggttgttggtattgctgttgtgttgagaaaaagggtccatgagcgtgggtggctcgttgtcattgccctcggcaaacttgaagacgaggaggagtggttttgacgacgattccatctcaagttcaacagcaggcagcatgacaatggattatttgccgtcttaatttgcttgctgtatcaatcgatctggagtcatcgatcgttgctaagtcaaaactgaataataatataatctatacgtataaaatacatatctctatctctatttttactattataaaaattaaagatgtttttgccagtattttgatacgtcatttgtgtatgagtcgttttttcaattcgtttgcttttggaaatacatatccgtatttgaggcggatttaagttcgttcacttttggtaatacagaaaaaatcatataagaaatctatttaaaaaagctcacatgctaacttgagacgatcgaagtcctaactacgggcctgttcactttgatgccattttcaatattaccaaattttagtaaagttaccaaaaaagtggctacatttagtttgttagcaaattttggtaactatataagaaatcctgctaaaattttggcaagtaaccataaggttttttttggcattgcgaaaatttgattttggtaggatttcttatatagttaccaaaatttggcaggaaactaaatgtagctactttgttggcaactttaccaaaatttggtaaggttgaaaatggtatcaaagtgaacaggcccttactaaaaaatatatatatctaagcaaactgctataatgaatttcatcttaaccaaaccatataaattaaaataaactttatccgttgcaacacacggataatttttctatttatatataaataacgaagaatggattaaccgatacatactttacatataacagcgcaagcgatgcgtggcgatcgagtcgtcaaatcgaagctcctcccctcggcctgatcgatttgattcgagtcgcctgccgcggtgacggtatatatacaaatagaggtagatcgacttagtccgagtcggagcgatttgggaaaggcaagtgctatttgggcccaaaaatagttccagcccagcacattacattattcctggcaggaaaaagttcatttgtggtccctaatcttgtagacttgtactgagtttcaaaaactgaaatagcatatataaggcatctctaatctatctattatattattaaaggaatagaaaaatgagcctctacgttcactctcatggcctagaaattctcacattaatcggagaaaaagaaaaggcagagtccatatagaaatacaatttagaaatagctgaaattcggaattaaaaaataaggaatattagaagagaaaactagagtccatatagaaatacaatttagaaatagtttgaaattcggaattaaaaaataaggaatattagaagaggagactagagtccatatagaaatacaattaggaaataactgaaattcggaattaaaaataaggaatattagaagaggagactagaattcatatagaaatacaattagaaaataactaaaattcggaattaaaaataaggagtattagaagtagagtatagagtccatatagaaatacaattagaaaataactgaaattcggaattaaaaataaggagtattagaagtagagtatagagtccatatagaaatacaattaggaaataatagaaattcggaattaaaaataaggaatattagaagtagagtatagagtccatatagaaatacaattaagaaaaaaaaagaaattcggaattaaaaaataaggaacattagaagtagagtatagagtctatataggaatttaaaactaacaaaaaaattggaataaacataataaaattaaaagtagagtttagagtccgtataaaagtacaattaaaaataactaaaatttgaaattaagaaaaagatgtgaagaagagtttaaagtcaatataggaatacaatttagaagtaactgaaattaaaaattaaaaattaaagaatattaaaagatgaatttagagtccacatagaaatacaattagaaataataaaaattcagaaataaaaataaataatattggaagaagagcatagagtctatatagaaatacaatttacagaaaattcggaatttaaaaaagaaatattaaaagacgagtctagagtccatataggaattaataatatgaatattgcaaatatgcatgttagttattaattatttttaatatcaaattttagttatttgtaaatttaatatcaaaatttaacatttatataaaatataatataaatattacacattaataatataaatattacacattagtagttttataaagttattgcaaaatttaaaattatgttgtcgttttaatatatttgaataatataatgagaaaacatatatgctattatatgagagaaaatataatgatgctaaccgtacaatctgcgcgggccaccatgctagttttacaaaacgggtcacattaggtctaaagatggtattgcttatgtcatttccaactcaataactaaaatgatgacagcagcatattaaataagttaccatctagaatgaaaagtgatctgtcaaataaataataaaagagaaagaaaacaggtcttgcatgagacatgatttttacacatcaaagttattatatgagataagtaggggtgagtcagcatggccccacatgtcatacatagaagaaaaaaacagagccgcctggagcacccggccggcaggcgaccaggtacgaagagcccaccaccggcgaccactcttcctcgctgtggcagtgaccaagcgccctctcaccgccggccgccggcacctcgacggacgaggaagaagagggggccttggagcagcagcgagttgaggcagaaggaggagcacgtcgtcatcggcgtcgatccaactccaagacaccgtgcgaacaggagggagggtttgatcgatggcggcaggccggcagcggaagcaggacacgcgcgcgtgccgcacctagcttccaccagcttccatccgctagctagctacttatcagaatcactacccaatggccgtaggggcaactggcaaaggaggagaagatcaggtgctgcttcttttctttcttcttcttcttcttcttcatcgacaatctttttcagatgaacgccatctttttgtccaggaacatgttgttgattcaacaacagctcgatcagtctgaaattaagatcgcgtgcaggaacatgaatcgaggagcagggcgtgcagcggcggtggagactagagccgtggggcgtggcaatggcagcattgagccaatgacggagatgaggacgagagcctcgaccgaccagaccagaccataccaaaccagacagacgagcgcaagataaataaagatccggaaaagaataatacggggaaaaaaagagaggaagatactccaccacattagcagtgcgaatgcaatcaaattcatctcaactgtatattccaaactaaagcacttctacatactaaaaccagatgcagataagtgccatcacatcagcaatatatttggtctctgcacaggaccacaaaagttgcctttcttaagttcaggcatcaaaacatctaatcaatacgaagacatgctttcttaaacgaagcctgatgagtactactagtgttccttactactactactagtatatggagtactataagatgacacttcagttctgctgcttgatctccttcagactggacaagccctgcaaaaacatcgagagatccaaaggctcagtaccgtaaacacacagacagtacgtacatacatatgaaaataaattaacttacttatcatattgccctaattgtgcttcttcttgagcttggtattggtccgctcgtgtttgtccttcgccttcttcgcgcccttggcgatttccgtcttcgtcttttggcattcgtggtctcggttgagagcgattttaccaccgcaatccttgcacgtgccaagtgggtatccgccatcctcacgcttcttggaagccatgacacgaacactggatgttcaaaacattcaacatatataatcaaacctaatgttatttgaaacaaacaaacattccttaggaatagaacccgacactacaataaaaacgttcaacacctacgatcttgtacgagaattaaatccaaggcaattttgagattttactgacagcaaaatacatgcggccgcatcttaagtcaaaaccgaaaccagcgaaggaggggagggatgtttcacaagaaaattgatcaaatacattaacgtcaaataaagacacactaacagggattttcttttcacgaaaaaaagaacttaacatgaaaaaaaaagggacggagatcaccatggttcctccaaacttgtttggagcaacatcaaaagaaaacgtggaaaaaattagacgatggatgaggagatatgagaaataggaagcagcagagttcgatcccaactcccaagaagagggacgaaaacagaggttgaaacgtgagtgaagggacgaaacagagatcaccattgctgtggttgctcgtccccttcctcctaaaaaaacaccatggaaaaagaaaaaaacaaagcgaagcttagaaacagtttagaacggaaagaggggacagaaatcaccatggttctcgatgctcttgcctccatagtcctctaataaagaacaagacccaaaatcaaatcaaagcgtaagcagcatgtgtacgagatcaagaagacagacgcactcactctaccactcgatcgagaagaagagaaagatgatgaagaagaaaaacaagaaggagcatacacattagtttcagaaaatgttaaacgaataagaggaagaggaaggaagtggggagctcgtcgcccctccgttcaacagcaactcaaaagaaaagaaaagaaaagagaaggagaggactaggagggaggaagggacagagatcatcatagctatcgttgttcgtcgccctcctccttctcaccaaaagcaacatatattcaccatggaaaaagaagtaatcaagtaaagagaagaagaacaagtagaattcagcagcaaactcaacaacagaaatgagaagggggagccgggagcgagggaagggacagatatcaccatggctattggtgttcgtcgccctcctcaccaaaagcaacactctccaagacgaagaagaagagattacacaagctttacccgctcgagaagaaagagaatagagacatggaaacagcttagaacgggaagaggggggcagagatcaccatggttctcgatgctcatgcctctctactcctcccaataaacaacaaaatccaaaatcagagcggcatgtatacgagatgaagaacagactcactcacactgtcgatcaagaacaagaagaacacgaacacaacagcaagaagaagaacaacaagaacaagaagaagaataagaagaagaacaacaacaacaagaagaagaaggggaggaggaggaggagcgagtaaggcagagagatcaccacgagtatcggtgtttgtcgccttcctcctcagtcctcaccagtaaatttgaagaagagaagaagaaatcaaccgaaacccgaaagaaaaagaaaaagaaatgagttaggaatggacaaagatcaccattagtatcggtgttcgtcgcttttctcctcaatagaacagcaagaagagggagaagaagatcgaagaggaggaggaggagatcaacaacaactcaaaaagaagaaaaagaaaaaaggtaggagggaggaagggacggagaccaccatggcatttggtgttcgtcgccttcctcatcctaaccagatggagaagaagaggaagctttaccagtgggagtcctgggagagaagagaagcagaggaggaggaggagggagggatggagttggcgagcacggagacggagggagaggtggtggaagttgtgtgctgcaacagtgtacatatatagccaggatcgacgaggcttgtgctctcatcaagcggatccaaaccgtccgtgactgctcatccaagtatccgacggcgcaggaaccaactgccctgtgccgtctgatggtgtccacgtgtgcggccgcgatgtgccttgagcagaggaggaggaaggggggtacctccgccgctgccgccgccgccgccgccgtcgtcggcggtgctcgatgccgcccatctgtccgcgagcgcagcggaggaagacggccggcgtaggggttgaggaagccagcggcgccgctgcctccggtggctccaaagcctccactcctcagccatctgctccggccgcctgccgcagctcgatcgcagccggcagccaccctcacacacacagcacaacctcccctcccgctccgccgctggtcgtcgccggcttgctgccaaagcttccaccctctgtccctctctcggtctcgggttgcactctccactctccccctccccgcagacacaatcccttctttgttggatggccatatggtcacacgggccgatcctatattctccggcctgttcgacaaaaatggcccatcaatgacctaacccacgcgaacgacgagccctccctcttattgaaagacgcatcaagcgcagcaaaccatatatatatttataaaaaggaaatattaacataaaggcattcgttctttttcatttttctttaaattttgactaaatttataataaaaatatattagtattttcaacacaaaacaaacatatattattaaaatatattcaatgttgaatttaattaaactaatttgatattttaaatgttgttaaacttttctataaacttggtcaaacttaataaagtttaactagacaaacgacttataatatgaaacggacggatggagtagatatttccttgtgatacttgccgaaccatctttgctgcaacattcttgccaaaaattttctcaaaatttattgttacatggggcgtacaaaaaattaagtcataatttaagtttcgctaagtgttgcaaataatgatgtaactgcaatcatccctggcgattctgtctgcccacgcctttgaaaaatcttaacacttcgctagcttgtttctgtctcagtatcacaatggaaagctacatcaaatatttcattgcacattgggagcaagctcatcgaaatcccttttattcgctgctgggaatattattgtctttactgcacttctcctggcagcaattgttttccctttgacctgtttcaggaggatatagagtgcatgagggtgacaatccagtgtttatatgcatggaatagcacacaaagatcaatgatcatatcgatagcatctcaagattgaccttttctggagattagcatgaatgataattttctcagcatattataaaatcgatcatgaacgttatgtggtttgttgatcaatcactaattaaaagagaaatcaaagatgaaaggcataggaggatcaatcctctggttgtaataatgaaatcacttgctattcccttaaataagagagatttcgatattccttgtttcaaaattcagacatggaaggcatagtggaaaaaaaatcagatatagaaggcatgggtcgtgtgtgtaaatgtctgtagcattcccgactattttgaggttttaaacttttaataggtagttcattttgtattcaagaccagagttcatttgcagtatatttccaatgctcacacctgttgagctaccaaacagtcccatataatcacatcccattgcaaatcgtaaagacaaagtggtgaaaacaaaagtaagctaacatagaaaagttaatataatcattgacacagtatacaaggccctaatttactctgtctttcaaattggaatgtttctaagagtctaacctgtattcaggttttaaccacttctcaccctcatccaaaagccaggtgacttctcacaggtggtcattatctcacctagtgaagcatcaaccatagtctttccagtgtcccggggtgatatcctgcacagcacaaaatgtagttaccctcagatattccatgtgctggaaaatgttatcaggtggaataaaagaagaaattgatcaggccttcatgaacagattgaagataatgaaaatagaaagcacaaccaacagcatctagactaatttaaagataagatgccattttgaattatgcccttactcgcatatcagatcctgatgttcaagtatatattttagaaggattcgaagaaactggcatctttgcttggagctgctttttgcccatatcttttgtgctttcctggcttgcgcaacatgctccttaacctgattagtcaaagaattaaagaaaaccaaaacaaggtaggatctcacactaatgaagtctgtagtaacaaaaaatacaagatttatttgttcattgatcactacttcagaaaatcaaaatcaattatgaatgacgaaccagatctcagttaataatccaaaagataatgacccagacaactaaacctacactacatgttgtaattaaaggacctaacaaaagcaagccagcaatatacctcatcaggcgtcaatgcagggaagtatcccaagtatttcatagtagcgggctcatagcattggaccttgtcagtctgagctcttttccctttccttggtggtatctgcaacggagcataaactgaatgtgttgtaagcctgtaatatcaaagcaaccatgtggctctgctagctctcagaagtcataacatgccactgtgagccttattcagctggagttaatcaatacaacttagaaaaaaaaagtgcctagtgcttatctgaaacctctatcagcacaaatcagagttgactcatagcatcaattcgaagaattaaaatagcactctgttcaagcatgcagttcatttacatgttatcatcttactgcatctggccattttgagcataggaatttaccaaattgaagttggagtatgtaacaacggtaacacttgatgaccgtacgcactgttgcctgttgctttctcaaaatttaataaccacagccctggaatttgctagaacataatctcaattttcacggaaatagcaacattgtagtacagcattggaacaagtcgctagacttaaaaatctaaaactggaaattccaggcagacagtctttaaacatttgtccactaacagtaagatagccatagtacaccagacagtaccaactagtattcttcttcagacctatgggcacatgaactgaacccaaataatgaaacgcaatatttgaaaactagatgcaatgtgcgatccgattagagtaaatcccacataaaccccatgagccatgagctatgagcagagcaatctcagaggaaaataaaaaaataaaaacagtaaaacctaagtaccgtcggaagcgtcgacatcgatggaggggacggtgggcgggatgaggaagaggaggatgcggcagagcgcgtaggcggcggcgagcaccaggagcggccaccacaacgccatggccagagactgcagcgccaaccctaggtcgcagcacaaccaagaccatacttggagtcattcgcaagtttgacaacttcttcatcggaactgaacttcatgattggcagaattggtccaaatgcctataaacaagcaaagagcattgataacactaatagcattagttcaaaaagacgtcaggcattctttcaggcttacctcttcttgcataattttcattgtgtgattaacattcaccaggacagttg

SEQ ID NO: 62637 - DNA, 3385 bp, Oryza sativa
  unsure (1)..(3385): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccaagaccaagtacctccactgggtgtcggcgctggtgttcttggagaagccggcgaggacgcggtgcttgaggtcggaaatgtcgaagcagcagaggaagcgggaggcggcggaggcagcgtcggagcggtcacgggcaggcgagagcaggtcggtgcgggaggcggaggagcaagaggaggaggaggaggaggaagaggaggtatcatcggcggagcagggcttggtgcagctggggatgtagtcgcggagcatgtcggcgacggcgcggtagcggcggagcgcgaggagagagcgcgcccggagctcgagagcggcctccatgcgcggcgacatctctagcaccgcttccactagtccaagcgccgccgtagccgctgagtgctcgccaccttccccatccagcggcgcggcggcggcggcggcgagagcagcccgagcctcggcgaggtagtctccgatgatctgctgcacaatgcacagcaccaacaaatcagttgctgaagccaaagccaaattgggagcaaaaccgcccaaattgccatcttttttggtggcacataacacattggatgaagaattaaagagggggcaagaaacaacctttcggtgtccgcggagccaattccttctcctgtccggcgaggacaccgccattggtggcaagaaacagaagcagcagtaaggccttggcaatctactggagtactcctatgtatggtatggagtatatatacttaggaaatgtagatggattgggaatgagaatggagagcaagaaattaaagaaatgccagctccctctgtcccttaacgaaccaaccaaactactccatctccatgagtcccatgaccatgagaggagaagagaagagaagagaagagaagagaatggaagggatcgagtagtatagtatagctggatatggatgatcccaagctggacaagaagaagatgcccgtgctgtgcactcctcctccttggcacgcacacgcaggccaccctaccctagtattggtggtctcctagtgcgtagggtgccatggcctatgcatccacctcggctaaaagctttttaaagagaaagaaagagaaagaaaccattggcacatcaccctgccagcaaagcaattcctgccttttcttctctcctcttctcttcttttttttttcttttctttttccctgctggcttttctgatcttcttcatcttctccatgtgattaggacactctgctcattcattcacattcgcatctcatgataaccttttactactcctgcacaccacctagagtaccacagtaattgtcgtggataaactcacggcacactactcctactcctacctacttacacttataatggcatgtgtagtacagtagtaaactggaagaattatacagtaggattacagtacatggagtaacaatttttaattaattaccttgcatatatgataatgctgttagaggcagtaatgaaatggaatgcagagagaagaaagagcagcagcagcaaagcatacttaaatttcatttcaattcattgaagccttgtcacatgtagaggcctgcctgactgtcagcatcatatcatgcatggcatggcctttccagcacaccaactactctgctgtccacccatgttactccagtggtattgctatgttacacttcccttcccccttttcatttcatcactgcaaaactactcatctttcaaactttaaaatacagactactcccctactaccagtacgccaacagtaatcaaagcaaccattacctacccactacctctacatagtgtaccgaattcatcttattactgctagactaggggattaactcacaagccctaaatggattatactacaactgatttacctctagaagaacacatgttagcatgtactatgagcaactaacaatgagtgggcccagctgtcagactgtgtccatggagagtgctaatgaggtggagccagctgcaggctgttggagcagtcgcctgttaatcaataattaagaaaaagggtaccactactccaggctggttgccaatgccatacagtagcattttatttggtgactaccatcggatgcctgattgcatatatatattgcccatgcatatgtcttcgcatacggtcaaacggatggatggaggggatcattggatcaatccatccctgttttcagactagactttcagggtttttcaggtggctggactggattggaccctaaggtcaggtcaaccttgttgacacctcaccatttccatcactccagtaccctgtagatacaagtgtactggagtacagtacatgtttgtgactacagtatatagatactcttgctcaattatttagtccagtagaaacttgggtatgtggggaagtggaatccaagggtatgtatgctttacttcacccaccctttacattaccacttgactacacatttattaaatattttctaatcagttctagtacagtttttacctcttaaactgtgagaaagtatatatctcttcaaggataggtgaaaaactcttcctacaaatattgacgttctctttttgaacctattttttttaaaaaaaaattgacatggtctaaatacaactttggctataaatttatatcacactatatttgtcaaacctgataaaagcttgcattaccagagtattttcttgaggcacattatgttcatatatcaaatcaaaatatttaaaaagatcttggtgttcaaagttttaataaagttatggctaagggcattttcactttcctaccattttcaaccttacaagttttggcgttagcatattttggtatagtcaaaaactaaacataacgttaccatttaccctaccaaatattggtaattctagaagtttcctctcactaaatctctctcaatggtaaggtttcataccaaacacaaccaacactatcaaattttggtaacttcaaaagtgctaaattttgacattaccaaattttggtaaggttgattttggtaacaaagtaatgaacaagcagccctaagaaattttctgcatgatgttatgttgttgtgatcagaaggagtatttaattactgtttgtttccatttttccgaagctagcattattgattgcagcagttgattgtcatatgatcatctttttttttcgggggaaatagggagatatattactcaaaagaatccacatcgaggagatgtgaaattatcatccttgcatatacgagcgatatgag

SEQ ID NO: 62638 - DNA, 3739 bp, Oryza sativa
aaagagaggggggtttttaaggataggaggactggtccctgacaggcagaggcctagcccatcttatcagatgggccgccaacctcctgaatcgtccttctcaatgcattgcatacaggctttgcagtatgcagctcaggaatctcgcaaatcttagactgaagaactaaaaacttagagtaaatttcacaaaactacaggtattttggtcaaattatcagaaaactacagatttaacatgatgtatcacaaaactacagatttaacactaattttatcacggaactacagatttaagataaaatatctcaaaactatagattttagtaacaaagatatcacaaaactacatgtttaatatcaattaatcataaaacttgaacattttcaactcaaacataatattagtgcaacgaatttaacccccaaaatatgtagttttgtgataattttattattaaatatgtagttttgtgataattagtcttaaacctgtagttttgtgataaatttgttgctaaatctgtagttttgtgatatatatccttaaatctgtagttttgtgataatttggtcaaagtatatgtagttttgtgaaatttattcaaaaacttaaaaagatttggccctgtagatacaagaaatgaagtaataaaaaggttagaaatgcaaggatactaaaaggtcattagctgaccatcggaatcccaacaagcaaaccatacagactatttatctgccgaaagttaacagacctgaataggctttgatggaacatatgggaatatggtcatcaactgccttgacaacgccacataccagtaaaccttccaccagcaaatcttccaaatccactggcttatacaccattttagctgcaccgacaaagagaaatgaataaaaacatgcttcagcaatacgatgaacatgaatgccaaacactacaaaataagcatgcaggctgcacaagatctttcaataattaaagcttaaggttataacacaaactagcaagtgctaattagctacctgacatataacttgaggcaaaatcatcgattaccgcaacaccacaatgtagttcggatgctatttcgatgacaccttccgggttgccattaaaaaacagcacaaccagttgcttcatgaagtaatatactgctacccgataaaaatacggttgaactgtcaccaattgccttactgccagcttttgctgatttctccagtccagatttggttaaaacacatagctgtcatcttatgttatattgaatctgcaaatggacaaaccagacattataacaatagatagcaccgatgaaaaaaatttatatgtttgtccccaaagttgcctttgtgggtttgcatgtcacagcctagcgataagtgttagctcgtgattaaaagttccaggaaccaacattcatagctattgtagcaatatatggggataagaaagtttttttgccgatacatatatataggagatatcaggtcatatgtcttcagttacgatcataaatgatttacatgagctataaccacgattatctagttccgctagatctgtcccctgaacaatcttgcatagtttcttttggatctgctaaagtacaagcctgagaatcacagttagatgtatgatgtttacatgagaaaagtagcatagtgtccatatttcagaaggtttaaaagaatagtaccttgtcgctttgctaccttggtgtgtgtgccatggtctggttcagaaggtgcaaagtactgcatgcatcaagccgaggtgttcatgaaatctgtgttcaaccatccaccagcttagagccttagatccattaagagtagatcggaccttcaagcttgttggtatgtccatgtaggcaacacaagcaagaaagcatctagaagctcaagttttcgaaaaacttagttgttcttcaacttaagcacacttatcagcctttcagaaacatctctatcgagaatgataccattctccatcatatactcccatatctcataagccaacgtagctttcccttcatccagaagaccactgattatatacctaaatgtcaagttatctggttctaccccttttgtcctcatttccttaaaaaggtcaagggcctcaacggctcttgagctttttccaagccagtatattagtgtgttaaaagtaactgtatctggtgatacttctttctgagtcatctgccaaaatattttctgtgcatgtttgaaatgaccaaccttacataaattatgcagcataatattgtacacatttacattaggaacaattttggtgtttagcatctggtcaaaaagctcttcggctagatttgagtatcctatgccaaaaagaccattaatcagaatcccataagtcacagcatcagcttgaattcccttgtaacccatttccttgaataggttcagtgcagaatttaccttttttgccctgcaaaatgcatcgatgagtatgttgcaggatacaatatcgcagaacccaccaacttccatatgatcagaaacgaaagcaaatgctttgtccagttgatgagctttgcatagcccttttaacagtatattatagctgtacctgtcaggattcaccccactcatttccatctttctgatcaaattttcagctttatctgtcatacctatactacagtaatggtttagaaggatattgtacgtcacaacatctggttcacaaccatttctctgcatgaaggacacagttttgtaggctttctctatgctgccagctctccagaaaccacttattagggcattataaatcgaaacattaagttggatatccagagttagcatccttgatgctaattcaaaagcctcatcaaccttttgattcttgcacaaaccaaatatcaatgcaccacaagctacaacatcaggtttaagtcccctcctcaccatttcttcccagagcccaactgcttctgagaacctcctgtgatcgcataaacagctaacaactgttgtgtaggtgacgacatctgggccggttcctttcatggtcatcttctctaccatttgcaaagcatcatataacctattgtgaccacacaaatagtgaacgtatatgttacatgcccaaaaatctgggaagcacccaaatttatccatgtcagtcagaagctcctctacaagctcaatcctgtttgattgacacaatgcagtaatccaccttgagtaagtgaatggagttaaacaaaatccttttgcaagtgccatgttgtaatacttctcgaccaaatcaaagcaacagttcttaatcataacacctatgaacctgttgtaatcgacaccgaactcacgacaacctgatgtgaccatctcatcaaatgtttctatgacggaatcaaacttgccagctcgggcatagccagccaaaagtacccgatagagagagcgatgaaatgctaccccctggctccttactcttcccaggaactccgaaagcagggcgaaattgtcatctacaaacagcaagcttatgatgtacgctatggcaaaattgttatgataaaatccagggcgtgactctgcccaccagtaaaaccgaactgccatccccgagtccaacaagccacggagcaccttgttgacgacgaaaggatccagctcgacatggaggccctccagctccagctcaaccgactctgaccacctcccacactccagcgctcgcccaataataacgcaa

SEQ ID NO: 62639 - DNA, 13637 bp, Oryza sativa
cttttcaccgcaacatcaaatcttttctcactttacttgcactatgataggtagcaaaaaaagttttgcatagtactattactaaataaaatactccctccatccctaaatgtttgacgccgttgacttttttaaatatgtttgactattcgtcttattcaaaaaaatttaagtaattattaattcttttcctatcatttgattcattgttaaatataattttatgtatatatatagttttacatatttcataaaattttttgaattaaacgaacggttaaacatatttaaagaagtcaactgcgtcaaacatttaggggacgagggcgtagctgacattgcatcgtattgctgaccactcttttgaagtgtagggtggttgtggtcattctattggttagacatgcatgctaaagggttaataccactttaatagtcttgtcggcaacaagagagattctcatgtcatcatagtgtcattacgttataattgttactgtgtgttaatatctctaacagcatagcgtttatatatagttgtgctgcacatactgaatatattcacaataattttcctacagtacatactgtatttctatcaacctccacaggattctctgctttttctagtcgagcaatgctccctaacatgtttcggtagcaactagtactagcaaacaagtagatcttttttttaatgaaaatacctagtaacaatacaagtatccgagttgctggattttgtttttcaccagcaaatgaaagaagatcgatcatgcagacaaatagtatataggtggtgatgtataagcaaccattcatcactaacaaaatattaatggcacacctcgaagggtgaagagagtaggagtacgcggcaacggactctatattgcaagaaaaagtgcatgccctactgttgtatctacactggtgacaccatatccctagctagctagctagctgtatctgttcccgatggatgacgacactatggattcataacaaagttgctcatgttatccctacaatcgtggtggcaatggcacacaaagaaagttgcttatggcagtccttcagattcttacatgaacatggcagtttgccactttacaaatcatggatataattagttaacaagtgatgaggcatgaaatatgcctgtatgggtggcaacagtcaccgataatgtgggcctaccttttgtaagctcacattacagtcattgttacgtgaaacatatagacaaaaattgactatattataatatattatattggtcagttcccttagcagttgcgtgggattcacgcatttgtgtgacgtattgtttttataaagaaaacaagatggtgccagtaatagccataagctgcccaatatgctcattcagttgtttatatgtaaaataaagatgtgtacttggttgcgtgatctattatacggtgcacgggagtcgggaggtgccaataagtggcgtaagctatgaccaatatgctcatccaattgtttcgtaaaataaagatatatgtacctagttgcgtgagaagattagattactgttgtctattatatagtgcacgagaatgcacgcaagtatctaacaaagcaaaagagaacgaactttgaaggatttgcatcatggctcctttggattgaagtattctcataagaattttttaaggattcaaatccttaggaatttttcctaaattgctgtttgaaacataggattaaaagttgataaattcctttggattgctttccaatagttcaattccagatgaaattttctcatgagctcaaacctcttttttttttgtctttgagaagtacaacacgccttctctcttcatctctcttttctctttctagaaagctatcaaattcatctgatattttcctatgagacgtccaaacacatcatcttttaaattcctgcattttgaattcatgtagaattcatcaatgcataacatttcagtcatgtgtttttttctattccgatacttttaaaatcccacgtttcaataggactctcacacgggaagtttttcatatacggccctttggaacaaaggatttaaccatatcaaattcctttaggtcaatccatcagaattttagaggaaaataagcatgatgtttgacattatgttttgttcttcctatgaccgaaagttcctatgttttttctctgtgtcaccaaatgatagttttggaattttcatgtgggaatttaatagacatgacgccctagtcacatggaagacacgtgagtcggtaacatagagagtttgagttgggccaactacaaaactttgtctgttttgaacttttgagtttaatttattgctattttatgttacaatagattttttgaaaaaaaaataatgttagcaattttccatgcagcaataatggatttttgaagctccaaaatagatgactatatatgccgattagtgataaacaagggattgggtaacatttcagtgtcaatatataaggaatttgtctaatgtcatactaagatactagctaatcaccggccgtacgtgatttgctactatggatgaatatgacttattatgtatgctgttattattaatttgtaacaaactaactgcaaaactcatccatgtagatgtctttgcatgattaacatgtattttagatattgcttagcataaaaccacattatattacgtagaaaggctattttacaatatgaaagtacatcgaggaacagttgattagagagaatctaaaatattttctattaatatagtaggtatgaagaagttggactaaggcaatagatgcacgaaccaaatttgaaaatatactttgttttttcatattttacatttatatacatgtctgagattaacttgcaaaaatatacctagtccgcggaacggttgtgcgggatcgagggcaaaccgcaggctggggatgcgggagcggaacccgagccggtcacgcggaaccgggatgtgcgaccgaatcggtaccgcagtaccgatgcgcgggagcgatggcgtcctcagccgcgcggcggtaccgtagaacggcggcgtgggaccgcgccgaccctatggtccactgtgttattcccccaattttttccaactcatctccttctttttccgcgcacgcttttcaaagtgctaaacggtgtattttttacaaaaaaagtttctatatgaaagatgcttaaaaaatcatattgatccatttttgaaaaaaaaatctaataattgattaatcacgtgctaatggactgctccgttttccgtacggagatgtgttcgctgtttgggaaatgacgcatggtcccgcgcatccattatgcgggagcgcgccagctccaggcatcgcccaaaaaaacccaaaaaaaccacgttgctgctaacccgtcttgcgggaccggcgcggtagcacttccctggcctgcgggaccggctcggtcccgcatcccggatccgtggtaccggcttggtttcgctcccacatccccattctgcgggtcgtcctcgctcccgcgcattcgttctgcggattgggtatatttttacaaattaatctcatgcatgtatataatcacaaaatatgaaaaaaaagtatattttcaaatttttttcatagatgcacacgtacaaaaaatcgattgtttttaatagaaaaacacgtcgacacattattagcaaatctgtttatgtattatgaggaggtaagttatatctcttcgagggtggcagaagtgttccgtaagggataaattgaaatgatccacattttcatatgtctaggctgttacacagttaattatttttcccaaaaacttatggttcatggttagggtgtgtctagttcacgtcaaaattgaaattttggttgaaattgatacgatatgacggaaaagttgaaagtttatgtgtgtaggaaagttttgatgtgatgaaaaaattcgaagtttgaagaaaaagtttggaactaaactaggccgaaatagactgcatatggacctactatgtgggacctaaaatttggatagttaataaagaaagcatgtatctgcaaaatttaagtggtgtgtttgtgaacatcagaacatgtaatattcgtcctgcctaattaaactgcataaaacaaaggcattgcaccattccctttagactttgaactagtattgtaatttcttaatttcaccaagtaaagaaggacatgtggacggaaaagaaacgagtatgaattgaaataaatattaactaggatatatagtacttacgtcatcatgtatgaaatacgtacattacattatatacacaggcatcataattagcgttggatagttgtcattgcattacctacgaccaccggcctgtagctgaaattttggggtccctttcagagataatcctctcaattgtcaatggcatatataataaatactagactcgtcagatttttttgttgtgaaactagctcgccgtgtttaagttctagacttcacacggatactcgtatttttagctaattattcttaaaatggtagacgatgtatctgtccacaatgaggcgcgcgtggtaaatctcaaaatatgtcggcccaatcttccggaggtagggataggatgtacgtgtatgttcataaggtgcgcgtgttgtgagtacctacgtttgtaccgtgttttttttaaaaagaaaaatcctctctctcttttgtttggtgttggttagtctatttttgaaaaccaacataatataaaaaggatggagagagtacatcgcaatcgtaagtacgggaacttttaccctacatatataatatatatactctatgtaagctgttcttttctacttaacaaattaataaatcggaatgttaattaactagttaggaaaaaaattaattgatttcgtcatctattgagataagatatatatgatattgtacaagatagaatactacttataacaattaaaatcactaggactggggcgggtggcatctcgatcaacttgggataggatggtagatactactacatctgtttcaaaatatttgacaccgttgactttttagcacgtgtttgatcgttcgtcttattaaaaatatttattaaatatgtaaaactatatgtgtacatgaaagtatatttaacaatgaatcaaatgatacgaaaagaataaataattacttaaaatttttgaataagataaatggtcaaacacgtacttaaaaagtcaacggtgtcaaatattttgaaacggatagagtatattttattagtattatatacactagatgtgtattaattttaatgcgctaacgtggcccgaagaatagttttaagctaacaatacatattaattaagtagtactacatgaataggctcactgacgaacaaagctgggatcaggtgttttttttgtgagatgtcaacaaatattatatctgtcttcttgatgtatcgatttcgatgcaatgatgtcaatggacaaaaaaaaaagaaaaagagagattaagaaagtgaaggtaggtattgcattgtttaaggcacaggtacatgtacgcgtgcgagcgtgtggcttgtgcgtgcacggacgtaggtgacgcgtggccagctcgatcgatctatctacgatgcaacatagtatatacggaaatgctcaacgccgggtgaccggcgcggaaggagacggatcgggcactccctcttccctaacgcacggtgtctctttctgatctcaacatatatcttcaccatatattccattgcaacaaatcacttatatattttggaaaccctctattaagaaatttggtttatttttttattccaaaaaaaatgtttcatctagtgcactcacaatatttcactatggatagatctaatgttgcagtgaactgaaatattctattgcaacaaatcaccaatatattttggaaatcctctattaagggaattcgttttattttttattccaccaaaaatatttcacctagcgtactcacaaagttttactatgtatatatctaatgttgcagtgaactgaaacattctttcgctatttgctgaaacattgtttttatataaggtgaaacaacacctgatttaaatgaatgaaacattttcgatccacttagttgaaacaattccgatatacctggtggaacatcgtgcaacatttaaaaataattcaataataagctaaaaaaaaatttcgtcggaatatatccatttgtggtcttattttgaagatttaattgcaacgaatttaaaggtgcaatcggatcatgatttggataagtaatttaagagaaaagttagtttaaaatagttttgcacgtaaatcgagcgctgacgttatgctgacatcaacgcccgattttaacctcctctcattgggcgccgagccagagtcgcttccacatatatatagcctcttctactctcaaaaaggctgcatgttagttagagtatacaaataaaatcttggaatcgtaatggaaacattgatatttgatatgtggaatcaacattagtagatttatcttttttttcgaatggtcatgctgttgccgacgttttatataaagaagaaggtgcctcatttcaaggagaaaacgagaccaaaccttccaatacactgttaattaggaaaaattgggcgaaaaccacaacactctaacctaagctaccaacaccatgaaaaaagaaaaaatagcaaagcccaaaacagccatcgataaagagcttgttgtaagcgacacaaaggcttcgacttcatgaggcaagtgctatcgttgccgagcttgtcgcctagcgacacaacagtttcgactccacagttatcacatcatcgttgccaaaggcatcgtagaaaacaagcaagacaccgactgtccactttaaacatcagcccaagccacttgagcactactacttgtacacagctaacaccaacctttctcgacaactgcaacgtgttatcgttgccaagcttcatcgcaccccaataaagcagctccaacatcagtagatttatcaataaagaaataatgtggctgataggatagcatggatatattcggctgcagcagcccactacttatacgttgtgacactgttggtgtttggtaactacagcgtagggtatcgaaaagtcctaataatatcatgcttttatacttttaatattttctaaatataaagttaaagagaaatatagttaaatatgtgcattatatatatattgaagacaatatctatatatatgtttgccccaacaaattaaagtcaaccgaaccatatcatatagtatatcgtaatgcgctagctatctattggctgtcgtatctagctctagcctcctcatttgcatacgttgtgtagtaattaatttgtctactctactaatatataatctgcaaatacccactattttaacttaaaataatataataacaaaaagtccaagtagtgatcggtgaagtgatcaagactaactgatagattgatagatagataggtgtagatagataacttttattattttttaaattttaaattttaaaaataaatctttgtaaaattcatttttaaaatatgaacctttttgttatgccagcttatttggcgtgacaaaataacacattacgtcacctgcagcggcaatgatagttttgtcctaccatgccagctatattggtgtggttacgctagctagttacacatgactaaataacgttgtcacgtcatttagacccacgtgataatattgtttcgtcacgccttcttgattggtttggtcaaaaagatactgatttaaaaataagttttgaaaagatatgtttttaaaattaaaaactaaaataattttttttaaaaaaaatcgtaggtactccgtagatagatagatgctatatctcaaaacaaaaagttagatataggggcagcttagagataggtacccgctgacacgtgggccacccatccaaaccgtcctatgctataaataatggcgcccccgcggctcaccattgcactccaatccaaaagtataatcaagcaaagcagctcgatcgagtgttcgactgatcaccagttggagctaatcgatcgagagagagagtatgacggtggaagtggaggcggtgaccatggcgaaggaggagcagccggaggaggaggaggtgatcgagaagttggttgagaagatcaccgggctggcggcggccatcggcaagctgccgtcgctgagcccgtcgccggaggtgaacgcgctgttcacggagctggtgatgacctgcatcccgcccagcagcgtggacgtggagcagctgggggcggaggcgcaggacatgcgcggccgcctcatccgcctctgcgccgacgccgagggccacctcgaggcgcactactccgacgtcctcgccgcccacgacaacccgctcgaccacctcgccctcttcccctacttcaacaactacatccagctcgcccagctcgagtacgccctcctcgcccgccacctccccgccgccccgccgccctcccgcctcgccttcctcggctccggcccgctcccgctcagctccctcgtcctcgccggccgccacctccccggcgacttcttcacaactacgacatctgcgccgacgccaaccgccgcgccagccgcctcgtccgcgccgaccgcgacctgtccgcgcgcatggccttccacacctccgacgtggcccacgtcaccaccgacctcgccgcctacgacgtcgtgttcctggcggcgctggtgggtatggccgccgaggagaaggcgcgcatggtggagcacctcgggaagcacatggcgcccggcgccgccctggtggtgcggagcgcgcacggcgcccggggattcctgtaccccgtggtggacccggaggagatccgccgcggcggcttcgacgtgctcgccgtgcaccacccggagggcgaggtgatcaactccgtcatcatcgcgcgcaagccgcccgtggcggcgccggcgttggagggaggagacgcgcacgcgcacggccatggcgccgtggtgagccgtccatgccagcgctgcgagatggaggcgagggcgcaccagaagatggaggacatgtccgccatggagaagctgccctcctcgtaggcaggcatcgatgactgcttccatcgcttgctacctcaccagctcacctgataaatcacctcagttactatcgattaatcatttaccatgcattaattaagaagaaaacatatataccataattatctaccagtaaaacaaatctaatagtagtatttaataatctcgttggtaattaactgcagtcatgcatgaatgcatgccatattgcgtcgctatctttttttcccatgatgagactgatgagagagagagagaatatatgtcgctattgagtgttactgcttgattactgtactagtagcttattacaatcaaccattgtctctgttgcgtatttatgagtgtaagtggttaattttctgttgcagcataattaagttacctgtatataatctgatgtgtacgtacgcatactgtctcgatcgatctccggggcttaaaaaggagatcgattaattgatcgaggagcaattataattatgatgcagtcatgtttatagttaatttgcatgtgatcatgaattccatcgtaacgatccgctacttcttaaaaaaacaaagtactctctccgttccaaaatccaagacactgtagacattgtagaactatttttcagatattttataatacaagacatgcatgcatatattcaattgactagcatattctcttcattaaattattatttttgaatccttcactctcatgatctatctattggatatttatatgcaatgatgcatacattgtaccatttcttaaagtgatctaaacgaggggacaataatatactccctccgtccataaatataagaaattttagttggatatgatgtattctattacaacgaatctagatatgaagattgttcagattcgttgtactaggatgtgtcacatccaattaaaatcccttatatttagagacgaaaggagtatggttttttgtcattagattaagggtggttaattatatcttatagtagtatttttgaatgaagagagtaaaaaaaacataaggatgagaatatataggcttattttccattagaatttaggggaaatggaggttacttcatatgaatctggacatcctatttctcatgtttaaatggcttcgtagaaaagaaatttctaagaatttaaatcctccacaaatcctacgaattttctttcatgcaaaggaaccatataaattaagcagccagatactagtcgacaagcctaaatgattggagcagcatccaccaggccaaaatgatttgatttgatcgctcgaaatgtgtgcctgtaactgctagggttactcgatacatgcctttccattaatatctccgttctaaaataaattaacctaggagaaaataaaacctatcccagtacaacgaatctaaacatggacagtcatttgtcgagattgtgtcctagaaaatgtcacatcctctcctaggtaacttttttttgggggagggggagggaatggagggagacaaaaggggtcgaatccattggttttgggctgtcagatgaatcagaacacacagtagtactccctccgtttcacaatgtaagttattctagcattttccacattcatattgatgttaatgaatctatatagatatatatgtctagattcattaacattaatatgaatgtaggaaatgttagaatgacttacattgtgaagtggagggagtacaaatttttcagttctcgacctaatgagcacttccgggaagtcagggttggtgcgttaaagtgttacagtttgactgcctttaatattgatcggatctcattcgtatcccttaactataaaatcaaatatatcgaacccatcagctattaagattgtgtaaaatgactttttcagcaattttaatagaggtattagctggcttggcagttcaatcaatagaaaaattaagaacaaacatagatcccacgtgtaagtgacaagaaaaaaaaactgtaaaacccacatgtcaacttataccgcagccttctctttcccactcagcatgcggggtggctgtcaagcttccttgattgctaaagatagctcccagctccaaggcagccacccatactccctgcagtggcccctcccgggtttgcccgcctcttagtgaagccacagagcaaagtgattttggcagcctctccctccgcaatcccaactcccctcttcccccaaaaacctacctcgtcagaaaccttagagaaaacccacaacttatgagatggcctatgacaagagcaagccgttaattcatttctggtttacacgacttctaacctgttgcgtcttggggttggaggggggagggaggggcgaggggagcgctcgcatgtcactgctatgcaaaagagggatgagggatgagaggagccttctagctaggggaggaagggccgaagagggaagaggaaggaggaggaggatataataagaataataggaggaataagagagggagagagaggatgacatataggcgccatgtcatgactgacatgtgggttacacggattatttcaatcttgttttaaaaaaagtgcaatgatatgtgggtctaatttttatttatttatcttgctgattgtaattccacataagtgctatgtagtataaagaccaggtcaatatttcacatgggcaccacatcagtgaaaaccaccattaaattactcttgaagtgagaaatgcccaggggtctttcggctagctccacaaggtggtgggctagacaacctgggttcaaagcctcacccctcctaattatttgatattaggtccttccctaatattctagttttttttaattactctcgaagttattttttaaccagttttaataattggaggagttgttgtatcaggtttgtgcatttgaaggatattaatcaaatccacggtatactagacggagcccaagtggacttttttctgaagagttcacctgacttcggttgggtcgtatgtagcccatctgtatggatcggccttttttcggggttggagtttaatttaccgaaccccggaggcgtcgcatttgctccctgaactgcccatcaaattcggaagccccggcgtccgtcgcgcctatcaccgccatccgccggagacacagctctccgccatcgagatcgagtcatggctgttcgatcgccgacgtcgaccaccgtggccaaggcggtagcttgctcgacgctgccatggattatgctttctgaattccgatccacccaattaaccaagaatcaatgtaagcgagagcagtgaattcatcacagcccgatctgaagaacactacaccacagatcctcctaaattcatcgatcatgatctctctctctctctctctcttgattaatcacttgggatctgcatagttttcgcttaagaaaagaagggattagagacgacgttctgctgttaattgttgttaccccagctgaatatatgtgctccttgtaattttggttttagcttgaattaatcactagtaattacaggtttgcaagatgcagatattgtgtgagagaatggctaggtattatacttgttcgagtttctgaatttaattgtttcgagtgtggtggatcgagtcgatcagtcgagtcgagagtcgagtagagtagaagagcgaattttaatacaagtaattaattaatatcgtcgttaattattgttaatcgatacagtgaagatacatgtaagcacgtgccaatgtcgatatacagtactactcgtatcatactaggggatcactatttactgcggttgtgctcctagaaaagctttcatataaaattttcgttcgaaaagaatatgagaaatactaaaataacttacattgtaaaacggaggaagtagaaacgtagttgtggtagataacatgcagaacaatcagcaacagcaactctggtctcgtgacacttgctttgctgtgctcctcaatccggtggccaagccggatgggcggtaattggtctagttcaggaaggcccagtaagcagcccaggagagggtctctagggcccatgtgccggtccatatgggccaaaagagcactgttgtccctttacggaaaaagtacaccgaaggtccctcaatttgtcatcgagttaaaaaatatccgtcatcacttaactaattaaaaacggtcaccagaggtcatcacttaactaattaaaaacggtcaccagaggtcctttggtggttttgacccggttttatccgatgttgcggctgagtcagcgtgggatccacgtagggcccacatgtcaggtgtccatgtcaccctctcggcctctctctttcccttttctctttctctgtttctccttccttcctctcgcagggcatggggatgccggcggcggccgcgtgcgggcggattgctcggtccgatccgcacggatttggggggggggggggggggggga

SEQ ID NO: 62640 - DNA, 4323 bp, Oryza sativa
gagggggggctgagctgcggaggcatcggaatggcggcggcagcgctgcctcgcctcctcctcgccgcggtggtgctgtgcgccgcgttcgcctccgtaccagggttcaccaacccctccgatggtgagtctactcaaccccaatctgtagcgatcgagtagttagcgtttgatgcctctactccgagctcgcgtgcgtacttgctcacacttcgtattagtgttcgtgttgcttctggtcttagccacatcaatggatgtgattgtgtaccacagcaagtgtgtgcttgctagtgtgcccgtgccatagttacctttgttcagttcctgcgtgtcacgccgtattcatgtctgtgtatgacttcgctgccttatgtttaattttccatggcagctttctgggtggacatttgagggcggtgacccctgtggtggccgcggtgaacaacggccatggcatggagtcctttgaagggattcatcattcatccattgtcgctttgtaattcttcagctattcgactgtgttgcaatgccggacggaacgcgcgacggcggcgtagcccggacgacgaggaggaggacggcgacaccagcgaggaagaagagatggaccagatcgagatggcgcagctcgaggggaacatcaggcggcccgcacgagggggacggggaggccggcgagatcgcgcagccccgagcccgcgcgccgcctgggggaatctcgcgccaccctgggagccgccgtcgccggccgcgcgcaccctacgagagcatagatcgagaggaaggaaggagaaacagagaaagagaaaggggagagagagaaggtgacgtgtacacctgatatgtgggccccacgtaggtcccacgctgacttagccgccacgtcggacaaaaccgagattaaaaccaccgaaggacctcttgtaaccggttttgattagttaagagacgccggatatctgattttgcggattgaggatgtttttgtaacttgatgacaagttgagagaccttcggtgtacttttttccctttaaacctccctgttataaaggcggtcatgtaaattcattggcataaaaaaaacctagaattgtaaatctaggacagtgaaactataaatagactatacgggatatgtaatagggatccaatattacttaattaactaatatactttataatcctatttttcataaaactcgagtgagcctacctttcagcaaaagtgttcatcatacgacaacacctactattggtaatttgaagatgcgcagacaatacttgatcgatattggtaatatccttggtaatgtacttgatctgtaagtatagttactctatggctggtttagtttgttgccaaaattaatcttatcaaaatttgatattactatagtttgacacatatgggcattgccaaaatttgaaagtattggatgtgtttggtttaccaccttttcaaattctttttttatgagaagaaacttttagaaatactaaattttagtatggtgacaatggaaaagtatgtttagttattacattaccaaaatttggtaaaaccaagaggtttcttttgcaacaaaggatttttaaggaattttagaggaattcatgtcctatgaaaaattttcctacgtgattatttggatcacaagaatagctataacaaatcctatgaaatttctttggattggctcaaaacataggaattttagagaattctaacattagcttcaacctcttagcaaaaatccttcatctctcaactctcatcttgtgttttttctacattttttgcaaatagctattcctataattttcttgtgtttttccaatccatagaatttgagatgttaggacatttaatcctgtattttttttcgggcattttaatcctgtattgtttttttcgggagtacattcgaaacagctgaaagaggtagtccgagtgtgcagtgatataaataaataaatgcagcagccagcgaggcgtgatgtggtgtgctgcaaaacgtaaagtaagcggcgtatgtcgtgtcctgttgccgtataggagtatgtacatgcacgtgtgcgtaccatatgctcgtatgtacggctccatatcatatacgtacattatgctgtcctgcatgcctgcctataggatcagagagagtatctcagtaatttatcagtatatataaggcaactggggccctgcagttgcatagagtagccatgtaccactaccgtgcagcagcctgaagatatgtatgtactcctctatcaccgtgtttagttccaaactttttttttcaaactttcaacttttctatcacatcaaaactttcttacacacataaacttttaactttttcgtcacatcgttccaatttcaaccaaacttctaattttagcgtgaactaaacacaccctatatatatatgggtggtcactccactcagcactgctcattgggaatcctatgcaactttttactcatcgtcaggttcctcctccgttgtttccttcctattcctatacccaacaatcgattgccctgttagtattactgactgtgaacaatccatcgaaataatgaataaaaacacaagctacccgcacctttttcacacatttagtaatagctcattgtcagtaatattatgtaatatggactggagaacatgatacatttgcatgactgcagacacatgatagtgatactagtaaaaagctactagctgctactactatcagctcacagccaactctgcattcattcagatgcctgccttcatcatacagtcactcttatgaattatgatctagaggcatatatatagctgccctgttgttacaaaaaaatgcaaagcatcgaacacttactgctactcttatgcgggtccggaagaaactccgtttctttgttcttctcaccgcatgaatgaataattttcatctctctctctctgtgtgtccccaacccaatacatactgccgctactttagcataggatccaatgagatatcatgtctcggccgtgtgcaaccctctttatttttgggtgcatgacatttctgagtgagatagtacattcgctgcatacatatccatggctctaaaataaatgcaagtgtacactaaaaactatttctcgatatcaaacaggagatctatgtgcctttgcctttcaagtaagaagaaaaacagagagaaataaacgacagacaatagctagctaaccaaacctttacaaacttgcttctcaaatttgttgctgtatatatgtctgacgtagacatggattaaattccattatccaaaaaaaaacccttaccaattcattttttttaaccaaagatcgatccagctttataacaaaaactagagagaatgtcaattcaaatttaaccatgacaaaaaaaacctataagcccactgggtggatcgatattttgaattgcatatccatttccgccttactgtacatgtcctactcctagttaaaacgacaatgcgcatatttaagttagtgcagagagcaggaattaatcttcttttacctctttatatattaaaaaattgcattccctatcttgggagcgtatcctatacacacaggccctcgcgtgtacacaccgtgtacaccaactaaaaaatatcacaaaaaattataggaaaattcatacatatactttcaatagtattacatctacgtgcaaagtcgcatcttcaaattcattctacatagagaataacaaaaaagataaaattttaacaaaattgcaaccttaaaactgtcagattttttgtttttttttgttacggctaaaatataatgaatttgacgttaagattttaaccctaggtgtaatacaattgaaagtatgtgtatgatttttttctagattttttggtgacattttttagttggtgtgcacatgtgtacacgtgaggatctgtgtgcataggatatgttgccccctatcctagcatcattggtgcacgtaactatataaatagtcatgaaaaatcgtagagttcaaaggttagaaataattctaaagattggatccattttaacaaccacatggccacttaagtacaagagattgaaaagcagagaaaagtaaaggaaaaaattaaaaaaaagtaaagtatatatctttattatcgttgtttttcccttctttcgtccgatggtgacattgttgcggtcgatgatggatctggaatttgcatatattgttgttttttcagttgtgtgcaagtcaaactgtctgtagggacacgtagcaatataatcttgattccattacagttagg

SEQ ID NO: 62641 - DNA, 885 bp, Oryza sativa
aaaggtaaaagaagtggaatttaagaaagtttcttacatccaattcctcaagcacctcctggcaaagaaacttattgcaccagaaatagcagcaccaaaatcagctaaccgtgggtagttgaaatcacccatgtgctgaaccaaggaaatgagacattcagaatgtagtgtgtatccaatggcatccaagaaaataaatttgtaaattaccattgcttgtgaaaaagataatggacttgtaaccaattaactctgtgccagttcttacacaactggttagagtctctgttttaatgacctatatttggttttgtaagaagtcagaagtcaggtcacacctgtgtgtaggtttgcacatgatccttccaaagggaacttgccttgagaacctccctcaaggtggatataacttcaaatgaagttgcttttataacatcatcatccttatcgtacggtttttcctgtaaaggacaagataaatgatccaaaattgcaaggcacctcccggcagtaaatagcaatctcgcatttatttcatagtgaaatcaaggctaaacaaagtttcttcagaacagcaactgactttcttcagtttcggaaaacaacactctttcttcttttctctgagcatgtttataatgggaaatacaaaataaaacatgagaatcggtggtggcactgtagaattaccttaagatggtcaacttttactgtaagtggatcctcctgaacctacagttttttgtatcttggtgaaaactaagttaccaacataaacccacaagaattgaatagcaagcaaaaactaatgtatcttaccatttcggttatctttaaacgacggtgaccaagtagcacaccctgatccccttgaatgctagttat

SEQ ID NO: 62642 - DNA, 5970 bp, Oryza sativa
ttttagaaaagtcatttacctgagcaagtgtaccaacttcgttaaggcgctgcagcaactccttccctttaagatcatcaatgcttttatctgaatctgagctggtcacaatatttgggtcagtaccttcttcatccttcacaagaaatgctccagcatatgggatggatcttttgcggttttctactaaggcttgcaacagcttttggtcctgaggggtttataaaaaacaggaaaaacacatcattaagaagggaaatgaataggtagcatgatacggaaaagtgaaattgatttaaccaatggcaaatttctcagcgccgacatacctttacatagatcggcatataaaatccaggaaagagtggacgatgtgggagaggcagtgctatgacctatttgaaaaagtaagcataataaagtaagagaaggatacaactagcagaaccatgttatgaaaaatatgaactgttaaataaataacaaataatctgaagggagacgtttagatctaaaaaatgatggaaagacagcaaagccctcccttgataacagagaaagagagagcatgatacccttctagacttattggtagaaaacccattttcaagacatggcatgagttcaaatagctactcaaaagactacaatcaaattataattattttgatccttcatcacacctcaaatgaattgctcactttagtcctaaatagattgtgcatttcatttggcaccaatgcaagttcttgagctattcaaatttgtcatcgaaatatcatatgtactccattatacagtttggaggcactttttctcaatgtttcctagtatatcctcatgagtatcactccaagtaacaaataagctctccttcccaatcgcctcccacttcataacggcagaataattatttcatggtgttccttcgttcttgtgcccattaatatgtgataattagatggaatatttattcaattgaacaacacttttcagaggggtgcaagctttcataatgcattaccaagcatcgcaccagtgacttttctcaaattagaaaacagtactgaactaaactacagttcaggacaacatgttaatccctcagtgagcaatcagcattttcctctttctttcccctaataaatagaaaggcaccatgtttgagcactcaaaaggaaggagaaaccatgctgaggtactgaactctttgtgcagctcattcaaggcaatcacactaacctagttgatccaaaccaaagaaactctaccttagcattacaaaataatgagctaactttgagaccaaagtgtttccatgctcagattgagccatggacttacgatatccaatcaagggagtggccttccatgcttactctttggaaccaaattacacattctccaattacttaggacacaaatgcatcgggttgctattggctactgcaagcaactaaacaaacggttatgatccaaacgagtagagcgcgcaccgagaggcagtcctcagggcggaggacggtgggcacgatggcggaagacgccttgccgtccgcctccccttccgcagcaaccgcatcctcggccttagcttccgccgccgccgcctcggagtcgctcccggcggagttggagcagaagcgcgccctcctcccgagcgtcgagacccggccgcctcggagcgcccccaaaaccctgagcagcggcgacctgacctcctcaaccgccgccacggccggcgcggcagcgaaccgcgaggggaagacggcggcggcggccgccgcggcgcgcagcatgagggggtcgagcgattctagctagggtttgggcgaggggagggggcgggggcgggggatgtggcggcgcggcgcgcgccctgtgaaagggaagctcgatttcgttggtttggggaggaagaaaggaatggaagcaccgaacgaaacccttctaaaaccccctctcttttacccatttttcattactattctataacaaatttttattaaactgaaagcgaaaaactatctttggcatttttttattctacaacaacattagctgaattgactagaggaagattcagctaatgtataacacatctaacatgttatacatggctaattaagtagtttagtgctttaaccatgaataaactatatgggtctttttatcacgtacttacctccgtcctataaaaacatacctactgcgagatgtgatacatccttattagatttatttttttatagaatgaaggaataacatactcacacacataaacaccatttccacccctacatacactcacacacacgtttagaatgattaaaaatctatagcctcatgtaagtgcgcatcatatttgtattatttttctctaccgtattaagtgtagttcgattccaatattattaattgtgaaaccaatcactattatttcattagcacgtttttcaaactattaaatgattttttttctaaaactttccatatccatgttgtttcaaaaattaaaataaatctatttttaagtttataattattaatatttaattaattatatgtactaatgagttttcatgtttcgtatgcgttggaaatctgtatataacctgagaaaaagaactcggtctaaatataaactttgatatataaaagacccttttcgaggagaaatatccgaagggttatcgctggtcttgtgtcaagtgccagtcactcagttcatccacagcaaagcgcacaggcatagcagcctccttcccctcttcttcttcttcagtagtggagtacatgctacctctgcttcagcagcacatgggaatcacccatgccaactccatcaccaccgagccttctccttctccccgcccgccgcttcttcgcctcttgccccagcctcgccgccggcgtcatgctcatgccaaacacatcgccctcttgaccaactgcaagtgcgcctccgccgcttccgcttccgtggaggaagacgacgtagcaggtggtaggtgcctcttttggccggggaaacatcttttggtttaggattcttctctctagagattggagattaattaatcaataataagttaattcattcaccagtcgtagtcccctgacctaaccccttcatatttgggagataatactcgtattcaatcccaccattttttctgcctgaattggggaacgactgtgttttgctttgttactttactatatattactacaagccttaaatttgtactcgatgcatcaatctgcagggttgggatatcgtcatcctccaaagcaaatacaagaaatccttgatgttccacccaatcccagttaccttatttcccctcgcagagatcggatcatgttcctacagcgcacagccatgcctccattatctgagcttacgaaaccagaaattgtactttccggcatacgcattgatcctgggtctaacatgaggagcagaatgtaagtaacacaccattaccattcaatcatagcaggagggttgacacctcatattcttgtgttcaatgatttacttatttgtaggtcgttttataccggcattattatccatgacctgatggatagtggaactttgggtccagcaaaagaggtccatggatatgctgatggtgcaaagattaattttgtgacatggttatttcccaaacatgtttaaatttaacttttaatgtgcaaccaaatcatatcacactgttttctattcatatttcctctttcggcaattttggaatttcaggtcacctgatggtcagcacatggcatttactgtgcgctacgaagataaggtgattggctgatgctttggactatgaaattggacaacatctttagtggttatcgatccttttgtttcactgttgtattttagtaggtggacaacagcgtcaacttgtcactatgggttgccaatgcagaatctggagaggctcggccactctgcatatcagaagacataagattgaatgctatttttgagctgtgagtgtctgcatctttccgatggagcatctttctactcctttccttcctaagtcatcagattttatcatgtttttctttacagatttgtatgggtgaatgattctaccgtattggtctgcactattccttcgtcacgtggttgtccaccaaagaagccattggttccttttggtcctaggatccgctctaatgagcataaaaatgtagttcagatgagagccacaaaagaaatgttgaaagatttgcatgaagaagaattgtttgattactatgcaacatcacagttaatactgctctcactggatgggacagtgaagccaattgccccacctgcgatatatactgctcttgatccttcaccagatgagaagtatctgatgctcacttctgtccaccggccatattcttctactgtctcgtataaaaggttcccaaagaaggttgagctgtggacagttgatggtacatttatccgtgaagtttgtgatctgcccctagctgaagatattccaatcacatctggtagtgtccgtaaggggaagcgtttaatcagttggaggcctgacatgccttcaacattgtattggtgagtaacaattccttagaagcttctgttgaaaaaaatatattgttgttctaataataatagtaatatttttccaatcctgatgatagtaggtaagctcaaaattgtagaatttataatgccaatgcactgcttctgctttgatgagatttgcaaaggtgaccgtgttattgtcttctcttgataggtagtgcagctagttgcttgcgtacgaaacaactagttgacagataatgaccctaggcatgctattagttattcttttgactgactttttaccatgtaatcacaatccattttaacttgactatcaacttttctgaaagatcaacttaatgcaagatttggtgacatagtatgtcaaaggtaacctcaaattagttagaaaaggtgaatggagatctgtcagaactcagaaacaatcatcatactaacagtagtccctacttagttcgtaataccacatgtccaatcaccatgctaacaatagttctcagatctgactgcgacccagttctattttcgtatgtgatgttttgaaagggtggaggcacaagatggaggagatgcaaatgttgaagtctcaccacgcgatatagtatatatggagcttgcagatcctttaaatggcgagaaacctcaagtcttgcttaaacttgaccttcggtataggtattaaattactactggcctaacattttctcctcatggtgttacagagtgaatatgcttttacagaaaggcaaattatgatgagtacatttggtttagcttggagataaatttggatttcgacttcaaagatgtaatcaatgatttttcaggctaataatctgtgtttttgcatttaaaatacacaaatatactttgtccaactgcttgccaaatcactcaaaatttactattttgatgaaacctgcagaaggatctcttggtgcaatggatcacaggcactggtttatgagcattggtacaggacacgcagaacaagaacatgggttatctctcctgactgcaaagatgttagcccacgggtattatttgaaagatcttcagaagatgcctattcaaatcctggttctccaatgatgtgcagaacccctgcaggcacctttgtcattgcaaaaattaagacaaactatgaaggaacctacatcttgttgaagggaaaaggtgccacaccaaaaggaagcatcccttttcttgatcttttgaatatgtatgcttacaactatctctaccaaacatttctgttgcacctcccatgcctgctctgttatgactctttgaatccatgaacataatgtaggcataactttttttctttacagaaatacgggagtgaaagagcggatatgggagagtagcaa

SEQ ID NO: 62643 - DNA, 3146 bp, Oryza sativa
aacataccccgccaattggaaggattcggccagttaatgttacttcacccgtcatcgcaaggtccttcttaacaggttttcccatagctaaggacaacattgatgtgatcatggtgcatccagcactggggccatccttaggggtggaccctgctggaacatgcaagtgtacctttgagtttgcaaagaacagattttctggctctttatctagtaatatagctctaccaacagtatgcgcaatctgagcactttctttcatgacatctccaagctggccggtcatcacaagtgcacctttcccatctccttcctccactttcgttgtttcaatgtataaagtagaaccacccatagcagtccaagctaaacccatgacaactccaacaggagtctgctcatatattcgctcagcttggaaaacaggtttcccaacataatctccaaggtttgacgaatcaattactaccttctcaactgccttatcagctgactcttccttggctccctccatatccttgttgccctacataacacaacagtaagcaattttctttcaaggtgagctataaccttgtaatgaattaatgacaaactatactgagccatagattatatttgtatgtttattaagctatcaaggtcgaatttatatgtttgacaaattacttaacgcttgcatccatggttttcagagccaacacagtagccagggaatgaaaaacaacgataatatccagtattctagacactggaactttgtcaaccataaatatagacaagacaatcacaaaacatgtacctcccaggtaagctactataggtcaaatgtcagtcatacaatagatttacgcatgcaaatgttatcttatcaaacagttaagcaagcgaagttctctacaagcaaaaccaatcatgcatgcaagcatatccaactaaattggtcaaccagcctaaaccggtgacaactttaacagcctaatcagcaggtcaacagccagcagcacagaaataccacttgtaggattttgcatatttgaagtgagcattatgttcaggttcaacatctaaaagaaacacataagcagaaaggaaaccatgacagcaacatattaacactacctctggtgtgcacaacttgtctgtcgatagggctgaatcagttaaaacagcttctttgggtgtttcagctggatgcacatcatgatcgactgttctattcagtaaatctaattcgctagcttcctttgaggcagtatcagcattggtcattgcagcattctctgtagcaggatcctccatagtctcatctttcaacttgtttgcactatcgccaccattaggttcttcgctcgctgttacaatggcagcttcttgagttggctcatttgataccccttggcgaacaagttgcagagctatctgcaaaaagagtaacagagtaggtaatgcaaagcttgtaaaaggacaaagttttgcatattactgaagagtggaggatataaatggatgcacaatagcctttcgtacaaatgacttgaagattgcttaaacactatcaacagtcagctaacatataaatgacatatcaatgcaccgtaatatatatagataatttgcttgctgctgcaatgtgctaggaatgtaggtaggtagacataattttctgctgctgcaatgtgctaggaatttaggtaggcagacctaattttctgcaaggctaagcaactagcgaaaacaatgtatgatttgaaaatgtataaattaattaaataatactaatataaactaatgctaagggtgcaagagtacaagcaaaaataacaagaaccaacattttgtaacttagaacgaagaaaatgttgctttccttttgtgagtagaaattgattcctcctggctccttgttccaaactagaataactgtcgttttttttaagaaaaaaaaaaaactagaatagttgaaagatcatcaggcagaagttctgttacacaccttgcggtaaattttctcaatttgcttttgaagattccgcactcctgcttctcggcagtaactttcaataagggcaagaagagcagcatctgtaacctcagcctgtacatgtttgtagtcaggcagttaaagttgaaacaagcactaaattttggtcctagaagcaagccctgttagcatattccacatctcaacaaagttgtattgctgtaaaagtggtgtgtcgtttatacaaacttgaaattacaacgattattcttcacttttcagtacttttagtccactcgggactctaatagcaattccaagtttatttgtcgaaaaagaagctaagaactttacaatcctttatcatgtatgcaatattaaacagtaaagggtatcatttccgaggtaaacttaaaagaattctgatatgaattgcatatgcaatcctcatcgaattactcagaaggcttaatgaaatataaaataaagtataataatctatatatctcgtgcagtgaacctacccaaatgtaaagtggcacatggtgagaggatgagatttctgaattagtacatgactattcaaatacaattctggagtcaaaaccagtggtaaggtgcagtttcacatctaggtgtgtttaccataaagcttataggttaaggcactctttggcattgtgttgcgttaagaaaataccccctctggttttaaatgtagattgttttagccttcccaactttttcctaaatgtacatcattctggaacttttaggcacttcttttttttccatatttgcccttgccaaaagaacgctacccctatcacaaataaatgacatctttttcaatgtattgtaaatggagggaaacaaattcttttgagatgtttttttattaatgtgcacaagcctaaagcaatagatatgataaacaacttccataatagcttgccatagagaggttcaatgtagcactaatgagtccatgaccactaggagagaataaatcaaaatccattcatcatggtgaaaatcagggaattaattaattaccaaaatttgctgccttttttcataacattggaaacaattgttctgttaaataataatatttaaactagtcactgttgactcctaaataaaacgaataattcatcac

SEQ ID NO: 62644 - DNA, 1258 bp, Oryza sativa
acaaacctatagtttccccatggcaatactgtcaaccagtccaaataattccttgttacattaaactcgctagaactggcttccaacagctgaagctttgtgagttcttcttcaatgacttgcaaaacatgagcaggacatttctccttctttgcttcaatccgctccctaaattttgctgcaacacataaatgaaggacaattttgaatcgtccactagaaatgtcaagttctctgggcaataaaaaaaacaaagccaataagaacagctgaatcacaaaccagacaatgctgttttgtcatcagtctccaaacctagctcctgaaagcatcagatatgcagagtaattatgaacctatataaaaccagatcaacctagaaggcaacaatgattatatttcccattttgcatggaatatatacagttcaagtcttcaagagcacacggctgaatatcagatgtcaacgttagtaattctgtagttctagaataggcaagggattattgcccattccgctaatctatgaaaagcaatggtgtcatcagcaatcggagtgccaaattctacaaaagtaattattcaacaatagaaatgtaacaaaagtaactttatacaagaaacactatatgatggagtaccttcttgattgctttaagttgctcattcaataaataacgccgctgatccccacttattttttcttcaattgcttttgcaatggattgctggaaaagaagtgtattggtcaccacaaatgctcaaccaagcaatggtaaccaaggctggagatagaagaatgaattacctgcaacttactaatctccatctccttcttgactaactcaagagttaactttagacgtttatatacctgttccaaaaagtgcaatagttggactgaaatagaccaagaaaatggtataaagaatgtggaatcttcaagaacttctagaagagtgctggtaagagaagctgtgctgatatgttccataatggattttcaaaacgtattcatatacccaatgttctattgattattggtgcatttggaaagagaatttgctagatcagggaataagttgtgcttctttgcagatttgcagtatatgcaaaataaatttcaaaatcagtatcatatctgctgaattttttaacaaaaaaaattatgttcaataagtcagagagaaaattctttggagtatagagtaaaattatagcacaaatgagacaaccagcgcacatggtgatgcacaat

SEQ ID NO: 62645 - DNA, 13248 bp, Oryza sativa
  unsure (1)..(13248): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccccccaaaccccttccgctcctcctcctcctcccaaatccaccacggcgacgccgccgccgcagagcccctagctcccggaggtccctcgcccccgccagctccgacggcctcacggaaggaggagtaacgtgggcgttgattggatttttttgttttccccccaccttgagtgagtctgtgccgtttccccggcggcgagggagggcagagggctgatcatggtcgtgcgccgccggtgccttgccgagatttcccccaaccgccaccgacgatcgttcactgtatgcatgctctcgctccccttcgtttttgagttggtttcgattatcaagtagtatgtatcaggccgggtattagtattaccaccaaattctcttatgctagtgtgcgcccgctattgctctagtatttacaagctgttatttttactccttagtactacttgttttggtcaaaattcaaaacgtctactgtacctgttgtattggaaattttaaatggttcatgaatgaattcactacccaagaacaaagcttgtccagtaatgacattatctattggctcgatttatgtttggtccagtggcacaaaggggagtagcactgtccaagctgttgtggtccgtcagggagattggccaacctgtggggtttcagatcgacataagtacgtcagtgtgcgtattcttgtccccacgtgcttatcatttaaattcttctactattatgttttctactatgtacgattgctgtaactcctgaggagttactgtctttgattagaaagaatttggcgcaagcatgtactgtacgatatccttagctgtttgaggtttcagtatgtaagctactaagtcgtcaaagatttcccttcttttttttaaaaaaaaaatgatctgtagatttcagccatcgatcaatctggcggttcatagggctgtgcttgcaacctttctggcagaaaggagagagcaaagtgatttgctgtctcctgttgattgtggcctgttgaggcccagtaatggcagatgctagttcaaggactgacacatcgattgttgtagacaacgacgacaaaaaccaccaggtaatcctttttgaggttgtcatctttcctttacacgttaagatgccatcaaattgactgctagagctcaagaatagagctggtgctgttagggtagtaacttcttttctcgttttctacttgctatgagttggataattgagagatactcaaccaatagtcttctggagaatggagataccactgactatgacagtagtaagaagaatcaaatgtaattgaccgtttaaaccttgcaattcttgtgctgtttcatctactgacactgaagcactcatacttttaatctattttatttactgattcgcaatgtcatgttttgctgtagcaccctgataacatattgatactatgaatccactgccaaatagtgctctaaatatgctcagttgctcaaacttgcagttagaaaacggacatagtggtgcagtcatggcttctaactcttcagatagatctgacagatctgacaaacttatggaccaaaaggtgacattttagttccgtttcttttcgtatacaatgtcacttaatcttgtgtgattaatttcatattgtattttggcatgcaatagacaattcggcggcttgctcaaaatcgtgaggcagcaagaaaaagtcggctgaggaaaaaggtactactgcagatttgctcttatgttcgcttttgctctgaataaaaaagccttgtttggaaaagcataggattaattctgtgaacttacctgtgcaaactaggtctatctaatttgaattgtcgcagttgttatctcttttatatgggatggcaagggcttaagtcaaatatgaatcaagtttaattgtttaattgcagtttttagtgatagttagttttgatccaccatgacatgtattttctctttgaacatttaaggcatatgtgcaacaactagagagcagtaagctgaagcttgcacagctagagcaggaacttcagaaagctcgtcagcaggtaaaatctttatggttgcatgctggatcatcaaaaaatagttttgaaaaatactaccttctgtcctcagagaattcttggatattcaattgcagggaatcttcatctctagctctggagaccagacccatgccatgagtggaaatggtaatttgtcatattttcatcgcttggtacccattaacattttgtgtcttgtgtacttacattgttttatctttttaacagtttatattaactgtttgctgcatgctttctaaaacattaagcttgtgttttgcaggggcattgacttttgacttagaatacactagatggctcgaggagcaaaataagcagataaatgagttgaggacagcagtgaatgctcatgcaagtgacagtgaccttcgtcttattgttgatggcataatggcgcattatgacgaggtattcaaggttaagggtgtagctgcaaaggccgatgtgtttcatatactttcaggcatgtggaagacacccgcagaaagatgcttcctgtggcttggtggtttccgtccatctgagcttctaaaggtgaccgcagattaaatctcaatattttcttatttgtctgatgcccctttctggtcctgtaatttatactgatttcaccatatggtacaaaatttcagctcctagcaaatcacctcgaacctttaaccgagcagcagttgctgggattaaacaacctccaggaatcttctcagcaggcggaggatgcactttcacaaggtatggaagcactgcagcaatctctggcagatactttggctggatctctcggttcatcagggtcttctgggaatgtggcgaactacatgggtcagatggcaatggccatgggtaaactaggaacgctcgagaatttcctttgccaggcaagtatcttcaccttctaagtgtcatcgttcttctgcctgacaacatggatttattaactggtgattcgtgtcagatgtcgcctttgcagtgattaaagcttagattttgactattcttttggtttcatttttgtcaggcggacaacctgcgacagcagacattgcatcaaatgcaacgaattctgacgatccggcaagcctcgcgtgctcttcttgccatacacgattacttttcacgcttgcgtgctttgagttcgctgtggcttgctaggccacgggagtaacaaaatggtcatgtgtgcctgtgacgaggttagacgctcattttgatggactgcagataattgggtttttccctgtacaattgtgtttggcagctgtggactaaagttaaaaactgtacctaaagtggtgtatgcaaataggtgaagcctctaagtaagttataacgattgcattattgtgttagcaataaaagttgggtaattcaggatgtgtcctgagttgttttgttgtagtagaagaactgcatgtagtggctggaaatgcagtgttgaatgtaactaaagctctgctgctcacgttgcataatgttgtgtagtaatagttagctagtgatgcccattttacctgcactcctctgggaagctgaaactgcaacctgaagcaaccacggtgcagaagaccgcatgcatggtaaatgattaaaaggatatatatgggctcaacatcgctgccaaatcctgagataatgaacaggcatgctaaactgctacttccacatgaaacctcccagttgacatgaagaatgagctgttcagttttatggtttctgtgttgcactgtacataattcctgtacgggtctgaatttatcctgaaatcatgctaaactgcagaagcatatgaaatctccagaccggttgacatgaaagatgaagtgtcccagtttttacggttcccgcgttgcgttgcacatgttttccgtatgtttaacgggtccgagtttatcctgttatagtattgacaattactgtaccattcacaggtgattgcgacctaagaagtcatgacatgtaacagtaacgaaacaagaagaagactggggattcgtgtgacaattttagaaaaccgtcggcagacaaggccgtctgccccttgtactctagaaaaaaattgactaattaatggccggttagccaaaatggccgggtctccctttcctgatgtgagtactgaagttaacggcaagacgatggcagcctgcagcgcgcggcggtcgctgtcccaggtgactcaatgcacacatatatactacgtatatgactcatttctacgtgctcatccaagctgagctgagccgtagtcaagctaggcaggaaacacattacacatagatggatggatagacggtggatggagtgctccttccattccaaaataaatataagtatttttagcgcagtgataagtcaaatattttcaactttaactattaataaaaaaataaaaaaatcaatcacgtaaaattgatgtcactagatttattattaaataaactatcataatatataactcttttatttaaaatatcttacttttatatagattttgttggtcaaaatagtatatcagaaactatgttagagtctaattttatgactgagggagtacctgatttgtcgtcgcccgagcggtgagggcgatggtgaggcgacgaatgaaggtacgtgccatggttaggagggagcaagacagtgttgacatgcatgcatcgcctactctcaaactctgttttgatttgatctgtttccttatggttttcgttcagcgcccttcgaattgcctcacgaattaatcctcaggcagccaggcgatgcttactttgaacctggcactatgacaagggggctactacttgctccctccgttttatattgtgcatcatatatttttttttaaaaaaagcaaactactctgtgcttcatttaatgtaagtatgtgatgaaaaaacataaaaagagacatactgacttgaactccctctacaacacttacattaaatgttcgcatgcaacatagatacaaattacaataagattacatgtgtcaaacaaaaggaccaaggccatagttcacgtgccaaaatttttctaagtatacggacacgtatttgaagtaacaaaacaaattacatattaataacaaaacaaattacagattccgcatgtaagctacgagacgaatttattaagcctaattaatccatcattagcaaatgtttactgtagcatcacattgtcaaatcatagcgtaattaggcttaaaagattcgtcacgcaacttacatgcaaactgtgccattggtttttttcgtcaacatttaatgttccatgcatgtgtccaaatatttgatgtgacggaatttttagaagttcgaaggaacctaaacactgcccaaggtaatattaataataactttagaaatttctatttttggataatgtgatgatcaatatataacggagagactactttactaaccgtactatttgttacttatcggatgatgcagtttgaattggttaagtggatcaccggtgcaattcaagcagcaaaagaaagaaaaaagaaacgggtggataattaaggtaggtagtacgtggacgtggttgaagatgaagggcgttggccacgtaccccgacaggtgtgcaaattcgattgcgactcaggagacaggagagtgcatgtgtcacccgtccatcgtcatttgcgcgcccaatttccaaaataagtgcagtcgtaaatatccgtacccaacgtttgactatccgtcttatttaaaaattttatgaaaaatttaaaaatatttagtcacacataaagtattattcatattttatcatctaagagtaataaaaatactaatcataaaaaaatttcaaataagacgaacggtcaaatattgaacgtgaacagtgtaaatgtgtacttattttaggacggagggagtagtctcaagttttgtttcggataaggtagcgtactcgatccatgatccgtcagccagtaattgaattgaattgtcctaagcgtgggcggtgcaccgaccaaaccaccccctctcctgtgcatgtgctgctgatgctgatcgatcgtctctggaacccattcttggcattcatgtcaattaacggcttgatgatgatcgctttccaaaccaaacgacatgtacatgacaacatccgaaattaccgcttcattctggatcaagacgtatctgatttccttcccttttttatactcttatcttctctttcatttttcataatatctcttgtttagatttttcttatatcatacctttcattctttaattttcacatcttaaaagaaaagatatagtctacaacacaggcctaggtacgtagttacatgttcagatcaggacgctaagttatcaaaatattgattgtcttcctccctccgttccaaaataagtgcagttttgcactatttacgttcaacgtttgactgttcgttttatttgaaatttttttatgattagtatttttattgctattagatgataaaacatgaatagtactttatgtgtgactaaatattttcaaatttttcacaattttttaaataagacggacggtcaaacgttgggcacagatattcacggctgcacttattttgagttggaggtagtacaattttataacttgacaatcttatttaagatttttgattctacaattctatatgtacttagagcttgaaacttttagttcagaatcgtgattttaacaacactgagaaagacattgacaatatcatagaagctagtacaaaggtatatagaagaaaaacctttattaactacaaaatgtatcagcagtaacgtacatgtatagtaggcagatctgtttatagttagaccaaccatatacgtacgtatttacaaactgaatacagactttgggtgttccctcgtactaaacaaaagaaaaaaaaacacactcaaaagtaagaccatgaccgatatatctgcaatactaaaatgtttatgcagatcatgtcccctaattaatcatagctagcactccttaataagcgccaattattattgtagctatcaagacttgacggcggccactgccggcgacgagcgcgcctacgcggcggagggcgccgggaagtacttgacggcgccggcctcggcgagcgccgtccgcatcggctggctggcctcgtcggcgttgtcctcctcctccttgtagtcgaggctctcgtcgttgtagatgtcccaccacctcttcaccagcatctttatatcttctctgttcatgttctcctccttcccggtgaacctccatggcttcgaaccctgcaatcaaatcatgccatccatcgctcgatcagataatcgatcattcaccgatcgattcatcgaattatcgagatgatcgatcatgtaatgcttaccgctgcacagtaatggacgaccttgacctggtcgaggtcgacgttctccgggtgcctccagagcatggcgagaacgaggttgtagacgttggggatgggcttgtactgttcgcggaagaacatgttgaggaagtcctgctcggcgaacggggtgggcggcgtgacgacgagcgcgtcgagcaggtccttggcggtgccgaggccgggctcgtggacgaacatgccggcgttgaagtagagcggcggcggggggccgagctcgcgctccggccacgccacctcgtcggggcgctgctggcagtagccgatgtcgtactgcggcgtgtggctccacgtcttctcgcagaagcagtccttgacggcgtagaaggcgcccttgtcgaggtcgaacaggtggtcgatgttgtcgaacacctgtatgtcggcgtcgaggtagaccatccgctcgtactccacgaactcccagatgcggagcttcgagtagttgatcacgtagtaggccatggcgaactgcgtctggctctccggcgggtacaccggctgaatctcccggaccacgcacccctgctcgaccagcttccgccggtgctcgccggggacgtccgggagcacggcgaccaccagcgggtacgccgagcggacgcggcggagccccttggcgagccccacgacgcccttccagtagtcgccgtcgccggccaggaacgtcacgtacgccctcctcttcgccgccgccaacgccttcttctccgacgacacgttcggccccatcatcgatcgatcaacaaacaagctttgcaaatgatctagctagatcgaaatttgcaagagaaatgttaatttgcttcaatggattggtgtgctgcaagattttgatgaggagttcgtagcgggaggaggagtttaaatagggagcctggtcgcctctacccgtggcggttttgcggttgaggacggttatctcgggggatctgggacgtacacgtgtccggcacgggagatcgaacggctgcggtggaaaggacgggcctcggcaggttggcgcgatatttctttctggatttatgaagtggggtccactgattaagtaaggctgggtgcgatgaatattcggcgtcatggtatggccggtgattacgtgagcaaaatcgaaatggataaagtgagtaaaaaaaggaagaaattattactgacctggttggtaaatgtaaattaaaggtaagaaagttaaggcggttggaatgtggtagatagctctctcgatcgaatattcgatcggatggtgtttttttttactgcctttatccgttgcagtttggaatgcaatggggatccttccatatttattgatttttctttccttttatttctggccagccttcaaaatttaggctgttgattttaatcggggcgggtttactgggatttgatcggaggctaccttcaattcctttttttttatctcctacattcaattccttcaattcctactgccttaactgaatgaaaggaaatgaattatcgaaaagaaaagaaaaagtaacggaaggagctagaagctggaatgaggagcactcagactatatggtatgaactttgggtatgttcagtaaatgggggtagaaaaataatatcacatcttttaaaaataatattaattgcatcatagttatttatttttcacacctcgtttaattctagtcattcattcatcgtcccttttcattcttatacatctcatattacctcgtttgccaaacacaccatttgtggtttagaaaatctggtgtccatttattcggaaatcaaaaaatggtctaagagacgacgattacgccatttgcataatatattataataattcggatgggataataaaagggaacacgtagtatattaaaaaaaaaagggcttgcatgtgtcgctggagtaaagaaccaacctgaggaaacaatattccgatggttcgctttatatatccgtgaagggaggcacgtggtgaaatgggaggggattgcatggaaagaatatgcaaatctcatcttcatttttttttggttggggataaacgtgcatggccggtatctgcagaagcctctcctccagtcttttaatttgtttctagagtattttggcaatctggctactagctagagagtaaaaattaagaaaaagaaaagaatctggaactgctgctggttgtagatgggcatatcaagggcagacacatgtacgtacgcgtgggtgcagaattaagaaacgattgatccattctgttgcaacaacacacgtagtagatcagctggtatacctagcttacccttgttgggtcaaattaaaggtctcaaggatgacatatgttgcgatctggtcggtgtgtgtgtgtcattcatattcggtcctgctatgctagctgcttctgcttcttcttctccttctccgctatatgcgcgtgactcgtcggcatggccgcgtgcgcgctgtcctgtacaatatctactgtccgtaataaatataaataatatgagcctatttagatcgtagctataataaatcttatcaagtttcggtaatattgttaaaattttggcaggatttcttacgtattgaccaaatttagcaacaaactaaatgtaaacattttttttaactttgtaaaaaaatggtatggttgaaatggtatcaaagtgaacatgccctatataatatagctagataatataagtttatataagttaacatggtttacgataatttaaaccgtatacataatgatgatccaaatgtaaaagtaaggtgatgtggctttacgagagaagaaaaaaaggaaggtaatttcgatcgtagcttaattaatcatctaagggttaaaaataattaagatgatatagcttaggggcatccacaatgtagtgcaaaagtagtccataagcaatacaatattttattcagccacctagcaatattgtggaactagtccacagaaaagaataaataataaatgctacccataagtatatgggatggccatagagaataaaatatgttatttgtctctactttctctctctcctaatattatttgctatatatatacattgtgaaggttacaatagttaaagctcatatatatatatatatatatatatatatatatatatatatatatatatatatatatatatatatatatatgggtcccatctatatggactagtttttctatatacattagtgttgccctgatgagagtataaaataagaaaaaaaattggactatagattaatcatataagggcttaaaaaaattgatacgttatggcttaatgagagaagaagaaaatagcattaactaagtgatgatgaactctgtaggtatatagagtcctatgaaaaatagtgaagaaatatattcaaatattatatgaattatgtgggatgatgattttatagaattatagataatacaacatacttgtatgatattttagaatggtgcaaagaaataacaaatcctatcatatcttataacccactaaattctaaagttcaacatgcaagtccttgcatgttaaactttagattgcatgttgaactttagaatttagtgggttataagatatccttgcatgttgaactttaggatttagtgggttataagatatgacaggatttgtccttacaaggtttggttcacttcaacaccgatccacatactatacacattttggctgtatatatccacacctgaacacattggcttctgggcatctcagtgggggtggctctgagcatgcgggataggagcttgactagcatgacgaggcagaatccccaaccctcacgcgcacaagtgaaggcgacattatagttgcagttgggacccagccgccacacgtgcacaggtccatgacgcgatcactcccggccgttgggagccactcacccgggggccttcgtcgctgagcttgtccccgatggctgccacccttctcccctactcattgtcggctgacctggaggttgcgttgagatgggaaggaggtggaagaagattgccagttgatatgcggggtctacatgggtcccacactgactcaaccgtcaagtcaccaaaactggagagcgatactgtcttataaccaaatgtgacatggttttacaagattctggtattccggttcaaggacgggtttaacactcgatgacaagataaaggactgcaggtgaactttttccgagatgaaaaatttccagcctcatgggcctgtgcatatgacccataggccataggcaggccgcaggcggcagcagagcgacttccccaatccatcatcccgtctccgtcctcgcccgccgccgccgccgccgccgatctccatcctgcgaggtggcgccggcttccgccgcatcatcgctcaccgttgagcatcctaatccatcccatccgccctcctcgcccgccgcttccgccgatccccatcctagccatcaccatcacgcacgccacgccatccgcctccatccctcgccgccgccgtgcaccaccgccgtcatccgcctcttcctcttcttcttgctccacaagtaatctcatctccctcgatctcctcttctctccatttctctccgtgtagagaaaggaggtggagacaggggttggggaacaccgccgcgtagataaggcccttcttccattcggtatgcctatcatttttcgattttgcgcaacacgtgatcaattgttctgattatatttcaaataattaatcaaattatccagctccgtaataattagggttccccactttcttcatttttttgtacactgataattgcttcaggtcaaaattgatacaacaaggcaaacacgcactatctttgcaatacattaattttaatactacacaaggcaaacggcaaacttctttattttagtaatcgtactacatttcagtgttgttctttcgatgttcttgaaaatcaccacaaatttagttttcttgaatgccagtttttagtaccgcaatccaaattcagactttcaatatcaatcatttggcaattaaaaaaaaatcacatatagatacaaagagattcattttactttgaacgctcccatatcatgatatggagctaatctgctagtcaaacacttctaaaagggattatgactgattaaggggaaatcaagattcagagccttaccaaattgtttggtgaatttgttagtgtagactatgacttcagtaatgtgcaagagtagcattaaagtagaaaagtacaacgtagagttctaacacctgtttagaccgtgctcaaatcctttcctcgttattgtggcatggtgcttatattataactgattcaatattctgaataaacctattccaggttctatcacagagatgatggctgtgacaaatggagtaatccatgcatcttctagggaacccttattttccttcggtgtcattgctgatgtccagtacgctgatattccagatggtcgctcattccttggtgtcccacgctact

SEQ ID NO: 62646 - DNA, 1571 bp, Oryza sativa
gcaagctagtatcgttgctgaagatgccaaccgattctgatcgtgcatactatgacttctctccatgtcccgagtacagatttgttgtcctggacgcttatgacttcagtgcacttggctggccccgtgaccatccagtgactgccgaagcaatgaagttcctggaagaaaagaacccaaactctgacaagaacagccctgacggtctggttggcgttgaccggcggtttgtgatgtttaatggtggagttggtaaagagcagttgtcatggctcaatgatgtcctccaggatgcatcagcacgccggcaaaatgtcatcctatgcagtcatctcccaatggatcctggctcagcttcttttgcagctctcatgtggaactacgatgaggtgatggctattgttcgccagtacaaatgtgttaaggcatgctttgccgggcacgaccacaagggaggtcactctgtggactcgcatggcgtacatcaccggactcttgaggctgcattggagtgtcctcctggtactagtgcattcgggcacatcgaagtgtatccagacaagttgttgcttgtgggttctgataaaatggctgatactgagatgtgttttgagccctagagtgaactgtgtagcggagggaaattcatccaacttcattgttttgattaatattcagaaacatgtgacttcattatactcattttctggcagcataattacatgtatgtaatagcatggaaactggaggtggcagcagctgctatgcttgccgcttaatctcccctcctctctcccaagaggaaagaggcagcaagatgaaaagcaaccgaaaggtaaataaagtaggataactttttccatgataatatcacaaattagaacatgcttgtttcttgaatattggacaaatatcagaaaatagagtgtggtaattttagaaatgaatcaatccaacgattgcttcttgcctgttccctttgtttcacaaccacctatgggtattcaatatgctaatatttatctggcattgtttatgtgccatatatctcactgtaactgcaagatgcagagaatactatcttcctggggtggtaccttagcttttgcccagtaattttcaccgttaaccatattttcctgaccctgtttggatttgtaatgttttcaattttcctttaagagaattgaaatggttcctgtagatagtcttttctgtctctctacttgtgtgaactctgaaccaacattggtcaaacttatgcagccaatttgacgatcaagtgaaaagcttatcatgtctaatatgcatatttacacattgatgactacatcgccaaccaactgaactactatcaagtatcatctggcacttaagatacaatattgttcacatccttcgatgccatttgatcaagtgatcattatctacaaaagaattaattgatcatctgtccaattctgaattactgattttcttctccaggggtgagaagaccttctgcagtcacgaatgctgctaccaagagatgttcctttttgtaacttgtcaattcaattagccaggataat

SEQ ID NO: 62647 - DNA, 1129 bp, Oryza sativa
  unsure (1)..(1129): unsure at all n locations
gctctggctaatttaatttgcacttttatattgtaatggtttccatttctagctttgaaacaatcttggtatatataaagatagcacgtagggtgtaagatgtctctaactttattattaaaatagagcttgtaaagtaataagtcgttttcactttcgcgctcatctcgtgagaacaacttgaactgtttattccatgaagaggaaaacaaccagaagagctttttcttatttcttgcgggtgctactaattactatgtggctagcggggtgtcactctgttatggtacgagagaaatttaacaacaatatataactttgattttgtgcttttatcctgtctcagtcccctgctgttttgtattttattgtaaataacttttattcctcttaatagaaaaaatgtgctcattgcgtattccaaaaaaaaaacaacaatatataacaagaagaagaacacaagcatgtagctaatgcataattctttatcaaaataaagatgattacatccggtggctgcagccaatacatggaggtgaagaaacgctgagcagatgacgatacagcaacaggacataataagatgcagggatacaaaatactaaatctccatggatggatggaagcgaaagcaaacttcaaactgcggatacaacgatcaatgcatggacgacgatggaacgacgacgactaatacaaaataaaagggaagctaggtcgatctcgatctgtgacgactgtgagatcagtttattcttcatggagatgcatttcatggagaggtggtagatctcgaattcagaagcccgcgggcggcggggtggtgggggtggtcggggtcggggcagcgacagcgagcagcgcctcgcgcagcatctcgtgggcgcgctccgccacgccgtcccgcagcaccgccagcttagtcaccagggccagcacatcctccggcgccatgcgacccacctccgcctccagatccatcatccacgccgccgcgccgctctcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62648 - DNA, 13488 bp, Oryza sativa
ttgatatacttgggatatatatgtccatcacatgtcagaaaatattgccagcctatatgcccatgtaaccattcagatttatatactttggacacattcagtattttcagtaatacatacttcagagttcagatatgtcagaaaattgcaagtcgatatgtccatcatcacaattgagatttataaacttcaaacaaattcaagcacttcatataagtgagataaaatcttaatatacagcatgttccaaacaaagaagaaacaaattttcataacatcagcagtgattcactataagttcagaaaaccaaaaaagggatgaaatttgacctttgtgcaacagatcgacagagaaggaaccaaaaaaaaatgagtgcttactatcacctgctgtgcttggacctgttagtgatatgccctagaggtaatcatagagatgattgtatcacacatgtggaataaatatatttagatgatcagcacatgtattaattgatgatcatgtctcatggatcatggtatagagataccaaattaataatgtggacacatgttagtgaacatgttgttggatagacccaacatgagacactgtaagagccatatgtgttgtgtcatcagttatctcatttagtgttggtgttgaatccttagacctgagattatcatggttcccaacatgtgtagttagcttacttagggactgctaaacgctactccgtaattgggtagttataaaagtagttttcgggtatgctatgaaacatgtagtgggatacgaataatcaagatgggatttgcccctcctatggagagatatctctgggcccctcgatgttgtagattatggaagtgcatggccatgccaaaggtgattgaggagtcaatcacaagatatataatctatcaacaggttctagtgaatgattgagctattagaggatggcacatatctagccttgagcttaatcgatatcgtgaggcaaaggggtttatacaagtagacactagaggttcagtcgatatgatatttatgtatgcccggtgggtcaatacgttctgctaggggccgctgttgacgcgtgaaccgaaaaggcgttttcgggttacagccgagtatatatgaacctacagggtcgcacgcttaatgggccggaataaggggattggatggagatccaatatgagcttaattcggatagggatccgaataagagtcctacgggccttggagacccgagtgatggatcctatatatttgtgaggggtgtgaccggcggaggcattgcatcacgtgagaaaccctagccatcacttccctccccgagcaaaaccctagccgcgcgcgggtgctagcacatcggcatgggagtacggcgaggagaacgcacgaggaggagaaggtcgagccagtgcgatcgactacttcctctacatcgacgcgcgctacttcgcgagagttccttcgacttctcagcgtcttcttccgttgcgcagcgcgtcgagtggtaacgatttatgatctaatacttacatggttcctggtttacgcgatagaaaattttaatttatgctatcgtagcctacgcgtatcccaacaggaccaactgccacgagtgcatttgggtttgggtgaaggaaccggccgtacaggactccaggagcaatcctaattttcacaagagaaattaaggggatcaaatattattctggcttttggtaacttagcatatggattggagaattattggtgattcgttaattttattcagtcaccaagtatacgctccggtccactacacaatagcttgctagcttataccgcgcgtggttcctccctcccaatctcccatgcctgcaacagcgcaaaaccattactccccagaccaaaggaaatcaagaaacactgctctagagtctggacattgcctgctgctcgctgcaaaaaaagatcctcaggaaatcatgccatttctttcagatttcaattgtgagagaacataacattttctcttcttgatagctgctactcgctgaattgccagctacctcttgctgcatgtgacctgcctacatgcctgccgcagccagtgccaccacgcccgccatccgtgggccgcctcagggccgtgcagccctcctgctgccggccgccggccacatgctgcggcttggcactacaatcatgtacctattcaagtcatagttatgagcatgtctacttctattactgaataatcattatctcgatcgttaactgtgatgttgctgatcttcgttgaccgtaggagaaacctgcaatatgttaagcagccatgtctagagttactatcctaatacaagcctgcaaaatagtgttttagatagattgatccagcaaagctgggggtgaatcgatgaatgttgcttgcctgccttgactacaggttgcttaccttataatggagtaactgacatgttgttttctttactgaactgatctctaatttggtaataataatagcacagttcagtaagctaggtgaatgctgctgcttacatgcattattttggagcgacaaccatgttgtttagtttactgaactgagatctagcatggtaatattgtagtactaatacttgcttcagttccaattatctagatctactacttcaaagttcaaagacacagttatcctcctaccacgttgtgcgccgccaaataaccgaatggcccacccctcccaccccgtattactctagatcccattgcaatgtgtgggcgtagtactagtatttctaaaactcttgtaattttcttctaactgcaaaggggcgggcaccagaaacaatacaaactagcgttctttgtttgtaacctatatgcatgtcttcttcataagtcaagttcatgccttcatggtttcaggtaaataaaaattgatgcaaatgcagatatgatccacataggcaatggatgccaaaggtgcagtgttgaattgtacattattcattggaaagtttttattcatccagcattttttactaactcaatgcgatttgattaaaatatctcctaaaaatctgcctttatactcttcctcaattgtgcgaaagtctgctaggtcttattcctagaaaagtattatttttttctgaaaatttttgaattctcttttcagcttttctcccttagcacagcaatgctaataagaaataaaataatggagccttttagagattttggtttttagccaaaacaattgcagtgtatgtcttagatacttctttggtttaattcaatgtgtagagaagtccttctttgatgtatacaattcatgtaaatttctatgggctaacattgagatatctttgtcttcatcaactgcaggtactgtaaattttacaaattcaagatttgtactgtagtactgtacataatgcaattgtatgcatatgcaagtagaggatcagttgatctggagaaaaaatgattattcagtagtttatctcaccagtggatgaaggtaagtaattttataaagagtatagaaatacgtatactccctaatcttgtttacaaattgtacacattcaagactggtctatgtattgatgcaaataacattaactttgtttcctatgcaatttggtttatcatgttgacttgtattatttgagacacatgtgatgcttataagagatgttttgaaatattactgtacatttctggatgaaaaggattgatttcaaaatcactatggtaattaaatcattattggtaatcaaatccttatgtgttactacagttaaaaaaaactactaatacctaaaattgtgctatttacttgtgttgctattggtaaagatatgtgttgtcggtcgtatgccaaggtgttttggttataacatgatgttactagcatgtatgtggtaacatctaatatgtgttacagcgcaatggctgtaatacctattttatatatgttggaaaacttgttatgtgctactagaccatacactcctaacatgggaaataggatcagttatattttatgttactgctaaccatagtatacataacgcgtttttgaggatatagtagctcacagccctgacatgatgtaatgccactctcctcgtgatgcatatacacgtgatgtatggagattgtttatcaactcttgtccaacgttttcaacggaccactacattgatcgatgcagatctctacatagaaggccacacattttggttcagccatgaaagtgatttgtaatgcatatcctgtcttgctgcaataaagattgtcaatactatcatatagcaataatatcatataggaatcattgccatgttccttactagtatcaatcatgttgcatggcatttgatcttgctagcacaaaattaaaatgactagggttaacaaataggccctattaggatccgttttggttcagtcatcaagtcagcacgtgactcaaaattaaaagtgggaccaaccaaagggacaaaatggctagggttaagaagtaggccccattaggatcggttttggttcagtcttcaaacccacacatgcctaagaaggtgggacacaccaattgacatcagatcttatctatataacttttttttgagaattacacagtacaacgcagacactcacaacgaacacgcactcaccccctatgaacgcacgcacgcaaaccctacccctatgagcatctttgaagactgggccggcaaatccttgagattgacgaggtcaccacaggcgcctcgctgtacataactagcaaataattaagtatcgttggctcgtctataccaaataaggaggcgatcccctcagatataagaccagatagagttagagatattttaaaagatcatcaatctatgtcaatgaaaagggaataactcgccatatcttctcctccattgttctcaatagcagggctgtttcaagttagagaagggagctattgcagtccaaaattgcttaaattaaccaaagcccgacatctaatctcttattgaatatatgccatccacccacatactatctcgttaatctcctcgttcccaatgtgcaaggattcaagaggatgaggcatctcttcttgttgccatgacctaatccttacaaaccccactgctaccactcggcctcctctcgattcatctaaatgagatgtatggcaattatttatcagctccttgtccaacatttatgaagaacctctatattgatagatgcagatctccatgtggaaggttacacattaagtttagtcatgaaaatgatttgcaatatatgtgttgtcttgctaaaacgagattgtccatacatgatatagcaatcattgggttgctccttactgctatcaattgatttgcatgacatttgatctcgctgccataaaaatatcgtagaaagggactaaattattagggttaagacatagtccctattaggactaattttggtttgctcttcaaaccagagcatggctaaggaaagtgggagtcaccaatcgatgtcgcatcttctctatataacttctacataactaatagttgaatattgtgagctcatctataccaaatagggaggcgatcccctcggatattgggccagatagagttagagatatttttgaagatcatcaatctgtagcaacaaaaaagacagagctcaccatatgtttgcctctattgtttacatgcatgtggtccatcgattttgcttcctactatcatggatgtactattatggttgacaaataatgatattttaatatttaccaaacaccaaacttacacaatgtgtggcctatagtgcctttgtctttaaaattcatatatgaaaaatgaaagcatctacaccctcaaaaaggattgtgttggctatgtgttggatggtaacggcggatggtaaccctgaaaataaatcatatatagtgcctattgtgttggatgtgtttcctaaacccgcaaaaaggatgttaacgaagaagatcatctatcgcaacccgatcatcagtaatgcattcgaggagttggggcaaatacagtacaattaggttaaagaccgtactataaagaggggttggaagttagtagcttgaagtttcaaaagtgctagaatcaaggtgtggtgctagaatctaggtgtggtgcacactaggttgctagtctttcaaatcaagtgctaaaaacaagttagtaaaacctcgtggttgatcgtgtgcaagttttactacacccagaagctgtactagccggattgtctgagtgatgccgaataatccatgctagacttgtcttgaccgctaaaactacttaggcggataatcggctacggtgccaaattttcctaccaatgcatcatccaactacggtcatgtgttgacaagggactggccggactaaccggcagatcatgggttgtccactacccaattctctggcaatcagtagaaaatttgctagggcgacggacagtctgccaacccactcgaccgttgcgagtcaattttgtttgaactgtagtggactgtctgacattgtgcgaacaatgacctcccagataatccgaatgatattggattttccgttgcttgatagcccagcggctacttgcctagtgactattggaaaagtgcaagggaccgtacagttcggaccggtggcgggctgtttaccatgcttgatatctggctgcttttgtccaacagtcacaaacggctagtcagctagtttggggctataaatatctattgccttcaactccctaatatcgtttggaaccctgttgaggtgtgtaactgaagagagagtccaagagcaccattgagttaattgtgatcattttcttcactagtttggtgatagattgagtttagagtggcttagtgtgtaccaaataagggtcttagtataatactattccatgaaatatgaggtacacaaagacaaagttggttatcataggcatgttcaacagaaatggtaaatagtacttactacagatgaacaatggatgcacgtatctctattcaagccatcttcaaatcaattaattgagtacacattgcaatttataaaggtacaaggaaggcatttgaagttcgtttgcacaaagccacattttaaacaattaggagattaaaacataaaataataaccatgattctaacctatataaaagcactaggtaacatcgcaggccgcacacccatgcttacccaactgagcatgaggtattagttaaaccatcaggatctactattccctgatttggaaaacaaatataagcatgacaaacattactacgcatgcctatatatgaaaggggcaaagggcacaacatttcgaatagtttaaacattttgtagagatcttccccacaaaccacaatctctacatattccttgacttaaatatcaccatagtacccgaatagaaattgtgacaagatcattcatctagttcaccattgacatggttcaccgaactggtccacgggtacaaatggtcttgattggtacattaaatagacaatcaaaaatccaaaatgtattgtgtagaggtgggacctacacatcagtcgaagttgaaatcccgtgcttccatgcgaatctaacccaacatttgcataaattggtagaatggcatattagatgtgtggagattattggtatcccatacccacatggcatggttatccgactggttataggggataatttatatctatgaaatatgcaacggatcatgacttgggtattacatttccttgtatattatggaacggcctaaagtcctggtttgataatattgtaaagtagatttaagaaactgataccatattggttaaggtttctatcttgtaatcatgtcctccatcctatataaggtgggcaggaggccctctagggggcatgattcacaaccagatcgtcagatcaatacacatccggcggattcaaatcccaaacagaaatagggtattacctctcattgagagggcctgaacctgtctaaatcttttgtctctacatccgtccacttttacgtctcgtgcgctaccacttttatattgccgaaatcttatttcgacagttggcgcaccatgtaggggtgaccaatgtgggaacagtcgtccatcaataacaatgaagacaccagtcggcgacggcggaagcaagccggtggtgtagataacgaggcccatcaacgatggcggagtccgccaaccgtataggtgaaaacaccaatcggcggcgacagaggcaagccgatagtgaaaacgaagacgcccatcaacggtggtgtgaccaaccaaccgtataggcgaggacaccagtcagcggcgacggaggcgagccggcgatgatgatgaagatgcctatcaacggtggtgtgaccaatcaaccatatagatgaagacaccagtcggcagcagatgagacaactggtcggtgatgatgaagatgcccatcaacggtggtatgaccaaccaaccgtgtaggcaagaacaccagtcggctgcgacggaagcaagccggtggtgagatgctttgaagagcagctccgctagatgtttaaactgcatgggagtcggcgccagctcgtatcttagacaggcgtataaagacaatctcctcaccgttgagcttttgtggtcagtcaaccctgacgccacgctgagcccgttagccgagttgaaattgggcctaggccttggcttttgtcagtcgtcgaatgtcgaactcggccattaatatatgaaaaaatagagcacacgttaacttgtgattagtgaacggaaaataaaaataattaatataataggtaatagattagatcagaatgataaaacccgttgcaagctgacgcttttggtgtattgtgtccaagtataagttgggctagcatacggtttgatcgagggttgtcatggcgagatcggactcggccggcgatgatatacacaacagaaaatatcaacatgtaggcgtggcaatcttcccgtgtaagttgagaggcctatgcagagttgcagacttgtgcttggcggccggagttctcctgcttgcatgtgcctgtagacgcatgagctcgagcagcaatcggctgcttgtgtctgtctgtatgacagcatgcagcagcagttaaacatgcacatcccattggtagtcggccgagatgctttgtgttggccatggtcccgagtcggagaagatttttgagaagaccgtgtcgctgttcaagcaaagatgtacgacgccgacgaaattggttcctgcttgcatgtgtagatatatgtgtgggcccggcttagatgattactcaacgaaacaggcgaaacgacaaataatgacaacttgctgattgcttcaaatctagctgagcagggaaacaactcggcaactgatgcccgattgcagaacaatttaattggtggctagtctcttggtgggatctagtcggaaattttggcaacgatcgctccagcctcttgttgagaagaacatgccatatatttctaggtgtggtgaaaccatgtgtcttttagtgacttaagaacatctgttaaaacagtgtgcgtatggcgtgtgccaatactttggaaaattctttattcacagcatataggcttctttataactgttttgctatgtgaatttttaatgatgtagtcaactttagattgcacacatcatattttacaaagcggtcggtatatcactcggatcatgttattcggggggttcacaccgcatatgctatatattgatatcaaatgactataattatcaaaaaccactcagttggttggattatttattccttgactatatgcttggtttgttcaactaaccacataatcgggggctacacctattaggtgcatctagtcgatgcacctatgtttacatttaattattttttagccctccacagtcttctgatttggtgaaagtactcggcagactatggcaaagatgattaaagcactcagctttggagtaatctggttcgagagaaagattatcttttcgactgtgaaggtcttaggggttactgtagagattataggtaccccatacccacatggcatggttatccaactggttataggagataacttatatttataaaatatgtaacggatcatgacttgggtattgcgttttcttgtatattatgaaacggcctaaagtcctgatttgataatattataaagtagatttaaaaaaccgatatcgtaggctaagatttctatcttgtaatcccccctgctatataaggtaggcaagaggccctctagggggcatgattcaaaaccagatcgtcagattaatacacacccggtggattcaaatccccaaacaggagtggggtattacctctcattgagagggcctgaacatgtctaaatcttttatcctcgcatccatccacctttaggtctcgtgcgcttcccactttatatcgccgaaatcttgtttcgacaagatgaagcagatcatattatttgaagccgattgttctgtgtataacacaggcaacgcaatccagcacacagcaatgtgacattcacggaacaaataagtaactctagacagcaaaccattaactaatagaatgtgacatttacagctcacatagtctaacaaacttgtaccaaaatattttgataccatcacaccccaaaatgaactttgatcatcaaactttcaattcaaaaaccaaattgatatgcacagaggagtttcacacaatttgtatgtctgccctgacaaacttcaagtgatgcgagaacaaactattgtcagcagagatcactgtaatctgtaaaggtgtaatccatccaaacttcattcgaaaacaatggttcaggtatagttccctctctgtaagtagagacaggaatacagtatataggtgcaaagaagtgaagtaaaaacatgaacaattttggccgatttcagcccaagctttcagaaggattcgaactgaagtaaaactagcgatgaatctcttgtccaaacaaaacaaaactagtggagaatcgaatgaaaaccgttgatgatcaccaagcatcatccgtggctgctctggcgttggcgcgcatgcggtcgaacacctcgacggggacggagacggcgccggtgcgcgcgtgccacctcgcgccgtggcgcgccgccctggccgccacgtcctcgacggccttgaggaactccttggcctgcgccggcgtcagcacctccttcaccgcggcctccacggcgcgccaccgcagcttgtcggcccgccgcgccgcgcgcgccatcttgcacatctcctcccccgccgtctccgccaccccgtccttggtcttctcgcacgccagcttcatcgcgtaggtggactggtactcggcgacctcgccgtccagcgcggcctcgcgggcgtggaggcggcgcgcggcggcggagagcgcgtggcgggcgtgcgcggggagggtggggaagagcgccggtaggagggtgaggaggatgcaggaggggcggaggtcgccgccgagccaggagagcgcggccacggcgagcggcgggtcgtcggtgcgcgcgaggaggcaggggacgtcgcgggggcggacgggcgggccggtggcgaggcgggagtagcgggcgcggaggcgggcgaggtcggcggtgatgtccgcggtggcgatgttgtcgctgtcgctggagtcggaggagaggaggcggcggtgcaccgtcggttccaccgatccgggcgctgattgccaagaaccaagcagcgatgagccaagaatccaccggaatcaagaatccgcaaatcaagaatcgggaaggagcgattacagcaggggaggaagcaggggaggaaggagaggaagcccttgtccttgtccttgtccttttccttcttggcgatcttcccgccgccgctgcctcggcggaatctggagtcgtaggcgtagtagtagtcgtcggcgtcatcgccagcgagagggctaaggaacggcattgcgcgccgcgcgtggtactgctgcactgctggggagggaggagagagagagagatagagagggaggtgggcaagctttaatggtccaacgatttgggcttatgagaaggcccggcccaacttgattgcttttcatttttctgataaaacttcctccatatgtatcttgtttttttttctccattggcaccctagataattaattaggttgtctaaaaatcctctcatggccctagataattggttaccagcgcctagtcatccctacatgtatgggtcggtttgaaaatcctagttaaaatttcttaatgtcatggttaaatgcggctccaagttacaaattatttttaattatatttgtcttataaactccctccatccaaatatataactacttatttttcaaatttggtatcatttctccaactattttatcatattagttaactataactaactttgttttttcaataatttttcatctcaaccaactataacaagtcctcatttatttatttgtctaccttcttaatctatatctatatctgtatctatatactaactagcaaaagtgtccgtacattgcaccaggtgattacgaagtgtgtacagtgataaaaattgttatttagtttagacaactaatctgctaaaaaaaggcgacggatgaaaatttgtatcatgaagaaaaatatttatttgtatgtaggtaagtctaataaaatacaagtggaatttttatactcaatgtactttaaattgccaatatatatatatatatatatatatatatatatatatattagaaatacattggccgtgtttagtttgttgggtgtaaaaactttgacgtatacggatacacatttgaagtattaaacgtagactaataacaaaataaattacaggttccgcctttaaactacgagacgaatttataaaccctaattaatccgtcattagcaaatgtttaatgtagcatcacattgtcaaattatgacgtaattaggctcaaaagatttgtctcgcaatttacatgcaaactatgcaattggtttttttatccacatttaatgttccatacatacatgtgtccaagcatttgatatgacttttttgataatttttgttagaatctaaacacacccatagtataaacgcgctcataacacaagcattgaaatcaaaaaaaaattatagccccctataattttaggccactgaggagataaggcctagatccctaatagaaaaaaataaaagcggtgcctactaagcagttggagtagtagcaattactggtagcaaacaatggttatggaattctcaaaaaaaaaaaacaatggttatggcagtgcagcacgagcacgtctcctcccatgcgtcaatggtccatagaccatgtctatggactcatgagctcttgcatcgttcttatctatccactcatcgttc

SEQ ID NO: 62649 - DNA, 18227 bp, Oryza sativa
gaagacggcaggtcggtttatatagagaagggtcgctgatcagggcgcccgcacgatctctactgcgcgtaaccgaaccggataagtcgcgcgtaacttatccggactccatgccgtttgcacgcaccggatttttcggaacgtttccaaagcaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggcgaggcgaggcgaggcgagcgagcgcgcgcgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaaggcccattcattaattccaacaattcgagtgggctaaggcccattcattaattccaacaatcccccaccaaatctcaaaatcccactgagatttgccttttccaatgtactgtttatataccagcggttcgatggagaccaattaaggttgaacatccacctagaattccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagtcaacagaactcattaaggcatagccaatctgccttgcagctcacgagagtacatgcatcttcacttggagagggtatatatattgatactctcctctagtttactaatggtttgttcttctcaggatctaattcacgggatctccgatcacatagactgggttaccaccatagtataactcatatgggtctcaaacccatctccttcaatgcattgtctatcacatttcgtgatagtcccttcgtgaagggatctgccaggtttctcgctgtttggatgtaatccaacgttataactccagagtttcttaattttctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgttttagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtaatctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactaggaattatttcagatggttggttcgaaccactatgtgtatccttcattgggaaaaagctctcaaagaagatagcatcacgagactctataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcatctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatgaatgtcatgaaatatcgttttccacccttcgtcaacaccccattcatttcacaaagatctgaatgtaggagttctagtggtgccaagtttctctcctcggcagccttgtgaggcttgcgaggttgctttgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacagacctacgcactcataacctttaccaataaaatatccatgtttagacacgactactttattagactcaaaaaccaacttaaatccgtctctagtcagacgggagccactaacaagattcctgtcgatagaagggacatgctgcacattcttcagctgcacgatcttttccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggcttgtatctcatgagcctgttcgactacagaacggttgtcagccattttgtagtcatgaaactgctccatgatatacagatcattgctagcatcagtagcaccgaatttactattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccaaggtgacgaaaagaccggctgcttggtcgaaacttttcgcaggtgtctacgaaggcacgaaacacgcgagcgaagaggaaggcgagccgtcgcgaacgaatagggagcagtcgcgcgaagcgctttccaaaaaccttattgccgccttctcccggtgcaggacgtcaaagacagaggttccggagacctgctctcccgatcgctggtgcacgccggcgagcgggatggagtagtctacgagcgacggcgcagtacatagtaggaggcaaaccctagattgattttgcgtgtgctgcgtgaagacggcaggtcggtttatatagagaagggtcgcttgatcagggcgcccgcacgatctctactgcgcgtaaccgaaccagataagtcgcgcgtaacttatccggactccacgccgtttgcacgcaccggatttttcggaacgtttccaaagcaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccctgccaggccaggcgagcgcgcgcgtgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaaggcccattcattaattccaacaattcgagtgggctaaggcccattcattaattccaacacatagatcatctctctcgttttgctctcggtcttctctctcggagcggcggagccaaggcggcaggcggcggcgcaagaggggaggcggcgggcgacgggtggcggcggcgggtgaagacggtgcagcccagcggcgggaggtggcatcggcggcgatgacagcgccctcccctccgcggcagcaccgtgcggttgcttcggcgacgcgcggcgggaggagcggtggccgcccggaggctccctccctcctccagatccagcggaagggctccagagccgcaccgcctcccctcgggacctatggtgagtcaccgccaatgctgccctcaaaaaccgttggccttcaactgatgtattttctgccgctggcctgagtcaagctcgttcagaagcccgacgaccgcgccaagcacttccgccgccacacgtcgcctgcaacccgacgtaacttagtgttgttggatttgtgatttcgtgattttgtggatttgtgattcattttctattgttttttattgtcgctcagatggattggattgggagggagataatacatgggtgttaggtttattgtggggatcaaatttatgaggtcgatattggtattttcttgttctttttggttatttgactgattgatttggggatctagctcgggattttttttaagacagactcggactcgaggagggagggatcgcacggacgagtggaaaatcgggcaaacgaacgaaaatttggtgacgaaagaaaaaatatgaatcttttaattagttattataatctctactactttaaaaaataagaatggcttccatcgtccgaaaaaaaaccggtcgaaaaaacccaaatttatccaataaaaaaaccggacgaaaaaacgtgcgaaaaaaagaagagaaaaaccaaatatgcccgatctaaaaaaaactgggcgaaaaaaaccaaaattgtccgatcaaaaaaaaatctagacaaaaaaatcaaatttatccgataaaaaaaccggacgaaaaaaagtgcgaaacaaagaaaagaaaaaccaaatccgtctgatccagaaaaaaccgggcgaaaaaaaatcaaaattgtccgataaaaaaatcgggcgaaaaaaaatgtgcaaagaaaaaccaaatctgtccaacgcggagagaaaaatgcaaaaagaaaagaaaaaaggaatgtcggaccctcattaattgacgcggagaaaaaaaaatctcccagatcgctctggtcgttcgtgataaaaaaaagagtagggggaaaaaaccggatcactcacgagaataaaagaagaccgcaaaaccagaatctaatctaacttcttaacgagagaagtttccatcgtccgctaaaaataaaaaatgcgcaagaaaaaaacagtttccaaataacgctcgaaaaaatacggtttcctttgtctgaaaaagcaaaaaaaaaaaagaagatattaaaaacggttagaaagaaatacgccatttctaaaaatggtttgagaaaaccgcacaagaaaaaatcaccgtttataaaaaaacaagccgctctgaaaaaaactaccagaaaaaaacaccgtttataaaaaaacagatccaaaaaacaatcagactcaacgtgagaaaaaaccaaaactgttgtttctaaaaacgattcgagaaaaccgttcgactcaacgcgagaaaaaaaaccgcttttctaaaaaaaagtcagagaaaaccatccgactcaacacaagaaaaaaaaccactgtttatataaagaaccgctctgaaaaaccgaaaaaccgtccgactcaatgcgagataaaattgatatatgcttgggtcggataagatccatcgattttttttctatctcctacacatcatttgattcctcatctcatctaatctctggtatgcaattatgattatcggactatttttgttaagtatagatactattcttaataacatattatatggaaataatattaaaaaataaacatatttttaattgttatttagagaaaagtgcacggtgactattttgtgtagacttgacccagagtgtaggatttgattaacctattattggttgcaagaataagattgaaagagtattctagattatatgcatgttgttacatgaataatccaattattttagataaagcaagtattggtaagattgccatcatcgaggttaagtcattatatgaagatgttctaattttctaattatgttagttacaacgatccatacaaatatattgatatggttatgcatgaaaagtgtatattgtaattggattttttttttacccgttgcaacgcacgggcatttttgctagtataagattaaaaaaataagaaaagcttcctgttaatcttttcgtccgtcattaaagagtgggccacacaatattttgtcgctaatccacaatccgaaagcgtggccacgatctcttacgcccgcaaataaaggagaaaaaaaaaagagaaagccttgtttgttgagcagcccatctaaagcagtccgtattggattagtgacgagtcagcccatccaaagcaacagcaggccggcccagagagcagccgcagcccacagagcggaggagcagcagcagcccagcacagtactgcgcaacactgtagcaacggaacaggaataaagtttggactcacgccaaccaggaatcggataaaaaaaagcaattttataaatgtaaacatgtagtcaccaacaaaatgaattatttaccgataaaataaattattttttaaaatataaaaaataatcacatgtgtctttcttttttaaaaagaaaacaaataatcaccaacaaaatgaatcgtgttaacatctggattttttccctcatcaattgctcattcgtcataggacacctaatcacatcacttttttttccttcatggtataatttcttttattatttagagtgaaagttattctgcgatataccacatttttttctttccttctgattatttgagtgagcgattatgcaattggagtgcagtgaggttgatctgatagctagcaaaaaaatatttcttggattatggctactctttacagtatgaaaaaaattgtttatcaatatcgagtgccaaaaaataacaaagtactgcaattgactcataataatacatgacaaaaaaagtaaatattttttgtggtttcaaacttcagtatccatgtcagtggatttagagcagcaaataattatatcatgttagcgtcttatttgcactggaaagattcgattcgactataaagacctcaattaacctggtggttttatgcttccacacactaattattattttcttcttgattctatcaatttttttggaacatgacctacaaccagcaaagaacttgaaattgattttatctgtgtttgaaaaaatatctggcctgaaaataaattttcacaaaagtgagctattctattttgggcaggcaaaagagtgccttgatcaatattcttctatatttggttgtaagctagactcttttcctgttaaatatcttggaattccaatgcattttaggaagttgagtaataatgattggaaggttattgaacaaagaatagagaggaaacttagtagttggaaaggtaaacatatgtctgttggaggtagattggttttgattaattctgtcctttcaagtttagctatgttcatgatttctttctttgagattccgaaaggggttcttcataagattgattattatagatcatgtttcttttggcaaggggatgaccataagaaaaaatatagactaactagatgggatataatttgtcaacccaaagaccagggtggattgggtgttcataatttagagatccaaaataaatgtctattgagtaagtggttatataagttaattaatgaggatggtgtttggcaagatttattgaagaggaagtatcttcataataaatctataacccaagtggataggaaacaaggtgattcttatttttggtcagggcttatgaaggtaaaaaacatcttcttaagtatgggctcttggattgtgaatgatggttaacagataagattctgggatgataaatggctaggtaatatagccttcaaagataagtatccatctttatatgctattgtcagaaggaagagtgcctctattgctagtgttatgggttctgttccgctaaatgtttcttttaggagagctttagttgggcagaatctaacactttggtataatttgtgtgcttccattgctcatatccagttggatgattctactgattgttttagatggaattatcatcaaaatggccatttttcggtaaagtcaatgtacttagcctcaattagcaatggttacattgatagaaataagttcatttggaagcttaagatgccgcttaagatcaagatctttatgtggtatttgctcaagggagtcgtcttaagaaaggataatcttgcacgacggaattggaatgggggtttaacatgttgtttttgcatgaaaaatgagacgatccaacacttgtttatggattgtcattatgcaaagtttatttggagagctgttcaattttcttttggattacatcttcctagaagcatgcctcatatgtttaatggttggcttcagggtgtggacaaggacaagagaaagttgatacttgttggtgcctctgctttatgttgggccctgtggttatgtagaaatgatagggtttttgacaaatcaccatctgtttcctatatgcaggtaattttcagggcaacatattggcttcggctgtgggctcaactataaaagtgtgaggaagatggagttttcctaaatgttgcatgtcgtactcttgagtcaacggttatacaactttttgccaaccatggatggagattttctaataggctggaataatgttttccttgtcatgttaggtctttcttttaattttggttggtttgatagttttatcttgaattaagactttataagtgtgttactttttataataattggttgtagctcttcggagtaaaggccgggatgtttcattccattatctaaaaacccaatgcaacgcatgggcattttgctagtctcgaaaaaaatagaagtggttataagagcatcatcaacattatctctatattttgtacccaaattattttctatgagaaccctaaacaagatttaagatataaaaatgttgataccttcaagagattggttaaaattgaggataatttgcctttgtatgaacttggtagatggcgactgcaagtcgatataactggattttaggcacatcgacaacggcctcggcgttggtggcaagttgtctgtcgattacctcaccggtgggtccgaaatggtcgacaaatgcgatagcaatggtggaaacaacaacggtctggtgagcgacaacgagtcctacggccccagtgtgctactcgtggctctcttcagaagaagggagctgccaaccggttgtggggtttaagaaatatgcaactctattatgattgattgcagtggagatgagtacaacggcatcaatggatgacttcgcaaggaagttcctggctgtagcatttcatgatcgcaatgggaagaagcactgagataaatggaaaaagcgcagatcgatttgagagcgagagacgcagtgatgagaacgcctaatttttaggagatgtttagagatacagttggagcaaaatttgtgtttaaaatcataaattctaatattggaaatgatttacccaatgtctcgttctaatctctccctgatgctcaatacaggcgacatatatcatctatatactataatataaaaaagaggagttgtcccgctccaatgctacaggccaaatcatccggactaatctggaccgtccatccaggcgcagcttattccaccgcacgatttggcttgcacgccgattcgccgaagacatcgctcctccgtcctcatccacccgctgccgcgaagacgtcgctcctcgactcctcctcgctcgctcctcctcctccccgcgtcctggcaggagatcctccccgctcctccgcggccacgccggagccgccgccgccaccgctcctccgcggccactccggagccgccgccgccgggtccttcttcctccccatcgacgcggccggcctcttcgctcgcgcctcctcctccccgctgccgccgctccgccgcatcctcgccggatctctgccggatctctgccggagctccgccttggtccctcatcaagtccctaatccctaatcttcttccttgagcattggcctgtaccatgattttcctttttttgttgaagccaggtcggccaaactgcaagtgacccattgattatgttatttggtactctcagaccacatatatattcttccttccatgttggttcagccattgcttcatgcttgctttactttgagttttgtttgctccgatctaacattcacattgtttttgtgcgttgaggactggggcgggcttctgttttatttagtgcctcaacttgattaagccacaaaattatgcactttgtatggcaaaggtaaagcactttgttgtcatgggttgttttaaataataatggatccccttttttctagccttgcagattgtcatgttgctggaattgtaagcggactgacgaattcaggggtttgtcattgctcgaataccattatatgcattgtttcaagttgcagaaccatactattttttttacgaaaatgctgaaccatactattatcatttacagaatatatatttatacatttatgtgtccatccatactctttataggttattctcaagtctcaactaccaatgtctctacaggaacgagctccacttgatgatcttgctaattccaagtgccatgacattatcaagctctaagcaaggccatgggctatggcgatctgggtaagcagaatatatttgtctttctatatacctcagcccatcaaccgtaacttagcaaaagtacctgtcatctggcttgggaggcattactgaatctcacctatgcaatttgatgaactgacattcatgttttgctatatacttcctatcactagaattcctgttacattatatatatgcgcatacattcttgtgtagctactaggtagatatttcttctaatgatacggttgtcagaatcaatggcattcaactgatcagttcaacttcatgcatttcgtgtcagaagggaacatatgagagttaacatgtatacggcatattgtgttgattgcccataaacagctagcccaacattcttctgctctgctagctgattgcccataaacagctagcccaacattcttctgctctgctagctataatttggatcctaacttcagtgtgagatatatgcgcagttacaagttgaactactattagtttactaggacggcctgtcataacaagctatagttctatgaattttttgaaataaaagatgatccatttgtgagttccattgtttgagactaaaagaaatacagattgcaagagcaaaaggcaataacgtgaggaagggagaaaagttgttttcagcacaataagtctgtgaccatgttttcataggaaactcattataaagaaatgaaatggaaacaactttccatggtgatttcattgaccattgctcagatcaatgacacaaatgatgtaggataccaatgcagtaatccacgaagtgaagaatgcatgattcagttggtggaaaggcaatacatgatgaagatgatttgtacaacaaattggcttatgtaaaattaatgctcttttctcatttggtgttttgtatcattgcaatactccagctgttgtaattaatcaagtgttaccaatgttgaagtggtctgcaccttgtagcaatctagcagagctctaaattttgttctgtgcaaaatttgggttttagtgagagaatgggatcctgtttacaaatgtcaaataaattagctataaaaaaaatccaagcagtttaaaaccagagcaaggtattcccttcagttttattacgccctttccacataggagacggttataaattctaagaaattgcatttccttcagttttatccccccctcccccccgcgcgcgcttttcacataggaaacagttagaaattatgtacacaacatcaacaatttgtatttacaccaagtttttctgaatggtgtagtactcaatggggcagataaaaaaaaatcaaaaaatgatgtcacaccttgacgcatgaaattaccaccacctttttaaatatataatgttgttgatttttggacatgacatttgaccatttgttttattaaaaaaacaatgtaaagttaagtcatgcttaaaagtccttctaagcatgacttatatttatatctttacgtattcatgctaaaattttgaattagacaaatattcaaatgtcatatccaaaagccaacaatatcatatatttaaaatgcagagagtacatttgttatttatttgtttcttaactgattccatttataatttattaaatattacactatagatgtatgttttattacctatgtggattccacatgttcacttacattgacttattaaaatgtccatcctatctttggacaatataccaccgtaaatttggtttttgatagaatatattcttacaattgtattacactggacttaattcatattggtcatgacgtgcattgcacgtacacgattacaagtgactttaaaaaaaaccttcactgacatgaataaaaacacgacccaaatacactagtgcgctgactgtttttttaccccgaaagctatcccatttccttcccacagtctttaccctttcccttttccttttcttttttaagcctttacagagtcttaacttattaaatggccattaagttagcaatcatcacaaacatgcttaatattccataatcatatgaacatggttagtaggagtccctagaacctcccgcaacaaataccccctccttcacccctctggacgcgacgccggcatcagtaattgagcgccgcggcggcggaggcgggcgaggctgcagacgccgacgagggctgagccggacccacccacccaccgagcgccgtggcttgggcggccggggagagggagggagtggttggtgagctctaatggcgggcctcccctttctcctcgcgctccacatcgcactgctgctgcttcttccctgctcctgccaggtactcctcccgattaaccgcttctttcatccgattcttgtcgcaatttgttgctcgagctactacttctttgcccaattcgatctgcctgccccgctgctgctgttccagcacttcttgatgcgttggttatgtatgcaggttggggattcgtgctcgtcggcgcgcgactgcggcgccggcctctactgcggcaattgcgccgccaccggcaagacccggccgtcctgcatcagagacctggcgatccagcctacctccattgtactaattctcatcgcttctcctcctctgcagcttctctcctgttgtgcaacaagtttttctcatctcacatgttctgttgttacatccatgcttgtttaggtgaagggactgcccttcaaccgctactcatggctggtcacccacaactccttctccatcataggcgagccgtcgcacaccggagtcgagagggtcacgttctacaaccaggaggacactgtcactaaccaattgagggtagcttctggatctctgaccagattcttcacttactcctgtatatgtgaactgttataggatgagtatatttcttgctttggatgttgggtgtttgcagaatggagtgaggggattgatgctggatatgtatgacttcaatgatgatatctggctctgccactccttgcaaggccaatgctacaacttcactgcttttgtaagttctattcattgcccatactagaactagatatgtgccatttcatatctatttaggaaaagccaaattcaaatataattcgggcgggccttgcttcagtagttcagtacacctattttaaaatctttgtgcatcctaaagcaaaagtagttagtttagagggaaatatggagaaacaatagttagttggatttgctaagatttttctgaatgcccagctcaaattttgcccagccctataaactgcacaattgaaaactggtgagtatatgcttgttgtagaattgaggtgcatcttctacctgttttcttgtcagatagctctgatacctaaacactatcttaatctagtcttgaatgccgatactctgtcagaaagaagacatcacgcattaattagcccctacaaggcctactgcctgatcatcattggtacttcttcaaaccctaccaaagcgtgggtaaatctgtaattgcacacttcttatctaaaagttgaaaggcccttgccatgtaaaatctaaaggcagtggaactatgctggactaacaactaaaaatgttggacaaggataaattcgtctcagtacaaaactatcctttatcattactaaccaaagttgctttaagatcgaatgtttcttaaaatagatttgtgctaaagattaaagaaaggcgcgtgcaatttagataagaagtcctgcactggttgctttgttattccaatcgtctcctgtatttggggacaacattttcaataagatttcctttgaggtaatcaattgtattggataagtttagtaaacatgagttggttattgttttgctttttggaatctattcatcgttatctttgctaacagtctgtttacactctaaaactaatgtttaaatgaaatattatgttagcaaccagcaattgacacattgaaagaggtggaagcatttctatctgagaatccgacagagataataacaatattcattgaggattacgtccattcaacgatgggattgagcaaattgtttactgctgctgacttgacgaaatattggtaccctatctcagaaatgccaactaatggaaaggactggccaagtgtcacagatatggttgcaaagaaccacaggttgctagtgtttacttctgattcttcaaaggaggctagcgaaggaatagcataccagtggagttatctgctggagaatgagtgtaagtatggctttctctgctttaattcttatctatgtttaatcatattaacagcgatagctatgtgatacagatctacataccactgaatcttcctgattcataggtgtgaacagtgatatagcagccacttttagttcactattttaagaaacattgcttgctaaaaaatgttaaattctttggcacaggcatttgttttagctttctcagtagtcagttattgagatgtctgaatttttcattaggactagtttgtgttgtcagtgtgcacatccaagatctatatataccggtattaacattgtatcaagttgccttacagatttcctgatgagataggattgaatatgaattattgtattatggtttaagaaaatatattgtacagagcagaaacagacaatatgtaaaccatctgtccatctgtagttaacacaatattgtactacctccatattttaatgtatgacaccgttgactttttgtccaacgtttgaccattcgtcttattcaaaaaaaattatgtaattatgatttattttattgtgacttgattcgtcatcaaatgttctttaagcaggacataaatattttcatattcgtacaaaatttttgaataaaacaaatggtcaaatgttggttgaaaagtcaacgacgtcatacattaaaatacggagggagtatttgttaagctagctctctttgaaatttttgcttattcactgggtaatcacataaagcacaacatatgcttcttttgccggtagtcaagatcaagaaaaggtagtggttgctaatcaaaagtagtgtttcttttcaaattgtctgtgaaatgcttgccgttctgaatttctgtaatgaactgacttcaaatatgaatgtttaatggaaatcagaaaagaaaaactaaacagcatgatttgaatccactgcccacccttctagagtttgatgtgttactactaaaaaagaaaccccc

SEQ ID NO: 62650 - DNA, 10274 bp, Oryza sativa
ccccgagacgtcggcgtgacgaggcgtcggcgacggcgcggcgtcggcagcagaggcggcggcgacggcgacgactcgcacggcatccggcggcggccaccacgacggcgagatgcgcgcgggcggcggtgctcgcgccgccgggggcgagcgacggctgcagcaccgccggccctggtggtagcggtccgagcgacggcggcgacggcggagcgaggcttgcggaaggcggcgaccggcagcgcggctggtgatgggcaacggcggcggtgccaatggcaaccgcggctgcggcctgaggcaccagcggcaacgccgtcggtgtggaggcagaggcctcggagctcgtcacagcggcggcgtcagtggctgctgtggcacggtgggaggaggcgcggtggtgcgtttggcagcagtggctgcggttgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcatctcaacaaactgctgtcctaactgtcctagagcatccaaactgaaagtagagatgctgtcctagaaagctgaaaaacaggaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttctgatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgccgccatgtactcggcctcgcagctggacagggccaccacctgctgcttgattgactgccagctaacgaggcactcgccgaggaagaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgtcctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggtgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatctccacaaccgtctggttgcgccgctcgacgacgccgttctgctgtgggctgtacggcgcggtgtagtggcgctgaatgccctcatcagcgcagtacgacgcgaattcagccgccgtgaattcgccgccgttgtcggtgcgcagcacgcgcagcttgcggccgcactccgcctctgctgcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggatgtgcgacttgcgcgctgaggatgtagagtcgattagtgcctctggttaccttggcaagaaggcgacaacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcgcagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttacggccgcctgtcggggaagatgactcccccttcctcccgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttttgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcgcggtcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgctgagaccgagcgtcggacatggcgcacctccggggggctgctgtgtggagagggggaagggaaaggggaaggaggagcaaccggtgctgctgctgctgctggctgagagctcaaccgagcttgggaaggggtggaacaagagatgtttagcctacaggaaagtgtggctctgataccagatgttagaatttcaatggttactctcattgagaagaggatggcactcgagatggggcaattttctggttttcttcattcactaaacacaaaagccatatcctcccaaagaggattggatacatatttatagctgcttgtagcagccatgcagccatgctagtctaagagggtgctgtcagcatcccaacaaactgtcctagagcatctcaacaaactgctgtcctaactgtctagagcatccaaactgaaagtagagatgctgtcctagaaagctgaaaaacaggaaaaaggcaccacaagaccaagaccaaccagccaagacttattcctacagcggtggcggtgaccatggtcgccggaggcatggtggcctcggacggctagctgagggcgtggcagatggctacatcgggccggctcggcgcgagaggcgcgagcggcggagaggaggagctgtcggtgggtgtggcgcggtcttcggcgcacgaagactggccggcggaggacgccgatgcaggggtcccgcatgtcggcagagctagagaggtggtggagcatcggtgcgtcagccaaggattcgcaggtggtgagcggcgggtgaaaacctagtccggccttggccaggccgacaatgatggttcattccccctcctgagggcgttgtcgtgctgcctcacccctcaagggtggttgccgggcgaaagcctagtctcggctcctttgagccccgacggacggtggcggcggtttttttccgtcgcttctcttcttgaagacgtcgttttggcatcccttagagggcgatcttttctgtgttcctttgtcggtatagcggcagtcggtcacgcttagcggcggccggtctggtgctagccttctcccgggttgtgtgttggcgctgtcggtatgtgggtggtggtatatttttttccttttcctggttacgaccctccagggttgtaatcttgtaattttttcctgctctatcaatagaacttcgcaccgtcttgtgcgagttgttcaaaaaaaaaaaatgtgttactactagagcacatgggcctttctgatatagctatggctgtggttgttgttgttatcaatagcattaaatttgagtacatgtcacaaaaatccaggtttgggggcatttataacacaaagtcttaggttttacagtttgtttcaaggaaccaaagttttgaatcaaaatgttttagaaaacactctttttttcccgagtatgtaggagggctgcatatcatttgattacagaagaaagaattctgcacaaaatccacagaccccaaaacatttttatatgatactaattactaagatataatgaaaatattgcaccttttagtacataattacattggtagacccgcaatcaacattctcatcacatattttctccttcctcgttttcatactccctcctttccaaaatgtaagatgttttatttttgtcctaagtcaaaacttctttgattataagttcataagtttattttagaacttgtgagcatattatctatagcaacttccttttgtgttctaattctgtaagactgctctgaatacctggtctacatcaggatatagactgtgcatgtttaacattatttcttctcattatttatagttcaaaacatagtccgggagtaaatttatatagcagtgtggtgattgctgcacatgcgctgtctgaaccaagtgctacttgcattcacagctgttaactatcccgtgtctagagtttatctgtatttgccaatttcaccaagaacaatggcaagagagcttaccttacatctgaggtcatttttgttttctcattatcatggcagctggagatccagggatcactggttcttgtccaaatagaaaggaatcacaaccactaaactcaagatctgcatctctgtttatgcaaaattacttccccacaattcctgtagagaatgaagcgtgtaaagagaattctgttggactaccacagatggtccaaacttgctatactgcagctggaaatagaatccctaacttcatagctgtgaattactacatggtattactttatcagcactgctcatacaagaaaatgcatatctgttattgccattgtatccaatggaaattttcttactatggcagcgaagcgatggtgggggtgtttttgatgttcaagacaggatcaatggcgtgacactatgtggctgcaacaccattgctgcttgccaggtaattgtgaagccaaaagtgttatttgaaacaaaaatagtaatgcatgaatcttagaacaaactattcttacttttgagcataaaaattctagcacctctttcattcaatattggtgtgtttcaagttgcaattctcatgaagaactatttttacaggctggggcaccagcgggcgcatgcaaggacaccggagcccctaaccggacttcctcttctgtaaatggaaacgtatattcaggaactatagaattcaagtcacctgcttcagcagccagcatttcgaatgctaacatccctagtaaatttgttggtttgctactgctaggtcttgtgttgatcattaagccgttttgatctttcaggcattctttttttcttttgatgagtttgccacgtttctttttcgtttttaatgtctcctatgtgatgggattacaattacagtaagtaatcttgttagccatctaggctagaatagattcagagagttacggtctggtctgtttggctgtctgacctgagaaatttcctctcatgcctgctcgatatgttctaggctagcaccttacgttgtacccatcacgaagtaatacaaagaaattgaatggattaatggtcctatgggttggcaccaatgttctacacggtgtgaacttacacgaaatatgttagaatgtttgaaaaaacagccagtgatcagtgtgctgcaaacttgcaatggaacttaaatagcagaactacttgtttttttcagaatttaaaagacttaagttaaattaaacgctctcaccgtaccggctaagagcaaggctaataaaacagccgacttattagctataaggttctttgtagccttctctctattcacccatataatagttagctatttacaattaatatatgatccacttgtccctcttacagagagtgtcttcgttcttgtatccaagccggctataagtgtacaacctttttctcctctctctcctctcttctctcctatacctcagcatttagtcggtttatagcctactattatagttgctctaagtaatcggtgatcgtgaagtgcaactcatgaagcggttttataagtgcttttgcacacgtggaccataagagagtagagggcagtgatgatattactaatggaatcagttaaatgatttttctaaaaaaattatagtagtttctcgtctcaaaataaatctaaccctcaccttcaaagctatggtagcattagtgtcgagaaaaaaaaatatcacttggtggattgaaggctaaaacattttccaagaaccaataacaacatgagttgtggtacttttacgttgtaccaaattatttgtttgatttataaagacacggtcagcgattaattgattttgggggagggtagaaaagatggtttgatttgagtttatatacgaaattcaacccttcattcaggaaaataaatatcataattagtgaatatatattttgccgctcttccttgtccacgcagtactccaataggaagagaagatttttgtttctccagtcaggaaaagtgaaatagatagttccaaaatagaaatcttggattttgacggtagcatcgggggtccttttcgtaggaatacgtctcgcggttgaaaaatatgtaggtcaattatatatattcgtcagaatataatacgaaaaatagaggcgagtagaaaagcaaagcaagcagttagaaatccacacgcaagaagagaggaaaacgtgatctcacctgaataactcgagtgaaacagggacgtcggaagcagcagcgccaattggttgtgcgtcgtcttgtgtgtctctttcacagcgacacccgcccttgttgcgttgcgtcggcgtatatgtacgcacgcacgcgcacacgcacacgcaaattaagcagagcgttccgttgattttgctcgtggtgtgtgtttgtgtttggtatggtttgtttctcgatcggtacatcgccaacttccgctcgagtttattttatttttctgaaaaaactgctcccgtataatttatttcgtgcgtgcgtgtttaattgtcaacccatacacaacttgatctatgtatgtattgtacggtcaagtaaaaggaaattgtggtatactagtatacaatttaaaagttattattgctagcattttttatttttgggtagagcgttgtagtaataatcaatttcattgagtagatagaaaaggaagcatatggatgcagtggagatttttctcgtctctggaatccaggacggagccgagcgagcggtccag

SEQ ID NO: 62651 - DNA, 5963 bp, Oryza sativa
  unsure (1)..(5963): unsure at all n locations
ccaaatcaacagcttccttaacaacatctacttactgctgctgctttttttttttttttggggggggggggctatatattcatcttttttcctctttttttgctggactacacaacaccgctcccatcccaaatagtactctatttaattagtgctttgttgctgctgttgttattgttgtgtgctcatctcaaattagtgcttcttctcaaatctcaaccatatgtgtacctttcttccttttctcttggaatttcatgaagctgtctgtattcctctaactgaaatatctattccttttcttttgtgtgagtgggaggaatatctattcattgtttcccaaaaattcgtcataaatgattttcccattaattctccaaactgatttattttacttcgaatatattcatacatactgtataggagtatgctaggagtatacatggatgaactataaagtttcaaattaatcattattaatttctgatgagatgcaccatcttcctccttcagcacaacaacggagtctacacagttggtgacttcatgaccaaaaggcctaatctccatgtcgttacacctgcaacctcggttgatgaaggtactaccttcttctctacttctataatatgaagtatgtcctaactatgcttgctgctaaaccaaatcgccaacttattattctgttcgtttttacagctctcgagacgctggtgcaacacaagatctctggtttccctgttgttgatgacaccggaaagttggttagtgcccatcaaaacttcactctattcaatctttttctacttactctctgcaatttttattctcaaaacagttatgcttacaagtcaacaacgttgggcttttctcaaggggaaatgatttattgctaaatagttatctcagtaacatgattctaggatattttctttctcaaacacggtttcaaactttatacctttttacatgctaaattcgaactagtatggtgattctacctaaaggatttagagatcttggaatgctcacatctagaatgtagtgctgattcataaaacggtgtccttgtccccatgacatgcgggccttttgatctcctctattatgttgtgtcttaagaaacattacattgacattatggttgaattgtatctgatttctcattctgccactcaatcttacttccacctgcaggtgggtgttgtctcagattatgatctgttagcacttgactcaatatcaggtattccttcttggaccttcaaatcacttgcttacaacaaattcatattactagtacaatattgcatcctctaaactgcataagcctagtatttgtcattaacacaccattgcactaccatctaaccatctgcttgcagtcatacatggtggtcatttgtcaatatcttgatagcctgataggcaggatcacaactagaaagaaccataagtagtggcggcttggaccatataatcttttgcatacctacaaccaaaccttgtttaaaccatagcaaccataactttgatctgaaattctgaatgcaacaaaagctttgcccacactgcaacttttctggaactctaagctgcaaagattaacttgagctatttaacttattttttgaaagtatactgttgggtagtaaatgccataatccttgtattcttacattggtggtattttaaatccattctttcaggaagtggactgactggcacaaacacaagcatgtttcctgaggtggatagtacttggaaggtatgttctaataaagatagaatgttacatgtttttttatatatattttctagctatgcaccattttcttagattgggttatctttaccacctactgccaggtgttaggatggaatggtctggtttggaataaaagcaatttttaatcatggaaaatccccagtttctatattcagaagcaatgatcctccttaaataaaatgttcccaccacaaagaaccttcacatgttatgacaaaatgctgtttgactaaataataaagtagaagtgtaccttgcatagtggctgatgtaatggactgtgttaggtccagcaaattgtcacttgttttccctatcaagaatgttgttacctctcaacttaggatgcttagtcagtattgggttaaatactaaatcccgtataccttacatatattttgtaacagtatttaccacccattttgtagcacaccccagtaatgatctttaaaatcttggtattcttcactcttcatgcattagtctgaaccacaatttagtacttcaatttggtaaatatattgtttctagcatttaaataaataattagtcatgctccacatattgtttgtagtagcagatcttttttttttatctttatcaattattttttatttcacacgttaatatattagactcattacgatcgctgtacagacatttcgcgagatacagagactcttgagcaaaaccaatggcaaagtcatcgctgatgtgatgacttattcgcctcttgcggttcgtgaaagtaccaaccttgatgctgctacaaggtacctacaaacagtccattagttctcaggaccacgtctaccaatttattatcagacatcacgattggtgttcatttgtttcaggttgctacttgaaaccaaatatcgcagattgcctgttgttgatagcactggtaaattggtgagttgatctgcctttccttccttccgctttcgtttcagtagtatctagtcttaagtaaagtttcttttctcaaggttgggatgatcacaagggggactgttgtcagagctgccctcaaaataaagaagacagctgaagaaactgcttaaattagacagtgtagatgattctttataagtcatttctgggactgcagtcacttggaaatttagtccactgaaacattatttggtgaaatgaactacatcagccttacnagatactggcgaaanattntncgtcnacaggtnnncaattctttctttggnaannncatagnnatgngnanntataggtnnattgtattgttgcangatnnatttggnnaatatagncncnngcaatgcttgnntttgggnnngccaccagatttggtcgcctctccttattaggtagcataacatggagaatgttattatttttatttttacttttatcattgacttgtattcaagaacatcagtgtattgaaatgtaacacttctgatatgatgataccttccgcatctgggttgaagtgaaaatattttccaatgtttagattatacaacgaacaaggttgtaaaaggtaaatttataagttagagcctacgtttaatttcatcatggtagttgtgtagtttttgagaatgaagttgaaaaagattatatgtttgtcagcatacgaagtaaaggccaccccttttgcgtcactgacgttctttaaaaaagaaaagaaaggttgtaagatcttctaagtatatttttggggtttatgttagtttgatagtttctaaaactgataagtcatcctcttgacttttgtaacaattcaatttactcctaaactataatactagacatttgacacccatccatgttcatgctacgtcgagatccttgatcatctactcgactgtttgacgccaccgtcatctttccgaacatgtgccatcgtggcttagggctcatggtgcttctagactcgtagtcggtaagattagattcttagtgagcaatgaactcatttacgaagggaccctacctccaatggtaagataccgaaaataaatttgataaaaagatgggtgcagtagttgatgcctatcgcaaaagtagggaaggggagggttagtcatttaaaatcagacgttaccctttttatgataatttgtttatagtggtgaaaaaataattcttgaaccagggtgaaaatcattgactaagttattaggtttgtcacatagtgatggtgtgatatgacacctcatactaataaaatatgttttaatagtactggttgtaaatgacttgtatgtttaatatgtgtttcatacttttaatagtaacaaccatggtaattgtgtagttttttactcttttgatttattttgctgaagttccactaggaaacaatgaagttggacgagattataagtttgtcagcatgtgaagcaaagaccacccttttataaaataaaaggttgtaaaatcttccaagtatttttttgagggtttacattagtttctaaaactgacatgcaatcccagtcactcttaaccactataacacagtttaactccacatacacggtacatccaaatacattcataacagtacatttataattgtctggtaatcatgtgcaatttaccccaatcccttgacttttgtgataatccaatttatcccctaaacaataataccatacatttggcatccaaccatgtccatgctacggcaagatcctttgtcatccactcgacagcttgatgccaccatcctcttccgaaaccgtgccatcatagcatagtgcttatgctggttctagatttgtagtcaataagactataatcgtaatcatagttaccaaggagctaatttacggaggaaccctatttccaagagtaagatgttgaagatgaagtcgatcgaataggcaggtgcaatagttgatgtctattgcaattctcaaaagtggatggagggagagttgtttaaaattggatgttacccttttcataataatttgtttatagtggtggaaaaataattatataaccaaggtgaaaaacattacggctaagctagctaatggatttgtcatgtagcgatgatgtgatatggcacttcatactaataaaacatgttttaatagtatctagctatgcttataatttagtatgtttgtcatacttttgttgttttcatatttattttaatttcaactgggccatacaagtgatattgttcaatccaaatcaataatcttttatgacgatatcaacgaagtaacataagacaatgcatttaagagctccttgtaaggctcgaacaacaaatggtaacaaatcaaattgaaaattttcaatataacaatattggtaaagacaatccattaagattgcgaataaccaacaacatattataagtttatgtggcatttttagtcggactaactctaacatatttttatctagtttcacgctaatagtgttgcctaaacatgatagctcgatagaaagaaaatataataaatttgctcgtacattggtccgttttagtctacccactctatttgtggttaagtgacatgattaaaatgttacacaaatttatataagtaggtataattcaactagttaggttccttgtggtagaaccgatccacttaggttcaagttctagatagacttgacacgagtgtttatatttttggctaattattctttcattaagtggtagacgacttactatgtgaggctgtattcgggagcgccacagaaaactatatatatgcattaacacatgattaattaaatattagctaattccttttttaaaaaatagattaatatgattttttgaaacaactttcgtatagaaaattaataaaaatgtatcgtttagttgtttgaaaaacgtgcacacggataacgagtgtaagcgcgcggtgaatccatacgcttgcgctgtgtttcttacaaagaaaaataactagaaaaaatgcccgtgcgttgtaacaggtgaagtctattttaatcttattattgttatatggtttagttaagataaaattcaccgtgggagttcgcttggatatatatatttttagaaaatcatgagctacagttaggagtccgattgtctcaagttagcatgcgagttttttaaaaaaagattcttatatgtttccttccgtattaccaaaagtaaacgatcttaaaatcgactcaa

SEQ ID NO: 62652 - DNA, 1927 bp, Oryza sativa
ttcgcgcaggtcggcggcgtcgtctccgtgcgcgtctgcagggacgtcaacacgcggaggtcgctcggctacgcctacgtcactcagcagccccgccgatggtacctccccgatccgcctcgccctgctcgattgctgttcttttccccgaatctagcatctaggtttaggtggattgcttttttttccttttcccaagacgattagggtttggtactctttttttttcttttcacacgtttagggtttggtctcgtcggattttagggtttggtctcgtcggattaggtttgctaccgtcggattagaatgccattagaattgatgtcgctgcggcagtgttaaagcatgcatatttcttttaaaaaagataggaaggctgcccttcttttttctgacgtggttagggtcctgatcctcagcgagctattccattgcagaaataactatggtttagcacaaatcattgccttcccccaatataaatacatttcagtggttcttattttcatatttgtaattctacatcatgttcggtaatgtccattaatctgttatgttggaagataatgcaaatcatttaagatggtacataaacacccctattgagcatcacatttctgtctagatggcaggcacgataaattttgatatgaatcctccttaaattgagtaaagttattatttttataacgtttgtattggagattttgggcttttgcttattttggtgtaatatctcctgttctagtaaatgctctcatctgcagagatgcacgtgaatctgttatgtcacctaaaattttaaaacatttgagatgccatgactaatatgcaataatttctaagttgtgctgcctttgggaaacttgcacattttaaaattctttgcctaacaacatatatttatttactactggctatgatagttgtctatttccttttcttacagaatatccacatgcatctacaatggttttatttgttgcttgacttttgtattagtcctttcatactaaatacgttatatctatcttgcagctgcacgagcgttggaaatgctcaacttcactcctatcaatggaaaacctatcaggatcatgtattctaaccgtgaccccagcttgcgcaagagtggcacagcaaatatttttatcaaggtatctgtgcccactcttgaaagctattttttcatcttttttttttgtagtttgacatcctgacttctcttttttcagaaccttgataagtcgatagacaacaaagctttgtatgatactttctgtgtgtttggaaacattctttcatgtaaagttgcaacagatgcttctggagaatcgaagggctatggctttgttcagtatgagcgggatgaggcagctcaagctgctattgataaactcaatggcatgcttatgaatgacaaaaaggtgtatgttgggcctttcattcgtaagcaggagagggataattctccaggccaggtcaagttcaataatgtctatgtaaagaacctgtctgagaatactactgaagatgacttgaaggaaatctttggaaaatttggaaccatcactagcgctgttgtaatgcgtgagggagatggaagatccaagtgttttggatttgttaactttgaaagtccagatgatgctgctcaggctgtccaagagctgaatggcaagaagtttgatgataaggaatggtatgttggaagggcacaaaagaaatcggaaagagagatggaattgaaagagaaatttgagaagaaccttcaagaagcagcagataagtatcaaaacactaacctgtacctgaagaacttggatgatagtgttgatgatgataagttgagggagctttttgctgagtatggcactattacttcctgcaaggtttgtttacttgtctgcctatgcatgtgttt

SEQ ID NO: 62653 - DNA, 5567 bp, Oryza sativa
aattggccagttttgagagtagcattgtgtgtactttttgcacgtcacaatgtgagtgcgggtgttatttatgcatagaagagtgcggtagctaatattctgtgatgtctcgcattttgaatagaattctggcataccaataaacaagctgtcattagattgaattttcttggctcacataacttgcatgtttttcattataatgcttattattactttctgtagtatgatgttggtggctattccttacttttgcaggcacaattttcacaactgaggcctgtcccacttgctccttcagttggtcctcgcatgcccatgtttccacctggtgttcctggagttggacagcaactgttctatggtcagccccctccagcgtttatcaacacacaggtaaataaggcttaattttcttattgatgtgttcttttgacatcttctctttccataataatcccccttttttttggtgttgtgtgttagtgtgcacaatttctttctttcataagttttagtggtatcttcttactgctttcgcttgtgaccatttgctttgactatttggcggttgcatagtaataagttcttgctgacaaatgcaagatcatgatgtaacgtttaatgccactgtttaatttccagtcctatttataaagattattcctgtaagaatatagcaaacaatcatgtcctaaaggcttttatgataattatgaggtgatcgaatgctagtgttgtttcctttgtgcatttagattaagtggttaaatgatattgattgaacttagacatatgtcttactgttttctgattatgtctcatatattggtcttaagaaaatactacatccaacctgaaagtataaagcttgcttatatgtagtaagtggcaaataattttatctagcaaattgatgtcttcttattctgtgttgcatttatgaatgttatactggcgctgtatttttaactttgcaacattgatcattttcctcatttggttttgcaacacaagatggtcattaacactacacttcttttggttgataagacatgcaacactaagttgtgagcattcagttgtttaatcatgcatctagagctctatgttgcttgctattcctgtttgccgaggagacacaaaactgtagtaatatataacccgtccaaaatttgacactgttagatggtcaagtgcaatttacatttgtttcataggaatagtccaatagtttttttttgtcttgttatgatggactgggtggatacttaagattgtttatatgatttgctggcttgacaattttacctttttttattatagcctggtttcggcttccagcagcctcttatgcctgggatgaggccaggtgcaggtccaatgccgaactttatcatgcctatggttcagcaaggacaacagccgcagcgtccggctggtaggcgtgctggtgctggtggaatgcagcaacccatgccaatgggtcagcaacaggtatgacatatttgtgcgtgtatgctgaacatataataattttccgtaagcattcctgtagtgttaatttgacaattcccttgtgtatcgagtgcctgctgaaatatagttaatgctgcagatgatggctaggggcggccgtggctatcggtatcctacaggacgtggcatgcctgatcctgcaatgcatggtgttgggggtggtgtgatgccatctccatatgagatgggaggcatgcccatgagagatgctgctgcgtcacagcctgtacctattggagcattggctactgcactggccaacgcagcccctgatcagcaaagaatggtttgggacctcatgcctttctctgtttcttatgcatagcgtgaacgtgttcgtcttgaagcgtgacccatttgttcattgattgttgcagatgcttggtgagaacttgtatcctcttgttgatcagctggagcatgagcaggctgcgaaggtgactggcatgctgctggagatggaccagactgaggtgctgcacctgctcgagtctccagaggctctcaaggccaaggttgctgaagccatggaggtccttcgcacggcccagcagatccagacgaacgcgacgcctgaacagcagcttgcttctctgtcgctgaatgacggcgtcgtttcctcctaagcataacgacgacagcaatttttgatccatatctcagttatcttatctatctagaattgaaaacgacttggttacttggtttattggagttttagttttattggtagttgaactaggcatttaggcaatgcgcgtggattgggtattttgtttgctcggatcttttattttgctttataagttatcatatggattgctactttatgtcttctggtagcatcttttattttgtgggtgatgcatgatttagcagtcttgatctgcaccaaatgaagcaaactttggctactttgttggcttcaccggtgtgagcatactgcgtcttcagtcttcacttgctttagaaatttccattcggtccttgcggtgaatatatacgatcatcacaattacacattttcttggctggtactccctccgtcctaaaatataataacaaccctcctaaaatataataacttttagccctagaatttgtcccaaaatataataacttatctaccaatattttctccttaactaattacaattctctatcattcatcttttttcatctatcttaactgctcatccaactataacccttcaccatttatcggagggagtagataattataaacagtttatgcgtccgtccccgtagagaattactaagagcaaaatgaccttcaccacttatcggagggagtagataattataaacagtttatgcgtctgttcccgtagagaattactaagagcaaaatgaggaattcctttagaacacaacataagatggcggatggccgcaggtctcttattctacagcggcagtctcaaacttggcctagcccaacgacgagcagagttatagctgctctctcggcctaggagtgtttgggtctaagactctaaggcaggtagagagatggccctagtgaggtactctctccgtcccaaaaaagccaacctagtacaacgaatctggacaaagggctatccatattcgttgtactatgtgggagtaatgggctagctgtccagattcgttgtactaggttggcttttttttagcacggagagagtaataggcttggttagtattctatttatttataatccacatatgtcggctttcttttccaaagaaaaaaccatattcatatctgaatcagccactcaactacttatccaaatcctccaaaattttaatatccaatctgttttcatctctacttataagcagtataggccggttaatcataatggtcacacatgactactatgatgatatgttcttagatagatgatgcaatcttagatggtagggaaaatttgtaaaattcaccataaacgtcaccttgagcttgagatttcctctataatatgatttgttttaaacaccttctaattcaccttggtttgatattcctccccaattagcaattaccattattcacatgttatttcttcacgatcgtgaaatggagtttgctgtcatgagaatgggtaatgagaatgagtgagtaacgataactaagaggaatcctaaaccaaaataaattaggagggggtatttgcgggggatattaaactcagggtgacatttaggtttacttttgcatttgagggcccacaaatatattaagaagaagtaaaatggtatagggctaatctaatttgctctttggtttgaaatcctaggcttgccctaagcatattggcccatatttgtgtcttgacaaaaatagacacgatcatgaccgtggtctgaatcgtgcggcatatctgatgggtattgaggtcttacaagtaacaaatacttgtttgtgcaaccctagactcaccattatcttgtcccccttccccccgccgccgccgccgccgccatttgacctccatctctggattgtcatcacaatttttttcttttgtctagcttcttgcctctacttgcgaggttgatcacgatcaataggtccttgatttcttcaccatatcgttgttgctgccatcgtcaccgttgccaccaccaccacatcaaggagatttggtgtatagttttttttttaacaaataagtcgccagctagacatagctagataagtcgctgtcatcttgctctctttgtttgtggaaggtgggtgaaggagaaggaagcagatcagatggtgcggccggggagaggacaacggcggatcgatgctgccattgaccacctatcagagtatggctttccgaggcccataatccgtcagaccatcaatgaactcctcgcggacacggtaatctgtcttgatgtttttctaggttatcttcgtgtccttagaaggttgctaattgaacttaatttcagctgtatgggaggaatgggtgggtcttcctagaggaaggctcctaccgcattgtggtcgacagactactcgaaaaacaggcaaatcagcaagagcagcaggaggaagatgcaaaggttttcttttctttcttcctgcgctcatagtttctcagttccatttttatctgcttcggtgtttgttgtgcggagcaagtgtttaagttgcagtagtgagtgacgcaactagtaatgtagcaagaaatttttcattaggtagtctcacttcaaaagttcatatagtaacatcacataccaaaattttcggacaccgtaaatcccatatatagatatgagtacaaatttatatatataaaaaagatacaaatgtagcaaagtgcaaaacaaatagaagtcacaaatcaaactttgttatgctctccgtttagggttattttgtcaatattgttgagcatgttttgcaatacaagtgaacatctcaagaagatagactctttatatctgttcatcaatgaaaatgaatcatgaacgtaatataaattgcacgaagatagtatagtaacattttactaccattaattcgggtttgcacatatggacttatattttcagcagtattaaaatgttaaaatgccagatgcatacgctaatttggagtgattagagtgatcaaataattggccaggaaaaaaaaaccagaaagctattaaaccccagtaccccacctagttttccatggacagacaagtcaattgtacttcctccatttcatattataagactttatatcattgcccatattcatatatatgttaatgactttagacatatatatgtatctagattcattaacatctatatgaatacgaacaatggtagaaagtcttataatataaaacggagggagtagctcacaatcgtgaagcgagagagacgcgaccggcttccaccgacaaatcagctagatgagccctataggaagccaggaaaaggggcgaacggtggccgaggggttggcggccaacgacaaacgccgtgatggcctgatggttgacgggcgggaagggaga

SEQ ID NO: 62654 - DNA, 12759 bp, Oryza sativa
  unsure (1)..(12759): unsure at all n locations
ggaagcaaatgcacttgactcttggctaaacaaccctctaacacactagatggatgaacataaagctcaagtgagtgtgagagaggtgcaaggagtgtatgcaattgaattgggtgccaagagagcccccttgctgctggtgggggagtatttatactcccacccaccaaaactagccgttgggggcgaaatcccccaactctgtgctctgccggtctgaccggaggtatgtggccggtcagaccgtgctactcaactagccgttgtagccctgtcagagggccccattggcctggccagtcagaccggcatggggtggccggtcagaccggcctcggctcggtcagaccgccatcggctcggtctgaccgaatacggctccgtcggctctgtatcggccatcctgagcagcaccatctcggcctccagggggccggtctgaccgcgcaaatgccaccggtcagaccgtccttatgctccggtcagaccgccttcttgcggccggtcagaccggccagggcacgccggtcagaccgccactatgtggccggtctgaccgcccctggtcaggccgaacccagtgaatttgcaagtgaatgtgtgcgtgatgaaaaaaagagcacaaatgaaaatgcaatgacctaatgtggcaattataatcatctctttgctaggtcattacccttcttaatagtacggcgaaactaaaaataaactagcaaatttgatcgccctacacctcgatcaattctaaattaaagcgctagttttaccgtcttctttccctttgctttgcgtcgtcaattttaatccatcgataatcatccatgcacacatatgacgtggacctaacttaaaatgtatagctcaaagacaacggttagtccacaattagcacttatcattaattaccaaaattaacaccgggggcctagatgcttcagtgaggcaacacgatgaatgtgtacaccacggtgccacagcaaagggaaccacgaggctcaggcgctcagccctagttaggaatgacaacagctctgcacctgtcggtttcatcaccccattcccaccctgaggtaaagggaatcatccgttcccatctccatccccacgttgttgtaggttttcccgtccgtccctgcagcgggtatgggtcacccatgggtctttacacccgacaacactatcaaaatataaagtgcaagccaggaacaatccccaacccaggtgacaattagcctattattaatgtattgagtatgcaattagcagtgaaatcatcattaaatcggctgattgaacacaaaattgacccaaaagaataggcacaagcaaacagagtgtaacttcagtgcttgaaaacaagtcaaccttccgtgctgttagcctgctacagagcagcaagatgtttccttcaaagagaaagccaagaagttaacgtagataactaactctggtagcatacaaatcaactactagctgactgctggttggtgatgagtccgcagtagtggagctagaccttgggcgtgcggcctggttgccttgtctcctagagacatgcggcgtggcttggatcccttcacacgaaggcgtcggccatcggtatcgactgtcgatctggtgtcggcctggaggtcctgtaggctggaggcgacgaggcagcgcatggatctggatggagggaagcggcggaggagaggactctatcaacaatgtgagtgtgggatctagggttttgggggcgtatatggtggtgttctttttttctaaagatgaagatgacgtttttttacgcaaaacgatgtgatattaatgtatgattgattgagttttaatcattacaaacttgaaaagtagattaatatgatattttggagcaacttttatatagaaaatttttacacgaaacacaccatttagcagtttgaaaagcgtgccatgaaaatcttaatcttcatctagctcttgttggagaaagaacgggacctatatctgaagtagatcataacagttgggtttttaatatctatatgggtgtgagttaggccaatctagattgtaggccttgacgcgtccaagtaaagtgtcactattttggcaaactagaccattgggcctaggactgctgcatggccatattgtactaggtaacctactacagacaagtcaactacaagccaacatcgaggcatgcatatgcatgctcctaatgatatagtcatgtatcctcgcactagaaggatagaatgagatatggtggcacatgcctggttcatttgaatgatcaacgtgcaagtatccctcagcagggaaggggatccttttttttttgcggggaaggggggatccatttgatcatgcttggttcctcaacaatggaacaacaagccacacgatgggtgtcgtgatgccttctccaagcttggtagcttttgtaggactgccaagtttggggacgtctctagggtctgcattgatggtcttggcatgatgctcttcttctataagttcggcgatcactagcaatgtcaagagtctaatatatttcttgactattcaacaactgggagaactcactgaggcttgttcggtgctctgggttcccaactcctgtcccacgttctccgcgtgcacgtttttcaaactattaaacggtgtttttttttgcaaaaagtttctatacaaaagtttcttaaaaatcaaattaattcatttttgaaaaaaatagctaatacataattaatcacacgctaatggattgctccgtcttccgtgagaggatacaggttactaaccccaagttacgaacacaccctgagtctagatgaaaagctatggttgagaacgatgtcacgtaggttcaggatcctaagtggcacagcgtggctgtatgttctcaacatcacgcttgtatagctggtgtgccatggaaagaccttgatttcacctatcctgaatttattcgcaatagatcaatataggtctagaacttctagtctcggtccgaaagttctcgtcaaattactgaaagttctagttagcaagaatatagcccacgaaggggaaatcacaataagcatgatttgcacaaggtagatacaacaatatgctatgtaaattgataggtaaacattgcacaagctatcacaatgcaacctcacgaagagaatagtaacccaaacacaataacggtagagagagagaaccaattctttttaccaaagttcggatccaacgatcctgtctccatcgagaggctcctacaagctgagttgcattcaaccctaaaacccaccaattaaattggttcttactcagtttaccccttttacttatggaggtggagtagaacctccaaaaacttcccaggctgtccacaatcaccagatgcttgcgagtgacatctagttgactaggaggataacctcgaagagtaagaaatgcgctaaggaacaagctcggtgctgatcatgcccccatgataaatccctacttttaacttgcactcaatcccaaaaatctgtctaatccctgcccacttgatacactagaagctttagatccaagaataagagagatgggaaatgtctaggaggctatgataatccgagcaatatacagactgcttactaaaaagtataatgcgcatagctataagctaactacatctttaaaaattgcatagtaaatgactttaataaaaagcctttatgcaacgaataaaggaattttgtaaggtattgggttcacacagtgcgtatatcgccaagacaaatatgctaagttcctataagacacacaacaccaccacacttgaaaatatattgcatatgtggtgtaaaatctgagtaaaataacactcataaatggattcaccaaccgcctaaaaatgaccaatatatattcaacctaaaccatgatattggttgtatcaaaaaatgcacgcatgtgacgaaaagcaatgatataatataaaatcaattgcttcatgaaacccaaacaatgtctctaacttataaaaagttaacagagtagctatatatataaagatttagtgcttgccactgtttaaattgtactctgtaccaacccctaacaagttgtataacaactgctgtatcaacccctaacaagttgtgtaacagctgaataaaaggattttaaggtaataagtcacttgaactcgcacatattgccaaaaacaaatatgcttaagtccatagggacatgcgatagaccacacctagaatatgggttgcatacatattgggattagccccgaaatatgcccatcaatgcccttgctatatgacatgtatagcatacctattaataagctcttgagtgatagattttctgggtaatgtagatgaagtgcatctcaccagagcgcccaaagtagatgcgataatcaaatccggactggagcaagtactcaaccgatggccctcgtagggaataatgattggtccaatctttgagcgtaggaagtaggcacatggccatgaattcatgtcacatatatccaaaacaagtccaaattgaaggtatgatccttgtgcttgagctggtaaacccctaaaatccttgtgcttgtgattgaaggtatgaagtaggcttgtccttctgttgtagttgaaatagtccattggcggcagctgatgtagttgtcatggaggcgagatcaccaacgtgaagatgatatcgcccatcagaagtgacggagatgttggtggtggagacgaagttgcccatcaatgatgatgatgaaatccaccaaccgtggagacggagaaaccagtcagcgatggtatacgcaaccaacagtaatgacgactggtggcaacagagatggttagctgtgaagacgaagttgcccatcaacagcagcagaataggctaggtcaaagtggcatagcaggatgttgatgaagatgacaatgttagtgatctagtcagattttaacgttgatgaagtccagcttcctgaagtaaagaacctgatggatagtagttgaccgaagatgaagataatgccgatgacgaaggtgtcgatggtgacgtcaatgataataatccatcaaaatgtcgagaatatatccatgctcgagcagttttcttgacgttgatgtgtgcgtgacgaagattgatgcaacacctcttgattatgaagatgacattagaacttggtattgtagctattggagatgcttcacttggaggaaagtagatgttgatgctgctgtccaacttgccgaatctaagtagattggttgataactccaaactccataggcccaaacttgttaagctcaaagtcatatacgagttgtactccagagggcagagttgaatctaaccaggacatgtaaattaaatcttgaacttgatatttgtgaaactcggagtaaaccgtggaagtagctgagatccaatgttgccgatgagaatgtcagagttgttgaagtagaacgcttgctctagaatgaagatgaagataatgactcccaaagttgactcgttggctggttaattgattacttcatcttgacataacgtttgtcgagatttagacgtgtttgtgcagcccccgactctatacttagttgggaacaactgaacatagagtcaagaaactatagcttcttattgtcgagtaaccatcacttgagtaaagatatgcgttgaggatgttcgagtagaaatcttgaggattggagcaccacttgtagtagattagcacgacgtcatatttggtggcgcatgctgagtgaagtagcaaagctggtgaagtagaggcgatcggaattgctggtgatgaagatgatcggctgcaacagaagcaacaatatgtgaagatgaagttgtctaataatgatggcgaaggcgctcacccgtggaagtgagagcaccagtcggtggcggcgtaaacaagctggtggtgaaaacatggtcacccatcaatgacagcataataggccagcggtaaaggcaaaggcactagccggctgcggtgaagacaaagatgcccatcagcagtggcataatctcacaaccgtgggggcgaaggcaccagtcgacggtgatgaaggcaagctggcggtgaagacgaagacgaccatcagcggtggcataatcgcacagccgtggaggtgaaggcaaaggcaagccggtggtgaaggcgaatacacccattagcggcggcataataggccagccgtgaaggtgaggacatcagtcggcggcggcgaaggcgactgacggtggtgttctgactgatgcattcctgaagcataagagataagcttatagacatgaatccctactatgcatatctggatttggatcctatagtataaacatgtaggatgagtagtctttgatgttaatataatactcgaggaaaattcaagcattttgcaatatttataaatatgtatttctcctcgtatcaattttagtttccttgagtagttgacttcctatgtttaaacactatgcccaactagtcatagcccccaagcaccgggagtcggctcaaggcaattcccaaacatgcataggagtaacatgaattcgtcattcatggaacagagctttatagatcaaaatatgtgctaattgggtacttcaacaattatcaatagcagaaaataaatgattttatctctatgcttttgatttattcgagtaatactactaacgaaagatctgcgctcgtcgatggtgctggaactgtgttggcgcgaactaagtcgacaaacacaacgacctgggagatctgcttaactccagtgcatgaccaaaacttgatgagatgtgggtgtgctagtcagtttgatcctacaactgacaagatatataaattgaagatcaccaaagagctgatcagctgacaagccggtggactagttccagccgatgcccataccagctgatgtcgatagggttttgagctatcggctatatgtttgatgtagaatctgacacttgatgtaaataatgatataaagataatcggctgatgataatgtaatgtaacaataatataatccaatcggctactaatggtaaagtgttgattcgaaggttaaaacatgcatcagctggaggtccgatgtcattaaatccaaacgactagataaatagtaaaacctttgttgtgatcggctaaatcctacttgtatgtaatccttgtaagccgatgcaacgtccagattactcatcggctgaaaccccaatgaaacccttattggcaatcaaaaagcaggcaagagattatggttctaaacacgactagggcagttgcagcgcaaagtatgaaaagaaacaaaaatatctaggcaatcaagcctttgactgattttctgggtggtggcaggggcggatacaggcatggggcagctagggcttgagccccatgcctggcttcatgatccccattataattttgaaaaataccatgtaatttctaaaaatatttgaactctcattagttcagccctacgcgtgtagattttctggctccgccactgggtggtggataccttagttaatctaatctagcaagataatttagtcgatacctgcataaaccctaaaacgaatctcagccgatatgagcaaattaagatgctaaactagatttaactaagatatatgataactagcggttgtagaagatagattagaacgtctaaaacgacgccctaatctgccaatgcaaaccgctgagacaagtcatacctcttgtcagaagatctaagctgataccctaaatcgaagtaagaattcgtcgaaaaagtagaaatgtaaaaggtggcgatgcaccgaagttgtattgatcgagagatagtttacaataaccctgggtgtacatatttatacctataggtagatactagtccttcttggacaagaaagaatcttttctaaagataaaaggaaaacataaagtccttatcggacactaaacacactttcctaaagataaaaggacactaacaaactattcctaattaatagttaaactgccataccgcatcctccttgaactcggtcacttctggataagctttcttcagtagattaatttccttaaccgaatctactaagaatccgactattggcgacttgataattcctataagccgattcaaatactctgaagccgatactgactctaggccgatgatgactttggggcttaccaaatttcactgttaacacatgccccccaattttggagtatgagaactcatgcttcaaaattatcttctttctgattcctgatgactccaaaattgatcgtcttctctctatcacaatcaactttcatgagctgatactgtttgcatcaaatgagctaggctgttgaactcgtggcaaaagaatttgtccttggtaggtgttgatagcccttggaatgcaagatctgctagctaccccgatcacactcgttgacggaaaactctcgacgcgacccctacctggcgcgccaactatcgaatctgaaaatcggcaataataaaaggggtagtgcatgagacctaaaagtggatggatgcggagacaaggatttagaaagtttcatgctctctcgatgataagtaataccctactcctgtttggggattgtatccgtcgagtgtgtattattctgacgatctaatagtggttatgcccttgaggggctccctgcccaccttatataggtttggggagggtggggggaggttacatagccaaatatggcatcggtttacttaatctactgtacaatattactgaaccaggactttagaccgttcctttatatacaaggaaacataatacccaagtcatgatgtgttacatattccataaacataatctctcccatatatccagtcggttaacccagccgtgtgggtatatggcacccataatctccacataagagatcaagaatcagaaaatgctgaaacatttcacacaacgctaaaacatctgtgcccattattgtctcaattttgtgggtgattgtttgtgagagttgacggcaaagctgacaccattcccccctttttttttttttacctttttgaccgtcagcttcattgccaataatatcaagtgctacttctatagaattccagttcatattgttgtgcttttcttcctataacctggtgtaccttacatttttagttatcaaaattattggtgtatctaacatttttagttaaccggattgtttgtttatctaacatttttggttaataggattgttagtgtatccaacatttttagttaataggacatagatcagtgcacgttagccttcaaacctccttgatgtattctttccttttagacctctcatgttgtttctactctctaatctcatgatattgtaagttatttcctatcataacatgtttagttcagttggttgccaaacaagtcataattttccattgggcttcccttgtttaagcagcatgaaggaggaactactgcaatggagccgcttccagagaatggcgtgcaaacctcacaagctgaagtgccagctgctgcatctgagccagccaaagttgtagcagcagtggccgatgagatgcccgattctacaacttcagtgccactccctatcactgcagctagacatactgcctcaacaaggcgcccatgctatggatggcttattgagagtgaatccgaggatgatgaattggacaatggagtgtcagctgttgagcaatctaatcctccatctgctacgaatcataagatgagtaatggatggtcatatgttgagcaagcaaggccttcagttgctatgagacatgaaatggaaccatatactcatcatagagggatgctctcaaagaggaggcggccgagcggatgggatgtgcgcccatcctattaagatggtgttgtttcattctaatcataaaaacaataattttctttcaatatctttgtctgatctatctagattgcaaacaacttggttgcttcgtttatctgagttttagtattatttggtggttgaaagaggcatttaggtaatgtgtggattgggtattttgtttgcatggatttgttgttttgcttgttatgtggattgatgctttaaggtctcctggcactatcgttcactgtgatgtgagcatcatgtttatttggttcaggatttcttgaacatttaggcaacaacattatgatagataatgtgttaacacatcactcttctgaccggttgggaactatgcaatttttatctgtaggaaactagatatggaatttcttgtcggtaaggattagagaaannnnnnnnnnnnnnnnnnnnnnnnaaaaaggaaaatgagatcctattcaaattggtagttgttgttgcagtatgcctaattcatgtagtcttgtagacgagaaacctaatgtctataagaagttagaaggtaagttagattgaaactttataaaaatgttcgaatagtagacatgctaccatagccattcatccaagtgcaccatgcacttgacagtcaaacacatggtgcacatggacaactaggtgacacctaccagctaatacacaagatctaggtgagcagtagaaatacacagaattattggttggttgacatatacaagtaacgactcagcaactcagcaatttgcttcccactttgttaggactagcctattttgctccttgagttatggtcgcaaggttagccctaagcgtactggcccaatgggattaggcccatttaatgtggcattcgtacttgacaagaatataatattgtatctcaccatcatggtcattgttttaaattggtagctcatgtttctattgatgagcattatgattttgctattgtataaccctagatattttttcatccgccatcatctcctatatggctgatgccctccaccaccatcgccgccacattggcctcttaatcacgttacatttatctaccacattgtttactctggtatcaacacccgttttgccaaacttctccattctcccgttgataactaaacttgccaatcagcaccacttcctcttgcctcaccttctacatagatgtaagattgaggtaaaagcggttcatacactttcttgttatttttgacatatcatcactgtcattgtagccgcctccgccgcaagcctgtgacgtgctcttccttataaggtacaaagggagtagtaacacaagcacaataatgatagatagaaaaccaattttcttattgaagtttggatccaacgatcctatgtctccattgagaggctcctacaagataggttgcattcaaccctaaacagcaccaagcaatcacaaagactgggcttggttctcactcaatttacccctttttcttatggaggcggagttgaacctcaaaatacttcctgggctgtccaccagatgcttgcgagtgatatctacccaactaggaggataacatccaagagtaggaaatgtggtgatgaacaagctcggaaccaattgtgcctcaatgctaaaacgtttcacacaatactaaaacacatatgcccattcttttttcacaattttatgggtgattgtttgtgagtgggtggtgaagttgacaccattccctcccatttttccccctttttgaccgtcagcatcattgccaacaatgtcaagtgctacttctatagaattccagttcatattgttgaacttttcttcctaccacctggtgcacctatcatttttagttatcagaactattgtgtatttaacatttttagttaactggattgtttgtgtatctaacatttttttgctaacaggattgttggtgtatccaacacttttagttaataggattattttctttttttatatttttggatagcttgtagatgactaattgttgacaatgaacgattctttcgggccagcattcctcaacttagactgaagacaaattataagtaacaaaactcaagtatgatgcaaaaaatttcaaaactaatattgctatgcacataccaagaaatgacatacttcaaaaggattcaaatgaatttactgttccttctgaaaccagattgttctaaagtacctcaatgatgatccaagtatacttgataggtcatttcagaatctttgactccattagagttaggtccatttccatgaaatacttgattaggggataactcttctataattaatcaacctcaggtggtttagtaacaatttcctaaaaacttcatagaagctactaagcaaaaagcgcttatgtcaatagctgatgaaaacttcccttgggtatcaacatcctttttgcctaacttctccattctccctttgttggccaaacttgctactcaacgccacctcatattgcctcatcctttacatagatgtagggtagaggtaaaagtagttgatacactttctcgatttttgtgacatattgttgccacaatcgctgaccagcccatgtcatgtgctattccttttaagggacttgactaacatatacccaataatcatcaccgatttaaatcgtgcaacacatgttttgatggacgttaagatttttccaacaatataataataaatggttgtttggcaacccaaggtaattcttcttccaccatcgtcttctcacacaccaccaccactattgcagttgccaccacctttgcattccccaccgcccgacatcgatctccacattattagctttgtcatcgctgct

SEQ ID NO: 62655 - DNA, 3469 bp, Oryza sativa
gtaggtgagttggtaaaggagagcttgcgtgaaggataggtcttgggttcgtatcctagccaagacacaatatcaaaaaaaataaatagataaaatagataggatgatagattaatatttgaacttttagtttggtacataaaactaatgccacatatggagtggtggcaataatttttattacaacgacgtgaagtgttgcaatatgactttttgccacatccattccgtggcaacatctaaatttattaccacaaaataaaaatcgttgcaataacctattacgacgctatttattaccacggctagaaacgattttaaaattgtggcaacatgcatctattgccacaattttagtattgatgccacgatttttttcgtagcaacaaatgatttttctagtagtgttaatctaagcaaaacccgaatctaaacgacacaattacaaggcccgaaacccaaaatcaaattcggactaaataagatacgtggcttgttttgcagattcccagcagcttggtaggaattttgacgtgggaccaaaaccatctaaaattaactccataagctttccaaaaagtactcatgggcccctaaattccttctagatcagcggctaggtccgtttgaacttgatgctgtcaggaggcccgaatccgttttcaaaacatgtagaactttatctcgtcttctctggaccaaaagtgacgtggtgaggtaaagtggacttggagaaggtcttggtttggtccccaatcaacttctttaatcatccatgcattccttacgctcggtctcttttctttcgcccaagcaagtacctctgcaaacgaaaacacaccaaacttattgtgtagcaacgtttgttcaaatatataacaagtaaatctaatatagaatatatgcacctttggttgattaatacacataaggtagtcatggttatatccgagctagttgtgtcctcatcatcctccccttcttgattggaaaccgtcctcggtttcaccttgtcatggagcatattgaacttatctttatctatcataacatctggtgaggaacatttcttgatggtcatatggttggctcctgaaatctttgtagtcgcaaaaccacaacactccccttcttgcaaaccaacttgtaactcatttaaacaactagaggaactagatagagaatcacttatacgcatgtggtcctctagacaacacatctcatcatgaaaaggaggtatcatcaaattctcacaaatatatacttgatgtacattatattctcctttactatcataattgccaataacatgaaaaatcacatcagaagagcatggcaattcaaatctagcaaatagtttcttctctaaaaagttgagtggacaaagatcatcaaattaaatataaccccaagtatttaaagaagataacaatttaagctcttcattctcgctagcaatgtgaataacatgtttaaactcaacacatggtggctctactatagaactaacatgttcattcactagttgtggcatggatataagtgaagcatcacacaactcttctttatcacaagaaacatcaagcaaattgttttgtgacaaaggtatttcaacaattgtttccactataggttgctctaatgtagcacaagtagtggatatagttagcacatcataactatgcatagagttagcacatcataactatgcatagctttagtagttgtagcaccattattattacctttcttctcatcttcagaaattataggcgcttagtaattaaacattcctcaagcatgcacggatctatggacaggtctttttgctcttcgtctttcttctcttcctcctcatcatcttcaacgtcggaggtgcttatgtagccatcttccatagcaatgtatgcacgttgactagggaaaaccttctgcacatggccaaatccatggcagcggtgacactgaatcctgggcgtgcgtcccgtcaaagcggcagatgaggcactcttggtggatacctgcgaagaaccttcacctgaatctgtaggtcgtggggaaggtggttttggcgctatagaaactccggacgcaactggtcacttgctcgttggtggggtcgcccagaaagagatgggcttgggtagccccgaagatggctttgtccacggcatgtacgtgcgctgatcacgcccctgcaattccttctctgcaagcatagcaaactgaaacaactggttgacagtgttaaattccttattttctaccatgtcctgaatctcgcgcctcaatcccatgtaaaagctacaaatggaatcctcagttccctccactatgctacatcgcatcaatcccttttgtagctctccatagtaatcctgtacagatttatccccttgttctaaacgattcagtttcttgcttaaatctctataataacatggaggaacaaatctatcacgaatagctaccttaagttctttccatgtagtaggtaaagctctcccaacatctaacctagaccaccaaatataagcaaactctttgaacccactactggcttgtcgaactctatgttgctcaggcacaaggtgggcactaaacttttgctctactgtcatctgccgatcaaagtatttcttagcatcataataacccaaaaagacggtattttaaacttaaccttagaataaggatcatcgggcacacaattattgttgccttattggtatcgctgattttaagcaccactcatacctgtcattgcaaacacaaaaacaataacaaacagtgaaggttatccctaataatctactacgcggtgtagtgatgcctctcaacaactcagccaaatggagcaccttaccaagctcttacaagtgtcttactagcaatgctaaggacggtacaaccggtggttggttcatgacaccttaaaggacgtgatgtggcgattgcatcaatctagccggtgtgagctcaacaaaaggggaagaagcactagcaatccctagtcgcaactcccaactcgaccgataaaaacttctgaaaagtataaaaacggaaactcaacgatgagacaattcaatttttcaaggtcctggtaacaaccgacgagatgcaaaactggacccaaagctgaagtacaactcacacagacttgagtgatgaaccctacacctaagtgatgaacatatacaatactcaaaactaaaaattaaatctaagactaaaccaacactcgacccgatgatgcaatctagaattcaacaaagcaaaatctaatagaacaatgcaacggctcaaattgtctaggtaaagaataaatatttttttgtggcaattttctagttatgcaaatataaattacctaacgggcaaccgcgctatgataccaactgatgaagggatgttaggtcccgatcttacgataggggtcgttctcccacccctatcgtattgataaaca

SEQ ID NO: 62656 - DNA, 2782 bp, Oryza sativa
  unsure (1)..(2782): unsure at all n locations
gaaaccccaacttatcgtgtgtattcattcctatttgcaattcagattgcttttatcttgttcttgcttgtttcttcgatttgcttgtaggaatagggttgatcagcaccggcaagatcaatacccacggagaggtgtatcgatcgcaaaggcgcaacacaacaacgtcttgtacggttgtagtcgggtcgtcaacgtttctcccaaatcgtagttatcatcaactcaccgaaaaatcgggccaacaacagccttgagtgtcgagtggaactcagggttaatcacctattcctgcaagcaaatcgaagaaacaagcaagaacaagataaaagcaatctgaattgcaaataggaatgaatacacacgataagttggggtttcgaatacaagcagacggacgatctagccgacacgcgcgctacaaggaagtagcaatggctaaactttcatctaaacaaaacccaagcaaccctgaaggggtacctagctacttataggggtgggagaatgaccaaganggtcatagggtcgtgctccaccagattgtggtgcaccccacatgggccccacttgggccagggtcccaaacgaagttacaaggccaaaggcccatgacaggtgacgcagaaccttgtttcttaatatgcgaatggcttggatggaatttggcgatgaggctagatccgttggaaagaggactccgagagctttccatcaagtactcacgggccgaaaacggaggtcgtacgcagattcgggggccgtttgaattcagcagtgtagcaggtggccgaatttgattccagcacttggaggacttgatcttgatatcatcttgttcttccatgatgtgagcaatggttgtatctgtagtagccatggtcactgatggaaatcaggtggcacatgctttattgggggttaacgtcttactaatattttacatataaatagttgcttgtgcaaccctaaataattcttcatccatcatcattttctgtccatccaccgccactaccattgttgccaccacctccgccatccccatcatccaacctcaatctcacacattattagctttatcatcgccagccttttttctaccttctccatttctatttgagtttttctgaccatatcttgccatttttgcatcggcttggcttactatccttctacatgtatctatggcgagggtgatcacaattcacacacatcctcagttttcgccattgccgccgctgcaacatgagagatttggtcaatataattttagcaagtagatcactatccttttgtggttttgtttatttgggaaggtaggtatggtgtcacgccccaattttcgttcgggattgaaatcatcgacaaggcctcgatatcacacatgggtaccattcgtcctcgctagaagatgaatatcagaggacgaggatgaagaactagatgaagaacacatggtggcggttgtggtttcttgtttggttgtagagtagatgaatggaaggtctttgtacatggtgttggttgtgcgattctttcaactatgaacataggagatgctagcggcatgatgcttgatgcatagtagtactactgttctatctcgagagtgatacggcaacggtctctgtatagacaacactaaaactaggactaggagtagtatattagtatgcccttcgtccaaaaaaaatcacaggataaatcacataacaagtttagccttggattgcttaccaaaatttttggcaagagtggctaggctagtgtttggttgctaccatagagtattcctccatggactttgccaaaatcaatcaaaccaaaaaactggcaacgccaaaattttgggtacaaacccaataagttacaaaatttttggcagcaccaatattttggtatggttgagtttggcaaagagccaaacacaccgtatgatttaatatgacgtcttccctctttgaattgggttctaacacaatttgatttgtagctctaaactgaaaagtgtgtgtttggtgttttctgttcctatctatccagtcaactaagaacgtgcatattttgtaatgcagcaattggatggagcaatggaggacacaccaatcaaaaatagcatgccaatcgtagagatgcatgaggtacctgctgaggctgaacccacagttgaggacatgcaggaggcgctcttccagaagcagaaggaagaacagctccagctgcagctgtttcaacaggaagaggaactggaagaccaacagcctcaggtggttcgctctctttcatttaatttgatgcattcatttcttgatgatcatccaattctcatgcttcatcttaccatcaactggttgctgggggtctaatcgtgttatctctttttttagtaaaagctctctatatgttgaaatgatcacaactatcataataaacattttggttttttagttctaatatattgtgcatatttgtagttctagtaactatttttggtatcagagagtttcttttataatacattgtgatgtgtagttagtaaatacatatgtaatattgcataatcatcaaaattttatatttccattgcaccaaaattgacccctcttaaggtctgaaagttttcaaaacgaaaatcaaatgatccgaatcgaattgcctcaacttgataatctgcttccacccacccaactctgtgtgtgtcacacacacacacacaaaaacaaacaaacaatgtgcccacacaacaccgaacggcaacacgtgtcaacacatacaaaca

SEQ ID NO: 62657 - DNA, 3354 bp, Oryza sativa
tctttcctcgtctgtccatgggctagtacagatcagggatattgtcaacctgcatgttttatagtgaataacatagtagagagggattcgcgactaaagaattcacatttaaagggtgtagggctcttccatattaggtgaattgattgtgtctgaaaatgtacagtaattcctgaaaatgatttgtattttttagactacttcgtagctgactttgtttcgtctcagtacatgtctatttctctgttctgaacatggatggctgtcgagtctacattttccagacctatcattggtttttcaggttcacccactgctgccgaagccatcaaaattatcaatgtgacctaccttatttgataatttgaagaactaaacattacgtgcatgtttgatattttggtatggttgagtttggcaaagaaacaaacacaccctacgattcgatatgacgtccttctggtttgaattgtgtgctgaaacaatttgatttgcagctctaaactgaaaatcgcgtgttcagtgttttcggttcctatctgtccagtcaactaggcagatgcatattgtgtaattattaattggaattcgtgtgtaatgcagcaattggatggagcaatgcatgaggtgttggaatcagccaaggatcaaacttcacacgagattacttggtgacgaacaccagcgacgacgcacgccttttcctttctgcattgcaacacacacacgtatatggaatggacacaagaacagaagcctttcagcaacaaatgccttttcctttctctgttgttcactcacttaatcaactaatgattacatggctttataagcctcacaagcgcacatacttcagagcaaccaatttgcctgagtctcacgccacgtacgcgtgatttacttgacccagactctaccgcatgcacttctcctctaatccatgcaacacatgtatgtacttatctactaagtaactaactagcccattcattaaggcatgcaacatatgcatgttctaactagctagccacttgacccatttatgcattggccagcctcaacctgaacacatcaagtttccagccatatgcaaacacgtctaacacatgacgtgatcactctagacaaaactaattaacaataaaagaatcatatgcaacaagattagtactaacatgaggcaccattggaaagtaacctgtcaatcgtagaggtgtacgaggtacctgctgaggctgaacccttagttgaggaggtggatcccatgctggtcgacgatccagctacagtaatctgtggcacaagacgaccatgctacgggtggcttatagagtatgtgagcgaatccgacactgaagaggagatgcatgttccaagtcaagaaagcttgtcctgtaagcggaagctgggataatttttcatggatgtggtctgcaatctgttgatgaaaaggtacatacaaagttccaagtgtgttcattattttgcttctctttttacctggtacctgtgtgtgctgttgtggttttggtattccagctgctaatcatcatctcttattgtttttaacagagtgcctggaaaagaagaatcaatgtggtgtgcaaggcataagatatggcccttgcttttaaggcagtctgaagttgcttctgactttgctcaaaacagtagttgtacaagtattgacacaaagcagccaatttgggttattggacagaatgatctgtactgttgactgtagacattgaaaacatagtatactcctacatattttaataggagtaaagtctatcaccggtccctaaacttatatcgttgtgtgatcccggtccctaaacttgtaaattgaccgttcaggtcctcaaacttgttcgactgtgtcatcccagtctctaaacttgcagatcacttgtttaggtctttcaaccttgttcagctgtgtcaccctcgtccctaaacttggatttgaatatcatctgggtcaaataggacggtctaaatactttatatttaaaaataattcataactttttcatgtgaactctaatgaagataaactttatatcaaacttatagcccgcgacgcgatctacaactttgtagttgaattttttttattttaagtcattttttgtcccaaaatgtaatttaaaattaaaattacaaaatctataaatatgcaacaatattttgggaccctaaacagttttaattcaaaaacttttcaactacaaagttgtaggtcgcgtcgagggctacaattttgatataaagtttgtcttcattagagttaacatgaaaaagttatgaattattttttgatataaagtttttagaccatcctgtttagagaccggggtgacacaactgaacaagttgtaggacctaaacgagtgatctgcatgtttagagaccgggatgatacagtcgaacaagtttgaggacctgaacggtcgatttgtgagtttagggaccgggatgacacaacggtataagtttagggaccggtgatggactttactcttttaatagataacaacgttaattttttttatacatttaaccattcgtcttattcaaaaattttatacaaatgtataagatataaatcatgcttagaatactctcacaacaaaataaattatagttacgtaaatgtttcgaataagacgaatggtccaacgtgtgataaaaagttaacggcgttatctattaaaaaagggaaaaagggaggtagtattagagtacataagctctatgcaacaggaaatgtcaaatgtgggatttagttgatctgtgctttgcatagatagaacctgaaaacgtacattcggtttgaattaggacccttttccatgtctttcgtttgtatgcttcaaaagtaaagatataacgtcaaagctaatgaaaatttcaaaaaaaaaaaaggaatttccgttgccgggactcaaacccgggtctctcgggtgagagccgagtatctaaccagctagactacaacggattatggcctcgctgggttttctgctctattgtatagtgatgtggaaaagtctttactgccaacgaattaatttttaacaaagtcaccatggatacgaatactacgtctaccacaaatataaaattagtattgtgagtctaaaattaaaacttaaaccctggtgagttgattccacgtaaaaaatctaaccggttaagctacatttaatttgtgatatataaaacttgttacattggtctgatcgaaatatgtgcctgccggaacataatggacctattgtttgattaatgatgtgaagttaatataatactacctccgttttttaatagatgacgccgttgactttt

SEQ ID NO: 62658 - DNA, 14552 bp, Oryza sativa
gtcatctattaaaaaacggagggagtagctgatctattgtattagttggttttttattaactgtaaaatgatatagatattattggagccagcagctgactacactattaatccaatccttctaagagctttctcttaggacaaaattatttttaatagtccttttgcatttttttccataaacacccaaacaattactagttttccaaggaagatcgaatggaacattactcgatcagttttcatctttacttgtttcttcttcttttttgagataagtttttcatctttacttaccatgtcgttatgtatgttatcgtaggcatcaacgatgtgtcgcacagaaaaaagaaggagaggcccagggcacgcctgcctgggcatcatgccaagagacgccaagcccggtcttggccgggctggcaacgacggtgttttgagcgtcgctttccctcatgagggcattgacgtgatgccccattgcctctaaggggtttgccgggtgaaaacccagtctcgattctcctttcagacctcgacgtgtttccgtcacggtagcggtgtttccgtcgctcctctccctaaggacatcatctaggagactcctagacgaaacccctagatctcagtcctcttgtgtcgacgccctagattatacaagttggccatgtcggaggtcctagagggagaacggttccatcttctctctcaccctctctccctcaatcatggatacagtacagttcagtgttagttggtagggttgggttttgggcctcctggttgcagtccctttgttggcctagcggcggctggttcggtgctagccttctactaatactgtgtcggtgatatgggcctgggggtacctggactaaggggaaggaagcctttcccttcgctacgcgcccgggtggcccggacccctcccccctccccgggggatcgggcactcggccaatgagtagccaaaaagcggctgcgcattcctggggggctcggggtacctcgtcgtacccctcgggcccaagggactgagtcacccccgaggcccttgctcggctaccacgtggcggccacatggaggcttgagcgggcgagggcaccgcctgccagccgcatttatgggcggcgctccaagcgccctcccccctcacatttaatgcgacgtggcaggttgcacaccgcccgccgatagaagtgcgccaggcgaccgtttcttgaccggtctgcgacccggcgatggatggatgggatagtcagcagcgcacccacgccccaccttgtgtcaggcggcgtgggggctggtatgccccgtcccatcatctgtagagaataggcgtgcaggtcggtactccccacgcgcgtgagcccacgaagtcatcaagaagttattgtggaatgacgggggatgtcccctatgtcagacggaggatttcggtgggggccacctgaaagcagccgcatgaatcgcttccgatccaaggcacggaatgcctttcgctaccagcatgtgggcccctctctcaggaggagagcgtaggagcagtgcatgtggtatccccttcatcaataaaaggaggaccttgccctacgagcaaggggatgactcttgatagatcggattctaggaaaaggccagcgaagccctagctagttctcccaggatccgagttctctgtaaccattcggaaatcaatgcacacacaggagtagggtattacgctccatagcggcccgaacctggataatccctttctctcgtttccttcaccatccaccttgaaaacttgatttccactgacatactccctcacacaagaacgcgctcttcagctcttgcacccggtcccccggccgaactcacaaaggggggggggggtctcatggcctcctgctagagaggatcaccccttgacagactgtgtgttggagctatcggtgagcggatggtggattttttctttgtttttctggttacgacacttcaggattgtaatcttgtaattttttcctggtggattttttctttgttttcctggatacgacacttcaggattgtaatcttgtaattttttcctgctctatctacatgaacttcgcactgtctggttgtgggtcgttaaaaaaaagttgtggtcggctagtggcatggcgtgacggtgagcgaggtcgatgtgtatcctgggtcatgtatttcaatagatttggggatcaaactatttcagttcctggttatgtgctgtcgaattataaccttgcttttgtcacgtcccaaaatgaccttaaaatatatcctgtaaattatgcctagaataattaaaatccgtgtgaaagcctccaacaattaaaatgtgcaaagtaaaagtcaaataaggcttaggggatttttttatatttcctaaaggcctaaaatgtgtaaataaattttagtggaattttcagagcacaaataataattattaagaaataaaccaagttgaaaaaggttttataaaaagaaaaaccctaaaaaccctccctccctctcttgggccggctcggcccactctcctccccctctctcctcttcccccgcggcccactcggcccctccccgcgcgcgcgccgctgacgggcgggcccgcccgccaccctcgctgatgggtggggcccacccgtcatctccttcctcctgccgctcccgccgcctcgcccgcgcctagcgccgccgcaaccgccgaatccgccgcaccccgccgtccccgcgtgcaataaagtgaggggaaatactccccgtgatcccctctccctttccccccatttttccctctctctctcgcattcaaacggccggatttgctcccgcaaatctcgccggcgccattgatggcggccggacctcccggccggtttccttcctctcccggccgccctctcccccttccaatcctatttaaaccctccccgcgcctccctcgcccgtttccgccccttgccgcaccgtctcctcgccggaatcgagctcgcgccgtcgccctctctctcctccgtcgctgacgaccttcggccggctctctccgctcgccgggaccgtttcccgccccggcgtcgcctcctccggcttcgccgcaccgtcgccgtccccgtccaccccctcgtcgagctcgccgaccgccgaagcgccgccgtccccgtcgacccgagccgcgccgccgccttcctcctctccggccgcctttttcgtcgtcgccgtcgacctagggtgagccgtggaccgccacctcgtttccccctttcccttccctctctcggccgccgctccgccgtgcctatggccgccgccgacgaccataggggcgcgggcgcgccgcctcccgccggccgcgccgacgtggccgccttcgggcgcgccgagcggctgccgcgtggggcccggccgtcagccgcccgcgccctcgggtgcggctgacgcttggggcccacggcgccggccggtgtgagcctgggtgcacccggtccaccgtggaccgtgaggctgccgcgtgggccccactcccgtggactcggtccgcgcgccctctcccctcggctgacgcaataaaccatttttaaattaaaatttaaatgaagaaattcgtaaatattcatttaaagagcatataaacttcaaatggccataacttggccatttgaactcggaattggaccgttcaagtctctaattttcccttaagaagtcaagaacccatttttgtgctttgttcctgcttgttatatggagtttattagagtaaaagcctttttcctttctgctagtcgtgtagacgctgcagcttcggaagatccgctctacgtggaggttgaagccgacgtgtgggaaagcgagcaaggcaagtcacatcatccttgaacatattgaatcccagtttataaaattattttgatttaaattattgcattatcgctttatttaaattcccgcgttatcattgttttatttagccatgcctatttgcctttgttatgaccttattattattgctattgttattattaccttgttcaccctagaataaacaaaaccccagctagtgggtactctatttatggtaccactagtatgaatttaagtagatgcttcgctgcttaattaggcaacattaggtggttttacaactctagactttgggaatattcatatcacctggacactatggaatggttggattattgtggaattggactcacacctccccctctattcaaaatcctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacatctctagggcaaatgaaggctacacgagctgcggcccggtagtcgagatgtcatggcacagggctggtgtcctgctgctaggggctcagtcctgcctacctgtcccggaggttctggccgtaggtggggttgggtcggtactcttgtctatggctaggatgggttggaaactatgtcatgtcttccgtccgtatgccgtggtggtatgtggcacgtggttacacgtgaggaagacatatcttgtgggtaaagatgtacacctctgatcagagtataacctattcgaatagccgcgccctcggttatgggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcatgtgggttcatggccttgattaataatcttgtatagctctaggatcgtgtttaccaaatcgctttgggcaactaagtgacttttaaatactgtttactgcaaaacttaacccctatattataactcccttgtactcccttgcatttattctgcacttgtgggtgtgtcttgttgagtacggtggttgtactcagtcttgctcaatttttcccaaacccagaagaggagttcctggaagatgaaggctttggtgtctagctcgtgcctgccgtcatgcgcctgtggtcatcgccctagtcttctgctgtttttcgtttgtctcttgtgtgctgggccttcgccgcccatgtaataaattatctagttacgcttccgcttgttaaactctgtattgtatcaacttttggtgtaacttgcctcctgggacaaggaataatacacgcacgtaaggaacgcccgttgggttatttccggtcgtgacagctttttatgtacttagaaattaaattgttaattcatgagttatcgtgtatttttgagagttaatattttgtatgtcgtgtttaaatgtggattactaagagcctgtttggttggtgccctcacctccgtgcctgagaaatttgtaagcctgagtggcattcaagtttgtaatgtaggctacctggtcaggcagcttgagcctgtgcttgtttggttgtcacttgtgcctgagaaaaaaaattcaattagatgtttgattattatgccgctaagtcaagtattaatatccgacacaaatttttgcatttaattgcatctgacctacaaccaaattcatctagtgcaacagatccctacacaaatcaatcataaaacaaagaaaggaaaaaataatctaaaaacaagggggaacaaacaagggaaaaaggaaaaaaaagaaagcaaagattgcacccagattgtaaagtcgatctgcttactcaaccacgggcggaagaaatccttgcctgacgacacgatgcctccgcacgacggcggcactgctttgcgtagacaccaggatcaacaaggaaatcatcaagaagagaaaaaagagagaagaacaggagcaaagagatccccagatccatgtcgcatccatcagaatagaattgcaaaatccatgcatccatcatagaagagcatctgcatgtgaagcatgacgcagcactccggaggggtcttcgtgtggctgcgatggcttcgtgcgacggcaacggcggcggcctcggcagcttcgtgtgaagttatcacggcggggatgaggggattatggtgctaatgtgtagcgcgctgctgcgtctgaagcctaggcgaccgattttggtcgtctggctcaggctaattccgcgcctgagttacatcaggccaggcgaggtggaaggagccttagggtagcaaccaaacactcacaaattagtcttaggcatgtctccagccaggcaacttgttgtcagggcagcaaccaaacaagctctaaactactcaagcaaagcaaaagtggcaacatgatgcaatacaaggattacatgtgcaaattatatatatatatatatatatatatatatatatatatagatacaatccctagggtgttagatcacattgtcatcaaagagctcctcgacgtatcatggagaaggaagtatgcatacgtttgtttgcttactaaaaacaaagggcctaaggatcgccaaccagcgccaatgatggttgtgtgtgtttacgtggatagatcaaaaaccacttttgtgctaggggaagaactcgattatccgtgcacttacggataaaaacaaaaagcgtaaggatcttttacatcaaccgataggttgcatggataaaaacataaagcgtaaggatcctttacaccagccgataaggtgctagcttagagatgtgtgtgtgttggaggaccacaacctcctctaggataagggaaggaacaaataggagatgaatgatttaagactaccaccccgttcatactcataaaatagaaaaaaattgccccaaaaagaaaagaaaaggcccttgttcattatgaaattatttatgacagaaaaaatggtgtgaggcaggcggacccaaaagtgaggcatggcgctgcatttgatagcagaggcatgagttccggaggtgggggttctctttcggttaccctatttgggttgtcgagttttggagtttggaggggtgaagaggaaactttccgttttaggcgccgtcttcctccgctctttgcaatgccccggcagcgtcccaagaagggggagcgccggatcgacgccgccatcgaccacttcacccccatgggctacgccaccgccgacgtccgtgccgtcgtcaaggaactcctccaggtcgtcagctcaatccctcctccctcctgatctctccgtcaccacaggcccggggtttctttcctcttttctttttttgttcgattgttcttgggaccaagaaccgcggaaatggtgatcaaaattccacatttgctgtgttcttggaggtgtccagatgcaacaaattaaagctcgcgcctttccttgcttctaggccctgttgatcgatcgacaagctagcttagcattcttggtgatttctgttcgtgtgtcgtggtgtgagcaggtgtacggggggaacgacgggtggccgttcctggaggaagactcgtaccgcgtcgtgcaggaggcgctcttcgagaagcaggagcaggaggatcaccaacagcagcctcaccctcatccacaggtgctgctgctgctttacttccttctactattcatctctctcttgatgatcatcctattcattcatgtcctctatttccacttctggctgtcaactatttttatatttgctactacttacgactaccaaagaatttcttcttttttaatacattacaatgtccgcgtactcatcaatacatatatgcaacaatccacattcatcaaaaaactttatttttctgctctaccaatagtaacattatatccagcaagttcatcttcaattcttaacattatccaactattcctgttctaaaaaaccggtatatcctgttgcaatttctgaaaaaaaaaaggcaaggggaatccaacctaattagtgctttgcacccaaatttccaataatatataggtggttttacaccttgttctaaatcggttttgtttagtagttttgatggtaacagtaatactatgacatgggcacaatgtatctgtttgattcaagggttgattggatccatgccattataaatatgtcgattcagaaaaatgccacgaccactatgatcctacagccactacaatttatctatttgtagttgtgctaccgaaattctacaaaattggaactgtacaatcgctgtcacgttttccatccatctcttcctttttttttccgttttctttccttctttctcccatcgtcttcccgcaccgatgagtggcgggaccggtaagcgacagggtgtgaggcgggaccgcagcagggcatgaggcggcaagggcggatatagtcataggtgatgcagcagtcccactccttgcacgctcgagcatggtggcgacgaactcggtatgcagcttcacgtcgaagagggagccgaagtagatgagcgcaagtagatcctcaacagaggaattagcgccggaggaggaaggaaggcgcgacggtggatggggaaggggcggggtgggaggagagctcctcggcgagtgcggcggcgagcggggtgcgcatccactcgtcaatgagcatgacgacaacgggcttggatcagagcacctcctcatgctccttgttcagcttcctcccgttggtgagcgattcctccatttggaggatctttttgtgcttcttccacagtgcgtggagccgttttgagacaacactaaggattggcccgtcgatggcctcagccgccgcagccaccacggcaggggccgaggaggagctggtggaagaggtagccatgggtagggttttgggatttgagcttggagatggaacgacgagggtagggaagaagggcaatcggctgaggccatggggtccacgcggagctccatcgccggtggtgtcgcctcgcctcaactccatccagatctggtgagagggatagattctctcctaccctttccccttccctttttgccaccgccaccaccgaaccgccgaggtcccgccgtcgctcgtaggtcccaccgccactcgcggctcgtcagtgcaggaagaagacgggagaacgaaggaagaaaatggaaaataagaagagatggatgtaaaacgtgaaggcagtggcaccgttccaaatttgtaaaatttcagtggcacggctacgactagacgaattgtagtggtatttttctgaatcaacatatttgtagtggcatggatccaattaacccttgattcaatcattattacagtgaccaagttttagtagatgatttgaggtctcctagttattgaacatcatgaatttcacttcgaattctgggcctcgatgagcttgatctgtatttttttaaaaaaaaaattgcttcatagctgcacctgctgctgccatttttttgttctcagaacatgcccctttctctgttgcaacttgcaaacatagatcgttcaggctcttcattttccagacccacccttagtttttcagtcacccactgctgccaaagacatctagttctcagtgtgaagtgccttatttgataatttgagaactaatcattacgatttgatatgacgttcttccagttcgaattaggtgctgatacaactcgatttgtagctctagactgaaaattgcttgttccacggtttctgaaaattacaatcaatgcgtagtgtgcaattattaaaaggtattggcgtgtaatgcagcaattggaggaggcaccattggaagacaagagcatgtcaatcatagaggtgcacaatgtgatgcctgctgagactgaacaacaagtcgaggacgcggaccccatgcttgttgacctgcctgcagttgaagcaactctgccccttcctgaagccaaagtaacatatggcacaaggaggccctgttatgggtggatcgaagagtacgaaagtgaatccgataacgaggaacagcctgccagattgatttgtaagaggaagcgtccgagtagatgggatgttaaacccatcaactggtgagttctcgacatctgatatcagctgagcatacagtattgtaattcaagaggttatgaactaatttggacaagctccttagttgcctaatataacctcttattgcagttacaacttacaatttacaagcatgtcagtaaggtttataagcatctttagccacgtctgcagctagcatctgatcttaagtcctaactaggctgttaagatcctggattgtgattagatagttgtgacgagtgatgcatgataatttcggacaggcaaaatcacgtagcaatgtgctgctgaaataagtttgtggtgatcaatctgtgacactttagaagcactgcacacttttaatgctggctagtactattcagtaagacctgaactgtaggtgttccatttttttttcctatgggttggtattgtaaggtactgcctccgtttcaggttataagactttctagcattgcccacatttatatagatgttaatgaatctaggcacacatatgtgactagattcattaacatatatacgaatgtgggcaatgctagaaagttttataatatgaaacggaggaagtagttgtttcaaaatttcatagatagatgtgatgtgcagtttgtgtggaagaaatactactgatctttcactgtgcgtgttccattgttttgtcttcccacttgtgtggggtttaattttataaattagagctgagaactaacctttgccaatccctttgtaagcttgtatggattgtgaacgaaccaaatgaaacttcagtcgcattcctattgtaaccactaatcgcctcttgttgtttctaacagattatctgaaaaggaggtgacaaggcaatgtggctgcacaggtggtatgcttaacccttgtttttgaggcattctggatgtgctgatttttcataagttttgtattgtacacagcagtaacagtggaagtattgatgcaatgtagagactttaggttatgcatggttgcatgccaattaatttgcatgatggtgtatgcagacagagacatgatggttgatgtatgcagaatctattcaagtactaatgtggatttttcattgatgccttcataaatcatactacctccgtttcaaaatataaggaattttggacggatgagacatttcctaaaactataaatctggacataaatcataatgttatttggttttcctggctggatgttgtttgcataacctagccgtggcacatgctttgagctgtgccttagacagaatgatctgttgaccgtaaagcataataccaatacagcaggagaagaatgattgttttcttaagcttgagatagttatgccatagaacaattttctgttttcttaaagctttataatttttctgtgcatttggtttgatggagtgtgaatgtgtgatagcacgaaagccctatttcacccaaacgcccgagcaaagatagcacgcgggttcggaacttgaatgacaaacatggatgctgaaattgccctctgaactctgaaccagaaaaacaaaaacttggacaattctttgaaatcagacaaggatttgagtcttgtgaaggcaacagtgattctttatgttgggccaaaacgcataaattccgttgccgggactcgaacccgggtctctcgggtgagagccgagtatcctaaccagctagactacaacggattatgacacaataattttgtgttagaataattcctcagaaattggcatcttttcacgttattaccgacaaatgactgtatcagtcgactgcaacaagaaaatagctaagattggcagaaacagactagcttagttttacatcgttagctcaatcgaccccgtgtctgtgttttattatactattgtcaaaaacatatgaacattgttagctcactattcgcagcgaaaatgcggatcaaacataaagtagcggtttctagtatgttttaataaatagttatgcacacttgaacaggttggcacatgttaccaatgaaaaacacaaaacgttgctgtagatgctgaaattctaagcaacagtcgctgttggctgtttgccatcgaagttcagagtctttagatagacgtcgacacaaactgctctctatttagtcaaagcatcaacagcacagaatacacaattggccaaaatataggggcacaagttgctgtagtacatcaatagactcctaacacaaaccaaaccaatgtaatcttagtgttgtatcaacaaaaaagaaaaaaggacaagaaaataagcactgcccaagcacccaaaatctcaactttcatcatcattcttgcaactatacccatgcaagatcacaaaagcacaccagaaaggactttacaagacgccatccttcgacagatttttccttatatgcagaaggacaacaagtatgacatctcaccagttgatgagtgctgaaacatgaagcattgtgctcagtcagtgctttcgcgaagaacggccactccctccctcgctcactcgctaaattttcatctctaacattcacactcactatataggcacaagaaatttacatccaaagacagtcaccctatgaacatatactttttttttttcgatcccgtggctaagtaaaatcgaagcacgaaggagatctcctggagcttttagctgcattgttacccttgtggaggtagttagctgtgtaaaccgtgtcagtccatgtggagacgaagaaaaaaaagaaaagaaaagcctttttcacatcactctttgaggtctatgaggaagaagctggggtctgggtcgagtccttgtcatcgtttcgtcactgtgtcgaatcatctcggacaatttccagggcttttgccacttccacttgaactgcagtagccactggtggtggcttcttttccatctccaaagttttcctgattgccctgctattgaaaccttcttgccaacaggcaactgtgccataggaaccatctgcattgtacgtcaccaattttaaatacgagagagggagatagaacaaagagtatttcaggggggtagagataccttaagatgttgtttgttgaatgcaggaacccctttgctggggctatttacaattccagcagagtacttcagctgcttctgtgcaggcaccgcaactggtgacaatggtgtgttggagtcatcagcagagtgcttcactgaaccatttccgtttccctgtaagatgcataaaatttccattaagaactatcacgatatttgttgaatatcttgtactcttgtgactatcagttagggattcaagtgactcaatgtttttttgtcagttccatctactataccctatgatatgttttcttcttttcgccctttcaagcagggcgtacgagagaatttgaacatgggtaatggagatgttaaataccctcctcaccaccagatatttgttttagatgtttaggtaatcctttcatcattcaacatttttttctactgaggggtaattgctgtgagctcatagaaaccatactggagatgtagtggcagttacagctgcctgctctctttgcttaagctgcttttccgtttcccttctacgtgattcgctgtgtcgaaggatggtcacaagctctgtcatttgctccttcatttccttgatctccatctctttctcccttacttggcatctgatatttcaacagtgaaggttagttccatacttttgtacaaatgatcatttttacagagtatcataaaaacggctttgcattgttcttccattcacattgttgtcatgctttcaggaagaaataaagttgccctttgagttcagaattttttttttgttattcctattttcaaatcagtaccacactcttttattcgaatcagtgccatattcttagcaaaataacacttacagattttcaactatttagaaagaaaaagtgagatttttagctctttagtaaaaataatttgtttccaggttctgcaaattgagaagtcctacaaggatggatgctaccatactattaaataatgaagccaaaagaataaataccaaccttgcatctgcagcaacgttaaatatatactgcagtaaactctttgcctctgccattgaacgcaactgattccaccgaccacgcccagagaatgcacgctctctttcttcagcttctgagagttgagaagccatagcaacgagagtatttgaagatattgtcaccatgctttcaagtgatgctatcctagcttgtcttgcatttggtgacaaagtatttgccctgagaaacaaaatgcagcaatacaagcataaatatttggatgtgctgattgcacattttgagaaaatatgagaaatataaaatacggacccaaatataacaaccagattacagacaaggacatat

SEQ ID NO: 62659 - DNA, 2147 bp, Oryza sativa
  unsure (1)..(2147): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagaaaatatttcgctgatcagcatgcttacctaacctagttgagtgtgaagagaatacagcagtaaacgcccaatataagttacctgacagcactaatgtatgacggccacctgcagctacttccactatcttcactcctgtattaaatgtcacaacacaaggtggtgctgaaagattttcatcactagatgattcactttcagccccgtgtttcgatgaagataacctccgtcgctttgtgctatcctcagaacttcggctttcagcaggaccagatgctgccttggtgcttgtcctagacacctttgacctggggctcactgtaatcgagtttcctatattacctctgtaaacaacggatgtagaaaagcttatattttttatgtagaactgtaaagaaataagtagtaagcaccaccaccttggtcagtggcaaccccactttgccttttatcacaatccatagccccagttgcagaatggtctgcaatgacccttccagttggaacgcattctttccaaccccatgtgtagacatcacctttacctgcttgagtggaattcaatcagtgtaatgcaaagttatgtgcagttttcactaaaatgcatggatcaatacacaacctgttattgcaacacaatgtgcccatccagcgtcagcccttacaattgcaatatcactaggaagaggaaatgcctccggagtttcctgagaggaacaagatgtttacttcagtaacagtttataagtttatcaagaacacgttggaaacaaacaattagcccaaaggtacagagatacctcatgcttcccagcagtcacgtaactttgtcccatatcatcggtagagccccaagtgaagagttttccttgctctgcatcaggcagatacaagctgtgtcagtgtcaagctcagttgacgtacggagtaaaacgctaatagcacacaatccgaccaagcaaaaatgcaatcttctaatggttgacagaactacctaaaaacatagaataatccttggagtaatggagttgttatggaaaattagtctaactaaaagcaattccacaaaaatacactagctgacaatatcacataacacattcccacaacacaatacggggcaaaacagtgttctgatattctctgtcgctcgaccaaaaaaaaaagtcgaaatcactagctgcttgcactatcaatcacaacttagtcagacagcatattccaccctgatcaaccaccaatcaggaaaatagtcatacagcacattccaccctcatcaaccacctatccagaaaaaaaaatcggcaataactgaacacccggcactaagctgctcaccaatcaattcacagacaatcactcagattcttaagaccttttttatccaattttatactcgcgttttcatggaacccaccatatacacaaaaatccgcacaactaactactaaaccactgcacgctaatcatccccgataataaaaacctcacacaaaccacaccagcaccctactagatctcccacgaccctcttggtgccacagatcgaacgaactcgaacgcaacgataacatcaagcaatggaagcacaggaacgagagagaaaggcaacatcaccggagacggccatcgcgaagccgcacccgccgccggccacatccctccacgcatcaccggccgccgcggccgcgtccggcatcctcacgggcaccggccccagcagcggcgaccgctgctgcgacaccccgggcaggtacccccacatcagcaccacccgctccttcctcctccccgcgcctcccccatcctcctccatctcctccccctcccctcc

SEQ ID NO: 62660 - DNA, 16062 bp, Oryza sativa
cgtggctggctgtgacagtagcacccgccaattttttaagtgtgggcatgttcggattaggacggtgatttggcttaaagaaatgttggacttgtatggttttgtaccctactaataagttgttagtgtcaaactctagtcaagttttggcgctactaatattttgataggtggaattgtaaatgtgtgtctttgaatttatgctaattgagagataaattttaaattatggtaaaaaatattctagtattatgccaaattaagtataagtattaccaaacatttgtcttcaaaccaaatcatcacatttactatttatactaaaaaaattggtatgataacactttggtatcaaaccaaaacgccccgttaagtatcagtgtatcacagtggctgcagctcacgtaaggggaaaaaaaagtataatcgctgatttaactctatgcctcttgactctcggtctctcgggtataagctacggagtacgagaggagctgatcctgctattacgagtcgctaaagtagcactgttgttacgagtacgtaataaatgtcgtattaggtatgcgaattttagtccgaaatgcacataaatgtactgttgaaatgctaccctagcacgaaccatgttgaatgcattgctgaagcgtttcgaaatgagcattttaaatgcgggaaaattttcgattctaaaatgttacggtacggtgtggagtaagagcaggtacaatagcatactataaactaactataaacatatattgagcagataaaaaaggaaagagaaaagcagcaggctacagatttgtaactagctgcagcacagacttcaatacacaacgtgtatatgacagatgagactaggtattagtagtgttatatgtttatagctaactattatatgaattggctattaaattaactatagataatttgaagctactattttttttgaacagtcagggcgttgccgatgttttatataaaaaaagaagtgttccattttaagaagagaatgggaccaaaccatacaatgcacaattaattaggaaaactgggcaaaaaccatggctatcgagacattccaccagctaaactaagctaccaaagaaacgagagcaggacaaccaggctcaacactcaacaaaaaaagttcacatgaacatgcaacaagctgaaaagaaaacaagtttcccaaacattggcaaatacgcaacgttatcgtcatcatatcaaaacttgggcgactccgacttcgtcaagaacactagggtcaggacagcaacctagcccatgccaaagcacaaatcaactaggctcatgtcatcgttgccacacgtcgagccccaccgacgtcgcagctccaacttcgcgaccaccagtctcgttaaagcaaggcctggccaaatcgacaaaccttgtagcctaaaagcttgtaaccccatactagaacgaaacacaagagacggaattcaactcgggccatcgttgctaagctcgtcgaccgcctcgacgcaacaactccaacttcccgaaggccctccttaggtgtcaaagcagggccaaactagagattggctcggatttccagagaaaccgtaacacgatagaacatgaaggtataaaaagacgcctcgagggaggaaacaacgctcgcgggcgtcgccgtctacgccttggagcttgttgactataagatacaatcgtagagaccaacctcttcgataaatagagcctgcgagggtaattatatgcccttgaagagtattatttaatatgtcctaaaatataaaagattttagttagatatgatatattataatattacgaatctaaactactggaatatatctaattcaatcaaaatcattatgttttaagacaggtgatgtactaatattcaacagtaataaaacttcaattagacgcctctttctagataattctcggaggaacgaaaatctaattcaaagctacgagaattcaagaacaagctagaattaatcgatatgatcacttggcgtttgatccatgcgccatcttgtcacaagatcgctttggcatttccaaccaaagcatcaacgggccaagataggccaacttccgaaaggaagtagcccatggacgtttcatttgaaaaggaaataaggaatcacatcagcacagagtattactcttgatactcttgaatcgttgtagaacgttctgggctccccgagacgtgcgatccatgttctaatcggatcgaacggcctagaaacgccgtggttgagagcgctctggcagtttcgagctgacgactcgatgaccttcactgctaaaggatgctttccttgctgcaatattaaaggaggacgcttcgatcgactcatcatcgtattcttgtagtactgaagactgaagtcgcagcaggttttggtttggtcttttttgtgaacagccatgtcgtcgtcgatggcgtcggcggcgccggagccgccgttccggccgagggagaagctggtggagaagcagaggtacttccagagcgtgcacaagccgacgtacctgaaggggcgctacgacgccatcgcctccgtcgccatcccgctcgccctcgccgcctccagcgtgttcctcgtcgtaagtcatgaatcaaagcctgaaactcgagacgcgtttcttcccaaacctgaaacttcgggtgtgtttagttcacgctaaaattggaagtttggttgaaattgaaacgatgtgatgaaaaagttgaaagtttatttttttttgaaggactcgcacaagacggtgcgaagttctattgatagagcaggaaaaaaattacaagattacaaccctggaggatcgtaaccaggaaaaaagaaaaaatgtaccaccacccacacaccgacagcgccaacacacaagcccgggagaaggctagcaccggaccggccgccgctaatcgtgaccgaccgtcgctagaccaacaattcaccaccactcaacctctgccgccatgtgggatcactgcaccagcgccccaccgccggccagcctttatgcgccaaaaaccgccacatccaccggcagctcttccctcgcgcaaaggtcgcctcctccaccgccggccgcgcctctcgcgccaagccggcctcctccaccggacgcgcccctcgcgccaatccggcttccctccatcggccgcgcctctcgcgccaaaccggcctccatctccgccgctcgcgcctctcgcgccgagccggcctctgctgccatcggctgcgtctctatgtgccaagccggcctccgacccctcctctaaacactgtgcgccgccggatgcggctgtctgccatgcccccgctagccgtccgagattgccatgcctccccataccgtggtgacggtcgccaccaccacagccactgctgcccttccatccccgccgccatctcaccatcctctcgtcctttctcgccgtcgtcgagctccaatggcacacggcgcagaccacccaccgtggtagcccgcgccgccgtcgccgcgagctcgtcaccaccatcgccgcgacaaacagactcctccggcgttggttccgccgccggcgcggccaggttcgccacaccgacgccatcccctcgccacctccgccgccaccacagcagccgctgctacccttccatccccgccgccattttgtcatcctcccgcaccttgtctctatcgtcgagcttcgacgacacacggcgcagacggcccaccgtggtagcccacgccgccgtcactgcgaactcgtcgccaccaccgtcgcgaccgccagacctccgggcgctggatccgccgtcggcgcggccaggttcacctcaccgacgccatccccttgccgccctcgccgtcgtcgccatccccgccaccagacgccgccgccggtcgccgtcccgccagatccaggcgcagatctggcggtttcctccgccgccgccgccaacgcctcgacgccgctgccaccaccaccagacaccgccgccgcaccgctcaaccccgccgccggctgctccaccgccagatccggccggcggcacggatctggccagttccgccgccctcgagcaggtccccctcccatgcccgagcgcgaggacaaagccccgccgccgccgtccttgtggccgcgcagctttgccggcagccgctcgagcggtggcgaggcagaggaggaggaaaggggagacgagcgccggtgaggtcgtcgcctcccggtcgcccgtggggggaggggcgacacgagaggaaacaggtcaatattttgttctcgtgttttagttggaagtttatttgtgtatgaaagttttgatgtgatgaaaaagttgaaagtttgaaggcattgacgtgcattgagatttcactccaggcattgacgtgctgttggttctgcgttttcgtgtatgcttgcgtgcaggggcgcgggatttacaacatgtctcatggcatcggccggaaggagtgatgaggctaactgattagctatgtgtaactggaggagctgatcttgtgttacagtgacagactgacagtgtgtcagctacatgtaacctctcttgtgtgtaattataggagtattagtgctacttatgtaaacgtgttggactccaataggagtgaatactgttgtccacttcaattgagcttgagtgagtgattgaagcatggaaaaaaagaagcttgatttaacgaatacgatcatgatcatgcaccaatcacgcatgtccggtaagctttcattactcattagtgtttccaacagagaaacacgtgagatggttctgtcggaaatgcattcgaggcggaaggaacagatcgccgaaccaaccgtccttcgttggttgcgtaagttcagtttaatcgagatgcgatgacgaattatctaatcgctgatcgcctcaatccacgtcgcaaattgctttaattttcttgttctgaccatccaccaatcacacgagacatgatggtctcactaagtaaattctttgcgacgatgatcgcaggagtaaattaggagggaagaagtgaaaaaaaatagaggaggaagagaataagccaataataatggcggatcacggcaccggccggcggagatccacgacgacgacgctcacgttgtcggcgctccgccgggcgatcgcgagcttcgcgagaagcaatgccgcgtcggcgcacgccttgtcggactcggccttgtcgacccccttcaccacggcgtcgccgccgccgccgcctgacgcgccggcgggcggcgggagcacggctttggggcgggagcatcccggcggcgacggcgggccgttgctccggaagcacgcccggacgacctcgcacgccatctcgttggtcaccacgtcccacagcccgtcgctcgccaggatcaggcactcatcgtcgtcggcgcgctccgtcaccgtcacctccggctccgacgtcacgtacggcttaggtagccgtcccctgcatgcgcgcgccgccggccaccgcgtcaagcaccacggccaaattgctccaaacttaaaatgatctaagcgcgaacgcagcgcgtaccgatggctcgagacatggcgaggacgccgagcaccctggcgccgtcccagtagatgacgcggccgcccgccgccttgatgcgctccagctcgtccggccggtccggctggagcaaacagagaggtgaatacgcagaagcaagcgaggaagacgacgttggattagtgctttgctgcttaccttgtggtcgacggagagggggacggggacgccggcgcggcagaggacggcacgggagtcgccggagttggcgacgacgacgcggttaggaccgacgaccgcgacaacggcggtcgagcccacgtggtcgcaccgtgctggcgtctgcagctcgcagcggcaggccggctcaccgccggtgcggctcttggcccagatcgtcgcctcatcgtccatccgcgcgaaccctttctccatgacgtccttccacgccggtgccgccgccgccgcctccttgccggagaccgccttcttgtacgcgtcgacgacgagctcatgcatccggtcctggcacatcctcgcgacctgacgccacaaattaaagaacgggctccgcttagcaacacagctcgacgtgcatttgctggatttggtcataggctcatgtgtgcaatctgtttcttgcgtgcgcgcatgcatacatgggagcaaccatggccgtcaaagacgccgaagaagtggtgcttgccggaagaggtggagccccgcaggaagtccggcctgatggacacggcgtcctccatctcgcgccgccggccgaacacggaggtgacgccgtacctcggccaccacctggacccgaactccgcgccggccgacggacggcacgggcctgcggtcgccgcgcctgcgcccgcacgcgcgcccgccaccctctgccgcttgccgcagcgcgccacaccggcgtcagcatcctcctgcggcggctcgagagagccggccgcaaagcggaagccctccaccctacggcgccgcctggcgatcgccgtggcgccggccgccgcagccggcatcgacttggccgcctcctcgcggcagatctcggcggccatggggcgtcgtgccggccgcgcgcacgagcacgagcgcctccccccttctcctcccgcgtacgtcacgccaccgccgctagcccacgcacgatagatatttcgtcgcaacaccgcgcgtcgccgtcgtcgtcgccgtcgccgtcgccctcgggggggcgctaaaacgagacgagggcgaggtggcgaatcgcgacggagcagagagcgcgagcgcgaggtggcagcagacagccgtgtcgagctcccattccttcgcttaatttcttcgcgggaacacgagcgtccgtcgcggcggtgcggccacgtggaaggggcgaggggggacccgctggcggttgggatgagtggggcccacctgtcggccgagcggcgggatcggtggggacacgtggcgtcgccgcgtgggcggggacagcgagccgacaggggaatttaaaaggttgggcctcgcacctaccaaccacgtggtccgtccgacgcggcgactcacaaatatcgtgtggctttgtaatcacaccgttgatctcgtggctaacctcactgtcatgtggggacgaaattacgtgggggacccatggcacagttgcacgttggaggatgcagcacgtggcatgtggcctgcgggccgaatcttgttcactgagccaggatggatgaaatgaataagttcatcggaggtccctcaccttaacagcgagttttttaatcccttaaccacaaaagcagaaatatttacccctaaactcacacaaaccgtgcactcaaagtcttatgatagtatatatgggtggtttcactgacgtggcaccctagttagcaaaagaaatataaaaagtacgtgggccccacatgtaagtgagagagtgatgtgggccccacatctctcttcattttctttcttctttctctttctctctcattgcttctcttctcgccggcagcggtggcggcggcactcttccccactgcgtgcggcgggggcgacctcccccaccgctagcagcagcggcgacgctcttcccctccgcatgcggcatcggcgccctcgcccaccacgagctgcagcggcggtcgctcccttccccaccgcgtgcggcagcggcggcgacagcttctcgtggaggagggggaaggggaggccgacgagccccctctccccgttgctgctcgtgcagatggcacagctactctgtggccgcgggacgccgcggcgatctgcccctcgagcatgccgcgattggtgtcaagccgcgacagcctccgcggcacgtcgctgaggaggttctcaagctcctccacacgtaggagcgctgcccgcgtctggttgttgtcgtcgctgccgtccatcgtgccgtctgccggtgcccaaagcaggagcagctactcctccgccacaccgccgtccaccgtgaaccacaacggcgaccgccgccgcacgcacgagaccgagacaaccggctccatggtggcgagtggtagagtggaaacagcgacgcgcgccactcctctcctccctcccaccgtgcgctcctcctctccgccgccgagctcgccgtcgcaccgactgcctcctctcctcctcttgcaccgaccacctctctctccctctcccgctgccgccactccaccgccggccgcctctctctcccctctgctgccgcgcccactcgagacaatcatgagagaagaggagagaaaaagaaaaaaaagaaatgtggggcccacaccattttctctacttacatgtgggccccacatatttattttattttttttctgactaggatgccacatcagcgaaaccaggcttctatactacctcgggacctttttttggacagttttacaaagttttttctggtattgcggttaggggatatcaaacaaactcggtgtaaagttgagggatggccggtgaacttattcctggatgaaatgccaagttaaatgggcttatgggcttccaatttatctgtgttacttcctccgtcccatattatatgttgttccatttatctcaaaataaatttatttttcgagtaatcattgcattggtgaaagtagagaataaaattattgggagtacataaagtgatgaaattgggatttgaaatattaaagacatgcctgtttggtatagctacaacttctaaatttagctccaagagttgggtctagagtggagttgtggaactgcctaaatccagctccacaactctaatttattttgtgagagagctccacccagctccactcccagttttggtggagctgaaactgtttagctgagctccagctccagaagaggtggagctagagctagagctgtgccaaacagactagtcttcttacttttatatttgtgtttgatagatgaattttggatggaggtactactaatctcttctactgatccatggattgagattctctgacataacttccttctaacttagtggctgacatgtgggcccaataaatagtggtgggtccatatgtcaggcacggtgaatagtaacatcagatgatcctcttccgtgatccatacgaccatgtgtttttcttttcgttgagtctaaccaacaccaaccgagacaagttgagcatataaataagcagaaagtaaagcgaagctagaagatttagcgaatatttttttttattcagaaagagcgatagaacttaacatccaacagaaaacttaatttcattttaagcaaaaattgccacacactgacacgcatgctctgtgcgatttaattcacagggaaataaacataaacacagcgccacagttgtttcgagtgatgtatggtaacgtcttcaatggctcacattgtaaacttggatataaactttttcttcggcctcagctgggaaaaaaaaaagaacggatcagatataatagaatgaaagaatcatatcaggctatcagctgccacacatcttcatatcaaaaataattataacatatgcccataaatgatgtataatctgacggtatataattaaactttatctttctctttttatatgttaattttgaaagccttaagttgcaactaaagccaagaacatgcatggacataaagaaaaggggaataaaacacttttgatgcatgaattgagatcgatgagaagaacttatatatggctctctatcacctcattgctgtggccgcacttctttttgcggcagttggtagccctgagaggaaggcgtgcatagcacctgcattaccaaacgcaaattcaggccatgttaatttgaaacttgaaagtgcaaacgaacgccagtacgccacacaattgtattaagtatgcatcaatattcgagtctgtatggtgaaatcatcggcagatcggtcaattgaagaaaggcaataatgggaaaccgtgcgtacttgcggcagatcatcttcttctcgttgtacttgagggctaggttctggagtctgggctcgatcatggggggtagccgcctctgccgccgccgcggaggcggagcaccaggtgaagcgtcgactccttctggatgttgtagtcggccagcgtgcagccgtcttccagctgcttccccgcgaagatgagccgctgctgatccggcgggatccctgcaaaaatttgagttccagacagtggattgagatgatgatcaactgaattaccgaaagaacacgataagaggatcgaacgatgctccaatgctctactactgctagagttatacttactccgtttcagattataagatgtgcttaaagtcaaactgcttcaattttaacaaagtttatagaaaaatatagtaatatttacattgctaaattagttttattaaattaataattaaatatattttcataataagtttattttaggtcgaaatattactattttttcaattttaaatagtttgattttaaccaaagtcaaaacatcttataatctgaaacggaggaagccctatgtaactatgtatatattgtggaaggccctacgcttccggcgcccgatgctttgggggaaaaatcgggcgctgacgtcatgctaacgtcagcgtccgatttacgtgcaaaaactactttaaactgatttttctcttaaattacttatccaaatcatgatctgattgcaccattaaattcgttgcaattaaatcttcaaaacaagaccacacatggatatattccgacgaaatttttttagcttattattgaattatttttaaatgttgcacgatgttccaccgggtatatcggaattgtttcactaagtaaatcgaaaatgtttcactcgtttaaatcgggtgttgtttcaccttatataaaaacaatgtttcagttcactgcaacatttgatctatacatagtgagacattataagtacactaggtgaaacatttttcggtagaacaaaaaataaaacgaattcccttaatagggggtttccaaaatatgtggggtttttttttgttgcaatggagtatttcagttcactgtaacattagatttatacatagtgaaacattgtgggtacactagataaaactttttttttggaataaaaaataaacagaattcccttaataggaggtttcaaaatatgtgatttttttgttgcaatagagtatatggtgaagatacgtggcaaatagtagggacacatggtggggtcctaatagaagcacatgaacacgttgtggagggggggaggggaggagcgcccgattttctccccctcccccgggcgaccgagcggcagcattttcgatatattgtatgttagtataccttccttgtcttggatcttggccttgacgttgtctatggtgtcgctgctctcgacctccagggtgatcacacgaagatctgcatcttgcctctcgcctcctcgatcgactggtggtggtgactggagattttcggtagtgttcgtggtcatctcaatttatatagcgcgtacgaaactcgaccgctacgaaacccgagagttccaaaaggaattagaaaagggaaagagaggaagaagtggcacgatcaacacgtaccataattagggtgtacgtgacccttctgagttgaactcgacagcggcccagatatccgtccaggccagcctgcaagctcagcccataatccaaacggcccgtgcatgagatcccaggccggaaatacacgggccgcgtagccatgcccaatgtggtttggaataagttcatctgaggtcccttaacttattaacgaatccgattttcgaccttcaaccgaaaaaccagatacaacgggtccctcaactatcaaaaccagtgcagatgaggtccctcggcggtttcgagggtgtttttggctgacgtggcgactacgtggcaaatttgacttggtcttcatctgatgtggcattgatgtggcaattcgatctggaagaataattaacttcgtgggacccacacgtcagtctcacacataaattaatataaaaatggtgggcccgcatgggccccacatgtcattctcagcatctccctctcttcaactagagcccctcttcctcctcctctctcccccttctcccatccccgaggcggcgggcggtgtccgggtgagggatggcagctcgcggcggccgggagagaagggaggcggcgcgaggcggccgggcgaggagaggcgacgcgccgtggcctggcgaggagggaggcggcgctcggcggcctggcgaggagaggcggcgcgcggcggccaggagagggaggcgacacgcggtggcccggcaaggagggaggcggtgctcggtggcccggcgaggagggaggcggcgctcggcggcctggcgaggagaggcagcgcacggctgccgggcgaggagggaggcggcgctcggcggcccggctaggagggaggcggcgctcggcggcccggcgaggagaggcagcgcacggctgccgggcgaggagggaggcggcgctcggcggcccggctaggagggaggcggcgctcggcggcccggcgaggagaggcggcgcacagcggccgggcgaggagaggcgacgcgcggcggtcgggcgaggagagaggcggcactcggcggccgggcgacaaagggtagctccgacccggatgtgacaatcgaggactcggcggaggtggccgggcgaggagggaggtggcgcgtgcggctaccgagcgaggaggggtggcgccgtccggctgggcattgcgggcggagcggccgacggagtgtagctggcgcgctcgccggcgacctcctcctctacctcttcctcctccggcaacctccgtcacccgcggcctgccgccgctccgcccgcccctccgcctcgccgccgctccccgcaaggacgagggagagcgaagaggaagagaaacgagagttgagagggacttgtggggcccacgtgggccccaccattcttttattgatttatgtgtgagactgacatgtgggtcccacgaagtttattatttttccggatcaaattgctacgtatgcgccacgtcaatgccacatcagatgaagaccaagtcaaatttgccacgtaggcgccacgttagccaaaaccaccgtcaaaaccgccgagggacctcatctacactggttttgatagttgagagacccgttgtatctggttttgcggttgaaggacgaaaatcggattcgttgacaagttaagggacctcagatgaacttattccatgtggtttttccatgatggaagcagtgatttttttttattaagttcactttagatccctcaacttgacagcgagttcgattttgtccttcaaccgcaataccagatacaacgggtgcctcaactattaaaacaagtacaatataggtcctaagacggtttggatggtggtttcagctgacgctaccactagcacgtggctcccactattgtttgattgacatatgggtccatatattttgttttaatttttaaattattaaattttgcttaatgtgccatgtcaataccacgtaagatgaagaccaaatcaaattagccacgtagacgccacgtcagctgaaaccgccatccaaaccgccttgggacttatattgcactgattttaatagttgagggacccgttatatctgatattgcggttgaagtacgaaaatcgaactcgctgtcaagctaagggacctaaagtgaacttttttttttcaaacgcaaaaaagctagcgcggaagttttccatcaattcagtatatgaagagaaaaagagtacatctgcaatagacggtcatttcgaaatactatatcataagtcgttttgactttggtcaaagttaaactactctaaatttacaacacaaacaccaaattagtttcattaaattagtaattaaatatatttttataatacatttgtcttgggttgaaatttttttatttcttttttctacaatagtttaactttaaccaaattcaaaacaacttataatctaaaaaaaagcttaaaaaggcaattacaaccacatatatcggttgttcggtcggtgtgaacatatataccgtcacgatcgatgtgtcatactgtcagtgtcacatgtgttcgttggatcccgatgacacggatcgctcgcttgaggtgcatggaagtatggcaccgtgcgtcaatgcacggggacgccgtcgcattcggagggagtaagacgacgtacgtgcagactccgtgcagagcggtgcagagaacgacggcgacgacagaatgtgagcctgcctcctcgtcgattcggccgcggctcgtgtcaatgcaaccgttctagtccccgtcagtcagacggcagtacggcacttcctcaggtaaaaaacattcggtgtgatctgggcctgtctgtgagggggaaaagtgtgtggatcaatggcaatggtaaatcgatagtacttccggttgtgatcaactgatcacgtacgaggctttttcttttgcttatgctaccaacaaataattctgttttccttgtgccagagagggaaacattacccatttctatttctgatatccgaaatgatcttacggtaatatgacttttaacaagctaacacggtctttcgaagatgtttatatggctagagtatacgtttgaatttatagtggtgaatgcgcatacatatggaagcgtctaatataatgttgtgtttctttgaaaaatattatttgcaaaattatttaatcggataaagtagagtatatatatgatataaagagaatctacactacgtgaggaccagaaatatcgcatgccccatgcatgccgaaagagcaacatctttgacacagtacgggtgcaattttgctatgaacagttgacattccacccaacgaaatcgaacaaccgggttcgctgttcatcccgcggaggcgtccgatgccgactcaactcgactgaagcggttgggggtggtcaacacgcttatctagctccagtcctccttccaaacaagcggaggagcaaccaatcatcaattcatttcgcagcaatccaactccctgattattaaaaccgtgtcaccctaatcatacataaaatcctagttccacacggagatttaattattcagaacccccaacgcctgaactgttgttctttaatcgagaaagataaactgttcttgctctcgcgttctgacaaacgaagtgatccctagactagaagtcttcagatttggctgtaaaatggactagcagggcacacgtcaataatagcagtagaaagccagaaacgcatatgatcggaactgaacgattctcatttgtccatatcgaccacgttacacatgagactttactccaaacacgcaaatacgtaaaacgaggtggttcatcagtacgcgattaattaagtattagctaatttttttaaaaaatagattaatatatatttttaaagcaactttcgtatatattttttttaaaaaaacaccgtttagaagtttggaaagcatgcgcacggaaaacgaaacgtggtgtggttgagagcacaagctgccgaatgcagcccaagtatatacggttatctctctactgtcataaatacttgatgtttagaataaaattaaattaaacttttaaaatttcaaacatcaattttatataatagaatacatatataaaatcaaaagtttacagtcaatgtgtataatttcttttattttaaaactaagcatttgaggagctattgatgatcggaattttgaaaggctaaccgaattatattctaaatattaaatatctaggaaacggggagtactacagaaacaagtctgaacaattgtgtgaaatgggtcacccttggggcttgtttggatccttcgggctattaaatatccctccggaatcttgctatttaggagtattaaacgtagattattgataaaaaccattccataacccctaggctattt

SEQ ID NO: 62661 - DNA, 17913 bp, Oryza sativa
ttaacgaggtatattaatctatgattagcgaatgattactgtagcatcactgtagcaaatcatggattaatatacctcgttagattcgtctcacaaaatagcctaggggttatggaatgggttttgtcagtaatttacgtttaatacacctaaataacaagatttcggagggctattaaatagccatctggatccaaactgatatgaacaaaatagacgctgcgaattatctaatcggcaatgacgaagtaaaggctcaatcatacattgacagattaatgcaaatgatcagccagcacccagcagtaacctactccctccatcctataactccatcctataatagtgattttaagattttacttgcaacatttgaccactcgtcttattcaaaaaaattttaaaattattaattattttatttatgacttactttattatctacagtattttaagcacaacttttcgtttttttatatttgtaaaaaaaatttaaataagacaagtggtcaaacgttccaagaaaaactgaaaatctagaacggagggagtacgatgattgactattcgtctagttgcattgacagggcagcaaaagccggaaggcattaattagtgaggtggggagagtggactgtagacttcgaattggaacccggaatactccagtattcatctcgcctgcttgtttgtacgtggtctaaactcataaatgttggctgacatttgccttttcgtttacacagcttaacgtaaacagggctcgacgatttaactatcaaaacagggctcgacgatttaacgatcgaaactttgtcagatcacggccctaaatggaccagccccatggaaaatggccggcggtcaacacaaatttctaaaaggcacagtttgcaatgtatatactgagctgaccattttcagcatttttatatagcaataggataattttatatccttaagagttatttggaggtaacatattttatagtgtaaaatttgatacctctgagtattaattatctcaaggtattaaaaattttaatgtaaaatttagataccttaatttactttttttaagtactataaaattcctcgtaaaaaattaccttatcttagaagaaacgagatagagtcattaattaaaaaaaattgagtgaaaaccataactaaaacaacaaccaactaagctaataactaccaacatggaagcaagacacaaccaagctgaaggaacaagaaaactccccacaccccggccacaacccaacatcatcaccatcacacgtctccgactacgttgggaagcataaaacaacgacagcaatttaaacccgtgccaaaacacaacttgattgggctcatgttagcaatgtataccagaaacatatttttttttgggcatacatcttgtttaaaacaacgagtatcattgcttttttttaaaaaaaggtgatagaatatgcatgaggatagtattcatgtgccaaaagctatatttgtagaagtaagatccaaattagaccccttatatgtcaacacaaacagcttgttagttgcattcatgcggatactagaaagaaagatcacgttcacatgtctcaaattgaaggaccttgttagttgcatttgcacatagatacaaattacttcatataaatctaccatccaatcctaggttagtactcgttattaagattagcaaccaaatatatatcttctcattattaagagcatacccaacaaatacctaaaatccatctctaaaatattgtctttggaaattcctggtttgattttaaggtgtaaattattatttttatctccaacagacatcttaaagttaactcccaataataaaaagtgaacccaccatagtaacagataaaaaacagaaatcattcattccatccccacacatctataagagaaaatttggagcaacttgttaaaacaaaatataatttagaattaggtttcacttcggggtgctgttagctatactttatcacccacctaagttaatcctggccttgaaggggatctgaaaaaaaatagtgtgaaattattcgcctcagttccccctctcttggggattaaacaaacaagaccttatatggaccgtgcttccaactaccccaaacttctaattttctatcatattacatcacatccaaaacttttctacacacacttccagctttttttccaagcttataattttccccaaacttctaattttttttaggaactaaacacagcaatggtctagccctgtgctttatccagtcaatttcccttagtgtatctaaaaaagattgtaaaatgtactactttcactggccaggtttatctaatccataatctaaaaggaaccgtactatcgcatctccaagactccatgtaaccactacacacgtcttacgtctacaccgtggaatccaacagcgagatcagtgcgaggcgaacgccgcaagaatctctcttgacgcctaccttcccagatcgaacgttcccaccctcatcttcctcctcccctcccctctcctctcctctcctcccgctactccggagaccagatgcgccgcgtcgccatggcctagtggagatcgttcgtggagatctcctcctacgtgcgcgcgtgaatcggtcgggcggcgatcgagccgaggtgaggtgtgtccatggtggttaccaagatgcggtgggcagacgacggcggcgaaggcgacgacgacgacgatctccggctgccgggcgccgggaggcgttcgccgtcgctcggcatcctggcgttcgaggcggcgtccacgatgacgaagctcctgtcgctgcaccggtcgctgtcggagaaggaggtggcgaggctgcggtcgaacaccatgcgggcggccggcgtggagtaccttagctcgaccgaccaggcgttcctgctccggctggcctgcgccgaggcggtggcggcgctggacgccgcggcggcggcggtcgcgcggctcggcgcgcggtgcgggctcgacttcgccgggccgtacgcgagcctcaaggccggcgcgcccgacgcgcggctggaccagttcgtggcgaaggggctcaaggtgaaggccaagaggatggagcggctcgtcgccgccacggcgaagctctgcgccgagatggaggcgctcgacaagctcgaggcggcggagcagaagctcgcccgacgtgggtggggccgcctcagcgtgccgatcccctcgccggccgccgccgccgtcgacgcggtgggctccgactcgctccggctgggtatcagggcgcagcgcgccagagtgcggcggctcaaggaggaatcgctctggagccagagctacgagaaggccgtcatcctcatggcccgcgccgcctgcgcggtgttcgtccgcgtctgcgtcgtcttcggcgcccacgtccccggcctgcccccgccgctccctcccgccgaagccgtccacagccgcctctccaagcttctgctccacccaatgtcggcggcggcgcagcccaggtcgttgtcagggcccatccaacgtcgagacgtgccgctgcgcatcgagatgagcagcaactcgtgcccgatcatacgctcgcattgccagcagccatggcagacgtcgccgccgggcgtcgactggaggaagctcctcgagccgccgccgggcacggtgggcggcgcggggctggacctgcagtacgcgaacgtgatcaccaccgcggagcggctgctgctggagacggaccacgccgaggggcggcagcgccacgaggaggcgcgcgccgagctgtacgcgatgctgccgtcgaagctgcgtgcggccgtgcgggcgaagctgcgtggatggtggagggagcgcggcgccgcggcggcggtggcggtggagctggacgcggggctcgcggaggggtggaggtcggcggcggggcgcatcctggcgtggctggcgccgatggcgcgggacacggcgcggtggcacgcggagcggagcctggacaggcagcggcggttcgaggtgggcggcggcggcggcggcagcgcgcgggcgtgggcgctgcagacgctgcggtgggccgacgcggagaaggcggaggcggcggtggtggaggtgctcgtcgcgctcagctgcgtcggctggtacgacgagcggcggcgggtcgcgtcgctccgtttctgagctagccgcctctttggcttccacgccggtggcctcgccgcaacggcgcagcaccggcaacggcacgtaggtacgtgcatggaacggtgaaaaaatttagaagaactagtttgccccaaatgggaccgattctttgtaaaatactagtattttttttaattcgattctttgtataataatctgttcatatacgagttccaagagtaacaccacgaaattgtgtcccgccttgcctgctggactttttaggctgttcccacttctcagtccgagcacttcgttgatggccacttcgaagtcgacgcgttcacaagcatctctctctagttctcgtcagcactgggtagcggccgtttaactgtttgctcattgctgctttcttcagggtcgatattactattacgagtaatttgagtaaaacttactgcctctatagttttatctctacttcctccatcctataaaaaacaatctaataccggatgtgacatattctagctgttttcaaatttatcgtactaaaatatatcatatctggtactaaattcgttttttatgggacgaaaggagtaaatctagaaatgatatagaaatgataagtgtcagctccatttggtcgctcaatggaagtagcggcctagcgggtgatgttctacgcaaataatagagcttaacattatctatattttaaaataattcattaccaaacacactccatttgctagttacaaaaggcgacatacattttcaccaaattcgctgattcacttaccgaaaatagttctaaaagcaaaatctacccatggctatcttcataattagttcaacatttcaatcacctgctgtcatttacaaatgtgtgaaacaaataaaaaactatggctgagttcgaggagaaggaggagacagagaagatatgcaaaacgatatgagccattaccacacgattaattgagtattaattattttaaatttaaaaaatggattaatatgatcttttaaagtaacctttctatagaaatttttttaaaaaacgtaccgttgagtagtttgggaaacatgcgcatggaaaacaatgtctttctctccaatcacccaatgaacgaacgcagccagttattgtggcatgtacaaacgttaagtgcatgtacaaacgttaagtctgatacgagctcttagggtgtgtttggttgggtggatgagcctggatgggagatggccgtccgaatttttgtggtgtttggttggagggcagggtggatggggcggcccagaatagggaatattccctcaatatgctggatgagtgcatccggcctatttggttggatgaagccatccagttttagtctgggtgatgtgtcatattctaattggctgtggttggtttgattttctgttaagcaagctttaaatgattttttctactaaaccgtttatctaatttatggtttgattacaccattatatttgttacaattaaatttttaaaacaagatctcgaatgattatattatgattaaaatatatatacgacaaatggatcccactaacttatggcttctcccatccatactatatccatctaaacaaacaagaaattagatcgccatatccatacaaatctaacaaaaaattagatcgccatatccaacaaaatatggatggccatatcccatcatgcatgaccgtgaaccaaacacatccttagttaatacatactatttttctgcaatagctaagacaataaaagctctaaaccattaatgcccatgaatttttttattacttttttttccttttatccaccccatgcaataatttttttctttaataaatgctaaaagtcaccactgagccattttcatgcgtagcaaccatatttttctttcctcccctttctctcatccatgttaccaaatttattcaaatttattttgcatggcaacggagaaagtccgttaagcactgttgtacatgctctagagcaataaatctcatttatgcaattagggtccgtgcatgttaaattcttctaaaaacagttaggcgcaaaattctgaaggagaaattcatatatatattggtgcatttacaggcttacaaccgcagattattgcatagtaccattcgttagattgtggaggctacatgaccctgccgatccgggtatcaacaactgttggttttgaaggtcctgaaaattccaaggcttcagctaatgttaatctactattcctccaagcatgttctgcccattctttcatccgttcaccttcggctcttctatttgactgaataagcaacaattctgcatactctcctgaaagttgaacatgtaaagacaaattcagtatggcctcaactagaatgggactatgggagtagaagcatccatacaagcaacatcaacatagaaatcaatgagttgaaaaaaaattgctgattatttgattgctgccagtttaaaacaacaatcagcatatgattgcgtccaatcgactatataaaaaaatgttatatttgttggggcttagaaaatcgcagctcggtctagcatttgtgcgcaagaaggcactacgcctgtttgtcaaatctaagaattgttttccccgatacaaaaattattagaaatttgtgttcacacatgacacatcccttgatgagctccaacagaagtaatatatcacgaaatcctactttactaaacaaacaggcagggcagatttggatgccatattgttaggttatagtgaagttagctgtcaatcaatcatggtgacaattttctcaattttaaactatatatatgccataatcctggatgcaccacacaactagttctttaaaagttgcatttgatgtaatgatcttatttaagagtttggtgcaataaattaaagaagggattaataggagcgatagttcagagtgtaacctctagcaagggagatgatgtccctccaatccatctgcttgctcacacctaaaaaataaaataaaataataaaatcctcaagtggttaaaacgagccatatcataagagattattgttttaccctcagagttaatggcaggggctcttaatacttctagggccttcctgtataacccctgtaatacacagctggtttgataagctcaaagtcccaacccacccagactgaaaaaagtttactcacagcatctgtactctgtagtctgtagagcagtgataattataactgcgagcaaactcgttcgagaaagtacatgaattgtctcatcattaaaactaaagatcaaaggaacaaggccattatagtttctactgatggacaacagggcaagcagaacaggaatgagatatttactgacctcctgaaccattattgagctagaaccttctgcttttgctttcagtttgtacattctagctacacaagtcaatacaatgccaacctttgggtgatttgcccctgcatggattaaaagcttgcagtattggtaacttataggcaattgattctgccattatttattattatattatttaataaattagcttgacaaaccaaattgatcttcagccttctttagcgcccttgtgagataatcctctgcctcactgaacttcctggtttgaaaggaaaaggcaagtgctctcagttggaagatggaacaaaagggaagggggaacacagaattgctacatttcaaaagccaaatgctcccaagtttatcaagcaaacattaggactaaaaaggacaacataaaagattcagaaattgtcatcttaccctgaatgtgataaaagctggccatatgaacaggtggccccaagagaaacctcctcaggaaccatgttacatgtggctaaaaaatttccagacatgtcttccatggttaatgcctccagaaccctttcatacatttgagtagccaaaggaaaatccccaacacagtgcagatattcacaatatgaaagtacagcattttctgtaaggaacatcactattgtgtatgaaataattgcagggaagaatgtgaaaggccaaattgtctcagagacttccataccagtttgtttattgcctactccagcacataggtccttgcacccgtcgaagaacagctgggctggtaagaacagctgtaaatcattttggacaaaatgccttacctatgatctacaagagataggccattgtaaataaaaataacctgattccgtctctccatttagaagtgcaataagccctttgatagcattaacccgacatttcagatggccctgatctgaccatttgatattatcatccttgattgatagatcgaccaaatcatctggggacactgaggtgttgataacctgtgtttaaggtaatcatgaaaataattcacctaaaaccatacaaggctaaatgtgcttgagtgctgtggaaaacctggcccgcttccatgcacagccccattgttgcttcccatgctgcaactgcacattatttaccaaaatatataacatcagttaagatcaaaagcttccctctcctcaactctttccatatcaaatgatgatttacattcttactcgacaaaagataattgtaagcttgtaatgttccagatcaaagatatatcaccgtttaactgagtgctagacaaattacacacaccaacacccttccacttcatatagaagggctaacacaatggtagacatgcatttgtccgtgtgttcataacttagtatgttggtattatctactcaattaacaatgtggcactaaaatgtgctcccgagcggcaatttttctattgggtctaggctacaataattgaataaccatcagatcatcaaatgataagttccaaatatctgtagtttttccttgtctctggtggctgctaaaatcacaagataaatatgagacttgggagacccatttgtttgagaagttcacatagctagtatttcagcctgctcccaatacagaatgctacttagtaaactttagtatttacagaaaggactataaaagcacctctgaaagctgcaggagcaacttggttggttgccttgagtttttccattgcttcttggcgtcttccactgtaccgagaaactaacatgatgttactcaaactactcaactgggaaggtaaaattagaaaagttaaatccagtataaaatgggagttgtgggcagttaaacatcattatctaaaggaaatggatattaatttcccacaagtgataccaatcctgctagctagcataggattctgaggtgtagtgtattacgtttcgcaagattatctatatgcacaatcctcttttcctttctgtaatgcttgttatgtctaaatccttcctaaatgtcaacatataggtaaaaaacgagtggctaaaaccagctatgcagatcagggaccaaattgaatcctattaaagggcaaatttacgagcagattagatagaaacgacccaaactgctcaatataaagtgtttggattacaaaatccagatgtctagcaccggacctccgatagagcagcgtagacatcgcgagcatgagcatcccgacggcctcaccgcacccctcgccgcctccctgcaggttcgaggccccctgctccagtatccgcatcgcctcatctggcacaacagcaacagcaattcagctcacacgacggagcgaccgagtgaggctaaaaaaccctagcgctcagcggcaccacgcagcaatggggggacaacctggcgagctaccgggcctggctccgccgagggcgtagcggaccatctccgccgccacgctctccggctgcgtcgcgccgccggtggaggaggttgcgtagtggcgggcgcgcggcgggcggggcttcggggagaggagcgccctcgcgagggccgatcggatcgggttcatggctgcgcctgcgcctgcgccgccgccggccgccgcgagtcgccgcttgaggagggaggagttaagcggcgagagccgaggggaagaagtgcctaggaggctagcggctcgtttggttggagggagtttctagcagggattgggaggttagagggaagagactattaagtgttttgattggttgggagagaattttggtgagatggggatggagaattgagaaaggaactccctcctttttaataccttggtaggggcaggtaattgggagggaattcctcctttactttgtctaagcaaatctcagtcatctgtttttattaatgacctaatctccaactaaactccctatcaatttccatcaacccaaccaaacatgatattaggattaaaaatcaaatttctatcttaatctcatcataaattcccttgtgtaaactcccaatccccttccctcacaagttaccgaacaagccgtaggagaagtccagaagagtggcagggtccacgtgttcaaagcacccgtgccacggcccatgggcccttttactgaatccacaggccttgtaggcacgaatttgcggatccctattccctagcgcatatactacagtcgttgagtagatacgatgaggtaccattttttggtatctcttgatacctagataatgtgaggtatcaaattttatattatcttatggtacctcttcaagaactataaaatctctacttctaaaccctttttttaggggtaaatggcaggagctctgccaatttcattaaggagagtagagaaaaagcaacaaaggttttttacaaacctagattacaaaggatcccaagtattcttctatcaaggcaaaccggggagataaggggctaaaattttaagaaaatgagaagcaactagaaggagagtacgggcactactcatctagaacatgtgcttcaacgtaggctttgcacatagcgataattgaatcaaccacttgcatcactgtactataaatgccattgaagactcttgcgttgcgctgtagccaaatgccccaagctatgtagatgaagaggtcataaaaatttcttctttgttctttggccatctctcttctgcaggctgaccaccatcgtagcatatctccatcgaaggtggaagccacatgcatgtggagcccgccttttgccaggtgtgtctccatacctgtttagcaaaggcgcattccatgaggaggtgcgttgttgtctccggttctactccacacagaggacaaatgtggctgttgtcccatccacgaagctggagtttgtcggctgtgaggatctttctatggatcatgagccaaccaaagaatttggatttgttttctaccttcgccttctagaagaaatcagacatattgtcttgtatgcctccaacgaactggatcctgtaggcggagtttgcttaatatggtccatttggagtccatctccaagctatcgcatcgtctatgccttcctgcaactccacctattggatttggtgccatagaaggatgaattccctaacctgtgttgtggtattcatttgtctcatctttttcaaccagttgttcccttgtatctcctgtgccactgatctgttctttctcgtggctaactgatagagggaacggtaaagttctttcaggggtgatccgttcaaccatctgtcatgccagaattttgatttgttgccatttccaagggttatcgtggtcgaaactctgaacagctgcttgtctgtttcatcacaaagaagactcgatccctgccaaggcttgttgacggcggtccattcctgccaaagccagcggagtcttaaagagcgaccaaaaagttcgaggtttgttataccaaggcctcccatgttttttggtctacagaccctcctccagttaactaggcagtgtcccccctgtgcctattctgaccctgtccagaggaagcccctacgaattttgtcgatctttttttcaacccattttttaagggggaaaacagtgaggtgataggtcgggagggcagagagggtagactttatcagaaccgtccagccagtcttgtttagtaactttcctttccatgttgggagcctagccgagaacctatcgatgagaggttgaacatctgattttctgagttttctgatgtggagtggaagtcctagataggtacaagggaagtgtttcatctgtgccgggaagggggagagaatatcctgtaagttgagggtgccacatctaatggcatagacttcgcttttggataaattggtcaccatgcctgtcgcgaggccgaaattttgaagaatcatttggaccgtttggaattcctgtttatctggtctaaggaacactacaacgtcatctgcatataaggccatattgaaacgagcagtcggcctgtggagcggttggaggagacctgcttcctgtgctgcggcaaggagtttttgcagaggatcaatcgctagaatgaagagcatgggtgatagagggtctccctgacgtaatcctcgtccatgcaagaagatgtttcctgccttcccatttaggaggatctttgatgaggatgttgctagaatggaaataatccatccaatccatctgtctccgaatcccaatatctgagtctgtctaggagataaggccagctgatcgagtcgaaagcttttgcaatgtcgagttttagcagaatcgcgaggattttggacgattggaactcacgcaccatgttgtttacgaatagaaagttgtcttggatgtttctgccttttatgaaggcactttgatttgttgagaccatctgttgcaattttggggccaatctgtttgctagtaacttggagaagagctttccgaaggcatgtatgaggctgattggcctgtaatcacctacccttagagcatcagtcttttttggtagaagggcaatgtaggctgagtttaatagccatagactatgagtgtcgtgattagcaacctgatttactgccatgacgatatcttccttaattatgtcccaacacttttatggtgaggacttttatctaaaaacctttatagaaaatttcagtatggaaaagtgtgcgttagaaatatacatgtgtcatatgttaatatatgttaatatcacaagtctagtttaaataaagatacacacagatatattgaggccgttcagttcaactgggttgtgggtgtacaaccgcagcgctgcaactctcctacataattttttgcttgctggtccgaacacaccatttatagaagtccatacaaatttgttcttgaaagataaactgatgataaacaaatatattccgttccttgaagtatcaattgcttccaaacagcccgtgtagtatcaagtggggattaattatcttatccttaaaataaacaggtatttttaaacgcagcaagtgttgtctgaagtcgattccttcagatggtgctgttcataaaacggctgaaatgaacagatgacaagaaaatcgaacagtaaatagtttcttgactccagcaagtgcacccatcgcggggactccgtctttaattccatgcattgtgccgtctccaataatgaacttaccatgaccatccttggtggtgatgatttacagtacaaccaatctcttaattctcgataatgacttccaagaaaattaactaagcctgatttttctacagagcatttttaggaagtcaaactcagacaacacaagttgcacgtagttgcagtctagcttcagaatagtgatatatcgcatacagtactgttaacgtcaaaatttagcaagccccagagttatcatcagcttacagtcactatcggctttagcgtcttggaatcatccaatggaaattatcaagtcttcaatagttggattcttggtaaatttggttaaggaaattaatcaattaaagtaagtttatcaaggatgcggcacgacagtttatatattaattaggaagagtctattagtttcgtttcatctttagggaagtgtgtttagcattcgataaggcctatgtttttctttttatctttaggaaagtttatatcatgtccaataaagactagtatttacccatgggtataaatatatacacccggggttattgtaaaatatcctcgataaatacaacttcggcatatcgccaccttttacatttctactttttcgacgagttcttgcttcgagttaggcatcagcttcgatcttctgacaagaggtatgacttgttttagcggtttgcattggtggattagggcatcgttttagatgttctaatctatcttctacagcctctggttatcatatatcttagttaatctagcttagcatattaatttgataacatcggatagaattcgttttagggtttatgctggtatcggctaaattacttgttagattagattaactaagatatccacaaccctgaaaatcagtcaaatgtttgattgtcagtgatgcatcagttaagtttgatctactaagtcgtgcttagaaccataatttctagcttgctttttaattgccaataaagatttcatcagggttttagttgataagttatccatgtaaagcgggtaggagtcctctcgaggacataaccacatccaagatcgtcaaatcgatacaatacctggcatattataattcccaaatagaaatagagtattacctctcgtcgaaagggcttaaatctgtctaaacctcttgtcacaacccatctattttagctctcgtgtggtatcgcttttcatatttcatattcttagtatcgacaatgaacattatgcttatgcatgagttagtatccaacttctcttgtgtttttactcatctcctccggttaataatccaaattgtaccaaccagcttctaactgaattactatagaaacttgtagaatccctgccgtacaaatattgcaaatactgttcagcagtagaaggggggagattgacgtgagattaagggagatgaaccctaataattatggtgtgtcatcaagatttagatgctataaatgccatatgtcgaaaccggaatatttaagctcatgtgcacgcatgcaaattaagttgtcaagactcaaaagagatggttgacataaacttatcaaacagaacctttgaaagattagcttgataatgcgattaagtgagagtgagcgtcttcttagttttcttttcgttaaggattttatggaacactatacactggacagttatagcagccatacgtacagatatcagttaccatcagacaccaaacatgtcgcactcgaccactccagcaacaatgacatataatcaagagcttaagcctgtgtgtaagtcaacagtgctggtaattaatatctccaaacccagaaaatcataagcgaaaaaagtcctgaattgaaattatctggctaccgatcgatatggagtattaccttttaatcttttaatagatgacgtcattcgtttaactattcgttttattaaaaagatatataactataatttattttatttaatatttaaaatataatttatatcttatatatttatataaaatttttaaataatacgcgtgatcggcaaagtcgacgacgtcatgggttaaaaatctcagaggcacgaattgtctcatcgatctgacccagctgaccagaattattaccaccgggaaaatgatgtggagaggcagcagcttggcgcttccgctttcagatggcacgtcacgcgccacgtgggtagctgcgtcatccttcccgagatcgtcggaagctgtgtggcaaatcaaaccgcgacgctgatctgatccagcaggttgttttcagagcaatcaaattctagcaatgcaggagtgactaaacgatgaggtggagagaagaaagatgggagggagatagtcatctctcatgtaaggggctacccctacataaactacaataaatatgtaagagtgctagagatattagagattgtgtggtagagataacctcaggtcattcccaacccaatgactacaatgatgtcactgcacttaaaataaaaaatgatgtggcaagtgaataaatgaagaaagagaaggaaaccagatcttgcatgagacatgatttctacacaacatacaatgcatcatgtgagataagtagcattaaatttaagtatgaaagagtggtgtttgcattgaaagagtagtgtatagtactatttttttatgacgtgaagtttatagaaactatgtgtagtgtcttgagttgagattgatctaatacatgttacctcttaattaatagtgtatatcatgtagaaattggatggggtagtcatctctactataaagcttgccctaattgcttgaaacttgtctgttaagtaaagactggttaagagagagagagagagagagagagagagagagtaaattcgagagcgatcgatcgaagatgtttgaaaaagaaacggagaattcgtgttccagattagatcggctaactgcatttaattaatttccgtggagactcgcagacttggccggggttttggggggtgctgcaaatgcttgctaatatcactatttgaattatttgaaaccgttagttgcttagggcacccataatggttatctataggctctctataaaagatccatgtcagcatatttttcttagaagagattaaatgaagagatagactaaagctatctactaacccgaagatagtctatagaaaaaaacgaggcaatggattagagagctatagatacccatgtagacatacaattgagctgagatgtacatgttttatagagagcaccttactttaccattgcgggtgctcttatgagatactcggagaaacgcgcagtgctactcctccgtaaggtagtaagacgatttgggttcaaagcctcacatcttctaattatttatattaggttattttttaatattcgtgtttttttaaagatgctatcttcgttccataaaaatcaatgtaatactctgaacagaaatctctgttcagattcattgtattaggatgtgttatatccagtctatacgttttttatgagaatgagcaaagtatgcggcttgttgtctcgatgaccgatctatttcccccctctctatgttggatactgttctttagtacgctgagtcatgttaactgtttgttgatcggaccctccatcagatactatgcatggacgaacacaaacgaccctttactcgtgattgttcctgtcgtgtcggctaattgcatttgcagcttcccagatgctgcatcaataatcaatctacataaaggctagagagagatacgttgatcaggccatatgtgacttggtcaactgtcctaaagtcagaatgctagtccaaagccaagagaagaaaaatcagattgtaataagagtataagaccatcagcacaggaggggacctgacacagattgttgcgatgctacatctttacttcttgtataaatatcctctcaagtctcaccatctacttagctaatatagcctccctccgtccctaaatatttgacgccgttgacttttctaaacatgtttgaccgttcgtcttatttaaaaaatttaagtaattattaattctttttctatcgtttgattcattgttaaatatacttttatatatacatatagtttacatatttcaaaaaaaaattcaataagacgaacagtcaaatatgtttaaaaaagtcaacgacgtcaaatatttaggggcggagggagtactatcctctattatga

SEQ ID NO: 62662 - DNA, 979 bp, Oryza sativa
aactttatcaagtccaattctcaaatcccaaaagtcaacaattcatcataaaacacaatcatatcagtctcaacagtatatgacaaaacataatctatgaaataaatgatctatgtttaagataggaatcatattgataaatcctaatacagaaatttaggtcaggctattattgtgttgtatgggctatgctatgggtctggaaattccgagaaaatttccagaagtttccaatcgatttcgagttccgacgaaaccgctcttatcattcgattctgtttcggagaaaatattttcaaattcaattccgtttctgaaaaaatccgaccgatatattccgttttcgaaaatagctttatgatctgaaaagttttcataccgtttttacccctaacgactaatgtcagatgtgacaaatttagttacaaacaaaatagaccctaattaagtctctttgataatgtatccaaaagtgcttatacttagacaaaggtgagttttttttaaaggagggcaaaagctttgcctcgtatattaatagagatagagaaaaaacaaaacaaaatcagatagggaaatatttacagggcaagccaaaagatagacaaaggtgagttaactttcgatatccacaaagtcataacttcttaggctctatttctttcagcttgggattattataatccagattattgggagtaagctgaaagaaacagataacttattgaagtagcttattataatttggagcccaacttattataatttgataagctcatttaggtgagttttttctagattattgggtgaaaaattacccaccatgccacccccactctctatttagacttgcaaactcaataatctaggctctaataatctaggaaagaaacagctaaccgtttattctactacaaattataacaatctagcttatagtaatatgactcaataatttagattataataattccaaact

SEQ ID NO: 62663 - DNA, 16884 bp, Oryza sativa
  unsure (1)..(16884): unsure at all n locations
acggaaccggagcaaattaagctgctgcgttacactattgaccggctatattagtctatcacgaccgtccacatcgccactcaacaacaccatcgctgccgcgcgcggcacaaaggtggccgtcgccgactcgccggtgtgtgcggtgttggtgagcgttcggtgagaacgttctcggcttccctcccccctcacgcacgcgcaatccacagctagctagcgcgggcggcgcgcgcgtccaccacgaaacccccccgcacgtagccatcggtgtattactactacaaccggttcacatcacacctcgcccggttatttccaacgcgaggcataaatacgggagagggaaggggaaacccgacgcgacacgtctcctcgattccgctggttttttaagtttggtgaaactcgatcgcttaggttaaacctcggtagctgttgggtgcgaggttggccatcgatcatctctcgctggatcacgccactttttcgcatgcaaagcgtaggatttctctctttgtttttaggatttcttggtggttgcgagccgcttacctgaacccagaaccccccagttgccggtcaagccaaaccctgcccactgcgatcgcctcccatataacacatactctcttcctctttctcttcgcttcatcaagtagtagtcgtgttcattaatctgcatctctcgcttcacgtactttgaagtggtggtgaactgtgttttgtgtcatcgatggtgaccatgtcggcgtcggcggaggcgaagagtcgacgggagaggcggtcggtggtggcggagctggagggggcgctgctgcgcgacgcggcgacgttcccgtacttcatgctggtggcgttcgaggcgtccgggctgccgcggttcgcggcgctgctggcgctgtggccgctgctgtgggcgctggagcgggcgctggggcggggcgacctggcgctgcgcgccgcggcgttcgtggcgacagcgggcgtgccgcgcgcggaggtggaggccgtggcgcgcgccgtgctgcccaagttcatggccgacgacgtcgacccggcggcgtgggcggcgttcgggtcctgcggcgggcggcgcgtcgtggtgacacgcatgccccgggtcatggtggagcggttcgccagggagcacctcggcgcgcacgaggtggtcggctgcgacctcgagtacagccgcctcaggcggtccaccggcttcgtcaggggcggcggcggcggcgagcgcgcggtcgccgaacgcgtgcgcgcgctcttcgccgatggcgaccggccggacgtcgggatcgcgcggtccgagtcggcgacgcgatccttcttgcccttctgcaaggtactaccacgtacacaccgtgcacgaacactcccggaactcgtccaaaccactaattaatctgcatcatatagcaaaaaactactgaatttgattatagtcagcaattttttttcataaatttgacagtgatttaaaagtgtcaatggagggagtagtagtatactagaacacgcacttgatcgatggagcaattaatgtgcgccattttcctaggaagaaaaaataatgtgtatattttcctaggagtagagctttagaggtgcttgcccataagcatgcgcgtcggtacatgttcccgtctaatatgtgcatggaatttgggcatatgcatgcatggacgaggatgaaccataccacaactaaatgcctagctagattaattctgaaagtcgtttacgcatgtgaccgccacagccacaagagtcaaacttaacccatcaatccatgatgcatctccaaatctgtgttcgatatactccacaacatgcaactcggtgcacatgaaaggatgtcatgatagtcggcaaaagttctttaaaaaataacccaagttgtcgggacaaatttagacgaataaattagtagtttagtactcgtgtcacaaaatttaaatttgactgtagaaattactatgtacgtatactcgtacatagtgagtgatcacgtgaaccttacatgtagaagtgtgtgtctctgtgtgtgcgcgctaagccatagctttcatctgaataactctgtttgaaaattgaaatgcgcatcgctattgtggttttaatttgtggccaaatacgcatcacttttctccaataattatgttaaatcgtggctcgttcaggtgttaattatcatgctatagttttgttgggaccaacatggcgagaaaccgcgaattaaacctgtaatttgattacgtgcatgcagaagcaactccggccgccgttctgtgaggacgacggcgacgacgtcgccgccgccggcgagcagcacaaatgccctccgttccggccagtcatcttccacgacggccgcctcgtgtgccggcccacgccgctcatgtcgctcgtcatcctcctgtggcttccgcttggcgcgctcgtcgccttcgtccgcatcgccgtcggcatctccgtgcccatccagatcatcccccgcatcgcgccctacttcggcggcgccgtcgtcgtgcacggcgccccgccgcccgccgccgccagcgggccggcgtccggcgtcctcttcgtgtgcacgcaccggacgctgatggacccggtggtgctcgccaccgtgctcggccgccgcgtggccgccgtgacgtactccatctcccgcctctcggaggtcctctcgccgatcccgacggtgcggctgacgcgcgaccgcggcgtggacgcggcgcagatgcgcgccgagctgtcgcgcggcgacgtcgcggtgtgccccgaggggacgacgtgccgggagcccttcctgctccgcttctccgcgctgttcgccgagctcagcgaccggatcgtgccggtggcgatgaactaccgcgtcgggctcttccacccgacgacggcgagggggtggaaggccatggaccccatcttcttcttcatgaacccgaggccggtgtacgaggtgaccttcctcaaccagctccccgccgaggagacgtgcgccgccggcaagagcgccgtcgacgtcgccaactacgtgcagaggatactcgccgccaagctcgggttcgagtgcaccaccttcacgcgcaaggacaagtaccgcgtgctcgccggcaacgacggcatcgtcaacgccaagccgccggcggcggcggatccggcgccgtggcagcgccgcctcaaggaggttctcggcttcttgctccactaatcgatcacaaattcacaatactttcgtggccaaagtgctctgctcacaagattaatttgacgaattttaattgcgataccccccaaaaaaattgcgagttttaatttacatgcgtgtgcatgtatgtacgcaaagaaatgtaaatgaagacagcagccaccattagatatcaaacctacacctacggttgcttttccttgctttttcttacgaaatttgttcatgattcatttgattttatttttgttgtaatcaaactatactgctgtatatatatatttacacatccattatcacaagttgcatgctcaatctattttactcatacgtagattttgtgttggtctagttgttgatcagtcctccctagctagtgcctattaattccattttttttatcttatacaacagagttcattgattaacaggtacttgctccgtttcgaaatattttataccgttgactttttagcaaatgtttgaccgttcgtcttatttaaaaacttttgtaagatatgtaaaattatatgcctacataaaaatatatttaacaatgaatcaaatgataggaaaagaattaataattacttaaattttttgaataagacgaacggtcaaacatgtgataaaaagtcagcggcgtcaaacatttcgaaacggaggcagtagttattaggtgagcaaattcttcctacgaaaaatagcgactgattctttggaaaaccagcttgttttgcacgcagagtcttttccaatttgttcctttgacatgacaaatgaaagttcgcgatttaccgctttgataattaagaccttactcaacgcctcaatttattggctgtgtttgcagaggccgaaaaatttattccattagtaaaaataaagtcagcacctcaattatggctgtaaacctctatgatgtggattgtcaaccctaacccttgatctaaaacccttttaatttcgttgtgttaaaaatagtcgaatgaattatatcattatactcaaatagttaactgatctatgggttggccgttctgatccacctaaacagaactgaattttaatttctgaggttatcaaaacacgcgacatgcatgagatgactcctttttaaggtcaactaatttgggataatatgttcagctggtcatgtacgaaacttaattatcagcaggacggtaagctgcaattaagatcgtatttgccttttgaaaaaggatcgccctccctcgttcatatgcgtttagcgtcggcaacacgtacttatcataaaaaccgtacgttaatagacgtgagactgattaagaatttgcggtggtttatggacttagcaaaggccacgtacgttcccggccctaatatgaaagccacgcatatatgcctgaattttcggaagcacatcattttactgtgtttgagtaagcacccatgtgaatagaacagaataacatttgtgatagtattaaatactaaggaggcaaaaaggacatgaatcaagttttggttttattgctgcgagtgacctgctgggtgcacggtgccacaggcgtatacattgtcaaatagtatttcttttcttttacgaggaaaatcacaagtattcctttttaagtgggttctcgataataatttaataagattagagatgtatcgctaatttctatatctttgagcatgtgttaagcaagacattcgcagatatgtgttactgatgtgtgtgcatgtacgtctaccatgtaataaaaataaaataaaattccaaataataatgaaaaatcacaacaatttgtttcctttgtgaggaaaatcaccaaatatccattttcttttgtgaggaaaatcacattaactcattttctattgcgaggaataccaaattgatttattttgtttagcgagaaaaatcaccaactattaccttaatttcttttcccattcttgacatttattccttttcattgtgttaggatgtatcacatccaaccaaaattccttatatttagggacgaatggagtatctagaaaataaataaataaaattggaaaattaaaaaagtaaatgtcaagaatgggaaaatagtaactagaagataaataaataaaattaccaaatattcattggaaaattaaaagataaataaataaaatcaccaaatattagctggaaaattcaaaaagtaaatgtcaagaatgggaaaagtaaataaaatcaccaaatattaattgggaaatttaaaagtaaatgtctagaagataaataaataaaatcacaaaatattaatgggaaaattaaaaaaataaatgtcaagaatgggaaaagtaaataaaatcaccaaatattaattggtaaatgtctagaagataaataaataaaatcaccaaatattaattggaaaattaaaaaaataaatgtcaagaatgggaaaagtaaataaaatcaccaaatattaattgggaaatttaaaaagtaaatgtctagaagataaataaataaaatcaccaaatattatctggaaaattaaaaaaaattaaatgtcaagaatgggattcgaacccatgccctttcggaccagtacctgaaactggcgccttagaccaactcggccatcttgacccacatcaggaatcgaacacttaacatttaaatacaattaacttaatcatgggaacatgacacgggcaatttctgcgtaggcaccgtgctaaccccgaatcaaatttgggacgcaaatctctgcggacacgtctgataaaaatgtgtgaagcaaacgggagaccccttgaaagccattttacttccaagcaagttcaaccgttgtttccattagttccttaattatcgtgaaacaagattacatcatagtagaccacctacttgcaccaacgccatcaccactcaccgggttcaacagccatgcgtgattgagtattatcaacaattaatcactcgatcgttgtccacgcttgagccagtcaccgcgtttgtttaatcaaaccttgccggtttgcacgaaaccatagtcgacgtagctataaccaacctcctccacggacattccaagccaaagattgtttacacactaacacccctactatcaatatcttataatcatatcattatcttaaaaaatatctcttaatcgtatacaacacggcaatggttaaagattcaccaaagatattctctccgtcctaaaataaatacagttctatactattcatatctaacattggatttggaccgttcgtcttatttaaattattttataattattatttttgttgttattagataataaaacatgaacaatactttatgtgtaacttattatttttattttttttataaatttttgaaataagacggatagttaaacgttagacacaaatacccatctatatacttattttgggatggaggtagtacattgagacacaccattaacgaagctactaattacaccaaccatatccgttatagagtgatgaaagataccagtacagttcgagttctaaacttttaataaggtgattgtatttatagctaattattctttcattcgtagatgatatacccgtcaacagcaagacatccgtggtgatttaatcaacttcaagatataccaaaccagtcttactgagatgttcaaaagaaatagaatgtgtgtatgcacgtttataggtgtgagtgtatgttgtaagcgcatctatactttttttttttaacaaacgaacttgtagtaccttcaaacaaacaaacttgttaggacctctttgtttaggcttagatttattggtttatatatagttataagttaatttattggcttatatgattccctatatgatctataagccgatgaatttaatgtctaaatttaatagtagagtcataccttcacctcatataagtcaaaaatattatccaatctaatctttggtttaatagagctagaatgacttatggcataaaaaacagaacgaaaaaactgtttgattgtttaagcttagtttttttaccttataataaactgatttataagtctacacatgcatttttggctttttttttctttgacaccgttctctccctcgcgacgctgtttctccccgcgaaataaagtgacgtcaccgaacgcaggcccgccgcctccgcctccgcttccgctcgcccggacccgcctgcgccggccgcacaagggatgcgctccctcacctcccgccaccggccggaaccctaaggaggcgcgtgcccacctgcggctgcctccggcttcggcgatggggcggccgggttacctgacgctgccaatcctctcggtgctcgcggccatcgggtacgtctactacaccacggtgttcgtcgccgtggcccggtggctggggctcgccacggcggccggggccgcgaacgccgcggcgatcaccgccctcgccgccgcctgcgtcgccacctacgccgtcgccgtgtgccgggacccgggccgcgtcccgccctccttcgcgcccgacgtcgaggacgccgagagccccctccacgagatcaagcgcaaggtgcgttcgcgctgtcccatcggtaggcttgcctattataggatttggatttctggagtagaaggtttgctcggttatggccattgtttgactcaggagttacattgggacatctctgctttatatatcttcgcatttctattgagaaatgcggcaaatagccaaatatgcaatctagttcgtgaaatttgaagcatttggaggagggactgtctcgcactgtcgctgacacgccgacaggcaatttaagatctgagtaatcaagtgcatccacagtatgagtggatctaacctgaatattaaggttttgtcgattgatggtgccttggccacaccaacatggattttctgtgcgtttgagatgaacagtttcaaaatacgttcattacaaaaactagtagtaagctaaaactatttggaaagagcggaattcaccggtttttgacggaatcagctagagcacctctgaagtttcctgggcaattgttgaagaatggtgggcttggcgtgcagctaacctaggaggcgtggtgatagaagaattaccgagtgatcactaataacctctgtgttggggcaatgtgtttaatgctcaacgagtgtaggacggtgtggagtccgtagttttcccaacccctaggggctggggttgtaaaacaacaaccatgtttgttgtccaaatattttaaacttctccaatcttaataaaattagtcggggcacttcgccgctggcctggcaaaaaataagctagaactaaaccaacgactctgacttcagaatctgattgagagaattgctcctttctgatagtggatagtgcctattagaccattacagttctttagggtaattgacctttgcggtcttgtaatttttaagtgtatgtgctatggaatggggacaaaaagatagtaagctgaaagagggtgaacaactgatcactcatgctgtacgcatcgacctttgttatattcttgatgttgctgacaaaacattttgtatctatacttttttttttcagggtggggacttgagatattgccagaaatgtggccactataaaccccctcgtgcacaccattgccatgcttgcaaaagatgtgttctaaaaatggtgctgatcagtactaatctgtcttgtatcttctgttaattacccacttacactttttcagcaacttcttatgtgcaggaccatcactgtatatggattaataactgtgttggacatgagaactacaaaatattttttatctttgtattgtatgctgtaactgcatgcttctatgctatggtatacttaagtttctttgatttacctttgcaaccatgattgtctgggtatagagcactgagaaagtttcatgtttatttcagattcttatcatagggagcgccatgtacagtgttcctgtagatgaacattcaagcaatgattcttctaggacatcgattgtaagtgtgctgggagtgtaattttgagttagtccgtactatgatattccctatttttctgaaccatcactaggattgttgtaaactttgaaggatttttcaaattgacagatcatttgtgggatcattctatgcccgctgactttggctttgacagtgctctttggttggcatatctacctcatattacagaataaaactacaattgaggttggtatttactccctcaattcacaaattaggttgcttttttcacttttccgtctgtgcaatatttgaataaaatatttatcaatatatgctaaaattaataataaatattgcatatcatggaagtattttgcaaggcaaattcaacgattatttttgtgaagttaacctatatgatttttatacatatattagttgtcaaagtttgagaagttaattgtgcaaaatcaatctcaacctctatttaaagatggaggattgcttttaacagtggctgtcgttaatataatttgcagtatcatgaaggtgtgagagcaatgtggttagcagaaaagggtggaaatctttatcatcatccgtatcatcttggtgtctacgagaatcttatttcagtaagaactattttgttcgttgctatttgtatcttctttcagagcataaacattctacatatcctaatagaaggcaataagggaacaaccgaatacttgacttttgagaaacaatgtcgaagattgtccccttttcctctgtataagacatcaaagcttttgccactacccattcatccagtagaaacagaaaggaaacagaacatgagaatgtcaatccattaaatttcagcgtagtcatcttatgcagccttctggtacttgctttaacattgcatttgtctcagtaattcaaaattggttgcatatttcggtgcattaatattcatgcttcctgaccaaggggaggtattgcttgttattgatgtcccaactattgtcattattttatacaggtgctgggacctaacatattctgctggctttgtccagtatcgactaatacgggaaatggcctccgtttccgtacatcacatgatattccattatctacaccatcgatgtgattaacacgagatactgttatttatttattcattaggtagttgctaatctgaacatagacctctggcttcctattagattgcccatatgtgcctctttttttttttactgaagcattgtgttttggagcagtacagataatctgtcaaggtcttgaagctcctttatgaaatgtgctataagtgtaacgtacaggacctccccacggctccaagttaggacatgggctaggctgctcctttgttttcgtggtggttattttacatacttgatgaggcagaacatgctgcctcgcctgtaatttagtgtagtctctgattgcgtttattaggagatttgaatgtagtcaattctgttgtagatctccccggcaggaaaaaatggggggctgctgtaaatccaacatccatactttgttctcttaaagagccacttatggcagcgaaaggccacgataggaatcatctgagattgttcgcatacatgtttattaagaacagaacttatatttatttgtcatacatcgacgcagtttctttgtgtatacactgctgacatatgcttgttaatattaacacgatgatacgatgtttgggtaatgtttggatgattctacttcttcaaagctctggttcaaattcttctgcattgtatgttagatcgcataagcagtcaccgtataaggtgcacaataatgcatattgtggttcatcactcttgcatggctatagtcttcctgtgtgaaaatggcgcatgtcaaactgcaacacctttttcgaggttgatgcgtagcctagccagtaaattctgttactatgcagcattgtttaaagggcaactcctcaatatccgataaaatcgtgtaagttgagcattaacttacagagacgcggtatatcatcagatatgaagatgcaatcattaaccaataaccggtcaatgattgcatgtgatgatttgtgaaaacgttaactacaattttgttctatcagtacagccatggtgtcaaacaggagcaacaacgcagcatctgatgaacagtagccaacaagcaatcttgcagatgatgatttgttgcggattatttctaggttacagtagtcagaagcaaatactagtcatctattttccctttccttttcccttccccttcttcgcgtcaagtttggcttggacacgagctgctgcagcagccttcgcttcttccctcttctttttctcttcctccttggtggcagcagctagctctcgctgcttctttagttccctaaggaaattcatgtattccgcagatattagtcttcatagctcaagaaggtagaaaataagcaattatctcgagataatttcacaggcaatcagcataacagttgattccataaagtgattactgcattcctcctaactcctacctctccagcattatagttttgactaaattatgatgcacgtgatatattaaccagttttctgtatcttgtacagctgtgctatttaacataataactgggaacttcatattgtaatcataacaagaagacatttgaaaacatcttactctagcctggctttctcatcagaaacactgcccaggcttgaacctttcctaggcctacaagccactaactccacctcaaaaatgagtgttgcactgcaaagacaaagctgattcaattatagacaccaggaactcaaatttgcatcgcataggagaaatagcaacagacttgggtggaatctctggcggcgaccctgcacttccgtatgcgtattctggcttgcatgttatttttgcaacttcaccaaccttcaatattccaatatgtcactccatatcagcaaaatctttgaaagaatcagaacgagctagcaataagaatttagaagttttataccttcatagttcttaaagctatatcccatgctttaatgacagctccttgcccaatttcaaatgagaaaatagagttgtcttcatgagtggtgtcgaaaacttcaccattttcagcgagtgtgccttcataatgaactgtgaaaggatataaatgtaagtgggctaagtattgtgttatgtcttgtattatgcacatactcaattactagtaatatacataaatagttttacacatcgacatgacaaacgaaacacaggcattcactgtgtggtactgtcactgataaaaagagtggaaacacggctgaatgagaaattattaggatttaggaccaattaaccaacttataaatgtaactcaactgcctagagattgctaatcaagcagaaggaatttcatggaaatgattggattgagaaataaatatatgaactgcagtaccatcaaccaagggaagactatcagttggagctatagcatcatcctttgcttttctgaccaccgtcttaagaacacctccatccccagttaaatctgcaacctctgccatgaccttgctatgctatcaaagctccaaaggagatcctgggtgattattcatcatagtattagagtatgtattataacagatccaatcttcatcaaatcataaagtacaggcatctagaaaattgggggaaaaatcactttctccacttatttaaattcactgctttcacaatttcaagccaatataaaggtgccccgtactttcaagttgaaccttagcgttccagaattccacagaagaggacaccacagctaatgacctttaacttgaagagggacagctgtggaaatatcctaaccaaacgttggtaatcaagcatgacactcattctgcactccccacagcagcataatcaggtatgtcactttccttttctgaaggaaaacacatagaccaatcccagtctctcctaaatacacccaatccaactatcgcctaactgggactgcattgatgcaaccaaaaggttgccactgctgtggacgtgtgatcagacgttgctgctcctccccaaccaacaagcctaatacagacctacaccttctagcattccatgcgtgttatcatgatacagaaccgcgaatccctcgttgcaaagttccattgggcatcattcggggcagtaaaacaagccggatagaccaaacagcgggggtctcgcggcatataccctcacggaagatcgctcgcgaaatcgaactgttcaaggtacaccagattggaacacgcccgaatcgaaaagagccaatcgagccagctggggggcaacagcagacacgtaccgcgagagcgctcccaaggcgggcgctaggatagctcgccgccccccaccggagaagccctcgccggctcgccgccgcccgcgggagaaccgagcaatcgccgtctcgtcgcctctctctctctctctctctctctctctcgattattcgcgagattgggaagatagtgatgcgaatgggatgcctccccgtagcggtggatgtctcgacactcgactctcgactcgagcagtgatgatgcctgctgagtggtgggccatgggagaaagtacgggtgggaatattcgtatgggctttggggccttgagtagtgagacacggcccactatggaagttcgcgacctaactcctaagggctaaattcacggcccatcttgagaggtgtgcaatgaaactgaactgaacttttggcctgtccatgggtacgggcaggtatttgacgtcttgctaaggctgtgtttactaactttttccatcacatcaatctgtcatatatacataacttttcagtcacatcgtatcaattttaacccaaactttcaactttagaaagaactaaacacagtctaagttgctagacaaaggcctgaacttcttttcccgtgcgtaagacgatttggatagaatgtacagtgcagtttactactctctatccaaaataagactacaaatctggatcgtcttagaatagttacattcttatctagatacctaggtgcacttattttgggactgaggaaatatataacagtggccaggtataacggtaaaatggtgaatctagaacaaaaattatcaggtatctatacgcatacttaacatgtagggcttgttcactttgctaacattctcaacattaccaagttttagcattatcaaattttggtaaggttgtcaaaattttggcaaagttgcaaattttagtaagattttatatgtatttactaaaatttggcaacaaactaaatgtagccacttttttataactttacccaaaaaaaaaggtaaggttgaaaatgttagcaaagtgacaagcctgtataataggcattagaggtggagtaatttgcagtgataacacctgtcctgtgtactaaggttaacgtggctttgcccccgcccccgcagatatacctgccgtccaaaaagaaaaagtttgggctttgaacctctatataggctatgttcaaattcataagtatttttctttttttttaaacagaggagcaggctaaggttgtaaaagtacacctttttcttatcttgtcctactgtccgaagaagctagtctgtggactgtgatggctgggctggcaagttgctgccgatggcaacaggttgctcaggtacggacgtgtcgtttagggtgcgacgattgacgattcacgacgacgacgactgtgctgtgctcaacagtgcagacgctcagctgcagcatgcagagccatagctggcctgatcagaacagtaaagcaacggcgctcgatctgctcttggccggcctctcacaagttgtgaattgaaacctgcgtgatttcatttcgtttctgtaacgtcaagaagaactagaaagaaaatgtacaaatacgaaccgagagaacgaggcatatatataattacagagaatgtatatgaggagtacgtagtttcacatatttcgtcccttacattttccatctagcaatgcaatacacttttttttcgaactccatttagcaatacatatatagagctcccctgtgctacggacgtggttgcatttctctcgatcggaacgtgaagagaattaagcagaagagagaccggcttaagcttgtaaaaaatgtacggtcagaggtagtcgacgtcgcgccagcacgcgagcatggtgatgcatcggcgcacgatgtagagccgcgcgcgctgctccttcacgagacgcgcgcaccgtcgcgggaacgacgacgacggcggcggcggcggcgagcaggatgcctgatgcctgctgccattgccggcttccgagccggcgcccgcggttctcccgatcctcttcttgcacggctccctgcgcttgacgccctgatcctccgcccgcgactccatcgcctccatggacgagaccaaacgcgcgcgcgcgcgcggccttctgcttggtgcgcgtgagctcagttagtgttgtgatcagtggagagcgccgcgggtgaaatcaagcgatcgatcagctataaatagctcgcggcgagatgggtggcaaactggcaatgctacctagctctcggcaaggaagcgacttgtagctagctagctatagctatagcgagctctgcatcgtgagtttatcttggcaaaattggttatatagcatcgaaagtttacgtttttttattttatagcaccgaaagttaccggttcactttaatagcacccaaagttcaccatgttcccatttttaacacttccgtcaattctcaatcgttttccgtccgtcttgatccaaccacacacacgatatgacgtttctacccctcacaagtacaagtataatgcatgtcaatgaggggtagaaatgtcatatcatgtgtgtggctggatcaataacaatcaagacggcggaaaaattgacagaagtgctagaaatacaaacatggtgaactttgaatggtattaaagtgaaccggtaattttcggtgctataaaacaaaaacgtgaactttcgangcnananaaccaattttgccaatcttatatatcacggagatcatcgcggagtggaggtgtgtggtgttgcacgcatcgcgtgcagtgcaggacctttggtatatgtcccaccggccggggccttttgtaattgtatcagtatgtattgtagtactagtttgtacacgtgcgagtactacctttttttagttggaagtatctagacatcacaagcgcctgaaattttcaaaaagaaaaatcctgttctttagatggcaatacaatgattctagttactcccatgtaaaaaaaaacgttgaatgataaattattgtaacctacgaatatttataaaattacatgaaataaatttatagctcatgaaattttaaataattagatcaaaacaattcaaacatatatagataaaaaaataaaagtaaaaccatataaaacaacaaaattagagttaaatgattggtcattttatagcactgtaaaactatgtttatcagtatgtaactttaggtgattgaagatttacaaaattgcaggtgcttgaaaactagcaaagttctttttaattatatagaagatacgcgtgctcacacataccacaccatgcact

SEQ ID NO: 62664 - DNA, 16105 bp, Oryza sativa
agttggcatggaatatataatatatattagttataactccatccagtgttgatggatgatagatatattcagtatttctctgagatagattaatgtaaaattttcctcagaataccaattagtataaaatatactccaagcatataataagtataggagtagatatggatacatggagcattaattatatgtctgatggcttttgttttctcagttctttgttctattttatgattattcattgtgtggaggagctaggtactctaaaaagcaattgataattaattagtcagttagtgtgaaattgaaaaggctagatttttcaggttgtgacttttagttcattttccttttctgaattatcagaatctgggtaaaaagtagattacccgttatagatgaaactatgtacaagaaagggatgaaatttataagaagaaattaaagagaatatacacatactgagcatatatacccacacttagcatgatctaactatagtggatggagagacgggagacatgaacccaagtgttgtaccatcgtgcattttgtggctgtttgtgcaagaatttacgacagtgcgagagactgaatgcggctgatttcaactcaaacgaggggataaatcgtcgttttcaattggaagatcgaaaccagaaccagacatgaaagctaatctaatggttgaataatacacgcaagttgaggaaccattgtacgcggaaaggatcaaagtaggcatggcaaacgcacttgcatgctaaataattaaatcattagctggtcctgtgctggagttgaaaacgctatccacaaatttcatgccgacaaggaaataaaaaagaagcatatatatacaggatgagagagagagagagggggggggggggcaagtagaataaaagaataaaaacatgaattgcacaacaccatccaatgtgaggttacatcgatcttgtccctacctctagcttagtttgagagacaaatcagagcacaaaccaacaggcacaagatgggtacacgattttcatcccaaaccgatcgagagtcgatatacctctccacacgccacgaacttgtacaagcacccactgaccaaaaacaccgctgatcaatccgcaccgtagactacgagcacatggggatatcggacggcggcggcggcagcttctgattcggcagcggcccgtcgttgacgagccacgccatggacaggccccagctcaggtgcacgtctaaatggcaatgcatgatccaaacacctgacacacatgacaaagccaacagtttatggcatagacaacgcaaattaatcctagtcaacgaatagaaccaagagaacaaagaaggtaatgccccctgtacggatgcatagtcagaaatgtattttttttaaaagataatttttaccttcgttaagaataaattgggaggtaccatatttctctaatattataaaaaattaaaggtgtttttgtctaaaagtttcgtacgttgtccgtttccattatcgtatcggtttcaattcagccgccgtttgctcgctcggactgaatatgaaaattgaatcgagcgatacgaagacgaggattctttttttgcttgacgtatgcaaatctaattgggctgtagaaagctggcccaactaacaatatgggctgtcaacttaaggggaaggaataagtctattttacctacctaggtttttgcctatgatcaaataaaaaagtatccggttttagtttggttcgtctggtttatatttttgtcgccattttttcttcacgcggaacttttttttttcccgcgcagggtaagccttttcttttttgtctttttttcgttctctggtcttatctgcatgcgcatagcgcgtcccgcctcagccaccgatcttccggttttcttggtcctacacgaaacggtttttttccacgtatgcggtaagtcccttttttttctttttcttttttttccattttccctgatctttgatccgatctgcacgcgcttagcgagccccgcctcagccgccaagcttccgctttcgttggtccgtgcggtttttttttgtcgcttcttttcatatggtttgtttcttcgcacacggtaagtgcgtttttttcttttttcgatctcgtctggtctaagccaaaccctagcgttgctgccacgttcgatgtacctcctgtatgttttctactctaactgattgtaaaaatcgatttcacattcctccatcatcattttcccatgatttcctggactttaatttactgaatttaatctctatttaaaagtcgttgatcatggcaggtcgataagcttttattcgattcgattttgggggaaaaaagagaagaggagattgggtggatcaaaaagtcctcaaccaatttaattttggaagatcgagaataatttgaccaaatttggcattgtacaagcaagggactaccttttggaggttgatgaccgaagaaagacagggcgaatggagggaggtagcggactgggctaggactaggactaacaaagaaaaaaagattgtgctttcggtctaaaaccaagaaaaaaaatcatttacttttttaattatagtgtataatgattccaatgacttagctcttaatagttgttgtttcattgaaaaaatatatttacccgttgcaacgcacgggtatttttttctagttttatataaaatttaatatcgctaggtattagatatattaaaaaaattagtgtaaaatttagttatcttaagatgttttctcgatcataaaaattccctttttaaatgaaggtataagtatagagcgggtaaccaaccggggttgtcggcgacgaagcggatggcgacccagccggcggtgggcacgctgatggtgttccgctgcacggggtcgacgaggttgtacttggcggtgtcattgctggcgtcgtagttgccgaacccggtgccgacgacgtagaagtcgtagccgtgcaggtgcagcgggtggctctcggcgccgaggatgctggtgtcctgcagcaccacctccacggttgtgttgaaactgagcggcaccaccctggtgccgtgggtcacgaacgtgttgttcggcggcgtgccggtgtagttgaacggcgtccgcggcgccgccgggaagttggccgcgagcacaccgttgtaccgccgctggtagtgcgcctggaggagcgacgtcctgggcatcacgaacgacacgttgttcatggacgccgcgaacctggtgttgttgggcccctggcacgtcccgttcaccgggctctggcacgggtcggcgccgagcccgacggcgaagaagaagtgcctgtccaccgtccgcggcacccgcgccgggtactgcgcgctcgcgaggctccggaagctcgccgagaagttggccaccgcgccggtgtcgttgtacgccgggagggacggcagcgggaggctccggagcgcggcggcggacgtcgcggcgccgtagtactcgagcacggcgacggcggtggtgttgtcgaacgtgccgacggtgttggtgtacggcgcgacggcgatggcgaaggagcgggacggcgggttgttggccgccgcagtgaggagcacgtccatggtctgccccggcgagatgacgagcgccgtggcggcgaacggcttgacgtagctggcgtccgcctgcaccaccatcagcgtgtggttggccaccccgaagaagagctcgtcgttgagcgccgcgttgatcagccgcagcaggtacgtcttcccgggcctcaccctcagcttgaacgtgtctgcgcaacgagaaaaattaaccacgagtcgttcgtacagtgtcacagtactgggacgtcgatcaatacgggccgtggcgtgttaccgttggaggaggagcagttgtaggttgggccagggaggccgttgaacgtgtaggcgtcggagacgttgggccctcctcccgtctgcagggcctgcttgatcacggcctccgggtcggcgttgaaccactcacctgccgttcggtcgcgtttcccatcccatatcaaaacgtcagatcggtcggggaaaaaccaaaaaaaaaacgtaacgagaaacgcacgtaccgagcaggaggggcacctcgcgatggggcttggggaacgggtaggcgacgccgcggggcgggaggatgacgagcgggccgtagagcgtggcgcggagccaggagaagtgcgcgtgccaccacagcgtcccccgctgccccgtcacggtgaacctgtacacgtagcttcccccggagcggatcggacactgcgtgatgtacgccggcccgtccgcccacccgctccgcacctgccgaatcccgtgcctgcacgcacacgcgcacgcgcccgctcggttaatcaatcagcgatacgatcgttgtgacatggcggcgcgcgtagctgcgtacgtaccagtggaaggtgacgttgttgttgatgttgttggtgaccctgatcacgagggtgtcgccctcccgcacgacgagcttcggccccgggaactggccgttcaccgtggggacgctcttcgtcacgcacagccgcgtcaccgtcgccattgtcacctgccattacatattgtagcagcagccaaagatcatcgtaagcaaacgtgacactgcgacgagcatgggttttacatcgcccgagcaaatgcaagacacggcatattatgtatttttacattgaaggagtagcggcgggtgcgggcggcggtgaggcccggcatagcgaggaggacggcggcggcgaagaggaggcatgcaggggaggccaaacaaaggagatgacgacccgtactactacccattgtgatcgatcttctcctgcagcagctgtaatcaagctagctagctgcttgatcgatcgattgatcgatctcgagctgtttctgtgtgtgtgtggctggccgggtgttcgatcgatatgatcttggagggaagtgagcggctatttaaacggccgtgcccggtgtcgtgcatggtaggaggtcacagagtgatagtggttggcttgagttggtggacgttcataaaaaattcgcgcccgggccgactctttgctccctctccgctcctttttttttcctcttctgcggctgccgtctctatcgatgtaggaatttataaacctgagaaaaaaaatgcttgtaggaatgtttagttaagcactctgttgattttattagccagctttgtcttgattcgcttattagttaagcttatactcaagcactctgtgcgtgatggtgcaccaaagcgcatgcaggcgtgtgttcgaaatatcactttcgttttcacaaaagggtgtatttgtctccctgttgagtaagaaataacctcagatgaactgtaattatgcagaaattaaacttgttgtttctgatgataagttgaacagagcttatcgatcgattgattcaacattttctgtccctagcatgtatggaactatggatcgacttgggtgattaatatagttgtatgcatgcagaggttggaccggaaaggtgggctggtggggttactgaagagttttccctgtctgaatatatggacaaactgtttcggagcttaccctgttgtgtgccattaatcattggaacacacatgataatctcataatcttgcccctagtaataatccaataaggtgatatatcaccttctgaaagcattatgcatgggaccttaactgtgagtgccaaaactctctaacctttttaaggctggttttactcatttttcttttccatagacgagtgctagataatactatcctgcttcatcaactctgcagaagaatgcgagttcctttgtgaacttctcaagtaaactatggaccccaacgtcaattcatgatcttttaaaactttttttttgccattttttctttcccaggataccaaaattgaaatgatactgttagggaagaaaaataaataaattgaagcacgaggtgtgtatggttctcggtgtgttgcttagagctgtggggttgttgcagtggagcttgttgctttgggcagattggatgtgtatgctaccttgtgatctgatatgatctgtcggttgggacccagttaaagtgtctcattatgtctgtcttagtaacaaagggaggctatggaggttagggaaccaacaactagtacatatctgaataacacacttaaatctcatgctttaaggcgagagaaccactttaaatgcatatatttgtattccatactgttttttttttgaaaagaagtattccatactgtagtttagaagagatactaccggtgacacagtaatccatctctttcttcaatggtatggctattgatttaaaaaagaaactaatgccctttcatttgtagaaaaaatataggaaaattgaaggattttaatcttgtagaaaaaaaatcctatgaatacatttgaaactatcctattctttcctttgaaattcctatgaaattgacaatcctatagaatttgatggaaagttaacaagagctcaaacctcttagaaaattccctacgagtctatctctcttatcccattgcaatgtttctatttctatttttttttgtgttttgcaattatctgttttacacttgtattcttgttaaaaatatgtgtttttcctattcctctcttttttcaacgcattgttttaaagaagccctaaaagatttgctattgttatttttttatgcagaagatctgctcttgcaataaatttagtttgatgttaggtttcataacccacaagaaaaatgcaaagagaagataaaggaaacaatgttgtatgatcgatttagccatttaggtgtcattgcacttaacaataaagggcaaaaagaatacaggaatgtttagtccagtttagtccaagattaagatatacgcttggtgttaaaggatcagcttaaccaggtaggcaattcagggaaataaaaatagcggttgatttgcaccaccatctgcacgtaaatcagcaagatttagctgttggttggcgatgtgacaaaaaaaaagtattacagccaatttagttgcgacgcaaacggccggttgattcatctgcgactatctggcttcaaggtgaagcattaccatgctaaacttctttcagtctttcaccgttctccctagctagcgatctcgtagtctgggcgtttggcttcatggagacagtggttgcatccgtttccgttggatccaacgaacccacgaaattctcactcgatctcgtgactcgtgaggcgtcagagccaagcttacggccggctggctggtcgatcgagacgagcagcagtattaaactgcgatttggtcagtcttgagttgctgtccaagtatcgccctcctctcgatcttcagattgatgagtagtgcagagtgctcgagtcaggtttctcatcatcattctcagtcgggaaaactactcgcgaccggccggccggcgaaacatggatggttacacttacaaacctcatttgcgacttgcgagcatgatcaggttcgagacggaatgatataattaactttattgtgctctagtgcagttcttggtgaacgggtgtacgtctctgacagttgcaaactgaaacgtttccagctcgttacacacacttgcatgaacttgtgctgatcctggtttggcaagtgatcaaatagactgttgtgatgaaaaaccggcaagctttggaagttcggatatggacgcctggccaatccaacactagttaacggaacagtatgtttgtttcaggaatagtgaagcagcattacgagatgtgacgggagaggtagctatggtatctatagctaccaggtgctggctggagttctgcaggcaccaaccgtaccaaactgccagcaaggctgcccaaatggtgaccgtcctggattattcataggatctctgaattctgaattctgaagtctgaactctgaacctgtcttaaattttcggccctgtttagttacgagttttttttctaaacttacaacttttcatcacatcaaacctttcatacgcacacaacttttcagtcacatcgttccaatttcaacaaaacttccaaacttcagtataaaaacacagccttcgtgtgttctttcttggaccctgtacagcaagtgcagcactgcatacctcctgcagcagaaaggtactccctccgtttcaaaatgtttgacaccgttaactttttagtacgtgtttgaccgttcgtcttattaaaaaaattaagtaattatttattctttttatatcatttgattcattgttaaatatatttttatacacatatagttttacatatttcacaaatttttttaataagacaaatagtcaaacgtatgttaaaaagtcaacggtgtcaaatattttgaaacggatggacatccgtacacgtatgatcatcagttcactgctagtacatctggcaagagagcgaggctttgctatctgaagaaattactgtgaccgcgactagtgacacagatcactcacttggggtttgtttgtttatggagggaatatggccaattccttcgggtgggcagaaactttcggtactcctaatggacgggtgattgctccctcccctcccaagcgataacccgcccctccccttactattttacctccctttcttctcttactactacaccatataaatttgaattaaaatttaaatttgaaataggcatgtaaactttttacttataaactttgggtctataaactaatatttgaattcaaatttaaatttgaaacgggtatgtaaacttttgacctataaactttgggtctataaactaatatttgaatttaaattcaaatttgaatcaggtatgtgtagcgcccgttccgtcgtggcgcctagcgggaaaattaaattctaaaaaccctaattgtgaaatccatttctttgcttgttgtcagtctccgtgccaatctctaatctcgaatccccgatcctccgccaaattcaaatcccaaatccaaatctcccaaattccatcccctctgaaaaagtttagtttgcctccctcaggttcggtgggctgatttccctctcggcccatctctctctctctatctctctctccctcagctctcccctccctcgctctgctcgtgcgccgcacgcgcgcgtgcgtgcgcgtgagccgacgccgagccgagcaccctctctctctccctctcgttctctagctctctctcttctccccgcctccatccccggcaagctctccgcgcgccgttgcctcacgcgcgcgcgcccacgcggtcgccgcccgagccgcgcctgcgccgcctagccctgcggctctgccgcaccagtggccgcgctgccgctcggacccgcgagccagcgcgcgtgcccgagccgcgccgccctcgtccgtccaaaacccggagacagagctcccgctcccatccctctccctccccaaattggcatggtgcgcacctcatttctcccctcccgtttcccgccttcctctctcggaccgacgcctcgccctccctccgttccctcgctcgattccagcgcctggacgcagaggagcagccgcgccgcgccagccgtcgcccatgccgtttgaccccgcgcccgtgagcccttctcctcgaagctccctcgccccagcactgctccgaggtcggttcccgaaccgacatagccaccccttaaaagccgcccctccccctctcgctcgatccccccgtttcgctccgagccgccgcgccattgcagccatgccctgttctccgtcgccgttcgtcgtcgcgcgtgtcggaggagccggcacgagcgaggacgcatgacgtggactccgggcgcaccctctcctttctcttccccggcccgaggccggagcgatcacgccccgcgctgtcggccatcgtcactgcgccccttcaccccgtcacggtactgccttcctccgttctccctcctcgctccatctcctccccttagactcgggtagtagcacgagtagattccccgtagtcagctggcgccgccccaagccttgccgccgcccgctgtgtgctcgccgccgtcgctgcccgagctcggtagcgcctctcatctgtaagttcaagtgccttaatttggtttcggtgattaatgataaatctaattatatgagactaacgtttttatgagcctttctttgactagtctcatttggatatggaagtaaaaatgatgagaggtatgtattaaacttcacatattctaacttggtctctcttgtggatctaaaatatagtgtgagcttcctatttgatctttattgattatgtgcatatgcgttccttcatatccatatgtatgcacatcttgagggggagcttattctatattttgtttattataagatttctatcttgatttgaaatcatttttcatctcatctctctatattgtttatatcgggttattatccatcaccaaagagagaaaagattgaaatatcttggattaaacaatttgtgtaattgttactttggtgatagatgataaaccgatgtttatgggattaacctctcttttgcataagttgtctactaggttatttcccgataatgagatgtggaagacatgcattcttttgtgatggaccttaatcatgacaaggatgaaatgcatggagataaaacgatatgtaccacttcttatctcctactttttgataggttcatatatatgatttccatgttattgatatataagtgtgagactaatgtttactcgaatgttatcttatttagtctcatttacattgagaacatggagatcatgaaggtatatgttttatgttggtctacatcattactacatatgccttctctatatgtatagaataaacccccattggtcattctataattatgcatacacttgcatctcttgtatatttatttgtatgcatatatttagggggagcaaatcctatacatttattgtgcatgttctagatctatgttgttcacctattatttatatcggatctttgcacttgagcttgcatacgagtatatgacacttgtgatgttaatgaatacacaacaaacatatccatatctttcatatgcaaccggttggtcatcaagtgaaggatgacaaccgatttgttgagactaatgttctcctttgaggtgtgaaaagaaataggtcccactacgatgaggctaatgaatgacaccatgggttagtggtcaccaagccaaggacatcgtcatgttggcaagaatgaagtcaagcttgtgatgagaataaagtcttgacaaaggatggacaagacctcggcataaacatggttcaaccggatggtcacaagtgttgatctcggctcaagcttgaccccaagatggatggtgcaaggcaaaggtataatgtagctaagaatgttttcttagtcttttcccggtcttggtgtttggtgtagaccggatttgctagataggcgctgtactatcaagaggggtctatgaagcgagcttgtggatgatctagtgtcatattagttcatatgcatgtaggtgcattttgtgggcttgtctaaccaagtgtgatgagttttctcaagtcctaaaccaagagagaagtgggcatgtccaataggagtgagtgacatcttgtaggtatgtccggtggatatcctttggagtgtgagccctttatccttgacttaagttgtgtttcttggatggatttttcatgggttggatggccctttgaataagctttccatagagtccaagaacgccaaattccgagacccgagtcaagagatatcaccgttttactaacggtcggttgagcttaaaagtgacctgcggtttgaccgtgggccttaggccggtctgaccgggtctgttagcgtggtaaggctggtctgaccggccccactggtctgttgcactggtctggtttttggtggcgatacagagccgccagagccgcaaccggtcagaccgagccgacggcggtctgttccgagtcgtggacggtctgaccggctactacactgcggtcagaccggccaggttgagtgggctcaatgattgccctataacggctagttttctagccgttacaaagtagtccggtctgactggcctcacaacggcggtctgaccggcagagcacaaagttggggatttcggttccaacggctagttttggtggttgggggtatatatacccactccccaccagcaagggtaagtttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagcatcctagacttgttactcttggaggttgtcgcctcctagacggcttgtggaggtgttgcccggtgacctctccgaggagattgtggaggaggcccggcaccgtttgtgagtggtttggagttcaccacctttggagtgaaggaagaactaccccgagtgatcgaggcttgggtagtcctctccgtgggccagctcccgccttgcccaccccttgacgaagggggcgtgcggtggcttcgtggttgagctgtgaagttgggctcgccttaacagggattaggaaaccggcgagtttttgaacctcggtgaaaaattccttgtctcttgtctcatttatttgttgcatttacatttgtactatttacattcatagagacatatttgagcccatatcacttaggtttgcaaaacttaacttagttgcttagttaaccttgctcctcaccttgcctagcaacttaggttagttttgtttaagtgccattaagttttaaaaccgcctattcacccccctctagtcggcctccttgatcctacatcgtcgccggcctccctcggtgcgtttcctcctattccggcgcaaggaatggattcccggagtcgcgtagatgctctagtgcgaaggaatcaaactcccgtcgtgccgtcacccttttccccttctctcgccgctagttgccgccgccgcaatccgccgccgtcgcactccctccggcgaatctgagccgttagctcgtctcctctagtcccgcgctacctcccagtgtgctcgctttcgcctgtatcgccgtggttcgccccgccgttcgcagccgccgtccgccgtccgttccggccgacgccttcttcaacctcccgccggcccgcgtggcagccacgtaggcgccacctcggccaggaccgggtcaagctgaccccggtccgccgctcccctccgcctcgctcgcgcgcgcggtccaccgcgagccgtgaggctacgcgtgggcccgccacatccgcacccaccgtgagccgcgcgcgtgcaccgcgtccctcccccgaaccctagcacgccaccacgtgctccctccgcacggtgaaccgtgtcaccgacaagcgggtcccactcggggccacgcgaggtgagcccggtccaccggctccctctctcctcccctcccgcgtgcccttgggctgccttctcgggccggccggcccattaagctcggccgagccgcccctttctctcgggccgcgccttagctgcccgagggaagtctattcctcctccctcttcctttttctttttccaaaagggtttaattaaatcctttttcctttagacaaaaatccaataatcttagaaattcaatatcttctcaaccgtgtgtccgtttgactccgttcgacttccaaaattccccaaatctcgagatctatctattggcacgcttagaggtcaataatagggctttgttttcgccgtttgttgagttgttccgtttcgcgtgtagtttcggagcccgaaagacccgcagtgcgaggatttcgaggatcaagctcaagatctcgagcaaggcaagtcacctttgatcatcttgcacctataatttaaatctaagtatttcttttgcacaaaaatattgcataaataggattatcacgagtatttcggccgcggcttgcgagatagcctgccggccccaatcctaattgctgcaattaccctccttgaattattgaatacttaaacctcctttgtcacctgttgtgcttcgatgcacgggccctcaggcacgcgcatcggaacacctcccctcaaattttaaaaaatccaacgatgggtaaaacttggggttttacaaaaagacttggaaaacccgacacctgggtcggtgcttgcgaactaaatgaatttccaaaatcgcggaccgggaaacgtaccgggagtacggtttcccgctcttgcacttaaggaccgtttccttggaattttatccgaacataagacaagtgcgaccacatgggtgtaatgggacgtccttggctgagtaattagctaatcgggggaatcatgatgccaagagacatgtggattcaacggggtggtgccggggagaacccccgggtttcctggcacagtatggtctgggacctaacctggtgttggtctgggacccctctcgttggcatatggtgaacctgtgtcggctttcgaaatgccttgtcatgaaagcctcaaggtctccagacgtggccgttctgcacgggctgggtgatccgggttagtaatgtcgtgtgggtaaagtgtacccactctgcagaggttattaaactgttcgaacagccgtgcccacggtcatgggcggacgtgaggtgattcctagcgtagttttgtttgactactgctttgtgaaattgctgttgtggaatgggatcgatgtttggaaaatctgcggctgatgggatcagctaggcccgggtggctgtttgaaagcgggtggccgggtgccaaccttgaatcaattcaaagactgatacatcgcacatactccgaccggacgagacgcactgtctcatccgtgtcgtttgagaagcacttagttgtttcaaaaaggggtttaaataaaatcaattgcagaaaaacaacagcctttcctttgaagcctgcattaaatacttaattcccatggcttgctgagtactcctgtactcacccttgctctatataaataattccccccagttgctgaagaagatgaagtggatcccgctaacgaggagttcttccaggagcaagtcggctacgatgagttttagggttttggcctagttcccaagtcgcgcctgtgatgaatggtccaagtcttggctttcgctttcccttttgtaatgcagttgtgagctcgggatctgtccgcagcccaacatgactgtactcctactctgcaataaagagacctctgttgctgtgaaattctgtcttcctgtgataccagcactgtttcctgggactggtatcgattgacaggttaatttggagcgtcacggactagttccgttcggggctagttcggggcgtgacagtatgtaaacttttgacttataaactttgggtctataaactttaggtgtataaactttagatgtatagaaatactatatatagaaaatatttgaattcaaattcaaatttgaatcggacataattcaaattcaaatttgaataagatatataaactttaggtctataaactttaggtgtataaactttagatgtatataaatactatatataaaaaaatatttgaaatcaaattcaaatttgaatcggatatataaacttttgacttataaacttttggtctctaaactttagatgtgtaaacttgaggtgtataaacttgaggtgcataaatttactaaaataggaaagtaatgcggtgccaaaaaaggaaaccaggtggaggaagggggaggagggggggcgggttacccgatcgctataggcgagcgagggcgatccctcgctcagtagcatttccggaaactttcggtttctttgtccatcaatctgtccaaacatggggggcctaatgggcgatcgatcgccaggcaatcgcccaagcgatcagcccccctcccctatactccatatactcctccctcctctcccctcttcc

SEQ ID NO: 62665 - DNA, 1044 bp, Oryza sativa
ccccctcccctatactccatatactcctccctcctctcccctcttcctcctccccttcttctcttcctactacagtacaccacatgaattttttaaaaaaacaaaaaattagaaaaatttatgtataaaaatactatatataaaaatttgaattcaaatttaaatttgaatcgggtatgtaaacttttgacttataaactttaggtgtataaactttagatgtatagaaatactatatatagaaaatatttgaattcaaattcaaatttgaattcaaatttgaattcaaatcggctatgtaaacttttgacttataaactttaggtgtataaactttagatgcataaaaatactatatatagaaaatatttgaattcaaatttaaatttgaaattagatataattcaaattcaaatttgaatcgggtatgtaaacttttgacttataaactttgggtctataaactttaggtttataaactttagatgtatagaaatactatatataaaaaaattgaattcaaattcaaatttgaatcggatataaaaacttttgacttataaacttttggtctctaaactttagatatataaacttaaggtgtataaactttagatgtgtaaacttaaggtgtataaactttaggtatataaatttagtaaaatagaaaagtaatgcggtgccaaaaaagaaaaccaggtggagggagggggagggggattgatcgctacccccgtcccaggcgatcaatcgccgattaggatttccggtccaaacaagaacgtggttcgtgcatgattgtcctgaaacatttcagagaacaagatgggccaacgaagtggcccaagctgagccctttatcgttgaattcggtaaatcatgttttgatgtccttctggcattagtccactctcagtttgtgatatagtactagctaaagacccatacgttgcagcggatcttataaaagataaaaacaaaagtaaaaaaataaatttatagtataattagttgattaaacatataatgtcatctacaaaagca

SEQ ID NO: 62666 - DNA, 5295 bp, Oryza sativa
taagcccttacttgtttgtactccacaaatcaagtgagaaatcaagtataagtcttgtagaactgttaggcctaggggtggaaacgagccggctcagcttgcaatggcctgtaacaaactaggcttggcttggctcggcttggttagagaaacgagctaaaatatgagctcggctcggctcggctcaagccagatcgggctggcttgcgagccttcccattgaagcatctcttcatatataatttgtaatcattaagaaaatcaagaataaatcatcgacatatataattaaaataagtccatatatttaattttttcaaaatctagatatgataaatttcatattgacaaataataacttcacaataaaataaaatcatccatataaagtacatgataaatttcatattgacaaataaaatttcatattgacaaataataacttcactataaaataaaatcattcatataattacataatagcctaggctcgcgagccaacccgggcttgactcattttagcaacgagctgaaatggagacttgggcttggctcgtttggcatttaagctgagccgagccaagcgagctcgagccaagaccgagctaagctcatgagtccgagcttctttcccgcccctggttaggccccatctttttttctcttacatattatatattactattacaagagtgttttctgaacttttaaatggctatttttttcctaaagaaaagttatatgtatataagtttcttaatatagttaatttaatagtttgtacccccaagtttgttaagaaaaccagacaatcaattatatacagacaaaattgatcaaaataaaaagataacaaaattaccccgagcagtcaacctgaaagtaagattattcagtggcggagctagaaacgctagaagaatttagttcaaggggaccaatattgttagtttttctatgtttgctagagttataggaaattcggtgtaaaatttgaagcctggggaggccaactggccaagcccctcctgtctccgccccctgagattattgttcattagcaaaatcaagacaagacaaggacaaccccagatgcacggactgaaaccaaaacaagaaggcaatccagcctccactctcgcatctgacgtcactgctttgctgctatcttcgcttccctggcgaacaagtatattatccaaacccttcctagcaacggccgttccttgtttgacttgttcttctagtaaagaaaaccaaaaccaaactataattaagcagcgtgaagttctttcttgggaaacaaggtcgtcggagatactagcagcgatgattaatgaattcacagtacaatatcttttcatatgcagctagcctgaaatgagctgcttttcctcatgaatgacggcctatatattccatcgccttttcaggttgtaagttgtaacaattggacgttggggttacacgcttcagcttacatagcctccaatatatttggtggcaccatgagagatgtggttataatcaattttcatttacaaagctatctatttttacatattttttcttcgtatttaaatgcatgatgctattgatttttgacaaactatttataatattaaacaaattaatataaatacaaaatatataagtaatgtttaaattaccttaactgtagatgtcaaacatttggtaacgaaaatatagtatttattagattttcagatctaaccattgatttaaacatatggtgttatcttgatcattgatctataccgtttatcacatggagaatttgtgttaaataaaacatggcattgcaaatactataccgaaaaccctctttgattaaacttttttttacacaatataaaaagtttaaaatgttacttttatcatttatacacaatgttactttttatctgagtgtgcgtgcgttgtgagtgtctacaccgtactgtgtaattctaaaaataaaatgtacgcttcctgaactgctcaacaatgtgtttttataaaaaaataattttatataaaattacttcaaaattatattaatcctttttttattttaactaatatttaattaatcaaattattcagttttacgtgcgaaaaggtgaagtttctaacctcaatctccgagcttcaacgcagccagggtgttaccctagctgatgggacggaaaatgttaaaaaaagagagcccaacacacgattcggcgacctcacaccgtccaacaatttcgatccgacggcccaaaccgccgcaacgacatcccaagagagcggagctcggatcggaatcccgtgagcgcccccccaccgaaaccgcggtcgccttcgtccgaatcgtctcggtaaaacgccttctccccctcctcttccgccgccgcggcgatccctctttcacctccacctccacctgctcaggacgcggccacgcagtagtcgcggagaaaagaaaccgaaaagaaaaaaaaaaatctagctacgcatctcggcccggcccccccgccgccgcgcgctcggatcccccgacggctcgccgccacggcgccgccgccgccatgagcctcgcctcgctcgcccgcgcgctctcccgccgctccgcgccctcctcctcccgcgcgcgccaggcaagtctccgccctctccctcttatcttccctgaatcttccgccaccgcgtctgggtggggggctgattgtgtggatggcttttttttagggtttctccctcggtgggctaggtgggaccaccaggtcgccgccgccgccgtcgtcgccgctcccatcgctccatggcggggagggcggtgggctgggattgggattcgtccgcgggtacctgacggcggcgctggggaggcccgccgcggtgaaggctgggacagactggaggtccatcctcgcgaacccgcagttccggaggctcttctctgacgggtccaagaagagtgagtcccatccgcccttttttgatcggttcggatggatggctttaggtgctaaaagtttgtggttgtgtttttgtgtgtgtgtgtgtatttttatgatttttagattacgagaactactaccccaagggcaagaaggaggcgccgaagggggatgggagtaacaagtctgattcgaagcgtaagttgccgtcttttttttctcggttgcatcatttgtttgtgtggagaatggtgatcatgttgtgaaattaatagaatgcactgcacagcttttaatacaatagcatgtaactggtgtactgattgtcattgaaccaacgaggtgaataatcaggacatgttatttttcttgcgctgcaagtgcttggtcgactgatgccaaatggaaaaatagcttgtgtagtgcaaccaatgatggcttgtgagcctatggtgtacaaccacttacttgtcagtgttcttaaaaaacgaatgcaaactagatccttgttcagttttaaaaaatgcagggatacactgtaatttagtataaaaactcagaacctcagtggttatctaacttaagaggctgaaccgctgaaccaaataaacacagtagcacagaaagttccagattttggtctttgctagatcgttagttctctggaaattaaaacgtgccgctgacctagcactttcatcttaataatttctttgggagattagtacgggttttgatggagattggagcctagattttagtggctggaatgccaagagtccttttgagggcaacaaaataataaactcttagtgcatcattgcgtgtgggctaatgtctggtttgatatgcagaagattcaagtacagacgatcaatggaatttccaggagactgcctcaaagcaattgcaaaattttctggcacctctactgtttcttggactgatgctctcgtccttgtcgtcgagctcatcagaccaaaaggaggtaatttttcactcccttctgagttctgacagattatattcacttgttctgctatgcacatgaatctcttcctatatactagaaaaaagtggatggaagaaaactatgttgcgattataaggactataaaagttgtacttaccccaatcaaattactgcaatcagctattgagcattctgtaataaatagttcaatacaagcagtactagatccagatggcagcaatacattcttctcaccgtgaagttttatcttaaactgacaaatggtagagaaaatacctgccgctcctctttagatggtttcaccttatgcctgcaccagtcaacatatagcagacaactgattttgtggttgcatatttattctttttaaatctatggtgaacaattattctcgatcttaaatggaatctcaagatattttgcttcaaatttctgcagataagcttccaggaattcaagaataagctactagaacctggtttagttgaccgcattgttgtttcaaataaatcagtggcaaaggtctatgtcaggagttcaccacagtcgaacagccaaggtcagaacactgatgccatcattaccaccaatgatgttccgagcaagcatactcccagcagatacaagtattacttcaatattggaagtgttgattcctttgaagaaaagttagaggaagcccaggaagctttgggagtagatccacatgattttgttccagtaacttatgttgctgaagtgaattggttccaagaagtaatgagatttgccccaacagtctttcttgttgggctaatatatttgatgagcaaaagaatgcagagtggttttaatattggaggtggacctggcaagggtggccgtggtatttttaatattggaaaagctcaggtgacgaagatggacaaaaattccaaaaacaaggttagttcattctcttcttctgttctactttgaaacgactgtcaaatatgaaatatatacatgcacattgattctcaagctctgctagttccacctattcaataatgcagtagctactgcttaaacgttgttaagttacaataaaaactgtataatgacaagcttttctgttggtccaggtgttttttaaggatgtagctggttgtgatgaagctaagcaagaaataatggagtttgtgcatttccttaagaatcccaagaagtatgaagagttaggagctaagataccaaaaggtgccttgcttgtgggtcctcctggaacaggcaagactctgcttgccaaagctacagcaggagagtctggtgtgcccttcctgtctatttctggatcagatttcatggaaatgtttgttggggttggaccatccaggg

SEQ ID NO: 62667 - DNA, 1379 bp, Oryza sativa
agattaccatgcaacattttgaatctgcaattgatagaattattggtggtttggagaagaaaaacaaggtaatgtgaatatgtgattatgtgccagtttgaagataatctactccaaactgttaaagcaataaatgcaacctgcaaagctgattagtgcctgatttacacattactccagcattgtgtagttctgtatagtgctctcatgtgaaccggttatgctctattttgatacacattttttgctggtttaatgactatggaagttttgtttttttaaaaaaacaaaaacaaaagaacggtacataatgactagtgcattcattaagttcctgttctaggtggaccttaattaagttaagtgatttgtgaatgtggcatgatagttcgtgtagatcactagatggttgatcatgcatgaatgtttaggtgagagtgctgtaaacaaggtaaactatataaaataagtagtggatctacatgcaaatataaaaaactctaggtcttactcagaaatggatggtcacttaagtgtacgcaaaataatgatttctgaaatttgtggctttgcacacacaatatctgcagtatgtttcccttttggaatgcccaagccataactgttttttcacctttaacttgttccatagtaaatatataaaatatctactttcagtaagggagtaatgcacagatcaatgcttagtaacttagtaactttcttttatatgaaatgacttgttctcaacatgtgatagtcatgtttccccatttatttttcttacctcttagcctgttaatcaaattgcaggtcatcagcaaactggagcgccgcactgttgcttaccatgaatctggtcatgctgttgctggatggtttttagagcatgcagagcctcttctgaaagttacaattgttccccgtggaacagctgctttaggatttgcacagtatgttccaaatgaaaatcttttgatgacaaaagaacagctttttgatatgacatgcatgacattaggtggccgagctgcagaggaggtacacactaattcttttacagtcttatgactgatttatgttaatagctaccttttgtggatatatctttcaaattcctactgctgagtgctgacacaccatttcttttcagtcttcttatgacagcatgcgtgttatgtttttatgactagaacgaatacaaggtttttctgcatttgacagctgtaaaaaaattaaaaaaaaatggttaactaggttacagtttacacattcaattatgatgacttggtgaatacgagtaatattatcacaatttggtagtcaaactcttgttggtttggttacatcaagacttcaaccatttatgactctaacca

SEQ ID NO: 62668 - DNA, 1246 bp, Oryza sativa
ttaacctttttctggtaagatagctacatattcttgttggcttcaatactgtacttagtctagctttgtttagttcctttcatttggtgatggcctgctcgaattaatactcgatcgattatctttggatggatatggcatgatacgagctgggttgcctgaacgtcgcatgcagtgcagctagctgcaccagccgatcgagactcgagaggttggccatgcaaagcattctctgtagctagctttggagtgtggctaaagtcaacctgcagggtgcatgactagttgtatatagtttcattacattgaatagttgtttaagattcttcattgccttaattatcacgcacgatcttaattttctgatgcaattatttatcctgtaactaaacacaagcaataagtataaatgaaccggtacaatctaatatccattaatcatgtcatattaaggatagaaattactctgccatccttaaaaaaaggttgatttagaaagtcaaaggcatgagaatatatatgtaatactattggaaacacacgtatatttcttctataatttttggtgatatgtgttagtcagtgtgcatgatatatccatctgaaacatgtgtacacatgatatgttcttattgatacataaattaaattggtacccttcatgggttacctccatcagtttgtgaattgcatgcacaaactaaaaagaggaaaaaggcaagcaccttaaagtcacatgctctcgtttttcaatgtcatttctaagagcctcatcggttgctcatattatctaatagaccattttggcttattggggaataaaaattaatttataggtaagacttttacatgtgttttgctaaaaaaaatactacgttgaaaatacattaaaatcaagtttgaaaatttaaattttggctttggttttggcttattaggccaaccgatggggctgtaaaaaaaacatgatatttctggtaaaatatgggacataatctattatctataaattggatcaacctgtgtgcatatgaagagagagagagagagagagaaatcctactacaacatataaatcactctaattaacgatgtaacgttatagtgtatattatcaaattttaagtgaatatcttataataactatttagatttagatgacatgtacgaaacagaatttaaaagttttatcctttaatttacataagttagcagatataggaagaaatgacgggggatttgagca

SEQ ID NO: 62669 - DNA, 8736 bp, Oryza sativa
ctttatatgtatgtatgattaaaaaaaattaagtgagaactatatgatgttcccatagttctgttgccaatagcgaaaactcaagcccccgtcgtccactgctagatccgtccctgagcacgttggcatatattagagtttgtgtcgaatatgtgtatgtagtcggttacagtttaggattagagtatgagttggattctatactaggttctctcataaataaaggggcgtgcctgttgtaaccgcatggcgacttagtatagcgagaggaagcggctgccggcggcgaccggccgtgagtcgttgtaactctgatacgctgtatatgctggatcggggaggagcacccgtaatcagtgcctcggagatgtaggcctcggctgaactccgttatcaaatatcgtgcctcggtgtcgtcatcatgtttggatctatggtgttttcttccgcgtttagctaccgatgtcgatttcagggctggttttataacagcatatttgtggtgaactcgtggccattaaaccgagccacgagattcgcaaaggccgaattcggacgcctgagccgtcattttgctcccccaaccataacctattccttggatagcaatcaagcatagcataacacagagacggacaaaaagcatgttggcttagcgagtaaagtgtccttgttaagtgactgcacatatagccggtcttttcatatatatcatgatcaaattgtgtgagccccattgtggatgatgcaacccatgcgtgtcagcgtgtatatggcttctgatggcatgggagtaagtaaaaaggtccgggtagtaccgatctgtagtaatttcgtttccggtgtgccaagccgtttagccgtcgtcgtgcgctaaccgcatgcccagctctccctttttcttcccccaagcatgatccaacaatgatgaaaaagatgcttgaaaaagatgaccaaagggggcttatcaccatttcttgttttagctgtgacagttatgtgcatcctaggctcctactctctctttatctttttttaatattgtaagacttttttgatttttttagtcaaaacattttaaaatctgatcatgttttatagaataaaatagctacatttacatcatcaaaatagtttaattaaatataatattgaatatattttgatattttgtgctgaaaacgttgctacggttttctataaatttgatcagagttaaaaaaatgtttgaataagaaaaagaaaatcaaaacataatggctatgttcggctacactgatatttaccagctgtagtgcagcggctgtgtagagcagctgaacagacccaatatgaaacagagagagtaggtagtagctccatttcttcgtattcctctgaatattattcgaaagcacgggcatatcactatttactggtaaaagggcatggtttttcttttatttatccaacatattagtactgcagccatttgcttacatcaagttgcttagacaacttgttttaaataatatactataaaatttaatctacttttataaataagttgatcatccatcaatcttcatccgcatgtaagagcactagatcagcaaacggttcagagaaacaattgcctagggtttgagtggaactcgagtattgattgagtgaaaattgcctatggttcagataaacaatcttgaatgctcatgtgttggggagttagccatcagccctgtattgattgacggtactaagctcctacattatgtcggcaactgaacctacttccctaactctatgagtagataattgccgtttgatcagggaactatacttatggttgacattttgttctaatcacccaccaggcttctacaacatgctttccagagaactaaatttctcgtgtgcatgctaccaaactaaaatgtagacaacaggtatcaaaagtgagaattttgttttggggaattgagaaaagttgttaaggtatgcagttcaatgaaggattaatgtactatacttcacatccatgcagccatacacacctaacaccttcaaagggaaagaaagtgaagagatctagcgtggatggaggcaagtagctcatcctagtgacagatatgagtttgttcaggcatccttctctgaatccggaagaggcttgggggaagaggaaaacatgaccaaacttcacacgcgacgagtacctgctaagcctatctcacacgaattctcccttgattttgatcgagcccatgcatgctccacagactgtttttttgttggccatttgcaatgcagtcatccaggatgatgatcaacagagtaacagactaccttcctcctcgtcaagtcactgtcttgcgagtcttttgttatttgctcaattgctcgtgcagtcgcttggcatgtaagaataaggttaggaaaacctatgctagctcagctagctgaagaaaagttgtggcctgactagcagtggatgcactgcaccagaggcggtcactcccttctctgaacttttcccaaaaattcctctctcaaagcaagaattcaactactgttgatttaacatgtttctgatgggttggagcgagagaaaaagtttcagataaaaccacactgttaattgatcaataatcactgttccttctcaagtagtcaatctaataatcctgtatatattttctgtttgttaagcacttttatggagctttaattgtgagctactgttgtggtgccgtcgttcggttccatcaatcaaatctagctaaccatgccggcatgcccaataatgctgttccaaatttagattttgcgtggtttccactacaatacataataagaaagtagtagaatttaatcttagaaatttaagtaagaggcttcagtctattcttcttcttttcttccttatcacaaaaagaatgtagtacctaattattgctgtgtttagttataggataattgcagcagagaaagattgtgcgtgatgattaaggcatgaaaatcttaaacaactattcaatgtgatgaagcagcatacaagtatacaactagtcatgcaccctgcaggttgactttagccacactccaaagctagctacagagaatgctttgcatggccaacctctcgagtctcgatcggctggtgcagctagctgcactgcatgcgacgttcaggcaacccagctcgtatcatgccatatccatccaaagataatcgatcgagtattaattcgagcaggccatcaccaaatgaaaggaactaaacaaagctagactaagtacagtattgaagccaacaagaatatgtagctatcttaccagaaaaaggttaatgaacttccttttgtgtagataactttgcatgcttctggccaacacactgccattgcaagcatagctcctcgatctcatgtatatatacacacctcgagttatggccataccatcacaagctgagctagctaagagcgagcttcattaacatacgagacagagaggtcagtgaaggtagcaatggcggcagcctcctctgttcttcgttgctgcctcctcgtcgcagcactgatgacgctgtccgcaatgggagctgaagccatcacaaggcagtacctattcgatgtaagtgcatgcatatccacggtgtggtgtatcacatcgatacacaagtttcgccaaaaaaaaccaacgcgaatttgccgtgacatgcatggcaggtgcaaacgacgagcgtgacgcggctgtgcagcacgaagagcatcgtgacggtgaacgggcagtacccgggccccacgctgttcgcccgcgagggcgaccacgtcgaggtcacggtcgtcaaccactccccctacaacatgagcatccactggtacgtacgcctcgcgatttccaccgtgttttgacgccaaaaaacccagtgttttcaccgtgtgtgtctcacgtacgtgtgcgtgcaggcacgggatccggcagctgctgagcgggtgggcggacgggccgtcgtacatcacgcagtgcccgatccagcccgggggaagctacgtgtacaggttcaccatcaccgggcagcgtggcacgctgtggtggcacgcgcacatctcctggctgcgcgccaccgtgcatggccccatggtcatcttgccccctgccggcgtcgggtacccgttcccggcgccgcatgaggaggtgcccatcatgttcggcgagtggtggaacaacgacacggaggcggtgatcagccaggcgctccagaccggcggcgggcccaacatctccgacgcctacaccctcaacggcctccctggccccctctacaactgctcagcccaaggtgattaattagtgactgattttgtttaatttagtcgtgtcacaatgtgtgacaatgtgtggtggtttggctgtgcagacacgtttaagctgaaggtgaagcccgggaagacgtacatgctgaggctcatcaacgctgcactcaacgacgagctcttcttctccatcgccaaccacacgctcaccgtggtcgacgtcgacgcgctctacgtcaagcccttcaccgtcgacacgctcatcatcgcgccgggccagaccagcaacgtgcttctcaccgccaagccgacgtacccgggcgccagctactacatgctggctcgcccgtacaccaccacgcagggcaccttcgacaacaccaccgtcgccggcgtcctcgagtacgacgacccctgccccaccaccgccgccggcaagatcgtccccatcttctcccctacgctgccgcagatcaacgacaccaacgccgtctccaacttcaccgccaagctccgcagcctggccagcgccgggtacccggcggcggtgccgcagcaggtggatcaccgcttcttcttcaccgtggggctcggcacccacccctgcgccgtcaacgggacgtgccagggacccaacggctcccggttcgccgcctccatcaacaacgtctccttcgtgctcccggcgacggcgctgctccagtcgcacttcgccggcaagtccaagggcgtgtacgcctccaacttcccgtactacccgctgaacccgttcaactacaccggcacgccgccgaacaacaccaacgtgatgaacgggaccaaggtgctcgtgctgccgtacggcgccaacgtcgagctggtgatgcaggacaccagcattcttggcgccgagagccacccgctgcacctgcacggcttcaacttcttcgtcgtcggccagggcttcggcaactttgaccccatcaacgacccggccaagttcaacctctacgaccccgtcgagcgcaacaccgtcggcgtgcccgccggcggctgggtcgccatccgcttccacgcagacaacccaggcatgtactctgaaccacatcgattcccctgcgattccacatttgcaccaacttaatttagctttagttaatcagtttgcaattataactcatcaaagatacttatgccgatacgattgcacgatctcaggtgtgtggttcatgcattgtcacttggaggtgcacatgagctggggactgaaaatggcgtggctggtgctggatggcagccgtcctgaccagaagctcccgcctccaccgttggatctcccaaaatgctaggaataaaactcaagatcaatggtcaatgattggatcacttcgcactgcccctgctcacttgtccgtcagatatttttctgcttcgatttctcgtcgttaactggcttgcttaatttgttgcttttttgataaacttatttctcaggcgattgacagtttgtttgtcatcagttagctccggtgttttgcatgaagtttaaatctttggtgttgtgaggaaatttgatttctttgattcgcagggcttgactcttaggactgcttactgtaactcaaagctcgcgggcttttgcatcttgtaatgtatctcaatgtattttgcactaataaaatgtacttgttattgaattctgtcaggcgcatgagtccatatcaattttcagttcatttacctgtttagttatagcgaaatatatatgtcatctttagaactagcatggtggctcgcgcaaattgcgcggttagcatcattatattttctctcatataataacatatatgttttctcattatattattaaaatatattacaatgacaacataattttaaattttgcaataactttacgaaacaactaatgtgtaatattcatattgtattttatatacgtgttagttattaattatttttaatatcaaaatttagttatttgtaaattatatatattcctatatggactctagacttgtgttttaatatttctttttttaattctgaatttttattatttctaattatatttctatgtggactctaaactcatctttcaataatctttaatttttaatttcaaatttcagttacttctaaattgtattcctatattgactttaaactcttcttctcatgtttttcttaatttcgaattttagttatttgtaaattgtatttttatatggactctaaacactacttttcattttattatgtttattccgaattttagttagttttaaattcctatatagactctatactctacttctaatattcattattttttaattccgaatttctatttttttttcttaattgtatttctatactctacttataatattccttatttttcattccgaatttctattatttcctaattgtatttctataagtactctatactctacttctaatattcctaatttttttaattccaaattttagttatttcctaattgtatttctatatggactctagtctcctcttctaatattccttattttttaattccgaatttcaactatttctaagttgtatttctatatggactctagtcttctcttctaatattccttatttttttaattccgaattttaactatttcttctaattgtatttctatatggactctagtctcctcttctaatattccttattttttaattccgaaatttaactatttctaaattgtatttctatattgactctagtctcctcttctaatattccttattttttaattccgaatttcagctatttctaaattgtatttctatatggactctgacttttctttttctccgattaatgtgagaatttttagaccatgagagcgaacgtggaggctcctttttctattcctttaataatataatagatttgggactctctacaactttgtgtgcttaatatttgaacaaataattcaatagacaaaggcaaacaaagcaaagctagtacaatctcattgttatgtataggtgaattttcaatgttttgtcattagcttaattaatcgcttggctaaactggttggtgcacgtaatacagttcacttttggtcttcgcttccgctgctcttcgattgctatggaacacttgagatcttaacttttttgttgatcgattgatttttattttgtcagttatttccttttctcaaaggaagctctcgcattttttttccccaaacagactgaaacaaaggttatttagttacacgggaaatcatggcctcatgggtagcggagaattacgggagtttttatgttaccatgggagaaaattgcaaacttctcaagcagaccctaagtgaatttgttgtaggatcgagctctcgtcataggtccaatttaaatcaaaattgctttattatatgtgcatccacctttttattcaaaatagcagatcgctatctgccctcaaagtagctctgccagatttctgaaacgccattgaattcaattaatgattttcataataagggtagtagtagaaacttctggattaattacttacgggatttcgtcatataatagaccccgataacttatccagcttcataaccacgtcaaacgtcagattggaaggactctatctcgagacttctcgtcattgacatcatgaaatcacaatagccaacaacgaaaatgtccgaaagtctgttgaaaagctgacgccaggacaagctcaaatcatgatcctcgactagctcttcgtattcatttaaaacagggaaacactatggccggcgaaaagccaactgggttcccacatcagagattaggcgagggcgttaatttatacaaattttcttatgctgcaacaacaaacaagaatctatcgaataggagtgcaatttacagctgtaaatttgctgcaggattacgtgggtacaacctcgccaagcgagggtgttccgtcatcatcaggctgaggggttttggccgcctcttggttcttgctgtcttcttcatcctggaacccttgcttgaagaggtcgtagttagttggctcggatgccttgaaaggccgttctcctaataccctaaccaaatcgtcctggtggaggacctccttctcaagcagcatttcagcgattttggcgacttgctccttgtgctcagttatcagttccactgtttttttgtacgccttgccaacccattccctcacctcatcgtcgatgatggatgctgtttggttgctgtaaggtttggtcatttcaaagccatcgtccctctgagggaaggacagaagcccaaccttttcgctgaaaccgtatacagcaacctgcgcataggtcattttggtaactttctccaggtcattctgagcaccagtggagatccttccaatcaaaacctgtaacaaggcaatcaaaacat

SEQ ID NO: 62670 - DNA, 6416 bp, Oryza sativa
tgaccccatcaacgacccggccaagttcaacctctacgaccccgtcgagcgcaacaccgtcggcgtgcccgccggcggctgggtcgccatccgcttccacgcagacaacccaggcatgtactctgaaccacatcgattcccctgcgattccacatttgcaccaacttaatttagctttagttaatcagtttgcaattataactcatcaaagatacttatgccgatacgattgcacgatctcaggtgtgtggttcatgcattgtcacttggaggtgcacatgagctggggactgaaaatggcgtggctggtgctggatggcagccgtcctgaccagaagctcccgcctccaccgttggatctcccaaaatgctaggaataaaactcaagatcatatcaatagtcaagattggttgcatttgcatcgcttcacacagaccccacttactgttgtccgatcagatatatattttgctgcttcggtttctcatcgtcgatcgacatgcgtgcttcatttgttgctttttttgataaactgattttctcatgcaattgacagtgtgtttgtcagctagctccggtatttgcatgaagtttcaatttctttcgtattttgaggaaatttgatttctttgattggcagggcttgactcttaggactgcttactgtaactcaaagcgatcgcttgctttgcatcttgtaatgtatcccagtgtattttggtgcaataaaatctagttctggtacattgtccggccgtatcaaatttcagctcattagatggttagttacagtgaaacatctttgtacagaataaggactccacaaccttatgtacttgtttaattattgtttcctccttatgtgtaagtatcagttaatatttttaaccaaacaacttaaatagatgaagccggataaagcaaagatttctatatgtattaaagtataagtaaattactcgtattttctcattagagacatcggtacggtgtgtgatagtggagtcgtggcgtcgtaggtgcatgactatacgatcgacccacagggtttaaattttgttatccacaaatatgctcaggtgtatctttaattgtgtagagggttatcagtgcatattttggtaatgctaaattttcgtatattttggtattaccaaatttcggtagtgttggctttgtttgttttgatgcttttgtcaaattttgatagagttttaagatataaagcttctacaaactactaaaatttaggaaggtagcaatggttaaagtgtgtttagtttgttgtcttatcaaaagttggtaatgttaaaagtggcaacaaacctttcagcgtttcagtagtagtttttattttaccttagcagcccttttttgtttttctctttctttcttatcccaggtaatggttgtctggctgattgtgttgtgtaacaaaaaaaaattctactttcttctaatatattaacgtgcaattattttacgtcttcacggaaaaaaaaagagagaaagtggtaacaaactggacatgccttaaacagctagctagctggtatctttttttccccaatgatttgttctgtcatatatatatatatatattattttgtcaatgattcatgcttaatgcatgtgttcaaataaatgaagggagaaaatcaactttgttggtagtatgtattttagttgtgtgtattctaacaaaaagattccaccagcagccattcgctagagttacctagaggatagcatgacggtccaatcaatttggagtatacatgatctgacaatttgcataacggacgacacaacagatgatgcttgccatggtgatcagcccaagatcagttcaagcatctttttcgcagttggatcatgcttgggaggagacgcgaactactacagattgtgggtatcttattagctcggacctttttacttactctcataagcaccaatgagaagccatatacacgcatatatgcatgcattgcatgtatatatgtacagtggaactcacgcaatttcactatgtgagcagtcacttgacatggacaccttacttgctaagacaaggccctttttgtccacccctgtcatgcttgattgtaatccaaggatagattatggttgggggagcaaaatgacggctcaggcgatcgtcctctcaccgagcatatgggtctgaataattctacgagcccacgacaaacttgcatatatgccaacatgtgttcgggtgaggggatatattaagtgtgcatgttctccacctcatttcatacatgtcctctaaatagaagaaatgttttcgttggcagccggcttaagtcagccccgagcaaaaattgtcttcattggctgctaactaagggctaccagcgaaaatatatctttactagcggttggcatttgatgatatgaggcccgctagcgaaaaagcattaaactagttgatagacgacaagtgacccactagcgaaaactattcgctagctgcttgttgacacgtggcccgtccgcgaatatgtttatatattttcttttttacaaaatttgaaacagtattattttttgtttgttttgtgtattttagaattacacacagaggatataactgattgagctatcgatagctttatatttacatatttcctacatgtgtgctttttcagattttttaagtacttccgtggaattctaagattgaagttttttttgaaaaaaaaaactaagattgaagataatttccaagtttctacctatttccatcatatatttttataagttatcatgctaccagttaatttttgtatcatccttctgacgtgtgacagacatgttagtgttgttatatcctcttgagtgtgcacacgtttatatgagtgcttacgtctatactgtgtgttttgaaaaaataaatgtagcctctctctctaaccaaatttaattatttctaaagttttacacgatgattaattaagaaacactagtacagatccttccatctgtgacggcccataacaagactggaatttgcgggccgtcacaaggaagtaatctcaatcgggccgaagtttcgcccgattgagatatggtcgcacaaccatggtatatcggcataaaactaaagcccgtcacggatgacacttatctgtgacgggccatagttataggccgatataccttggttgtgcgaccatatctcattcgggcgaacggcggcccgatagagattacgcccatgagacggcccgcacatccccgtctggttctgggccgtcccggatggtaggatcggggcaggcgttatggagcgattcttcgtgtttttccctaggaatagggcagctggactacagtgaccagcatggctgaaccgactgactaatattaatcattaattgagcaaattcatcacgtcttacttttgcaatactgatcttataagatgtgcatgtaatttgttttttttattttgtagcaattgatcgaagttggatgtatgcgaaaaatttgaaacgtcattctacggagtacagaaagggcataataaattttatgaacgccgcggaggaggatcggaaaagaagaaacagtgattacatgtgttgtccatgtgcagattgcaagaatgagaatatgtttgatagcggagaggacgtacatggtcatatgatacaacgaggattcatggagggctatacatgttgggtgaagcatggagagcaagaattaggaagtggagcagcagcagacagaagtgttgcgcataatcaggaagatgaagatgagcatggcatgtttataccttctccattgggcggtgaaatggttgatgtggatcacgatctgctgcaagacatgttacgtgacgttgaggacccagcccagaatgagagagatggaatgaagttcagcaggttggtcagtgattccgagacgcctctgtacgctggatgcaaagcaaaacacactaagttgtcagttaccttggacctaatgaagctgaagtcaagtagtggatggacagacaagagtttcacagatcttttaggaattttgaaggctatgcttcctgttgagaacacattgcccgagacgacatacgaagcaaagcaggttctgtgtccactggggttagaggtccgtagaattcacgcttgtccaaacgactgcatattgtaccacaagcaatatgcggacttggatgcttgtcctgtctgcaaggcttctcgatacaagcgaaaaaaaagtgctgacgaaggaaagaaatcaaagaggggtggttcggcaaaggttgtgtggtatctacctatcattgatcgtttcaagagaatctttgccaaccccaacgaagcaaagttagtacgttggaacgccacagagagaaggaatgacggtatgcttagactcccagcggattcgattgaatggaagaatatcgatcgaaaacacaaagactttgctgctgaccctagatacatgaggatatgtctgtatacggatagcatgaatcctttctgtgacatgagtagtactcacagcacttggccagttcttattgcgaactataacctcccgccatggttatgctttaaacggaaatatattatgttgtgcttgttaatccaaggtccgaggcaactcggcaatgatatcgatgtattcctggaacctgttatcgacgatctggagattctttggaaagaaggtgtggaaacttgggatgcatatggtcaggagaacttcaagctaagagttctattgttctgcaccattaatgactaccctgcactcggtaatatttccggacaaactataaaaggaaagaaggcatgctccgattgcaaggaacatacacgaagccggtggctgaagaaatcatgaaagatggtatacatgggtcatcggaggtggctcccgctacgtcacgcatttagaagaaagaagaaaatttttaacggtaagagagaacttcagcctgctcccaaagatttgtccggagatgaggtccacaatatggtcaaggacataagcaatgagtttgggaagaaaagaaaacgtagcaagacaaaggagaagggtatgtggaagaaaaaaatccatattttgacggctaccttactggaaagatcttgatttccgtcattgcattgatctcatgcatgtagaaaagaatgtgtgtgagagtttggttggtctgatgttgaatattcccgagaagacaaaggatgggttgaacgcgcgccttgatctacaggacatgaatattcgtagtgaactccagcccatacgagatgcagagacaggtagagtgtacctccctccagcctgccacacattgtcgaaggatgagaagatcgcaatgttatcatgcttgaaggatattaaagttccattgggctattcagcgaggataagtaagtatgttaaattggacgatctaaaacttgttggaatgaagtctcacaattgccatgtgctaatcacacaaatcttgccagttgctatcagaggcattctaccaccgaaagtgcgtcacacgatccaatgtctgtgctccttcttcaatgcaattggacagaaggttatagatccagaagatctagatgggttgcagaccgatattgtgaataccctctatcacctggagatatttttcccattgtctttctttgatataatggttcatctccctgttcatctggtgaagcaaataaaactatgtggcccggcttttctaagggaaatgtggccgtttgaaaggtacatgggagttctgaagtcgtatgttcgtaacagagctaaacctgaggggagcatcattgaaggttacacgaccgaggaggctattgagttctatgtcaattacatgtccgatgccgatcctatcgaagttcctgcgtctcgtcatgagggaaggttgtcaggtgttggcacaatcggaaggaaaagaattaggccagatcaagcgtcgtacgcgcaggctcattacgctgtgctccagcatatggcagaagttggcccatactttgaggagcacttagcgaaaatccgagatgagaacttggggcgatctgatgcatggattaacagagaacataattctcggttcaacaaatggttcaagaatcgtgtgacaatgtccacggatgtcccaaatgagacagtacagttgttggggatgggaccatcttggaccgtagacacatggtaaggatacgatataaatggatacacattttacaccgtcaaacaagatgacaaaagcacagtgcaaaacaacggcgtccatatagatgcgttccaggatcaagttgggtcaaacacatactacggccgcattgaggagatctgagagctaaactacgtcaagttcaaggttcctttgttctgctgccgatgggtgaat

SEQ ID NO: 62671 - DNA, 1204 bp, Oryza sativa
ggtcatttttctatataacttttttcccaatagcttgaaattgattttgaatatatgacaaatctaaacagcatttgtaaatactaaatgatttcaaataggaatatggacaacaaaaaagttgatcctctcatcaagatctacaacttttcttttggtcacttcttcatccgataaagtgatagttatattattcacaaaaatcacatttctctcatctggtttataaacatcaacacatatatgtcaattttataaacattggtactatcactttatcggatgaagaagtgaccaaaataaaagttgtagatcttgataagttatacaactttgttgtttatggctttcccatttgaaatcagttagtatttacaaatgctgtttagatttgtcatattgtcaaaatcaatttcaagctgttgggaacaaagttatatagacaaatgaccaaaataaaagttgtagatcttgatgagaggatcaactttgttgttgaccatattcccatttgaaatcatttagtatttacaaatgctgtttagatttatcatatattcaaaatcaatttcaagctgttgggaaaaaagttatatagaaaaatgaccaaaataaaagttgtagattttgataacctctacaattttgttgttcaccatatttcgatttgaaattatttagtatctaaaaatgtattatgactaataaaatgaattattatacaacagctatatattttgtacgcacaaatataaagatttgtttggaaaaatggaaaaatagtcatcggtgacgggccttagttaaagcccgatagagatttatctatctctatcgggcattatcttagggcccgtcacagatgactcatctgtgacgggcctgaatgtcatctcaatcgggcattagtatggagcccgtcaccgatgagtcatctgtgacgggccctacggcaaagcccgatagagatgactcatcactctactataactagggtttctcagatcggatcgaaaatttttctaagtcccgctacagtttcccgcctccttagaaccctagcgccgccgccaactcctacttcgccgccgtcgtcctccctcgccgccaccgccaccgagaccgccaccgccgccaccgagcccgccgccgccgacaccgagcctgccgcctccaccgagcccggtgccggctccaccgaccg

SEQ ID NO: 62672 - DNA, 1770 bp, Oryza sativa
agggcacgtactcctaggactgggaacaaaatccctaaagaacggttccgtataacagcggtggatgccgtagggttgccaacatctccaaagaaaatattgagccgatttaggtctatctgcggggtcatagggaggcagaaattcagtattctgcaagatgacatcaagctcatgccgaccgcaaagaaggacattgcttggctaacgttcaaggagagtttcgattatcctgtggagcatgaggaccgtctcaggcgggctgctttcaaggttatgggcaatgcttggaagaacttcaagactaagctagtcggcgagttcatctacaacccggcgaatccagatccaagagagaaatttccttggatcacggaacaggtctaggaggaattccatgcgaagaagtcgacccccaagtccagagctagtagcgaggcatatcgcttgctccagaccaagaaccagcatccacatcggcttggcaccgccggatatgccggtaaggaagaggaatggtagcgtgaggatgaagaagcggaggaatcgaacacgccgctcgtgtttggtgatatcccacaccctcgggttaggaactgggccagggccaagtaccagaagaaggatgatggcacaatcttcatgccaaatccagaagatcaacgagtgtacgaagctatagtaagtgtgtagtccaactagatgttcgcattgtttccgatcatgcagtttatttaaccccactaaattgtaatgcagaaggagttggttgccgatcaacaagccttgcaagaggccttctctcaaagacgcgaggacgacctcctcacgaaagcgttgggcaacaaggaacaccgtggacggacacggggcattgggtcttctgttccctggaaatatggatttccagactacgcgtggcagtacaagaagcggacttccaacaaggcggagaaagatgcacgccttgaagccaagatctgggcgtcgataagagctgagctgacatctgaattcgacgaaaagctcgagtcgatgagggccaagattaggcaagagatccgagaagagcaacagaacccccaggccgccgctgctgctgcgcacgaagagttaggaagtcccacccaaaaacgcagcagttgcgcatcaactgaggtggcggaaaatccaacatcggtcgacaacgccatcgaccacataatggtaaaagtttcgtccacaatgcatgaaagacttaacgaatccatatgatatataatattctaaaaaaattgattaatctatcgcaggaaccaacgagctgcaccctcacagttagggtgatgccgaccttcacggttccagcagccgagggacttgcgtacaagccgaccccagagacaagagtgcatggagcgcaactcaggggcgactaagcaaaagttcaagtcaactcggtgaagccggaatacgagctattcccactaaagtatccaccgaacgacgaggtcctctcactaggaaatgcccgtggtaccttcatccaatggcccaaggacctcattgagatcagggttacagcgaggccaaccactgcagcaggcggtcgtccaccaaagagacccgcctctgctcctttagcccctcctgctcaagatcgtcatgcacaatcttacgatgtgcagttgcagtacgacacggattttggggaggaccgaacggaggctgacagcaaggcgattcatgaacccccaccgatgaaaaagagcaggaaggcacactcttccc

SEQ ID NO: 62673 - DNA, 20435 bp, Oryza sativa
  unsure (1)..(20435): unsure at all n locations
agaaacagtataatgacaagctgactgttgcgacactccaaagacagcggttgacactcccagactctaggaactgctaattggccgctcgcggtgatcgactcgatctcgtgcacaattaacatgcgtgtatgttgcatatcgaccaatcaccaaacaaagagcattgtccaggcagccacctaatcacatactttcatctaaaaaaggttgtaagatactttcgatataggttgtaagatactttcgatataggctggtggctccttgtttaggccctatgagctgaggtggcacccatccaagaccaaggtgacgaggtgcatgggctgaccaacagctagagcgacgacattcatgtggagcttgtctgaccaagtactcgctacatgcgactgaggccctctttagtttccacacaaagattttacactatatcatattgaacgtttgaacacatgcactaagtattaaatataggctaaaaaataactaatttcacaaattgcgactaatttgcgagacgaatcttttaaacctaagttctccatgatttgacaatgtggtgctacagtaaacatttgctaatgacggattccaatttaccctaataaatttgtctcgcggtttactgacgtattctgtaattagttttttttattagtgcacgaatacttcatgcaacaccctatataatacctcatgcgacacgctaaaactttacacccctagatctaaacaccccctgatagcggcaaggacagcatcctacaaggaggttggtctgcatgctctgtgcgagggaagctagcagttggtcgggactcaggactctcatggcactcgcagtgcaaacaccacagcgcgggtcctagcccaaaaagttagcctaaagactctttcccacaatgcaagtatcctattttgtatggcttaattggatgaaggtattgtggaagaaaaccagcccacagtgcgtgttaccccaagcgtgtggacatggggagcggaacgaaataaattcctcacctacccttctagcaactcgtcttctcctagtccatcgccctttgcctcatcccagccaccgcacccgccgctcctcctccccgtccacacgcatggaggattcagtcgccactcaccgctggcgcaggctcttggggctagagcctccgtccaaaaaaaactaatttaagtgaagatgtgagccatcccaatacaacgaatctaaacaaaaggttcagattcgttgtgctagaataggtcacattcgcacctagattgagtttttttggaaggaaggagtacctctaacgtactccctccgtcccataaaaaaatcaatttagtactggatactagaaaatcaccggcgcactcaatttatagcctgtatatattatttttgtgttattaattagcgcattttcataaaaaaaaagtatagaaatcagtttagtttccttgaaactcatgcaaaaattatagttgaatggaattttttgagttccagtttaacataatcgatcatattgtagagaaattcatcaaactttctctgttttttccgtctatactattaattcttcttttgtttgtctaaaattacaattaaatttctattaattattcttttgtttgtctaaaattataattaattgtttgctaatgataaaatagggtcttggtttttttaaataaagtgttctagaattttgttttgttaggagtcacaatgatttgttgggattaagtcatagactttgtataggtatttatattgacggctaattagtggtaggtgatatatatgttgaccatgagttatatatggtgattccattaattttaagagaaagtctattttactcccttaactatttcaccaaagcacttaacctcctaaacatttttttttgctcattttacatcccaaattattgaaaacggttcactttactcctctaatgctatttctttctcttttttaatttctctatgtaagtcatattttgcatgcatttacaacatacatctcaacatttctttttattttttttttctcacggtttatgtaggttgaaagcacttaagactaatttaaacatcaaaatttaaagttcaagcaaacatccataacaaactttttaaaaaatgaactttgataatgatcccatgtatggttcagtttaaaatacaacttatataaagagtaataaaattgagaaatgccactatggagtaaagtgaactgagccataaattagatttttttttaatagtgtccattgaattagttcaaagaaataaaatatttttttattttaagatatgcagttcagtatttcaaaaatactcatagatatatgtatgaatatgagtagttgtatatgcattcaataattttttgtaaatgtactatagaatactaatgactattgaacgtgtacatgtagagcaagtgggctgacataggcatttgctccttcccctgattttgagaaaatcccctatgtacccatgaaagttcacctaatcccttctatacccctgaattttactcaatcccttacatacccctgaattttagtttggatcccttccatgccctttccgctagttgaccgttagttgactgttaaattcttttgaaaaaatccattttgccctttgctatgaagaaacataataaattaatgaagtatattgttggaatgtaaaaatttattagatgagactattatatttatgagtatgtgatgcaccatattatttgtgacaaatttacttttacatatgatataaaaagttaatacttatttattagttattaaaagttcttttatgtagcatatgtgttttcatagtaatacaacatatttatttattactatcagaacacatatgctaaaaaaacttttaataactaataaataagtattattttttatatcatatctaaaagtatatttgtcgcaaataatatggtgcataactatctcataaacataatagtctcatataacaaatttctatgattcaacaatatactctattaatttatatgcttctttataccaaagggcaaactggacttttttataagaatttaacggtcaactaacggtcaactaatggtcaactagcggaaagggcatggaagggatccaaactaaaattcagggatatgtaagggattgagcaaaattcagaggtacagaagggattaggtgaactttcaagagtacacaggggattttctccctgattttccatagcgttgggcggctagctaatgggcttcttatgcatgaggtgctttgggcccagatgaacgcgtactacgcgattgatcgagaagaacagcagccgcgctggagagaatcatctatacgtcgttggttcatgccacgtgtcagaaaaatacacgccgccatctccaccaatcagctggcaggaagacccgccagctttagatataaaaatatgatatatcatattactacaaatcttgatatacatctcttaagattcactgtattgtgagtgcaagcaccacagcccgggtcctagcccaaaaagttggcgcaaagacactcatccccacagtgcaagtaccatattttgtgtggcttaattagatgaagttactatggaaggaaacccagcccacagtgcgcgttaccccaggcgcgtggacacggggagctagagatggcaatgggggcctgttcaccgtttccccgcggtgaattcacctattaggtgacggggatggttaatatctactcaccaaggggaataaaatggttaaaaacctctcaccatcggggatgactggggcnnnnacannnaaccattcaccgnccccgccccccacggtgacccgactatactgtacaagggaggaattctagactttttagatgtattggcccataatattgaagcccatttaacagatacatatataaacacacatatataatctaaccctaagtcaacaggtcaaactccaaattttccacccatccagatccagatccacaccagccacccgaccgagtcacacgcgccgccggtcgccagtccacctggagccgcgcgcgccgccgttcgccagccacctccggcgccgtttgccagctaccacgcgcaccgccactcactgccttctcgccgggagactgaagctgccgtcgccggccgccttcgtcgatgcgccgccgggccacgtggcgcctgaagctgtcttcaccaggagcggccggcaggctccgtcgatgcgccaccagcctgtagcctcttcaacgggagccgtcgtcgccgtgccgccgggagtcgccgtcgccgcgccaccgggaactgccgtcgccgctgccatctgccgaccatggcttcggccttcggccacctcccccctaaagctacaacagcgacgatgcaagttgagcatactacaatctgtgactgtgaatatattgtttacccggggacgggttcaccatggggaaaaattcaccgcgtggtgatcggggctagagaaattatagccccatcgtggttgacgggggcggggacggtgaaatattttcaccgcggtgacggggacgcgggcatgacccccgacggtgaattcaccgttgccatctctacagggagcagaacgaaaaaatttcctcacctacccttccagctactcgtcttctcccagtccatcgcccttcgcctcatcccaatccgccacacctcctccctgtccacacagatagaggattcagtcgccactcgccgctcctcctttccgtccacacgcatgaaggattcagtcgccactcgtcccaagaaaaaaaacctaatttaagtgaagatgtgacccgtcccaatacaacgaatctaaacaaaaggtccaaattcgttatactaaagtatgtcacatccacatctagattgagtccttatttttttaagggaggcgtatacctctaacgtattccctgtcccataaaataatcaaccagtactagatgtgacatatcatattactatgaatcttgatatacatctgtccagattcattgaattgtattagaatgtgtcatatccatctagtttttttttaaaggatggagggactatgaatcacatactcctatgtaacatgaccaatcatctcatttcaaggctcataagagtccacgatgatataaaggaaaaaaaagtatgtggaatcttgataaactttttaaatgtttctgcagttcaaaaaaaggaaaaactttgataagtttctataactgattgttctttctacacagatgtgagttgtgagcctttaaaaattgaattgctaactgtgagcttacagtagcaacatattttctgtcgaaaatggagatggctttgtacagcccaccaaggagagatggtagggttggtaaatggtgactctcctgtaccttggtaattcaaacgaactgcaaaaaaaagaaaatgtgtttcctatttgcctttaggaagagtgacaacattaaatttagacgcatcaggtctcctcgcccacttcagcacatcgctagctgtttctgcaacgtaggaaaagtaaaattacatgcatctccaatgccacaaattcttccgaggaaatatttctttatctaaaagaattccaaataaataaaaaagcatagacatgagtaaaagaattccctatgaaaatagaaccgtgggtgatgtacacttgttatctaaacttgatgattacacattctgtatgcagcatggaaacgttcatttaaaaatatggtgtcacagattcatacctgaatgctacaaattaggttgggtagcatccaactttgtcgtatgcgcaaagttcatggttaaagtttccaatccaatcatatgctcatccagtttcttcccttgaatgcttgaaacaccactactggcattagcacaatcagaattcccgcaggcagatttcattgtagtatcacaaatgctcatttcatcagatgaaaaatccagatgattttgaacagttttcaggacagccaatctttttgaccttagtcgatatggaggggaaacatcaagactcccttgctcatccataggacccaaggacaaaagtgctgcagttttgaatgactgtgggctatctgtagtacactttcctatgggagtgtggaagtcatcactgcttaatctgccaatcttcaaatcattatcttcagcaggcgtcggtttatctctttttcttcttcttagtattgagggagtaccatggaatttttcagcagcacttctcaatatggattcaacactaagctgatctgatccttttccatgagtgggtggagtagtatagccattgggtgagtgcattacgttcctagagtgttccggtacataatttgctgtaaacactggggattgggcaggagcaatgtcttccatcttaggtatctgataacaaagagaaccaacagagtgagcctcactctgcaaggatgatccgccgccattaatggctgcttcaccttctctcttagcttgtcttgaacagcccattttatctgatatctgattaattttaagtcccttgtcaccaagaaaattgattccctgaaccttcccacaaacaaaattgttcccagtacccttgtcatgaacagaatccattctcattccctgtgttgctagatcaaaagcagaatcatcagctgcagaagcctcacatgaagttactggctgaccaagtgagaggtaatctgcacagcccttaaagtctttcaaattggatgcccgttgatgagaggtagggtcagaatgaactactcctaagcggtctcttgaacagataattggctctttgtttaagtcaaaatggttgtcagcaggtggccgctttggtaactgtttcaaaccatcaccaacaactggtggatgaactggcagaatatctctggtattgtagtcatctattttttttcttaatgaactgttccaatggttttttatagaattgtctgtcctggagataagaacaaacaagcatcagtgtaagctgaatatttagaagcctaactgttcgattagtaaagaaaggtcaattgctgtatgaacttaagacatgaaaatagcatagaatgcagaagcacatttacaggaaacaatatgtacgtaaaaaaacaaagtactttcaatttcaacagcaatagccctagtgcacatcatctgtttggaacagcaaagcagcaaaagtcacaaaatcccatcaccagattacatttatatatatgtcacaaataactcatttattcaacaatttaatttattaatacacaagccagacgttacaactgctaagacaagagcaagcacaaagaatccataaaacgttgccacgagcagtgccgttagtgcatttctgtgtctaatttacatgagtaaacaaaaacactttacataataatgctgcggattagtaccttccaggaagaagtttagcaatttctgcccatttattcccatacatacaatgagcacgggcaagcacacgctcctcttcaacagtccaagcttctttccttatttgtgggtccaaatgattatgccacctaaattatatgggtacatcagaagtgaacactgattcatacggtatgtactttattatggcaaatttataaataaacaagaaatatgtaagaaaccttactacaattttataatcccgatatgttattagttctgaactaatattgaaaatttagctggatggccaactgaccatttaaactgtcctattttaggaagcatggatatgtcgattaaaatttaacatgtagagaactctgttattactaaggctaggcaaaattactcatgtaaaaaatgtcatcctgcttaaattttagtaaggcacaagaatgttcaaattccaaggacaccaacagttgatggtgtatggtcttagtgtcccttcacttcttacctcatgtagaccgtctagcccatagggtaaactaaacatatagtgctgtttcacatatattaaacacagaaggcatcaaagggcaaattcacaatcaagcagaacaggtgtattgtgtgagattgccaagagatttgccaactgaaagcatgaagttgtacagaagtgctgtaccaaatgtggaaccagaagttgtatagtgactaggagctggaagtatattgtcggtcatgtctagcctcagtataggcattgtggtggtcaaggattagtttgtgtaaaaacaattcttggtaggacgccaaaacttggggcgttcctgcttacaaaataaaaaccaccagcctccaaagtggtgattcagaagtaccattatatctgggcctaaattagatgataacctcaataggtgtcatccagtttcaataaccccaaaagtatgatcaaagaatctgactagttttttttcacaatttacctcatcaaggaaaatcaaaaattgctaactagtctacaaaatgtgaatgcgacatttcacttgtagtagttgattgcaatttacaacatgcatggtaatgttctcaaaacaaatacctctctcggcattgtttaccaattcgaccatttagtgaccttgctataacagaccatttttttggtccatgcttctttaccatattgatgatgacatcatcttcctgcaaaagaattcaatgaacaagcagaatatacagatttgaatttatggaaaaataaataagatatttgacaaacctcttgggtccatggaccttttataagttcaggatcaagaactttctgccatctatgcagacattgtacttctgtcctatcagagaaagattcggctgcacacatacacagtaaataaacaaatactgtacagttttcacaaaagaacatgaaactgacactaagttgctaaatttcattgttatgaattactgcccagtagtttcttaaaagtgcaaatgccataaccccgccccataaacataattcacatgttttttttttcaaatagatcaaataatttgatgtgctggtacttgacaaatatgttttgaatttttttttaattgctaaaattaacattatgcaattaactgatagaagtatagaaaccacttataagttattcaaataatttacgcaaggaaaagatgagaaccacactggtgggctttgaacattattagactatatcattgccgcactggtctagctccaggcacaaagaattgtaaaaaccattgaaatagtatttgtgtgtgtcattggagggtatttgtacgataactctaacttatgggtgcaaaataaatgaaaatttgatgctggaggcaaattggacaaaaaaacaggtggctcatatattttatgtatttgttttccctctttgaaactgttaattgaatattatgcgcaggatgcagacaagaaaagagaagcaaacctatcttcttccagtttttgccattataaatatcaactgccttccgcaatttttcatcctgcacccaagtgacaagaactaggtaaacaaacattcattttgaaatggatgccgtccaacccaaaggaaaagatccacacataacaatatagaaaggtaatggtaagtttcatatgcaaaaggtaaacggagtgcaagataacactgcagatagagggaacagtgaacaggtaggaaatatagtagaaaatagctaacctcttctggtgtccagccacccttagctctccttaccgggccactttttcgcctaatatgtaagattccatcagcaccacaaatataagataaaaaaaactatcaatagctcatgtaattatggaaaacttgactaggatccagtacagtacataaaatacaggctgtccgattgaaagacacaagccaggttagaggaagatgacaaaatcagtaaattctagcaatccagatttctcatgtgccctcaggcaaggatgtggaaatgccgcccgtttcagaaaaggcgattaacatcaagaaacaaaagatctagctgattttcctgatcccattttaggcaggatatgtgtaatcatacatgttagaaatccaattaattaaaagaagtaaaaaaaaattaccaatccatctggaaaagaccaagtgcttctggttactgcccaatgctcatccccccagaaaccactagctggcaagttacttgggaaaaacaaactagctggctagtttcccctttttccccagtaccagtttcatttttttttcttaagcctcaagaatgattactgtactttactgttattaaacctgtagcttcttacagcttactgatacagtcactcccttttagggaattaatatgataagtactgccagcttaaaaaatgttttgtgagtaaaaaatagacagtcaaaggaaataagcatagccataaaaaataacacagctctgttactacttactaccatcagactgtaaagcccctattagaccgtgttactacttactacatgatccaacactcgtatgggatacttttccacgggatatgattgccgtctaaagcccttcatcacactaatttcttcccccaccacatcgctcgctcgctcactcactctggttttttaagcagaacagcaagctggagagaaaggaagtggatggagcagtgagcggaagctaagcagtggataggtcgctgtgtaagggaacaggcaatccacaagggcactccatgtgcgttggaggcttgagaagcaaaatgtgatgccctggtcaaagataagcacagacacgtagatcatgctgccaattgccttgggcatggcagtttgccaatagtttcgagcaagccccaattcagcttcatggtctacatgcttgaaacatggctggttttgcatttctttcattagcaatttgcactggcaatttttagttggaatctgcaaaactttgaaaaatctctggaaacatgagacttgctgaaacacttttgaaactcaattaagcacttattagacttatggaaacactctgggacttgcttacttgctggaatttcttacgaaggttgtcaaacctgtcaacatgttattaaacttgggtttgaaacttggcgtttcattttttaaaactatctaaacatggtgttttagtttttgaagctcccagaaactgcaaggaagtatttgaatgcttggaacatgtcgaactttcctatcctgttgcatcggcgtcttttttttttttgcagcaagtagcatccttataaaaattcataaaataactcaaatggaatatctcatggatgaacctttgtctcctacatagtcatcttgatgggtcaactcatattccagtacatgaaaaatccaataatatagcattacgcatcattcagaaactgcaaatcagctattacaggctccaaaagacatgactcaactataaaatcggtataactatttatctaaaaatggcatagtttcatggcattagtggagatttcctgaaacattataaataacacaacaacttataaaaaactgatttctgcattcagaagcatcagcttcttttttaaaaaaaaaaactatccacatactgaatatatgtccaatccaaaagcaaatgtcgaaataaaaaatggcattttagataaacagggtgcctgaaatatgatgcactaactaataacacaccgcagatatgctaaacagtatagtggatacttgcggtttaaatgatcaaaacacacacctgaaaacaaacagacgataaactttactcattttagcaatcactgcaaagcgacttcaccgtgcctcaaccaagaaagcatgccaatttccaaaacaacagaactagatacaattacccagtgaactagagtactaaaagaacaaagcaagcaaaacccttcccaccattgaagtgttaaaagtgtgatggaacaaaaattcattcaacgaagactacagctgtaaagaccagcagcaacggcaagatacatgttaaaaggtcaaccaacagtcctgtccaaacagccgtcatgctgcacaaggaccacgtcaccaatcagaaataaatccaaaggccacagatttctcaagatcgccaaagctgctgcgatcgcaatccaacccagcccagcccagccgcatctgcgaacgagacgaagcataaaaaccccatctttcccaggcaaagcacaagcagcgacccccccgtccggagttccggaccatagccccaagcaagcgggggcatccgaacgaggcaaacaaacaaccacccactactacccaacagccaacagcacagcgacggtaagttgagccgcggcgcgggggcggggggatcactacctgcgaccgaagatggaatccgccgcggtgggcgacgccagcgcggcggcgtgcgcgctcccctccgagaccgaagggctcgacgccaccggattccgctcctcctcctcctcctccaccttcaccgccggcatcgcgcccattgatctaccgcctcatcaacacctccgccgcctaaacaaacaatcaaaaaaaaaacaaaacaaaattcccatcagaaacactcccccaacttaaacgcacctcgcggaagaagggaatcaagcgccgccgcttaccaaagccgccgccgcccagatcggggggaagcggaggatcgaatcgaggaagcgggtggggtgggggaaggagagatggggtggcacgaaaccctaggcagggcaaagggagcgagctcctctcctcctcctgcgcgcgcggctgcccgtctgggggtggtgttgcggcgcggcggcttcgattgtgtgttggggaaggaggaggaggaggggtttcaaaaaacctcgcccgttgaaggaaaggaagggaaaaggaggcgaggagttagcagacggggggaataatttactcccggtcctggatctttttcagataggggctccaggttactggtaatttcttgctaggtgagttgttggtagccatagtatctttattttctcctttcctaaaatatactcctaacaaatctggataaagatctgtctaaattcgttgtattatgatatgtatcattcaatcctatatcgttattttttgggaggggtatagtagtatataatattagtattacttcatccgtttcatattacaagtcactttgatttttttctattcaaatatttttatgtttgatcgagtttatattaaaatataaaaacattttcaacacaaaataaatattttattaaaatatatttaatgttagatttaatgatattgatttagtgttgtatatgttgctagaattttctatttcctccgtttcacaatgtaaggttttctaacattgtctatattcatatagatgctaatgaatcgagttcatataatgtctagattcattaacatatatatgaatgtgggcaatactagaaagttttacaatacgaaacggagggagtataaaattgatcaaacttgaagaaatttgaataaaaaaagataaaatgatttataatatgaaatggagagagtagttaatattaagtttgagtaataaagctgtagttttcttacaactccgtactaacaaaaatctcaagcgattgattgatcattgattccatttgaaatataaatagttgagattcaatcacaatattatacatcagattttgtaaaaggttatataaaatatagtatgtatatcttttattatttattaagttagattagactagttaggcgtgtaaactacaatagtgcattatgttatcagcattgcatatcaattaattgttttcttaaaaaatagtataacataagctaagatgcttatttttctcacgggaaaagtaattttataccctggaatatgagttgcattacgtttgcttcatgcaatcgtctgacgtcactagtggagaaatcgtttttaggcccggttcataacccctctataatcccggtttgaaaaccgggactacgaatctgggactaaagatccctatctttagtcttggttcaaatacccgggactaaagatcgatctttagtcccggttggtggactaaagatgggagtgggcaatagttttttttcatttacttactatttaatctctaatttattttctcccaaattaggtgggatgcgtaccatcccaaatacacaaatcaatcatatacactacagattatacatcccaaatcaaataaacatcccaaatatacaaattatacacaaatcatgtacatctcagatccatacaataagattccaaaaaaaattatacatctcaatctatacaatgaaccacagattcttcatatcattctacacatggatcacaaattctttgaaaaaaaaagaaaaaaaaacgaagcaaagccgccggtcggctgagccggctgccgcctcccctcctccccggccgccgcgcggccctccgcgccgccaccgccgccactgcgacgccgctgcgccggccgccgccacgcggccctccgccggcctggccgcccaccccctcctgctgcgcacactggatcgagttgggaagggataagaagaaaaggagataaggaggaagggaagagataagactagagatggagggagagaggagtgggtgtggatgagaaaagagtggacgagaaaagatgataagtaatagagataatatactgcgttttgatctttaatcccggttcgtaacaccaaccgcgactaaagatcctggaggggcctgacaacacctgacagcatgtgaaccgggactaaagatgacaccaaccgggactaaagatcacgtagtcccgttctacttataaaccgggactaaaaaccatctttagtcccagtttttactgcatccgagactattgtggtttttggtcgaccgggcaaagatggtttttcactagtgctttttaagaagaactacgctctaggtgtcaaagcttactagtacagttatattccttgtccaattgtatcaatcccaatgtttcttttggtcaaccgacattggaaggttgtgttctttcccccccctcctttcccaacttatcttccatatttttcacgcgcacacttcacaaaccactgaacggtgtattttttgcaaaaaaaaaagtaggaaagttgctttaaaaatcatattaattcaattttcaatttttaactaatatttaattaatcatacataaataaaccatcccctttttcgtgcttcttccttccaaaatgcatctgaagaattgcacccgctgcaccgaggagggttcacaaaaccgatggaatttcgcgaaaatcgaacggatttcatgaaactactaggtctcggtttatgaaaactggtcggtattagccagtttctgtacggcattgatcaaaagtcattggtttttactagtttttgggtcggatttcggtaaatcgatgaggtgcggtttttacttcgaaatcgaaaagttaaaccctgtcaaggatactaaggccctgtttctttcagcttgggattattataatctagattattgagtcaaattactataagctagattgttataatctatagtagaataagcggttagttgtttctttcctagattattagagcctagattattgggtttgcaagtctaaagagggagtagggtggcatggtgggtaatttttcacccaataatctggaaaaagctcacctaaatgagattatcatattataataagccgggctccaaattataataagctacttcaataagttgtctgtttctttcagcttactcccaataatctggattataataatcccaagctgaaagaaacatggcctaataaacacagaagaccaacactctcatctttagcataacacatactccctccgtctaaaaaaaccaaatcctggctatgtatctggacatgtgttatgtccaaattcatagtaatgagttttttttttccatagaaggagtaagtcataacagcatcagatcagaggggttgaaggaccaagcggaaattatccacaactacaagggggcgaatggaaagacgctggccagccagcgtgcgatccggggacggaaggaactgaacaaacggaaaggaaagcgacaggcggcgaattcacggcgcggtgacggcgccgtcggacccgagcccgcgtgttcggtgcgatgcgatgcggcccccgctaaaaccagcagttaccgttgcgggtccgagcacgaggctttggtggttccagtttgaccgtttgaacccctcgcccgggttgcatggaccgtccgatccttccgtgggccgctcggcgccgttcgatgatcgctgccgcgtgcggtcgcgggcggtgggcctcgcgatcgttcatggacaacgtctacgtgtggcgtgacgcgcgtcgttgactcgataggaaaagaagagatgcatggtgacatactgacatactccctccgaaaaaaaaaaaaaaagaaagaaagagataaatcctgatttccatgcccaacgattaaccgtccgtcttatttaaaaaaaatatgaaaaaaattaaaaagacaagtcacgtataaaatattaatcatgttttatcatctaacaacaatgaaaatacgaattataaaaaaatttcatataagacggatagttaaagttgaacacggaaaaccagactttatcttttttttacggagggagtatataggtcattaatgtattttgtttttgtttgttaggggcactgacgtcatcgatcccttccagaagctttgtgaaattgctaaaacgcaattggcgtagatttatctctattatttacatggtgttgactgagttaagctattcaacgggaaacagtgttgacgccgtcacaatttgtcctccaaggatctgtcagtcccatcggatggcctaataagccaaagaaaaagctaaattttaaattttcaagcttaattttaatattgattttgacatattttcaacgtagtttcttttttaacattggcttttaagtcacaaagaacacatttataaaagttttacccataaattcatttttatttcctaataagccgttttggcttattagtaaataagccaaacgatggggacctgtatttttcaggttgttcgaggaagtcaggagcatatgtttccaaaattaaattccaaattttaaattttggttgtagagggatcatattttaatttgctgaaaataaaagattaagtccgagcaggagtaacccattaatacataattaattcaaacttgaaaaaaagatgtgttttatgttttaaagtaaattatacatgaaaagttttcatacgaaacgtgctaataaaaatcaaggtaaaatatgtatctcaaacacgacacatgtactcttgaatctgtgagccggctataaacagaattgaattgtctctcagactacatcaaacacgatatatgtactcttgaatctgtgagcctaagcagaattgaattgtctctcgaactacataaagtcaaaatcaattggcattgaaaagctcacaagtggctagatggttaactagaacatagttgtttctccggtgtacggaattacgatcactgatcagaacaacatttgatcactgttgcatgctggctgcagaatctctcacaaaccgcaaatctcgttttctggtggggctgcaaaaatagcaaaagcccttggcgcgctgaaactgctgatctcctgggccgtatgggcccacataagctgggccaaacctctcggcccgagaaggacgcgcccataccgccctacgtgcgccgccggctgccgccgtgccacggcggcgccacggcaccggcgacggcgatgtgcatgtgcccgtgtggcacggcgagcgcgccgccggtctccccgtgcagccggccgctcacctggcgcccgccgtgtccgaggcgccgcgtggcgtcgggtggcctggccgtgtccgcggtgacatggtcaccaggcgaccactggagcgcgtcgtggccgccatttctcctcttttgcgcccgtggctcggctcggctcggctcggcgccccgtcggcctcctcggtttaacttagctcggtggcaataaatggcggcgccaccgcttgattcacgcagggcggcgtgtcagacggccatggcggcgtcaaggtgagatcactcctctcgttggaaccgggcttcgttttatgctgcagcccatgtgttcgactgaattcccctgagaggtctcgagctctgttgctccgtttgatctgcagattggaggtttgcatacttacacctgcaccttacacgtctagatctagtatttgacagttgataattatcatctcttgcttgtttttggctgatctcgttcgtgtacgtgggttgacttctgcctgcttgctttccatcgttaatttctgcaagtgcaatttgcaattccatatgtttgatgtgctagttgtgcatacggcatactgatagtctttttcatcggcccgaacgatttctataccagttctgggcaacgatttttgtgtccatatttttagtggaattctgctccaaaatggcatccagtaggttggacgcttgtagggttgggtttgtccctaaatgctaacatggggcagcttgtcccccctgaattcagccaaataacatgcttttgtatagaaagagacagctcttaaccttctaacccaaaattagttttatttttcacttggttgcttctgcaagcaatctcagcaggtgtccgttgtgtttttctgattttccttaggaaaggttgagaattgaaagttgaaatgcggctgcacaaataataagcatggagagcctcatgtgaaacatgtaacatggttatccatcaatggcttgaaattttggagagaatttatctttctagaaatggaccatcttgttgtttttattcttctatagcttcctaagagaatataatcagtactagatttgtgttgagtgtgactttcctcttgcacttcatttttgctttagtcgtatacttgtatgcagttacataatgtgtttaatcagatgctttcaaatatcataaaatcttctacctattcagagtgttctgtttcatttcgcagttctagcacacattttgttcacacgggacagaattggtggttttaaagtttgttttccatctaaaatttccgtactccagtattggtttcctccccttttatgctgcatctccccagggagcttacatgatttctataatcttgaatccttagcttttgtcggtcttaattctgacagttttcttccattatatagacttggtagctctgattgtgacgtcctctatggtacccactgttgatctgagcatagttgttggcctttcaaatcatgatctttcaggtatattgatgtcactaagctacacagaactgaggattgatatagactatggcatctttatgttgcaaatggctgttgcactggaaaaatcactttctacctgtacattttagctgtacttagcttaatatgaaccaccagatggtagttaggtcgccttgctttagcacttcagtgtgatccaaacctacagagagaaaaaaaaaaggtagcttccaaagcaaatgagcttcaagttggaattagcaataagtactaaatatgggaaatgaatggtcataagctctgcaccgaaatgacgaaaactacatgctaatccactgatgaaaaggagtcttaatatatattaagaacagtcctgaatacataccaaaaaaaaaaggtttgatatatttgggcttccagtacaatatcgagtttcagtgagctgtagttgtgccaagctagctattagttgttgtgctgtcgatgttgtaatacttcttcaatgaattctcctctaagcatgccatacctttaacttcgaagtgtaggaaggggcatctgcggccgacagctctttgtttgtcaagatcctcacttgatcagtctccgacaggtcacaggcctggcttcaggggattcactttcatagctgctgtgactttgcaacgcaaacgaagcttcaaggtaacggctcacctgatctgattaagattgctgctgctgctgcttcacaaaggggaatcgcaagaccttgctgtttcctctcaggatcagctgctaacaggtatgttcataactctgttttgcgtagctctcgtttctattcctctcactatctgccagccatggatcaaccttcttcttccttcctacttttcgggttctccaagaaattagtccacttaggaaagtagcacactaaagagctgaattagattcagattcagaaatgcgcactaccaaacagg

SEQ ID NO: 62674 - DNA, 6102 bp, Oryza sativa
cgttcacggtgcggcgggcgtcgccgctggagctgctccggctgctggacatcccgccggcgtacctgagcgagtgccagagcctgccgttcccgtccaccacggcgtacatgcccaccagcttcaccatcctggcgcaccaggcgtggcacacgctcacgctggggctgggcaccaagaagtccaaggtggtgctcttcgtgttcgagtccgagggcatgaaggccgccgtcgaccagctctggccgtccatgatcccgctcggcgacgtcaacaagaagctcatccgggggctcaccggcagcgagatggcccggttcaagttcaggaagggctgcctcaccatctacgtctacgccgtccgccgcctcggcgccgccggcttcatgtgcgccgacgacctcaggaggatactcgagtccgtggtggagctcaaggatttcttggatcacaccgccatgctcgccatgcccagccagaagagcatcaccttgcagtcccgggtcgcagtggctcactgatccaactctcccaagtgctcttgatcgtttcatcggtgcaggtactcctcctggcttgcaatctgcagaggagtctaattctttttttgcggttcaattggtttattccagtgtcgatgttccacttcctctgctggaagggagttgtatagatctactgagcaaaatctttcgaagatgataggttttttgtttcaaaggcatttcttccccaaggatcatacaccttggtatactgtttatccatgaaacaaaataatccatcaatgagaaccatctgtaccatgacattcttgtcgcattgtacagaagccccaacttgttaccagtactctttattattggtattgtacaggtttcccgttctctcatcatccttagttcttactccatgaatactcattacttgacacaatcacaagaaaaacctctgaattgtccttgtgtagttgtgttccttgaatactcattgcttgatacaatcacaagaaaaacctctgaatcgcaaactgcctctggtgtttctttctgagatgctgtcattagagatgggagctatccagagaggaaagtgaacagcaaagttcagaatctgagagaaagtgggtgctaatctctgtttatgtgggacgtagccatcatggagttcatagaaaagaaggacaaatgctcttcttttacctgtctggctctgcctggtccgttattcttatatatggagatgccaatggcccaatgcaaggataaatttgaccaggagttcatgctccatattgtgcattttcaccagggaaataacagcaaagccaaacccaaaaggacagatgggtgttggtcatgatcattgagcgagttaaaaaagtttgttgggcagggacactcgattcagtgtcatgatacaagtggttgagcaagcatgggccaccacccactatggcctgaatcattaacaacaaaagccatctcatctctcatcttctcccacacaacagtgccacagagggacagtgcaccccttgctgtgacctgcattcgttgtataagatctgtactccagttctgtaccccaaaagaactcaggatatctctttcagtagtttagtgccgctgttactggttgctgaatttatttgcaatgcatgtactgttatctatctctcattctcttaccgttctgtctgtaagcttcaaagcttgtattactgcatgggccaatttggtcgaaccaatcacccatcaaggctgtgtttagttcacactaaaattaaaagtttgattgaaattgtaacgatataatagaaaagttgaaaggttgtgtttagaaaagttttggtgtgatggaaaagttaaaagtttaaagaataactttggaactaaacacggcgcaggatcgtcggtatggtggcactgccatgaatcggcatgtccagctaaaagagctttattttttgcctgagctatgcccaaaaaaataaggggacacctgcattgctgcctgcctgccagcgagccaccgcctctgaatcgtgccgccgctggatggctccgccaattatgccgccggggcccaagccgacggaggagaggagaacggatggagacgtatttatgcgccctcaacctcaagtgggtggcggtgcatggtatggtggtatacaatacaacgtttcctgggctactgcctctcggtgtctcccttggatgcaaattgcaggagacctttctcgcccaatactccctccgttcacaagaccgttcacagaagttaagtatatttaacatttgagttttttcaaataagttattcctatttgtaatatttatacatttaacacttaaatgaaaagataaattaaatgtttgattagaattcaaggagtcatctaaatactcattggatacatacttgcattcactccctgattctataatattcaacaacatgatttaatttctctctagtcttgatgacaaaagtaataggtgtaacttttatagatggtgggagtacaatacaacgcgtcctgggctcctgcctcttgggcagtgtttggcaaatgtgttagagaaatgatttcccacccatctttaaatcctaaccattcattatccctcatccgtttaatcctaaccctttattcatttctcaatcccaatcccactcctcatttcccattatccaaacacaccctccatgtctcccttggatgcaaattgcaggagacctttcttgcccaaagtttcaccctgatgatttgctgttcttggtcaagcaacgagctagccaacgagctcgtggttagctttgatgcgtttgagaagtttaaaattcttaagagtaattggttgatagcccgatttctgataaccttattattttttatttctagtttattttttatgaactttatagttacagattctcgtaatctaaaaactatttaggaaactaaagattatagaagaagttactacggctaaaagccctctacatatgacctaagtaatattatctacgctgttgagggtgtatgtttgcatcgcagagagagcttacggctatacgagcctttctatcaagggaggatctatgattgagagggattagagtggatgggtacgggcattagtacatggctctattattgctcttgtcccaggctttatggatagctttttgactcgagcctttgctttcacttttcgttttaaaagattttagttggattttcaggagactcaccaacctactgatgacagatacttcacctcatgacctcaagtcctcaacccagcagcagcaggatgaaaattttcttttattttttcttaaagtaaaatatagaaatccacgtacacttacgatcaaatttatagctaattattctttcaatgttaggtgatgtatccgtcgataacgatgcgcctatgatgacttcataaatctcagcatgtcccgatccagccttttgaagatgccgatacagtgatgggtcatttaactataaaattaaattcacttaccgtctattaactttacgtcaagcctgtatgacattcctaatccgccgacgagagatggaagatagaagagacggccggcgagcctgggagaggcggcggcggcgggcttacgagagacggaggaggaggcagccttgggcatgagttggttgcatgagctcgctagtagagagaggagaggggaagaaagagagaaagagatagaggagatgaggggaagagccgcgccggcgaccgcatccccttcacacaacggcgacgaagcagaggagatagaaacgggggagcttgaccacagcgtaggcaaaggagcagaggggatggagacgagcggtggtgacggagcgaaggggatgtaaacggggagctcgaccgcgtcagagatggcaaagcggaggggattggatggacaacgacgagtctcctaggcttcgtgcaagggtgacgactgcatcccctccacacgacagcgacggagcgaaggggatgaaaacgggggagctcgaccaaggtaagggtggtggcaggcctgcaatgcgaagaagtcacggcgacgtcaagccgtcgaaggatagccgcatctagctatcacacacgccctgcgccgtccggatcttgttgtgcaggtctgtcttgaacggacgcgacgggcgcttccgcgccctgccaccatcgtcgtttcttggcgcaggtgatcgagcacgtgaaggagctaaagtgccaaacgacggcgattgctgcggtggcgacggcaaagaaaggtgcccgtgtcgccaccgtgcgtttgggggggggggagtggaaagagaagtttatgtaatatatttttcgtgtgacttatgtgtggatcccacattatttttattatctccttgctgactaggatgccacgtcaataaaaccactcatgtatattgttatgggacctattttacacggttttgaacacttgggataaagattttcggtattggggattagggatgtcacacagacttgacgtaaagtttgagggatggccaagtcaacttagacgggctgagccgatggtgatgacggcccagctaatccgaattccttcctggcccggtcatcagtaggacaggccagaaaactatccaatccagcccagatcacgcggcagcggcagcagcagcgtaccccacctccaccgggctccacgtcggccaccgcacccaccgcctcccgtgttcaaaattcgaaccgcctagccgcctccttccttaacggtcgccgtcctcctcctcctccacctccacctctacccccgccgcctcgtctcaccctctctcgctcccagtctccctcgtcgtctcctcctcctcctcctccatccgccgccgccaccggcctcgtcctctctccttcgatggcgaccgccgccgccacgcagtcgcagccggtgcgcgtcgtgctgcgggtgcgcccgcacctcccgtccgaggcgaactccgcggaggcgccgtgcgtcgggcttctcgggagccaccccggcggcgaggtcaccgtccagctcaaggaccagtacaccaggttcgcctcaccccctctcttctctgtacgacggatcacgttgaattccccccaatttcgcagctcccttgttgagcgctttcataagatttgttgcatccttagttgaggaagatcgctactactactgttctagttcgcctggaaatttggttgcgaattgttcgtcgactagtaatgtttcggatgatctgcgagggcgtcgtcttagcttttttctcatgattatattcatttggtaacaccacttccgcagccggaacgagtgctataagctggacgctttcttcggccaagagagccgtgtctgcgagatattcgatcaggaggtcagcgccgtgatcccgggaatcttcgaggggaccaacgcgacggtcttcgcctatggcgctaccggcagcggcaagacctacacgatgcaggtgcccattattttttttttcacgacggcaatgtgtttgatgaaatgccgctgcaggggagttgaacctattgctgatattgggggatccttgttgctgtgcagggcactgaggatttgccggggctcatccccttggcggtttcgaccgtgttggcgctatgtactggcacatggtgctctgttgagatctcatactatgaggtatacatggagcggtgctatgacttgctagagcccaaggcaagagagatcatggtgctggatgacaaagatggcaacttacagctaaagggcttggcctgggtaatgcgctggggcttgattattcttacttgtgtttgctgcaatgcattaggcatcatcgattgtgcactgtgcttactttcgtattttcatggttgaaggtgcctgtgcgatctctggaggaattccacgagatatactctataggagtgcagaggagaaaagttgcccacacaggcctgaacgatgtttcaagtaggagccatgctgtgctatcgatcaggattactactgatgttgttaaagggaagcttgagtattctatagtgtcaccta

SEQ ID NO: 62675 - DNA, 712 bp, Oryza sativa
gacgatagatcggggatttgagatctgagaaggcacggacactagacaacaagcaaagaaacatatttcgcaaataggatttttaagagataattttttccgctaggtgccacgacggaacgggcgctacaagctcttatcggcaaattaggccgcaaacctcctagtacggtcaagcagatgtttgagaaagctaatgagtatgccaaggccgaagacgcggtcatcgcatccaagcagtcgggcaacacctggaagccaaagaaagatgcgccgactacggggggagtggaagtaccaatcacaaggatcgcaagcgtaagcccgaggaacttgtagcaactaccacaccatcgtcccaacaacgttcacgcgtcaacactttcgacaagatcatgaactcccaatgtccccatcacccaaattccaatcacgcggccaaagattgcttcgtctacaaacagttcgcagagcaatatgccaagagcgcacgcaagccgactgacgaagaccaaggcacgtcgaaaaagaaggacgatggagatgatgccccaactggttttcaggactcctgcaaggaacttaaccacatctttggcggacctctagcttacgaatccaagtggaagcaaaaactcaccgaacgagagatcaatgccgttcagcctgatacgccccagtaccttcggtggtcagagacagctatcaagtt

SEQ ID NO: 62676 - DNA, 3690 bp, Oryza sativa
ttcctgcagcccgctgagttagattgtaaataggaagaagccgggacaatggcagatgtgtgtcgattataccgacctcaacaaatcctatcccaaagatcccttcggattacctcgcattgaccaggtggttgattcaatggccggctgcgagttactcagctttttggattgctactcgggatatcatcagatccgactaaaggagtccgactgcttgaagacttcattcatcacacccttcggggcctactgctacatcaccatgccttttggattaaagaacgcaggagcgacttatcaacgcatgatccagagatgcttttcaagtcagattggtcgcaacgttgaagcttatgttgatgatgtagttgtcaagaccaagcagaaggataatctgattgcggatctagaagagacctttgcgagcatccgcgctttcaggatgaagatgaatcctgaaaaatgcatcttcggagtaccgtcagggaagctgcttggctttatggtatcccatagggcatacaagccaacccggagaagatcaacgccatccttaacatgaaatcgccgagttcccagaaagatttccaaaagctgactgggtgcatggcggcgctcacccggtttgtctcacgactcggcgagcgggggatgccttttttcaagctgttgaagaaaaacgacagcttccagtggggacccgaagtgcaaaaaagcctttgaagacttcaagaaacttctcactactccacaagttttggcttcaccgcatccacaagagctgctgttgttatacgtgtcggtaacttctcaggttgtgagcacggtcctggttgttgagtgtgaagaagatggccatgttcaaaaagtctaacgaccaatttatttcgtcagtgaagttttagccgactccaagaccagataccctcaggtacaaaagctgttatatggtgttctaattaccgttaggaaattatcttactattttcaaggtcactcggttacggtggtcacatcgttcccactcggagacatacttcataatcgtgaggcaaatggacgaatcgcaaagtgggccttagaattgatgcctttggatttctccttcaagccacgaacttcaatcaagtcccaagccttagcagattttgtcgccgagtggaccgagtgccaggaagacacgcctgcggaaaagatggaatactggactatgcattttgatgggtcaaaaaggctttcaggcaccggagcaggagtcgtcctgatttccccgactggagaaaggctgagctacatgttgtggatacatttttctgcgtcccatgacgtggcggattatgaggcgcttcttcatggattaaggatcgcgatttccttgggaattcgacgtctgatagttcgcggagattctcaattggttgttaatcaagtcatgaaagagtggtcctgctttgatgataatatgactgcctatcgacaagaggtacgcaaattagaagataagtttgatggccttgagctaactcatgttctccgacacaataatgaggcagccgaccgactagccaacttcggttcaaaacgagaagcagctccttccgatgtgttcgttgaacatctttatgagccgaccgtaccaagaaaagaaacgaccgaggccacagacactcaagaggtgaatatgctcgaagccgactagagagagcccttcatcaaatttttaaccaagcaagaactccctcaagataaagacgaagccgagcggatctccaagcgaatcaaactttacatcatgcatgaggttgaactgtacaagaaaagtccgtcagggattttgcaacgctgcgtgtctttggaggaagggaggcaattgctaacggacatacattcgggcatttgcggcaatcatgctgctgcgcgaaccattgttggcaaggcttattggcagagttttttctggcctaccgccgtatccgatgctgacaggattgtgcggacgtgtgagggttgtcaatttttcgcccgacagactcatctaccagctcaggagttgcagaccatcccgttatcctggccgttcgcggtttgggggctcgatatggtcagaccgttcaaaaaggctaccggtggttatactcatctctttgtggccatagataaattctccaagtggatcaaagccaaaccagtcatcacgatcacagcagacaaggctagagattttttcatcaacattgtgcacaggtttggagtacccaatcggatcatcaccgataatagtactcagttcactggcggagtatttaaagatttctgtgaagactttggtatcaagatctgttacgcctccgtagcgcatcccatgagcaatggacaagtcaaacgcgccactggtatggtactccaaggaataaaagcacgaattttcgaccgactgcgtccctacgctgtcaaacgggtggatcaactgccatctgtactttggtccttgcgcactacgcccggtcgggctacgggccagtcatcattctttctggtttatggtgcggaagcaatgttgccaagcgaggtagaattcgagtctttacgatttcgtaacttcagagaggagcgctacgaagaaaaccgagtggatgatctcaaccgattggaggaagcccgtgaaacagctttgatccagtcggctcggtatttacaagggatgcgacgttatcacaaccgcaacgttcaatcacgagcttttttagtcggagacctggttttaaggaaaattcaaactacacgagatcggcacaagttatctcctttatgggaaggaccgttcataatttctgaagttactcggccaggttcataccgactcaagcgtgaagatggtactcatgttgacaactcttggaatatcgagcattttcgtcgtttttatgcttaggcattatttcttgtattttcctctttgactgctaacaccaagcttttccttgaagttatcagtcgggggctactacaatattaatggagtgtgatttttatcaattcaatttgcttacttgatttatcattgccttgtttgattttttggcttagtcaataaggactgaaagtttttaacaacttttgcaggttctaggctcaataaggttcgacaaaaacttttaagaaatcaggagctgagtctaaatcatcaagcacagcatactgtcggagatatgggcccgggggtatgcgaagcatgagcaatccgccttcacatcctgccacgtgtccctgtgacttgctcctgccccccgccgtccacgaaccgcgggggcggctagggggttcggggcctcggggtgccacggcacgcccctcgggcccttgcgccgctttgccccgaggccctcgcccagccaccatgtggcgggaaaagcgagcgaggagggagcccaggatgatattacattaatgcgcacaacgccccaactgccccctgctacatttaatgcagtgaggcagacgtgcggcgtgcgggtctgacgcaccataatcgaagaatgaccggtctgtgaccggtcatgatgccggtcacgtctgactagaccgacgaccgagctcccacgtcgcgtttgcttctagcggagtgggggtagatatgacccatcccatcggagggtcattcggacggcggccaccacaagtcttcat

SEQ ID NO: 62677 - DNA, 2488 bp, Oryza sativa
ccttgcccaccgaaagggggggacgactgagagaaaacctgaactctaggagaagaagggcaagagagctctccggagtgaagggatccttgtaacacttaatcataatcccaaacacaggagtagggtattacgctccacagcggcccgaacctgtataactcgattgtgtgtaagatagccaggagccttagtggcggatacgtgatttctgagaagcgagcctcttcccccggccaaactcacgaaagggggatctcacgacctcccgctatcgagggccttccctcgacacatagatttatcaatattgtacaaattgtgcctgcatcatcatcaaaatacaatgtcaatcagtcttttcatcattagagttattggatccagtcggcttgaggtcggtctcttggaatctctcgactacatcggtggctatcttgtcaggagctttttgtgatcactaatgaggtcgagggcggcttcttcacttgtcccgtctgcaaagccatcgacagcatcaatgtcaatctttgggtacaaggacttggtcatcgccaatgccagactcgcccccatacttccggcctctttgatgttcttaaaatatgtatccgaaccggttcttagcttgtcgaagatttcaacagcatcaaacgaactcggaccactgttattgaaaaacatggcttgaataagtggtgtagcggcattggcgacctcatctctagccccttcaagcttcttgattttgttgaccaagacgttgaattgagcctgggatttgattttgcgatctgcacaaatggtctatgtcgacgaatgaatgcaaagataagaaaggttttgaagtttcagctatatgtaccttcgacatctttcagagccgagtctctttgtttggctagttcgcccttgtctttttccagagctttgattcgtttttctagctcggatatcttggcagcttgcactgtgttgttttctactgtttaattacacataggtggcaacttcaaacaagtcagacaagagtaaggattacctttggatgaaccgcttagctcaatgttgaaatcttgaagctcggtgatccggtccctgagatcatgctcattttttttttggcaagctccttgactccatgaagctgggctctggttgcgtctagggttccgagatgggggaccagcttttcaagtgttgtggtttttgcttcattcctaaggtggattctctgcattataaattcatcttcattcagtaaagtggccgacaggatgggtaaagctatgagcaaagagactacatttacgagacgagtagcttggttaagcgttttggccagcaaagatatttcttcgtcttctttatgtttatgtatcacaattccttgtggctgcatttcatcatcccaccatttgactaatatgggtgggcgagagtcttcagccgaccgtatccgaaggacctcctcttcgtcgccaatcattgggccttatacattcatgaataatggtgaagcaattgaaaaaagtttgtcggatcaagacagatttggaggattagtttacctgttataatttccggtcggggacaagtaggtccttgcatcctgacaggagagttagttccagggtcagcaccaatgtccgtcctgtgagggctgttggcttgagtttccacttctgggatatttttattttgttttgtacccgactggtttccagtcgggggctcctgatcagcaccaacttcagcttcagccgactgattcccagtcgggggctcgttgctggtatctacattgccggatgccggttgattattacccggacggcagtcggcccagtttctgctgaaggaccagtctccgtgccaatcggcgtggggtcttttccagagggatctatgtcagatggtttcctacaaatttgagatatgctatcagctttgcttcaatagtgagtgactagcgaaacaggggaaattgttagatgacacatacctggatgacttccttatttttggcatgggatgactggatgttttcttcttcggattggcttgctttggctgtttctcagtcccctcttttttgcctgtcttttttgcgtcgtcaccttcatcgtcacttgaaaccaacttcctctcatgagaatctggctgattagttgacctcgaggggttgggttggacatccgactggatcttctgccctccactagcttggctagtgtgccggcgaggtgagcggcgttgaataatcggaggatcagatttcatcaaagcgaattcctgtgcacggtattccaagtttttcagtcgaccttacagaagatacaagtatgatttgagaaaggctgaggtgtataatacgtaccggtggaggagggttgaaggcgttgtatggcacaactggcattaagtgtgaatagctgaccacgatggcattcgagaagatcttgtgcattctctcctacatagtttt

SEQ ID NO: 62678 - DNA, 13648 bp, Oryza sativa
tgtggactatggaattggggtttaggtgatgcaaactgatcccatagaaatccaaaatctcccggaagaaacttgaagtcgaaagagaagacccgccataaaagaaatgggagaacaccaccacctcgtgtgtcgggggttggaaacgcttcgccgaatgctggacgccacccgatgatctctttcgccggaagaactctcgccactttccccaaaaacaaagaagtttcgcactgtagcagagaatggggaaagtggcgagagtttcggcggggaagacgaagcgatgctttgtttttggtgttatttcattagggtttcgggagtactaatgggcctaggcctaaacagtactttagcccaatttggttatcggcgtggctaagttgtgatccttagggacttgggcatttttgcttcggcaatacttgctcacaacaatatagcccaatgttgctaaaatcctttttgacgcagttaaataattctttggaattactacgatgcaaataaaaaggtgcccaacggaaaagtgttatactaattttgtaagcctttttaggctgcaaaagctgtttgggttttgttgagatgactggtttttgaatggtcattctctcggcatgttatatgcttattttttattatggcgtgagtcatagcctaggctatttggattcgtcaattgtcatgatttaaaccacatttgatggatctttttgagagtttttactcggattcttgtcatatgtgttgatttatggacctttagagtatttcttactcgggtttctttatatcttcatttttggtatattaaagctaaaacagtcggctagatgttttacacagcgtcgcatatgcttagctgtatgatacttttgatgattcagttgaaagaccactcggttggatgtaatttgtaccttgactatatgtttagtttttaactaatcacatagtcgggggctacagctaattaggtgcatctagtcgatgcacctaacttcttttattttcagcccttcacagtctttgattttagtactcgggaggccagagcagaaggagttggatcactcggattattgcttcggattacgagagaagactatttcgtcgactgtaaaggtctcaggggctactatggagattatggataccccatacctacacggcatgtataatccgattgggtatagggagccatgtatagatagaatatctttaatgaggcccgggttaagttccaaacttgtgtgttaaggaagtacccaggatcctagttggttacgattaggtcatatctgtaactacctattccgttagggatatgggctgtattttgtaatacggactccttctcctatataaggaggggtccgggtgcctcttgggatacgagattctactctcagatcatacgatcaataatacactcggcggatcaaaccccagacaggagtagggtatcacttcttattaagaatgcctgaacctgtataaacttccttgtctccaaacccatccacttttctagcttgatagccacccccttttagtattgccgaaatcttgtttcgacaccacccacggcgcgctctgcaccgtcgtcgccacgccggccacggtggcgagggtgtgccccaccgttgactcggcccggcggtccgcctcaccgagttcccgctcgacaacgccacctcctcctccacgctcgcccgacgtgccttgtggtggacttctgccacccgtgggcatcggagctcgccgccggcctcgccgtcccgcggctcaccttcttcagcatgtgtgccttctgcctcctctgccagcacaacgtcgagaggttcggcgcctacgacggcgtcgccgacgacaatgcgccggtggtcgtgcctggcttggcgaggaggatcgaggtcacgcgggcgcaggccccgggcttcttccgcgtccccgggtgggacaagttcgccgacgacgtggagcgcaggtgttgggcggcgatggcgcggcgcggccgtgcttgagcgctggccggctcggcgcggtgtggagcacagcggcaaggtggaacggagggaggcggcatgggaggaagaaggaggtcctccagcagccactggtgccgagtaggccgcgcgtgctctgggcgtcgccgccgtcaccgagcaagtcgcgaccgggaggaagaagaaggagggagaaagaaaagaaagagaggaagacagatggagagctgacatgtgggcccaagggcatttttgacatttcacgtgatttctctcctctttaaccggaaattattattttaatcggcgcggtgtccataggcaaattaccatgtttatggagtgttttcgcccaaatatgagtttggacagtgtcctagggctaaaaccacatataagcagtgccatgtagcaaaattttcccaatttaaatctgggcactaccattgattaggtcacaatccaaacctacgagtttactattccaataaccaaaatattggtatggcccagttttgcagttttggtagcaaaccaaaacggccctgtattcttctcgtcgagactccaaactacaatttcattttcctttagcaccgctttccaaagtaaacgatgcattttattaaaaaaaaaatatatatatatagaagtatcttaaaaaaagaaataaattaattttaaaatttataatagctaatacttaattaatgatgaattaatgagccgctctgttttacatggtgctaatatgctgctctaatatgaacttacaaacaggcactggctcactctctatctccagtttttcagccacgggctctagatattctatatatttaaatatgaaatatggtgatttttgttttccaaaatatttaacttcgcacatgaggcagtggatttgtctcaaactcccatgtagtctacaatgaactatttgtcccatttggatttgtggacaattttttgggttttcaatgaactatttggatttgtggacaatcttttggattttcgatttacaggtatttatttgaaatggacaggtgccaagctaatactacaaaatatcgccaatcctttcttaaatctcaaaaggtccatggagaacaggctgctaaattgcaagtttgctacagacgacaaggctgtacagtgatgccaggtcagtaagggctgcagacgacagtgatatacagtgactaaaactcaactttactcttcagttgtcaatagctacagagctcatctctcttcatcagttacttgtcaacatctaccacaagtgaaaaagcctgaggcgccctactggtcacaaccattgaccacttcatagttcatagtactagtttagtgtcatacaaggaattttttataagtaaatttcatccaacgcaataaatcatatttaatctttaactaggactataggagatgttacatcagatccagaataaacgtttttttttcatccattggtgcaagcatgtctttttgttcccaataacatggtgaaacaaaaggtatcttccctaaggagtgtataagccactggcctctaatgtttgcgctaaattcttgggtgaagttgatgttttactctttcgatgtaatgaccagcaagcccagagcgccgatgagcaggtactgcaacaacagataacaaatgtcagccatactctcagcaatagatcgattaagctacaaataatattctcaatttgagttatagtctatctagggaatagataactgacagacctacctagtatctatttacaatattggaaataataatcgaggactaaaacttttatcaacatcttacaaactattcccacatggataatggattagagtaaccgtagtttaatctccaggttagtaaacaaggaagagcatacctttataaatggtttctcagtcatgatgattgtaacccacccgacatatggaagaaagctgcagacagcagaaaaataaggttggccaagttaattttcaccaggaatgacaatagattaatgttctcaaattgagcatactgaccctacagcccgtcccataatgtgatgttggtgaagccaaagctgcccatgtgcataaagaagacggtcgtccccaaaattattatcacctgagaagcagtttactagttaagacaaaacattcattggcacccattgtacattaaacatttctagatgtccattgcaaccagcactacacaaattgaccagaaagagaaacatatggagcaaaaggaaatatggttaatacctttcgtgaggatatcaacttcagcactttcctcgcgttcatggacctatacacagataagagtaaactcaaatgaatacccaggaaaaataacgaaataaaaggtgacttaacatcaactaataaaaaattagattgattgacgaaaacttcagagttcattaccttaatcacacggtgaacaattggaatttcacggccctacatacggtacaaccaaatgttaaaattaatgatttcaggagcatatgtaagcatgatttatagggccaattgataaattcatgattcagcgagtaatgtacagataataagttacaatgactcagtaagacttacatcaatgttgaaaacaactatctctcctgtgcggataggatctttgctcatgtgtagaaaaaggatatcgccctgcaaagaagataatacatcattcaggtttactagtgtgaaagatgatcaaaggatgcaaaaatgaaacatggagaaaacactggggactaaatagacaatattcactaacacattatcagattgacgtaacattatcctttaaaagtgatgactgggaaataacaagttaaagatggaaggaagggaaaaggacaaggcagcaactagttacaaactaaccgaactatgaaacggaatctactcttatgcaaaagaactatacaatgtgtattcttatcctcggtgttttgttccaaactgcatttcagaagaggagggaaggtcgactccaaaggtcttttgctttagaaaaaactagagattggcttttatcacgtgtttggaagacttggaagatcgaactaatggaattaaatgggtgctagagaaatcaggtgaattcacagttagctccttgcgcagaactcaatttgggttgagtaaaatgtcagctacaagatctctggaaagctaaaattcctttgattattatgtttttatttagttaatacagacaaaatcaaaaagaaaaagagaacgtcaatcaatgccagaccagttctccatgtggtggattccttggcctaaacttaccacaagcactatcgagtaagctaccaaaaggtggtgcataagaaatgggtggctcggataaatatgctctgtgtggcttgatacaagatgggaattgtgtcttcttaggtatattatggcttcagtgcagcatcaatgaaaatgaagcccttggttaggagtgcagtcctatggcttggaaaagttatccacatctgggttcaaatgaagattgatcgagaggctgggccctggatcttaggcttggccacagttgtgtggcctgtttggttaccaacaaataaaatggagatagaaggaaaatggatcaggcagcctgttgtggttatttccaggtccaggatggttcttccatgcagcaaaggaatgtgtttttaaagctggtgatggatagactgcggcattcgcgagaaaattaagaaataactctgttagcctttcttctattttgctctcactatatctgccactttacagtccattactgtgcattttggatgatatattttgcaccctggtttctctcatttctgtgtgtttccatttccctgctctggtgaccctaaactatgttgcttcaatataaagtggagcaagtgcattttattcgaaaaaagcagatatgcaaaatcttaacaggacaagataggcgaataattatgtccacaggacaagacgaggataaatgtaattaaaataagcaaatttcatagttttgttaggtggaaactaacccttttaaatccaggctccatgctaccagaaaggaccacaaccactggggactcgctccccgttgcaaccatcaatcccttccatatgatcagtgccgaggtaacaatcatacctgcaaagtaaaaaacatctcaataacgagtccccaaccaaagagacaacaaatccaagagcactaaaacctcaaacaaacaaacaaaaaagcagattaactgataaaacccaatacccttcttttcccctccctaaatatcacaactttacaatctaatcttaagcagggaacagtattattatttacaactagctctaacccctaagtttaaaacaatcatctacaggcattcaccaaagtcacaacccacattacacgagagcagaaaaatcacaatccattcctctaaggctttcatatacaatgcagatattcctcgttttttctttcaagaaaaggaaaaccttaataacctcacaggaacagatcaagaacccctaaagcctccctccccaaatcctgcaggcgtaacctcccaaacgcttcaaagaaccgaagctttcgcataatcgcgcggtaaatccatcactacctttgaaatcaagaactacgcggcgccccgcaacccactgatctgaacgggaaggactccgaaaagaaaaactctaaaaccgacgaacataatcaggggatgagatgaagggcgtcaccgaggctgatgatttgcgcgaggacttggcggatctgtatcgagcggatcgactccaccgtatcgccgatgaatcccatctctctcgggcctcggctcccggcgcccggcggcgaactcaacgctgggagaagaaaggaaaacaaatctgcgtgtactgcgttctgttttttttcggacagcaccccgcgaatggtcggtagttacgttcatgcccctctcgttgggatcacgtcactgggcttatttctgatcgacggatgtggatcggacggctagggaaatggtgcggcaatgaaatggcagattgtgctcacagagtttggatatattctcgtgtaatgtgccattggcccgttcgtttctaatgaaagtggaggataaacttttgaattaaaatgatacgttttttaaatagctaaacggtacgtttcgcgtgaaaactttctgtatgaaagttattttaaaatattagattaatccattttttaagtttgtaataattaaatcacacgtttttaacatctcattttacgtgaaacaaaaatactccatccgtcctaaaatataagtatttttagctatgaatctggataagtgtgtgtctatatttataactaaaagttactgtattttgggacgcaagtagtatgaaattaacggtaggaaatgaaatgatatgcgggagaagatgaatgttaccgttgatcatagtctctcctatagatacgtcatttatatcagtacataaccaaaattatagtgtagctattaattttcttatagatgatgtgacacacgtcaccagtaactcgtggtactaataaacctgctctaagctgtactacactactatatattcttatgattatgattagagagctactataggaacaatattttacgtacgaagctcgtcaatgtaacgttttcgacggaagccagtcacgttgtccgcaacaagtaacgtttaccatccgtgagcaatcgtacgagagaatcaaacataacaatcgtacgtgcgattatgacattttttaaaaaatgcgagtttaatagtatgttctttctcatgagttcccaactcatctcactctttttttgcgtgcacaattttcaaactactaaatggtgcgcgtttaaaaaagtttatataaaaaattgttttaaaaaaatcatattaatttgtttttaaaattttttagctaatacttaattaatcctgagattgagagtttacacgagaaaattgatggtgagattaagatgggaatttaatttttaatcccagtatcttgtttggtagaggtgatggaaattaatagggagtttagttagagattagttcattaatgaaaacggatggctgagttttgtttaggcaaagtaaaggaggaattccccccaattaccatctcctacctaagtattgaaaaggagagagttcctctcacaattccccatccccattccgcaaaaatttccatgtatcccaaccaaacaaagcagttaataggctcatctttctaaactcccaatcccttctaaaaactccctccaaccaaacggaccgtttgttccgttttaagtgaggaggattggcaccggggtgtccttgttcttgcttagcgcaatcaacaagcgctaagccgctaaatgccgttagtgtaatcgcatataatcggactgcgatctcctcccctctccgggccccgtcggtggtggtggtggtcgtcgccgtcgtggtggggtggccgggtggggatcctaccagtcaatcttaccggcggcacgcgcatgctcattgacttatcctcctcgaagatattcctctcacttcgctgcaatggattcggatagtgccagtccattctgccgttctgggaagaatctagagtatcaagtaggagcagaggctgggccgcaccatggccggagtaggggaggtgctcacgtcgatagtcctcagggaggtggccaggaagctgggctccgccgccagggaccaggtcacggcgcagtggaacttcaccagggacctggacgggatgcggacgacgctggagtccgtcaacgcgctgctccggctgctccgagacgcggagcagcggtcggcgctggaggatgttaaagtatatagtagttagagttatattaggatagaattggtttgtttagattcctttcatatctgtaatcctttcttatctcctctctatgtactcttatatatttcgacccctgaggctcaatacaaatgtgtcccacgttatgcagtattcctctctccctatactatccaatatggtatcagagcgggcgatctagcgccgctctcacgcttccgccgccgctgcccccgagagtagcgatctcccgggggtggccacccattttttcttttttcttcctcgtcgctgtcgtcgtcgtcttggagagatcgatctccacgtctgttcttcgtctaatctagtcatcgtcaagcagctgcaacagattgcatctcctctgccgacctccgtgcgtggcgctcttgtatcgccgtcaggccgcccgtcgtcgacttcatcttcagcatctgttctgctccgccggcctcatcgacggggccctgccgtcgtcgtcgcctccactggccgacgatcgcgccccgatggacagacggatggcgcagctcggctccacctctggcaccggtctccccctgcaacccccgactcctccatctccagcaccaccgtcgaccggggggacaagctcccagcgctgcttctccgccgccggtcctcgcctaccacctcgcctgtcctgccggctgccgggaccatcctccgccggctcaccggacgtccgccgctcgggaggagcccgtgcggctttggctcaagcgcctcaagggcggcctacgatatctccgacatgctcgacgaattccagtccatcgagccggacgcaaggaaggtaagctcctgacaaaccaaattaacttgtcctgggtccgaccaagttagagtaggaacatttttcccaatttttgtagtattacgttgtgggattatggcacatcactttttttttggtaaatctggtgtatcggatagatgaaacatggggctaaaagtttgtgggatgccataaatttgatcttgaaccaaacactatgtacaaaagagctgatgttggagtaacatataggcattgtttagttcgcgaaaagaaaatttttgggtgtcacatcggatgtttgaccagatgtcggaaggggtttttggacacgaatatcacctaacgatttatggtgtaaacaatagagtcgccaaaatcgatagatcaaaatcggctagtgaaaccgatttcgagattaattcactttcgcggaatcacacgactaatttacaagcaaattagcaaagaggataaatatcgtacttacgtgacgacgaacgactagttttcgagcaaactagcaaaggataatcttctcgctttcgtggagaagcatgaccgtttttcagcgcaaaatggcaaagatcaaccaaattctagggttgctagaactcagccatgaaaatgaaatagaaaagaactaaagagaaatagagatctaccctatagttcaacaaatactttcactcattcactcatcactcattttttcattcctcatgcaatggtcaggattgtctcggtgaaatcccaacggtccagatcgctcccacctcccatctctcaaccgcgccctcctctccgccccctctctccactctcaagccccgccaccccctccccgcgcccaaacccccgtctacccctaatccctcctgtcctctccctctcacgcgccgccacaccgatccctccgccgcaatcgcatccgtgctcggccaaatcggcgccaccgccgtcgctgctgccctcgactgccgccactcggccgtcgtcgcgtccgttgtctcgccgccaccgatgactgatccccgccgccggctcgccctcaaccgatccccaacactgtcgtccaggattcgcctgagccctcgactgctgccactccgccgtcgtcgcgtccgtcgtctcgccgccaccgatccccgcgccaccgccgtcgccgtcgtcgcgtccgtcatatcgccgccaccgatccccgccgccggctcgccctcaaccgatccccatctccgtcgtcgcatccgtcgttgtccaggattcacgttgccgccgacgccttccgtcagctggtcgccgccgacaccttccgcgcagatctcctccacgcctccctcaggtcgttgccggtgtggatcaggactcaggaggccagcctcgacacactgcgctacacagccgccggcctttgctgctcctgttgcatggatctagcggtgggatttgcaatagggacggcgatgtgccctgctcgtgctggtggcggaggtatgagcattggggaagcggctgacacggccacgtactcccaaagaccggccgccgaccctgcatcggcgcctcaatggccagccccacagtcccctccccccatctaactggtaaaggttcctcttcctcagttttggcgagttattcacctctccgccttttcgttcatttgccaatccacgactgtttttcagcgtaaaatggtaaagatcaaccaaattctagggttgttagaactcagccataaaaataaaatagaaaagaactaaaaagaaaaaaagatgaatagtagattgataaaattgtccggggttctcatctctgatcatccgtgaccagcatatatatatatatatatatatatatatgccgtcgtacacatgaattaaccggtcccacacaaaaataggaaagttgaaccgaaaggaaacaaactaataaaacagaaataatatctttatctttgcagccacccgcgctaatcatgccttgtcatctgtgaactgccgcctcagccgcacaccaacgcaagccaatacggctcctgtgcatgaggagtaatgcagcacgccaaatttcttctccactgcatgtatgtgatcaaatcaatccagtatgtacagaatgcacagcagtaactcctcggtcgtagcagcacatgcatcaccatgccgatccaaacactgcagctccccagcaactcgtacacctccaggtgcaacacaaattcctgcgcatatatcaagctagctaattcttaaggaaaccacctaacgattgcaccaactattctaaataatctggcccgctcaaatgaaatcaaccatgagccaaattatggcgtaaacacatctcctctgccgacctccgtgcgcggcgctcttgtatcgccgtcaggccgcccgtcgttggcttcatcttcagcatccgttctgctccgccggcctcaccgacggggccatgccgtcgtcgtcgcctccactggccgacgatcgcgccccgatggacagacggatggcgcagctcggctccacctctggcaccggtctccccctgcaacccccgactcctccgtctacagcaccaccgtcgaccgggggggacgagctcccggcgctgcttctccgccgccggtcctcgcctaccacctcgcctgtcttgccggctgccgggaccatcctccgccggctcaccggacgttcgccgctcgggaggagcctgtgcggctttggctcaagcgcctcaagggcggcctacgatatctccgatatgctcgacgaattccagtccaccgagccggacgcagggaaggtaaactcctgacaaaccaaattaacttgtcctgggtctgaccaagttggagtaggaacattttgcccaatttttgtagtattacgttgtgggattatggcacatcactttttttttttggtaaatctggtgtatcggatagatgaaacatggggctaaaagtttgtgggatgccataaatttgatcttgaaccaaacactatgtacaaaagagctgatgttggagtaacatataggcattgtttagttcgcgaaaagaaaatttttggatgtcacatcggatgtttgaccagatgtcggaaggggtttttggacacgaataaaaaaactaacttcataactcgcctggaaactgcgagacgaatcttttgagcctaattaagccatcattagcacatgtgggcaccgtagcacctatggctaatcatgaactaattaggctcaaaagattcgtctcgcgatttctatgcaaactgtgcaattagtttttgtttttatctatatttgatgctctatacatgtgtctaaagattcgatgtgacatttttgggaaaaaaatttgggaactaaaccaggccatactctctccgtctcataaaaaaataaggccatgctctctccgtctcataagaaaccaacctattactagatgtaatacatcttaatacaataaatctggatgtgcctatgtccagatttattctactagaatgtgtcatatccaatcatagattcgttttttatgggacggagggagggagtatattggtacagaggaatttgtagtacggtttatctaacttggttgcaacattaagtcaacgacctgttgtgtatatctgagatccagtaaccaattttcaaaaccattttacataatcttcttgcactgaactacttcttcaatgtcgtcaaagtgaacaatcctgtgttcgttaacagttggccaggtttccatcaatataaattgtagcttgtgacttttcactaattctcacgtatattaataaatcaaatgaaatttattgcagaaaaagggagtgttccacaaacttgcaactgcacctagcaggtttcctatggctagtaagatgaagaggatgagaaagggggtgc

SEQ ID NO: 62679 - DNA, 1331 bp, Oryza sativa
cctatttatgggattggaggcattggtaaaacaacgttggcacacatggtttttgatgacagccatttcacaaagtacgatttccatgcataggtccatgtgtctcagacctttgatttggataaaatagtgaacacaataatttcacatgttgcatatccagaaaaggagagctttatttcagatattcagttgatgagaaaacgccttgccggtctactagaaggccgaaggattttgattgttttagataacatatgggagagcgaccaatttaagctggacaatttgaagattatgttaaatgttggcaagaagggcagtgaggtggatgtcatagttaccacacgcacagaagaaattgccaaaagaatttgcacagtgaaaccatacaagctagaaccattgaacgatgacatatgttgggctatcattaaaatatacagtgcctttgaaggtagaggtgataaacagcaggtggaggttatagggcaagagattgcaaccaagtgtggaggtatgcccttagcagctcgagcacttgggtacactttgtattccaaagcagttgacagatggctagcactgaacaacagtgaaatatggaacgaatgttcctctgaagaagcatctttaccacatcacttggtgcttccatccttgaagttaaactactacaacatgcaatcttatttgaggatgtgctttgcctattgtgccatctttccaaaaggtggcaatatcacaaaatacaatttgattcaccaatggattgctcttggtttcatcgagccatccatcacattctctgctgcatagcttgctgaggactacatagagcatctcttgggaatgtccttccttcaacattctaaatcatattcggtaagtaatcagatgtgcacttctctataaagaaacaaacctagttctttttttttttgaaacagtagacggtaggagatctaccggatatattagaagaagagagttgaccctgtttataaggaaaaccaggcccgaaaaccatacaactgcacagtttgctaaagggaaaccggcaaaaaccttacacagaagacacgaaaaagcctgcgacaaaactacgaaccgcagtagtgaccgaggggagagcaagaccctcaaggcgaagcctccaaggaggtgaacaacgacagaagccgctgccgacgcccgcccaaagaactaggctgggttttcacccaaagggagagaaagtccataaggcaacacctccaaggaggaaacggcgcccgcagacgtcgatgttgccgatcctggaagaccagacaaggctttcgcctaagact

SEQ ID NO: 62680 - DNA, 823 bp, Oryza sativa
cctgcacacttgcccttctccatcactgcaaacatcagcagcaagaaattagccccgacagcaactggtatacagagctagcagctcgtgcaatatgaactcccaaaaaggcaatttatggaatttctccaggaaaaccaacaagaagcgaatcattgagcaatcaaccattatatatgaattagctatcacatttttaggggaattaaatcaactgttgtcatttgcaaggaaaaaaaatcagttacaaagacaccctcttcctaatcttcagagcagtgaggcaagcaatggagtcattccttgatgcacagcgacagcgaggaggacgagagcagtaaggaagtcatcggcggcgctggcagtagtgctttcttggaatggaggtagagctcacggggcaaattcaccagatagtagtccaacatgagaattgatgggagaggcttgagcttgggcaatctgcagatgccatgtcgttgatgaagctgtccagctcccaatttcctgccgtgcaaccaccctgtgttcgacctcacttcacatgacaccttagctctcaccatgctgccacaggtaggaatggggaagaaagtgggggctttggggctaatgaacagggaccaccaccacctgttagttgacgggaattggtggaagtgggttctgtgttacaatttgccccccagtctgttgtattgtgaaataaaatgtataactgtggttttgtgatatgtgtgcctcaaaacctgtgatttgtgaaatttactttcagaaagatatatatgcttctgagattgtcattgctattatatgaacagat

SEQ ID NO: 62681 - DNA, 6066 bp, Oryza sativa
  unsure (1)..(6066): unsure at all n locations
nnnnnnnnnnnnnnnnnnnnnnnnnnnnnnnnnnnnnnnnnnnnnnnnnnnnnnnnnnnnnnnnnnnnnnnttaattgagtcaagataaataaatcatcaagaaagcaaagtattagggcaatccaacccaaaaaatagagtaaattgcatcgccggtgtatcaacttggcatgtgggtgcaaaatagtgcaagaacttgagaaatgagcaatctagtgtaacaacttggtagataggtgtaatttagtataaaaattttataagtgatcacataaatgcaccaacttgcaaggtaggtacgattttgatacaataattaagaagttatgtggcaacttaattatttgaagcttatttatatttttatcatagtaactagtaactgaatttcaattaaactgaatgtagaaattattatatttggttgatatttgagaaggtgaagaaaacaaaaaattcttaaaaggtaattgtgtcgacggtgggtacccgtagaccggatatagagggtattggggtacactggtacgaggatctacgtagtacgacatcaaggaaacaagagacaaagattatactggttcaggccccttagcaggtaatagccctaatccagttgatgtgggattatattgagagaaccacagattacaaagggaataatagaactcggtggtaccgacgagatcgtagtcgagttgattcgactagatcacccggcgacttggctcctgtagtctccggcttcgtaggctgtggtcgttgtgtaggctatgagattcgatcccctaagttccctcggggggttccttttatatcgctggtcaggcggtctccaggtaggaactcggagacatcagaccctgtacgatatagtaacgacccagtcctacacgggtaggaacctttccattggtagactccgtgatggatttccttagcgtgtccagataacgtccgtatatgcaccgctatatcgtatttccgtatagcatacatccaagggtagagggtataccttatccgtaaccctgacaaattggatgtaaattatatgtgcagtataatttttaaagattaaattcaatattataaggtaatatccgtaggattactatgtaatggcgtattgacatcgtgaaaaaaaatcacctagcgtatgcttagccaaattaatgcaccaaaattctaaattatcaagttcttatactagaacgcacctatttgtcaagttgttgcactcggacgttcaattctcaacttcttatactatatcgcacccacttgtaaagttggtgtaccatgagtgcaatttactccaaaaaatattataattttcatacttgccatatcatatagatattatgcatgagaactatttgcccaatgggtggtttattcaaaataaattctcgtccaatcaccttcttctctctccttttacccacctatcctttattttcatttttcgtttacgtgtagagcagtttttttcctaagaattagtttcctcatatttttccctctctcttcattaactctcttgccatctttgctctttacttatgtggcagtgtaattagggtgaataagtatagtttcttatacaatacaagattatttagagatcgtatctttacaacagtaagatgacaaaagctctaaccattacctcaaaaaatattcttttgattctattctttccattttttcccctcatgcagccatgctttcatattatagaggctaagagttattgttacccgcaacaatgatgttttatctattctctttctctctattttatgtcaacaagcatttttaattaggaaagctaagacattgttataaataatcattgtacatgtccttaatgctatagaaattagctaaggtggagggttaagagtgcccttaacagttacgtgtccccgagaaatagaaagttagaaacgatcacgttgttcttctatcaagttctgttcatttttctctttaggaaaaagaaactgagtgctgtaactttgtttttgggtagaaatgatgcggtcggggaatcaacggctgccgtgagcgaatagcctcaaaacattgtcgtccgtccgccgcggcgggccctacgcgctgaactccctaaaggcatcgcgtccggcgagtagcggcgctgaccagatcagccgagtgcctgcctaatgtggctgtctatgtggccgaattttgattattgtgtctctgactctatcgttttttatttttcgggtggtgagtgtgttcgctagcaggagttaccaactccccccccccccctctcctttttctccttttccgtgtgcacgcttttcaaactacttattttttaaaaaaaatacttccttcgtttcatattataagactttctagcattacacacattcatatatatgctaatgaatctagacatatatgtgtgcctagattcattaacatctatatgaatacgagcaatgctagaaaatcttataacctgaaacagaggtagtagctaatacttaattaatcacgcgttaatggactactccgtttttcgtacgtgggtgatgggttcccaacacccaccaccgaacacagccaaaataacacgctgttaacgacgaaatttggtaagcccaaagtcatcatcggcttagagtcagtatcggcttcagagttatggaattagccgatgggagtcatcaaatcgccagcaaccgtgttcttgatggagtcggatcaactaaagggaatttatccagaagagtccgagttcaagaaggatgtggcatgtcagtttatctattaattaggaatagtttattagtttcctttatctttaggaaggtgtgtttagtgtccgatagggactttatgttttccttttatctttaggaaagtttctttcttgtccgacaaggacttgtatcaacccacaggtataaatatgtacactcgtggtctatgtaatttatcttcacgatcaatacaattcggcgcatcgccaccttttatcttttctactttattttatcgtccgacgggacttggcacctgacatggggctgcatcggtgttcgatctctggctaaggggtaagtccaatgatccgccggcccaggcaattgtatcatttacgttgacgtcgttcaaggctgcatcagtacattcgacctcttggattgctctggtttggatgatatatttgcctacctatttatcatatgtctctgttaatctagtcttagcatatcaatttagctttatcggctgcttctcgttttaggatttctgccggtatcgactaaatcgcgttgctagattagattagcttagacatctaccactctgaaaactcagtcaacggcttgattatctagatattatgtttcttttcatatttagtgctgcatcagttaagtttgatctactaagtcgtgcttagaaccataatctctagcctgcttcttgattgccaataagggtttcatcggggtttcagccggtgagttatctcgacgttgcatcggctcataaggattacatatacatataagttggatttagccgatgacaataaaggtttcactgtttaatctaatcttgtggattttatgacatcggacatccagccgatttgtgctttaaccttcggatcgatgcttatttatcatatcattatttgccgattggtttatactggattatattgttattttattacatcatcatcatcatccgattgcctttatatcattatctacattggacatatagccgattgcttgaaccctatcgctatcggctggtattggcatcggctattatcggttatcggcttgaactactccatcggcttgtcagccaatcggctgttttgatatactatttgcatatcttgtcagttgcaggatcaaactaactagcacgtccgcatctcatcaagatttgggcctacacaggagctaagcaaatctcccaggccggtgtgttcgatttttttcgtcaacacacgccgttgctcaaactggcttcagtcgacagaggagccgtcggatgaaattagggctactaaaatagctcgaggctacctcaaaatcaacattggtagctaaacgtaagaatgtcataagagattcaagcaggatgacgatagcgatgtatgatactccctccgtttcatcttataagatattttgactttggttaaagtcaaattgtttgaagtttgactaagtttatagtaaaatataatactccctccatctacttttgatagtcatatttccaaatctgaaaattttatttttgataggcatatttcaatccaacaacttatcatcttaatgactttcttggatttaatgcatgactcttcgttcttccacacatgattggctacatgggcattgagaaatgtaaatattaatgaatcgcttatttacgaggaatgactagtagcatatttaaatggatgataagtagaattacttatccttggtctatgtgccaagataaaatatgactatcaaaagtagatggagggagtaatatttacattaccaaattagttttattaaattaataattaattatatttttataataagtttatcttgggttgacaatattacacttggttaaacttaaagtagtttgactttgaccaaagtcaaaacatcttataacctgaaaaggagggagtatttactaacgaaatttagtcgaaacctacatctgcaaggtactaattatgagtgctcctcccggatcctgaataattataatgtatcagagttataaacgaccctcggtcggacgacgttggcaaccgctacctttcgcctatactaaattaccatgcggttataacaggtatgcctctctatttaagggagggtctaggggcctatttgagagagcttaagattctgagaagcagctggttggaagccagcttctaagaatctggaaaagctgggtttctcagcttcatctcaaaatgtttctcgacagttgtcgatggtttccttgaaaatgttcaaatcagctactcatcacaaatcccgttttgaaaagcagtgagaacgatctcatccttactttcaggatcatgttgcgtgcctccgagaaacactaggggtatgtttagttcacgttaaaattagtaaactaaaagtttaattgaaattgaaacaatgtgacggaaaagttgaaatttatgtatatagaaaagttttgatgtgatgaaaattaaaagtttgaagaaaaattttggaactgaactcggccctgatgtagtccttcaatgactcgttttttcgttgttgaatgagaacctgacctgacgagacgtaaatgccttggaagttggcaatgaaccgctcccgaacctcgcccccggaacgaaatggattcccgcggaagccccgaaagccagctccctgcagagtcggcgagtgccacaggaaggcagtttgcccaagttgagtacacgtgatttgcgaccgaggatgtggtttaacgaagagaatagggaggttaaatagacttacgttttttttggtttcagctggtccactagtcggccgatccaagaccaagctagagaaaaagcccatacttggcccatgactccttgcaccatagtcgcaatcacccacccctcggactcgactcccggagttggcccgccgccgccgccgccgccgcctcgcctgcgtcgatctccatcccgcgaccggagctccacctgtgccggcgtctgctgcttccaccgcatcctcgctagcctgccccgccggtgagcatccatccatccgttccgcacaaaaatcctccttctcatctctttctgctcgattttgagttagccctagcagcttgtcttccaggagtagatctggaagctgcttctctcgttgccttatgccttagctctagtactaatacccagtttagtttgttcccaagaaaatttggtctaggtccacccatgccaatttaggcttcactgcttgcagatacatatagtattgatcgttggttgcaaatca

SEQ ID NO: 62682 - DNA, 1363 bp, Oryza sativa
acaccaaaacttactcccattttcataatcctttctgatgcccttatggtttggattgttttttttgcattatccaaaaatattgccacactttaatattcttcagtactttggatgcctttattcatatttacaatactaaatttattcttacatgtggcaacactgaagcatcacatgtttctttgttgcagagaacgagcagattttggtgacagaggatgactttccagaagtgaaagtggattttcaggtaacaataatcaattcctagtagtatatcatcctttttaattccctatatgactaatcaaacctgctaacaggaaacatttttaggccataacagttcaattagctgctgtcgattttctgcatctggatcaaatgttgcaagttcttccgttgatggtacagtgaggtaattgtgccatctccattttcctttggttgcctaactgatgtttctagattttgatccattggttttacaattcttaaaaagaatctggacatatgattcctcaacaccatcatccaaaaatgccactatatactgtgggtctgaagtcagtgctctttcttgggaatgcagatctgaccgcttggtatgtgatgtctatattggattttttttgttatatcattttttacagcatttgacctttgaaaaaacatatttaagacatttcattttatcacccatttctcttgacaatagctgctcataggcacagctaatggtggcattaaagcttggaatgctgatgcaaagagagttgtttgcgacctcagtacatcaaaagactttcccaggttacaactgttactttcttgcttatcacttaagtttatgctaatggagcttcttgatctcttgcagtgtgttagatttgaagtgtagccctgtagaacctgtgtttgtctctgcagctgcatctagacggtactttttgaatccttattttcataagaaatccatttccagttatttcaaattgatagcttccttttcctacaatagcagggaccactgcatttctgttttgtgacaaaagctttggttatattttcattgtacatgccatttaactttataaaagcttttatcatgttgtatcttctagatttcctacaccactgtatgattaaaatctaggtggcatttgcttattttgagctttgaattactttcaggcctggatcaactatatttgacagaacaggatttgcttccttgactgtatggcatatgaaaacatggaaacctctggtacttctattgcttatccccttgtcttaaacctatgtgtggattcggctagtaagctcttcctccatgataatatctttttcttctatt

SEQ ID NO: 62683 - DNA, 1731 bp, Oryza sativa
ccatttggagtcgtggtacgaggaccgctatgctgtctgtcgaagatcagtcatagctgttcctcaaccatctgaagtcatctgaactcgtggtgcgaggaccgctacgctattgccgtagtcatacctcgaccatcagaagttaaggcgcgagagatcgctacgtcctactggttcgagaaccaggagtaggagcctctcaatcacctataggggtgctaaagttggtttgttacatgtgcacctcatgtggccagcatgactcacatacccaacttatagcatatccggatatccgctcgcaatcatatcgggtgatcaagccgacaacgttcacgagaatttatccgttaacaaccttttctcgaatagcccagccatggtcggcgctatgagataggtcgtcggtcttcgttggtaggttgggtgcgacaactccgcatttgtcgagaatgttctcgataatgggtgtactcgaccacaacctactcgagtgctcaattgttcctgaaaaatattttctagaaggcaagacatatagaagataatatcgagtatgtattcaaaaaactacatggatcttctagtattatcaggatataacgagcatatgaaatatcaggcattatataaagagagaatcccttatatgccattgaaatttggtctgatccctgatatgccacacaaaattggctcttcccttatatgccattgggtcaaatttgagcaccctctcatgccactcacgtgagttgactgtgtgttgactgttaacttgatagtgaaaagacgaatttacccctgagttgttaggcaggcagtaccattacttggcatttttttttaattggtgcatgtacatgtatatacaacatttcagcattatattgattatatgaataattttcagcatttattgattatatgaatattgtatatacaacatttctaccactaccatagcatatatttttcacaaagacatgaattaaacaagtagttctccaacaaaagcttggacatgcagtataccaaggtctctaaaatattacatggtcatgtcataaaggttcaaatgacctcacaacaccaaaatacatattgacggtaccaaaatacattatagtgcatcagcactcatcacagtgcatactaacacagtcctaacatgcaaattaactagagcagtactccaagatattacagtaccaagctaacttccaaatattacagtaccaaaataattcaacacatgcttagtataaattaaaatctagagatttcttctttttgcttcttgtccccattgctggactatctggagtcacgggaacaactttttttcgcttgatttgagccaaaggtgtagcatcagtgctatcttccttgtttttcttagtggctaccttggctttagtctttgtcttgggtttggccttggccttgcacttgtcaggtgctagtgctggtagtggcatcagcacactcaaaggttccggttggttggatcctgtcactgatcttgatctgaagattcacataaatgtaagacaataatctttgaaaggaaaatgtaactaaaaaacaaaatgatcagtgaaaatgaaatctgaaaaccaaaatacctaattgaatctgatgaagtaatagtatgtcctttttttcccactttggcagcttttggttggtgggtatgacatagttggagctaagcaaggattttgggct

SEQ ID NO: 62684 - DNA, 1228 bp, Oryza sativa
aacaagtgatagaaagaaatgtcattattcgtgattgtactgctcatagacaacttcagtcagatttgattgagcatatttggctaaagtttgggaaacgaagttaattaggtgatcgtgcatcattttaagtctagtttacaatctgtgtattacatatactacttcatatatagcttagcagtaacagttgaactaaataactacttatttttttccgtaatgtgattttttaccttacatatactgacatctcttcttttatttccttcctgcagataaggtcatgtctaatgtgttgctgctctacctaatggttgaagtgctcctgtctgctggatagatgaaatgctcctgtctgctggatggatgacctaatgtccattggatgaatgaatttttaatgttgaatgtcatcaggctatctaagttattatacttatgtttctttattttgatgaactgtgtcgacgtttgatatcgcgattccggtatttgtatagtatggggatcgttggtactaggatatatgcgagatgtaataaaagagatggggacgaggatttttatataggttcaggccactgaattgtcaggtaataaccctactcctgttggccgaagccggtcgttgctcttattcaccataatcacaccagtataatatttgtggtagtctatctaactgttgtcgacttggcgatctcaagtgctgactcgtagtcgacaacagggtaaccttcctcctcgaatccgcatccggcgatatcaaagacaacgatatgtctctcctgacagtatccgtagacaccgtaggggactagccatgcttatctctgaagtcgatatccgacatcttgtcttggcgcatgttggcttgtatattgatcttgtgtcttgatctattgttccgtgtcccctctcctcctagggggccttgtatttatacccataggtgtccccttgtccaagtagaactagggaaaccaatatggatacaatccgagtagtcattgtcgtttccatgagaactctattcatccttccttatgcggaactcctcctatctccgaaggttatttccgtataagacatggtatgtggtgggtcatgccgagatttagtcaactactattaggtatgtgttatccataaccctgacaaactgatgttatgaaagactaccagtttgagtgctgctactttgttatttatgggtacctattta

SEQ ID NO: 62685 - DNA, 820 bp, Oryza sativa
tcctgcagcccagctgcattttatcaatcctgattggagatgctgtatttaacggactgcaaacacagtatattttgcaaagtgaacttatcagaccatttcctcatttttcctaattgcatttctatcaccaggttttgcagtccagagagctttagcaaacgcatgcatgagatatcattggattctgatggcaagaggctgttggttacatcgggtcttgtccgggctcctatatatcaggtctccacaatcacccaaacttccaggttcattttgcagaagtgataccaatgcaaatcatctataatttttcctcaggtacaaggccatgaaagtgggctgaggacacttgctcatagtgcatctattacaagtgtggattggcacccgacgctaccaatgtacattactgggtctgcagacaactctgtccgggtcacatccattgtatgaatcaatctgtgagtgtgacaggcagattgctctcgaggccttgttgatttctcgatgcaaccacatacgccattccatgaggtgaccagtggtgcgccaaatgattatccattttcctaaataggcctggcctctgggtttcaaatccccaatacgtgcttcttttcctaccatataccgactcagttgtcatgtccagattagtggcctttggttcaggatacatttttgcgttgaaggtgtcctgcgatggtgagcttctataacctttttgctgtagaactgcatgagttatgcaatctttacaacagggtttgggaattaaaatcgtagcagcaggtttcgtcctaaagcaaaacagttt

SEQ ID NO: 62686 - DNA, 2271 bp, Oryza sativa
catgcggagatatcctgtctgaataaatcagaaccacaggttgctgctctatcctttgttccttttggcctgttaagattgaaactgaggtggatagtcaaacattacgagaagcaatactactcataagacgttttgactccagtaaaagttaaactactctaagtttgactaattttatagaaaaaaatagtaatatttttaaccaaagacaaatatattatgaaaatttattcaattatagatttaatgaaattatgctggtgttgtaaatattactacttttttttctacagagttagtcaaatttagagtagtttgactttgactaaagttaaaacgtcttgtaacctgaaacggagggagtatttcggtggattgaaattctgcaattggacccataacctgcactattgaagttagctacccaaaattccttacattatggagggagtaatgtcgaggcccttttctgtattggctctacggtcctttcggtgttttcagcctatgcaacttatatactccatccatttgaccaagcttgtttaaaaaagtagtaacatttttaacccaagacaaatatattatgaaatatattcaattatagatttaataaacttacttggtgaagtcaaacgacttcaagtttgatcaagtttgtagataaatgtagtaatatttgcaacactaaataagttcattaaatctataattgaatatatttcataatatatttgtcttgagttaaaaatattactactttttttaacaagcttggtcaaattagagtagtttgactttgaccaaagtccaaaacaacttctaatctgaaacggagggagtagaatatcaaggcaccgtgttaatttcaattcggagtttcggggtgtggcaccatgttaaactagttgatgcccgcgctttactgcgggatatgtggatgaatgtatattatacattataaaaaatgatagacgtatatatgtttagataatgtgaagatggtgatttaacattgcttgcgtgataagttcaaacaaaattttttcgtcaaaaaaagttcaaactaaattacaaatgatatatcatgttggcatgaaatctagaatactctgtataataattgctagtgagtgatgatatggcacacttgcatgttaaactttaaaagttagtgggtatcagctatatataaagtatagttgtctttggtataagagcaggtacaataagatccttttgccggtgacaacggctccacgttggttttgattgtgcgctggaggagagagaacgcgtcagcgagcgactaattagtcaccgagctatatgcgtgttccgagaaattgtgggcccaagcatatgagagttgcgggagccgggaggataggatgatcgatgcagcatcacgatcatgcggaataaaataaatatatgatgcatcatgattatagcccatttattgtactatatttgcctcttaagtttgatgaagatgatgtggaagaaattggagtaagcaatgggctacactattaaacttcctctaagtatgattaaccatgttaaatgtgtttgcacacgagacacgactaaccatgtaacgagtaatcttttgacctgtgccacgtcatctcaatctttggcccccctgctctcgcaagctcatgccatggccgccgtcgctgccaccgcgccggcgacctccgtgaccgccgctaccttctcgccatccctcccattgctctctcgctaccaactcccccgcgcccaccgggccgcgtccaccgtggcgttcgccgcgcgccgcttccgcggcgtaaaccctagcagcgaccgcccccgcgggaggcgcgcctccgtcccggccgctcccaccacctccgccgcccgcgacgacggcggcggcggcggcggcatcgatgccctcgaggcggagctctggcgcctccatcgccgggcggagctgcgccttcaccgcctcgccgccgaggccgacgaggcctaccgcgacctccgctactccgcccgcgtcgtcggcggggaccgcgtcgtcctcaccttccgccgctcgtccctgcgcttcgccgccgccgcgctcctctggtcgctcgcgctctccgccgcggcgtgggcgctgctggggtgggccgtccgcgcctggcagcggcggggcctggggtggcgcggaggggaaggcgcggccgtagtgcggagagggaccgcagcctgggtggcaaggaggtggtggtcgctgtgtcgtcgtcc

SEQ ID NO: 62687 - DNA, 2180 bp, Oryza sativa
ttgttttggatcccattcaattcatcattattaggagcatagtctttgaattttcagaaatatgagaatggatcaggtcatgagagcttgttagtaataacttttccaattgctatgcttcagtaccgattcaagaccaaatcgtggtataatcttcaaaagtcaatctttattgttttatggcatcgagcctaaccaattctaagatttctatcaaaatggaaatgtgaattcttctgctattgtattgtcatatgtgaagtttggcaatagtttgtttttagctactagcttattttttggcattttatagaatataagaacactcatcgttagtatgatgatccaaatagaaaatattcatccttaagatttgttatgatcatttgaataatctcctacaatacctctttcccctgtcttttgaacaaatatggttttatgtggtaggttatacaaaatagtaaatacctaataatcttaccttttttgttggcaggtaatttataccatctttcaccatattcatgagaaacttgctgcttcatttctcagacctttcaatatttccttgtgccagcaatcattgataatagaatcacggggaaggattacaaatatgatgatgcaattcaagttagtattcattttacctgtagtccatagaggatatagtgttatgatatttcatttctgtataatttctatgcttgcaattgagaggcattggcatcctcttcatactatgttctatggattagaaccagactattttaggtcatccatcttatcctgactcttgcgtggatgttgtttgtcatggcagcatgtagttccacttaagcacctattcagccaacaaaatgaattatcttgcttggggcactaacagaaatttgtggacttacctcgtttctgagatcagtgacatatctgaaccatcggaatatgatggctattaatgcaatttattcttgttttgttccctactgttatagaactttcgagctttggagaaagcatcacaaccctgatctgttgtatgaatttatggaatgatacaaatgttaggcattaacatgtcaataaatgaaccctgaatattctagtaatatggtttataggcatgatcttaagatccttggctattctgttctaaatgttgttaaacggatgatttaagatatttttggcagaacactccaaagttatccaatcttaggtgcaccagagatgttatttgaatattgctacagtttatctaatgatagggctttccactcttgcctaattatatctttcttttgaatgtagctaaggcaattatgcaagatatcaggtgtaaaggtctcttttgacacagagaatgctcgtgattctttctatagggcggcaataaactttgttctggatgattgcagcaggtgtatttttgtttttgcttcaacctttgttgctattacctccttttgttttactattgattttattatcatctccattgatctgcactgtgctgataatttctgcttaataaagagcagcacaagacattggagcagcacaaatcagtggggagaatccaaggaattttcttgctggtcttgctagcaatattggattggataaattccgtgctgccacacttgtttgtgcatcagttgctgctcgcacacgttctttgttcttgcaatgctgggtacggatttacctcgattttcaaacctgattgtgtttttacccatctcatggtcatgctgatgttatgtgttcaccgcatgcaggcactagagatgcaaggaaaacggtcagaggctctagatgagctctcaaagatttgtagaattcataacatgttccctccagaggaaaattctgtatgtatttggtttttgttttcaacttggttttgagcattactatttttctgcttacattttcagacacgtataacccttagttgtataacttgtcttgatgcctttacaagttttctgttgtcccaatgcctttacatgatagggtcaaaattttatgttgtgaatttgtttacattctgacagcatattgatatatatccaaactccaatgtagccaagtattaacaccaaggccaactttcctttttggaagagtagacatagaaagccaagcgatttactacagttgttttctgagtc

SEQ ID NO: 62688 - DNA, 12369 bp, Oryza sativa
tttttttcttttcggaagagagactgggtttgatatttggaggatgtagtaaatggtttccaaattggaggtgaaaattagaatatgggatgatctgggctgctaaaagtgaatttattcctattaaaatagtaattatttgaagagaaaattgttactttgccatataagagagtggcatgctcacattttccacagttcattgtcattgctaaaataacacaaaatgtccggtgaaaatttgctctttaacaccatggaatgaaaattttgcaccaatcatctcccctcactcatccattctggccatggctgtggcctagctagccactaccttgtgcgtcaactccagatgctgtcctgtgcaccctagcctccagagcataaactcattcgtcatattcctggtttagcatccaatgtggcaaaggagcaaattcacacttactttgtggcatattagttatatttaagtaactttgtggcaaatgcaagtatgctactcaactatttggctgaagagttcctagggtagttaaagggtatatgaagtatgtagatctgcacatatgttttccagatatatagggtgtgctcaacaatctttggatgaactaaaccagcatagattgatccaattacatatcaagaacaaatagtagcaagagagtgttaaggaatatagagtcctttacatgtatagtactatagtttatctctttacatatttgggcctctttttagttctatatgttgccttagggctattattacaagctatattcataacaaggtatcagagcatctgatccgtgctgccccaggagattgatcttgggggtggccccattttcgttttttcctctcgtcgtcgatgctcttcccattattggccgctcatccttgccgccaggtctctgacatcgccgctgtgcttctccaccgtgtatggctgtcgtgcgtcgctgctgtctctgcgtcactttctcatcaaaccagcgtcgctgcttcctccgctggttcctggttttgttgcttccattcctagtttgctgctttgagcagatcgattaggatgtgtagggctgttgtcttctctggttagggtgcacctttttgatctgctgctcctcgccttttgtttgcactgctttacatgtctgtcatctctgctagatcgatcaggataatgaaaaagaaaatccaccttccacgtattttgtcaggctctattcctcgttgcctgatgatttttgatggttccaatttcttttgtttctgctgtgtccacatactcaaatctttttatctttgaattttcttccgttgtgtcctcattctattttctgtttgagttcatatttgccctgtgcgtccacatactcctgtcatctgctgtcttcctccagtgttagccaattttattgtttggttaatctccttgtcgttttttatgcaacaagatcatctaggtctttttgtagctttagtggatcatttttctttgtcatcttgctgctcttcgccgcttttgcttgctgctcttgaccaaggatacttttcattgccattgtcacgactttatcttcggcttcattcgacaggtcttcaaggattcacgcttcgacgacattttacagagttggatgtattagctttatattgtctaagttttagtacttagtgtaatctctttcaattgcaatgctattgcatacgctttgcatttaagggaggatgttaagaaatagagtcctttacatgtatagtttatctctatacatattttggcctcttgtagccctatatatttgcctccttagggctattattcaatacacaagctattcataacagagagtttgcaggagtcaggaggaacagcatctccttatttttttttataggttaatgggcagtcaagctagagttatcaacaatcatgaacttacgctacatatgctctttaattggctcaccagagtcctacctttgctcacaagaatcctattcctgttgttttacttgaacacgtttctctattttctagaagggctatttatctggttgttttttcatgcagagcttaccagatcaatgagaatgcagatgctgctggaggactcattctgtccatatttttctagttccaacttctaattgcgacaactctattcggagtctcgaagccaccaaaaaagattggtagtgggagattttggcatcctcagccatcaggtctccagaagatgctgattcaggagcgaagcaaaccacaggaacagttccaggcggaacatgttgtccccaagaaagaatgatccgacacatcatttgttctccgtggcatccgattttgatacaacattagcttacacatttgacagtttcacaggatgtaagatgttgcattgagcagcttctttttgtaagattttgcagtgcagaagcacaaaggtgcttggtcgtggtacgagatgtttctttaaactcgcagatagtacttgccaagttgccattgtccttcaaggttgaaaattgcgatccattttacagtacggcctgaggggactttctgtccctgtcggtgtcctctctccaggcgataaaggaggtccctctccgtccggcccctttcctttatcaattccggtggttccggttgccggcaatggggaagggggtatagttcttcccgtaccctaattgttttctcttcttctttggtgcttttgtgtagttcatcagcatcgtgtttctcttgtcccagttcttttccatggattctggccaaatccatccatggagtggtctttgggttttgccatgaacgctccccgactggaagtaaagcaagtttgcttcacaaacggttgcgccgggcattttgttcatctccggcgaggcaaccttggatgcaagcctaggagagaagctgagagtttttattgttttacaatggaagcctcaaccttcaagtggaggtctcttttgggtatgcttccttgcactttcatctgtagctactcatagtttcttcatcaccgtcctcgtcatgatcaagcttgcaagttgcaacctagtggaaaagagaaggacttggttgttttttctagtttctttagaagtccatagcaattttcatgagcttatgtcaatttgacaatcttcaaggggcctttatgcaaaactgcttgtacttgcagttgactctccactagggataactcatgtgatatgtacttagttatctataatcaataaaatacatgagttttcaaaacaaaatttacactatggcctgccatgcccacttttgggcgaggtcggaatgtgacgtttgcatgggtgtacttaggggtgaatagcgagctggctcggttcggctcgtttgaaagctcgagctagctcgttaggctcacgagccaaaccatctaggcggccaggcctctcctcttctcagcgggtgcggcgcaggggtggatgcgggcggcgagcgagcggcagttcagcgccgccgcaacctcctccgtcaggcctcaggactctagcacggcggcgagctcggcgccgacgtgctgccgcgcgtcgccgacgggccacacgctccaccctacagccatctcggcggcgatgaggctgtgcaccttggtgagctccgcttcgagctgctcctcctcccagtagcgtgaggcagcggcggcggaggatgaggaggagcttgtcgacggcgccggcgccggcgccgttgccgatcagattcacgccgaaagcaacctcctgagtgcaagccattgcagcaagctacagagagcaaagtgatcgacgagctaagagtgcaagaagagtgagctcgctcgatggcttgcttgctgtctagcttgcagtggtggtgagtgcactggatcactgagatggctgcgtatttataggggatatccggcatggttgcggcggccagcgccgtcaaatcttggacgggtagatatgtgctagattgtgggtgaagcgtacgtatccaaaggccagaaagtttgttctgtgcatcaacttgcctgaagcaaccgcagtgaatctagcttgagtagcagtaaagatttggcaatctttatatacgatttctgggtccaatcccggacctctcattgggccacgtggcacatgcgctgtgctccgttcgtattatcggctggagaagcatgccacgtattcgcacactcccgcaaccgtccgatgacaaatcaatggtgaaaaatatatccaacagacctaaatataaattgcacgagagtttatttttttaaaaaaatgcacgacctcatctagaacagtcgggagcagaggaaaaactcctagaaaaaaaaagcaaaaaaaaaaagagcgagaaaaatccagcgaaaacaacagattgtatattcccctcgcctgatctccatgccgggacgatgacctcgagctcgatgtaccaccggaagaaggccccgcccagccttaatccgctgcattgacccagagcttgccggcccgcatggtgccttgtcgtgcgtcggccccggagctcaccggccagcgccgcctcggagcgaggagtaggggcggcgggggtccacgccatcgccatatccatggggaacagctcggctcgacaccatccttctcgtcgccagcctcaaccgcctctgcgacagatagatcgctcacatcgcctcctcgacaacctcctcgccggctcgccgcttccgccaccaccgtgacctcacatgatcttacctagtcgcccagatcaaggcgtcgccgggagagggtagaagcggggcgccggggagatagaggggatagacggcgctgctggcagagacgacaaccgagttggtgatggcaggctggccggcggtgagcacgacgggattggcgagggtgtcgggccttcagctactcctactaacccgccgttgttgatcgccggttcgccgccacctctgctgcctccgacatgcatgcagagctggccatctccgctgcctccctcacgcagaaaagactgagtgttcgttaggtggagataggagagattgtctctcgttttccgcgcgcacgcttttcaaactactaaacggtgtgttttttgcaaaaaatttcaataggaaagttgctttaaaaaatcatattaatctatttttgaaatttaaaatagttaatactcaattaatcatgacctaatggcttacctcgttttgcgtatcttcccaatctcctcaatccccttctcttcaaacactccctaagtgaactgatagattgaaggggaaaggcagagatggataatgaaggatggagcagcaggtcaccgctcccaaaggccacctgcactgcacgtggcatcatactctaggaatttttcattttcacccctaacattatttttattctatacttcactaagtactaaatatttttaaggacgcccctatattagtactcacatattgatgtccaggaccttgaaagtttcaactttccaaaaccgatctcatgtacaaagagtaaagagtaaacttttatgtctctgtatattgagttgaccataggagtcatttacctaaaataatattcaatacataaatttcgaaattttctaataattgacaaattttgtaaatcctactaattcaaaagacacatctttcaaagtacttggtaaaggcatacagagaagcttaaacaagtaaattgcccattcacaaatcatatcttgaaatattgaagtataattatattactctaattgttaacaatattgctctcacaattgtacctatgattagctaatcaaccgatgatcgttatattttaagatgacggaatatcatatataagaccagagatgtgagtaggtcacatgggtagattagcacaagaaatttctcatagagagacttgaaaaaaaaaacttagttttcagtcctctaaccgtatagtcataccaattgttaataggtgtcaattactctgtttaatggaagagaaaagggttgaattttttttttgaaaaaagcattctaaagtactacatttggaactctaaacatgaataacattaattatgttaaatatatgtcatagcggtaagttagtacgctaaccgacgcacctattttctagaaataggtaagcatggatttggaaaaggatagggaggggagattttaggatgctcagtataaaatattgactacgttttaaattagaaagaaaatgttaggattgaattaagaaacatgacagctgacatgaactttgtattgtgggataaacaattttcaaacatgttacctcatcatacaagacactttgaggctccttatagaagggttttgtactgcgaatgatctaagagatgatagagctatataattttctatcatctaaatgggctattacttaccataaaagattagcatcattttaactggatggaatggcttggcatacaaagagactcttgtgtagtgtgttcttcattgcacatcggtagttagaatagaaatcagtgaatcttaatcatcgattgttgatctaatggccatataatttgaggtgatgtgacacattgtgggatgagattaagttaatgggaatgaactatgtaagtatataaaatacatatggaggcgccccccccctcggcgccaacccacatgtggctcttagcatgtgcaccacgtggccctctcgcgatcatgacgatttttgctaagtaataagcagataagcatatattggaagagaaaacgagaaagtgatagatatacaaatgataacattttcaaccatcaaaataatggatttaatactctaaaagtaaaataaataaatagaatgaaaaggttatataggctgaaataaaaaaaatatgggaaggaggaaaggaacaaaataatttccattttcccataaagtatgaccaattaaaaaagcatgtcaattgttagggttattatataaatctctaatttatgaaagtcccaagcaatttgtttacttcatttttttagcttgattttattaataacaatcaaatcgaccatcagccaacataaattaatatcgccctttgttttgctttatctgctatgtaatttaaatgtttacaaacataatgtttttctcggacttgctgacataaaatttaaaaactgctaaaagatttttcttaagatataactcttttacaaataaacaatattaaattcactatacacgctatatggatagtgcgccaacggcgcaaacgctttctagttaattctgattggtagattgggctcctgtccttacgttcagaaaacagttatctctccatcctattttaagtgggtttctatgtttaacatttgactgcccgttttatttaaaatattttaatgattagtatttttattattattagatggtaaaacatgaatagtactctatgcgtaacttttttataaattttcgaaataagttggacggttaaacgttgtacatggaaactaataactgcatttaaaatggaatggagggagtactccttatccaaaaaaaaaataaattatgcataatagtttgtgctcatgtgagtgtcctaaaattaagggtcctcatgagtgttcgtctcatgagcctggtagttggaggaactgtatgttggtccggcgacggtcattgtgtggattgattttgtatgtaactcgagtagaatcaacggtgaaaaccttgccgagccaatggccaacttaaagatgaatgcccaaaggcggcgtttccctctttgcaggcgttttttatggcccctgtcctctcgaaccaaatcttttatgatgaaatcttgctacaatatacggacgaatgatgggggtgtttcacgttgcatcctccgtgggggctccgcttaagacaatcttcctcgtgcaatggtggccgttggggtctcttgtgccggctgcaaagctctttaggcctatgacaaggttatctcctacttggttccacttgtttcacgatggatgactagacatcttcgtttgatattggtagctggagttggacctgctttactgttggggtgcaacgaagttgagcaacaatgacacatgtagtattttcttgatgtgttggtactggctatgtggaggaagtggcacttggctttgtctgatgtccgccagggaaaactggagttgcttgatcattttagtagttggtacctatgacgtgtttgatatgaggtaggggttgctgtgtcattaaggtgacaagctcaacaacgataacatatatatgtgtgtgtttgtgaagccaaaactgatgtgtcgtttttttgacaagctgtgcataacaataccctgtgtcgttgggctccgtatccttgtttagttgatgagagccactacagtgctctatactaataatattattacactaccagtagaaacgaccttaaacatcgatttataaggacatatcataactttacaacctctatgattaagggtaatttataaaattatttttttcctttcgttaatccgacgtggccggtgactcacagcataaccacgctaatgctgacgccctcggcacatggagccaccggagaccggaccattcgccagccaacacagttgatgaccaagaaacgtcaccccggtgtcaatgccatcggcgcctaaagccagcggaccagcctgttgtcgtttcgctggccgtagctagcgaacttgcacaaagtacacgataatgacgacaagtttgggatgtcgacggtaaccatgggatcgacgaccatacacacgcatcgacacattgaaatgatttggaaattgtatccatgttcttttgcattgaacgatttcaatcataccatggttaatgaacacacatatatggcctactagaaatgccactactacgaaaatcatctttcgtgacggtcattttaggttttcactgacgaaatttgaagccgccataaagtaaaggccagtgaagatataagattttcgctggcggttagatttttgcaagcggacacacgatattcgctagcggtttcggtccgcttgcgaaaatcgatttttgtaagcggacaaatgatttttttctagcggttgacgtctgcttgcgaaaactcattttccctggcggttgcttaaagataagcgttagtgaaaatcaacccagcccgccaaaaaccccctaccccaaattcaaaattaatacataatattggcatcaatccaaatacagagaatcaacattggcatcatcaacaacacataaacagattaacaacacataatctgatttacacccacaaagtcatcagcagataatcacatctagttaagctcttcactgaaaccatccatgcatgcagcagcagtgttctctctctctaggattcatgcctcaggatgcctcggcggcggcgaccgccctggcctgcacaagcccgtctccgccgcggacaggagcaggagcaccgcggagggccggtcgaaccgcacggcggaggcgggcacgcgacggcgggtggtggtggtgcggcccagaagacgaggttggaggcggcggtggaggcgccctccctgcggcggcggcagatccgccctccccgcggcccaacggtgatggatccgccctccccatggcacggcggcggcggatccgccctcctcacccgcgtccgagctcgtggccacccgtggcggattcggcggctgagggagaggccgagagggaggaaggaggaggagacggacgtaccggtggtggtggatggcgcggcccgaaagacgaggttggaggcgcccttcccgcggcccggcagcggcggatctgccctccccgcggctcgacggtggcagatccgccctccccgcccacgcccgagctcctccgcccgcgctcgtgctcgtggtcacctgtggcggattcggtgactgagggagagggaggaaggaggagacggggcgcgccggcgactgagagggaggaggaagatgaagaggacttagctgcgcaaaaaaaaaaaaaagaagacagagggagagggaggaagaaaaggagaggactagctaggttgcgagtttggacggttttaatatggggaatttagttttcctggcggtcctcttatcggccgcctttgaaaataaccgccaacgaaaatcctattttcgcaagcggttgtttaagtgagccgctagcgaaaataggtatatttttgctagcggtcctcttaatctggccgccagtaaaaatctattttcgctggcggttcgtagcctcccacccctcgtaatatttatgctagcggtttccacgtataaccactagagaaaaaaaaatagggtgatgtcatgaaaaatcaattttctagaagtgtgctagcatgttgatatctaggattttcaagaactcatcgcaatacatacaggacaaaccggaattttcagtgttcattagtcattaatgcatgcttcattgtcaaggcgccatggttgttggcaaggttctgccggagtttgcattcatagttgtttctacggtacgaggcctcgaaggatcatctgcgtcgacgacggatgggtaggtggcagtgcggcaccacaagcgaagatgctgcgagatgcatcgcttgtgtcaatggcgcgaaatggcagcgaactatcgcgtttgtcgactgcggaagtacgaacgacgacatcctagaacagtggatgagaacatcataactaggggatacgtgtatcacggaaatacaaagccaatacgctgatctgcaaaattacgagtgtgaccgtccacgcttatatttctatggacgattatgctctctcatatttatactactattattgattaaggtggtggtataattaaatccggtcccttaaataaaaacagatcaacggtttggatttatttatcctactaatagagagcaccttaccagggcttttagttgatagttaactggtgttgtaggatgtggtgtgtgatgcgttgtcacaccctgaaaattcaaaatatataaattgttgtttaaatggaatttttagaaataattttaaaagtcttgaaaagaaaatctaagtttaattaataaattccaatataaaattgggccagataaaatttcattaaatactttgcttaattctttaattcctagatttttctgggatttatttgagctaaggaagtatttttaataaatggaattgcatttaaggaataatttaaattgaaaaaggtcttaaaaagtctcttttggctttgggccgaaagtcggcccaaaacctctcttctctctcctcggcccagccggcccagtccgccgcgcgcgagcgcgcgtccgcccgctgacaggtggggcccacctgtcagtcgtcgtctaccttcggccgccgccgcccgaaaccctagtttcgcgccgccgccgtttcctttccaaatccggccgttcctttccttctccggccgatttgttagaggggaaatgatctccgggatctcctctaccttttctcctttggaatcttcggttaaatcgttttggaaagctttggaatcgagttcgactcggatcggtttccctctctccaagccgaaggtttccttcgccgttgccgtcgccgtgggccttcgccgccgcctccgagcccctttaaaaggacccccggtgtctcctctacccgtcgccaccctcgccttcgcctctcgtcgccggaagagctctagcgccgtgtgccctagcttttgccgtcgccgccgccgctccagccgtgtgccgccgtcgtttcagccgtcgccgtcgctcgggaagaccgccgtcgtgctcgccaagtcgccgccgtcctcgtccgccccttcgctgccgtcggagaccgccggagcatcgtcgccgtcgtcgagccgaagagcgccgccgtttcaacctcgtcgctgtcaccgtccgttggtcctccgccgtcgctttggtcgccggtgagttcgccgtgccgtccgctacccgttggtgccttccgtccgcgtcgctgtgccgtcgttcgccggcgagcatgcaagcccgagccgccgagccgccgccgccggtgatgacgtcatcgctgacgtcatcggggccgttcgctgtgagccggtcgtagaccgatcgatctcggccgtccatcttggatcggttaaatctcggccgtccgttcgcgtgaaccgccgcccatgcgccggtccacccaaaccctagccgctgacgcaataaatccccttttccttttcaaaaataattcattattgcgtcataattcaatttaaaccgattta

SEQ ID NO: 62689 - DNA, 3347 bp, Oryza sativa
atttcatgatggcttaatgatagttcacgatggtcgatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgttttataagggggtgattatgatccaggatggtgcgctgcagtggattgtgttatgcgaggggtattgtcacaactcctttccgagataccgtggtggtattgaggcacatggtaacatgatgtgggttgtgtcttgtgggtacagtggtacacctctggccagagtaaaactattcgaatagccgtgcccgcggttatgggcgggtctaacaatgtctttcgtgattagtctcacacctctcatcatagtaaaagatgctataactggtaataatttgattagctcctggtttggaatggtacattcctggtttggagatagaactgtgcagccggggtggttgttcagaaatggttgggcctatacaacagggtatgttgtatagcgttggattaatattgtttaattattacttaactgttttgttaaattctcaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttattttccgctgcttagaactttactgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccaggcgtgacatgcgtgctatcaagctgaccatgtttttttatctgagatgtttggcgagattcttcaggtcgagaggttattttctttttcttttttccttatagcccgtatgggtatttacttatgtttattgaaataaaattgacatttcttttagtacactaagatatttgttacttactccctctgtaaaaaaaactcaacctatcccctcttagttaataaatatggataaccttatgtccagattcgttgtaataggagagattacatcccctcctagattaagtttctatttttagagacggagggaatatatgctaaaaccccaatttttctctaaattttgaaccatggtacttgtggtactatggaatttactcaaagtcaaaaaatacaaagccttcaaagttatggaataaaaaaggatatgtatgttccctagatatttccaaaaaaaaaatatctcccatatttctagacgtaattacatatttttaataaatattaattgattaaatctttacgtggtcaattcaaaaatagttgaaggaaactatatgcccatgcatcgagacatgtggcctactagctagctagcccagtgggtggactctcttgaagtctctccgtgtcagtacttccccagaaagatgttcttgaggtgatacttttctctttgccagatcccctctcctctccattggttgccggggcaaggaagtgggcttgtcgagcttgtttcgtagtcgggtaaatctcgttgtgggtctttccttttccttctcttgctcaaataaaaagagatagtggcatctaccttctttgtcctggagttcttcggccatgaatggacctactgaagcttactttagcatatgccacatggctggtgaccatcgggtgagttacgtatgccttactactcttctgcatacgcaactcgaagttctccagtttctattgcaaagatgttgtgccagccgttcaactttcttccagcaaccactcacacaagagcgccgatctgcaggggcaactttgatttattggtttgaccatggtagcttcaacctcatagcggagaggccccaactgggattgctcctgctctatgttttgaagcttgccatactatcatcttcaccatcgccgtcaacacaagcaggatcgctggtccggtggaagaagcagacagagaatccgattgatttttcccattctttttaagtcattttctgcaaaattcccaatgtatgctcaataatttgaccgtttctgaggagcctttctgcaaactggatgttctttccgttgctgtgctttctcatgtaccatgcatctaaactttatattaaataaagtgcatgagtcttaaaaaaaaggaaaagcagaagctaagcccagtgctgggcttgtccgcgaaggatgacggcgcggggcgtgcccaactgggcaacttgcagccgccgcgcgcatgatgccattgcactgcacgcagcacactacacacacatgagcgagcacgcgcgtagtgcacgaacatgtacaggaacacagagttagttgaggcgtagtacgtttgcaaatacatggcttcaagacatgaacaacggctgaaaagcagaacaggtaaataaatgtactctatagtaatgcactaagtatccccgaaaaaaaaagaataataatgcactaagtaaatgtaatgacaatgataattatctctggaagatgatggatcagttaattataaataatgcccccgcaaaaaaaatataaataatgcatgcagatcgttcgagctagacaggtagagtgtgtaagagcaggtttaataatatcgtcaacttgcttgctataaaacatcatctatatatagtctgttagtataggctatttatataagaatggtcgttattatcatttatggtaacagcaaatatactttttaattgatatgggtcccactaattactgcattctttactattgttttaagcatgaaccaatcttcatcaggcttatttctctttcttcattgtattgcgtgctgcagccggcgataattctatcgtcgactcgtgttctctctcaaccattccctccgctagcacagcactgagggtgacgtggtcacgctatcgccggtcaggttgacctattagacatatatatatatatatatatatgtgtatatatatatatgtg

SEQ ID NO: 62690 - DNA, 14188 bp, Oryza sativa
  unsure (1)..(14188): unsure at all n locations
cttttaggattttctttttataaacctttttaactttgttcatttcttttcaattattatttgtgctctgaaaattccactaaaatttatttaagcattttaggcttttaggaaatatacaaaaatcctccaagcctcatttgacttttatctttgcacattttaattgttggaggctttcacattgaattttacttattcttttgcacaattttgaggatagattttagagtcgatttgggacgcgacagcggcctcctcccgagcagcttcctccgcttggcgaatccgggcggcctcccgggcggcctcttcagcttcccgaaggcggtctgcggcttcacgccggtcagattctcgcctccgctcctctgcggccgctggatcttcggcctcggactggccggacttggagtggcgggaggaatgcgacgggacatcgctgaagcagaagaaaaaaccagaagacgaacaaaatgagtaagaaaaaacttctttttgggagaaagatggttgcaatgagagtgagacgaacctgcgagggggtcggttgaatgaccaccttggaggggaaatcaggtttccccggcatggttccgtctcccccgtcttgcggagccgtttcttcttgcgctccccctcgggctgcgacgtcggcgcggccccctccgggcgccgactgctggcacgtgccgccccgccccctcggggaggagatgggggaggtgttcctcccagcttcctcttcccctgggcgtcggcagggcggctgctccccgagcccccgacgcggggcccagaagcacgaccccctcctggggcagattgttccccccggcggcgctcgcccgcgccgtcgtggcccttaggggctctctcctctgaggccccgacccccatcataatggttagaatggaggcgcggtcgggatcgctgcagagggggaggatctcctgaggaatgcgagacgcctccgcggagttaagattcagcaccctttggaccacgatcttgaagtcctcgggagcccaatcccatctggctccctggtgggtccgcatgtagtcttcaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggcgcccgccagctggagacctgcgccgggggctgacttggaagtcggaggcgcgcttcgttggcgaggggggtgtagaaccagtcgctcttccagtcgtcccacttcttgcggaggacgcaggggatgtagcggttcaacaccggcccccgcggctggaagtagcagccgccaaccaccgacggcggtgacaccgactgcacggtgaagaaccaccggaacagctgaagagaggggcgcaccccaatgaacatctcgcacaggtgcgcgaagatggccaaagtcatcaccgcattgggggtgaggtgcgccatctggagatcgtagaactccaggacatccatgaagaaagaagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcgatcacgatgcgggaaggcggtagtacactgccgtcgagcagagcagagccccgtgccatggcggtggaggaagagatgattgagaacgagcgcgtgtggcgaaagtagggcgtagcagagaaagagttagagctcaggcggcgaaggcaagaggaacaatggcgaaaggaaggaagcaaatccttttctcgatgcttttatacccttgccatcgctgggcctggctcctcgtttctcgcgcccactacctcgctccctcgtatctcgctatctcgctccctcgtttcccgtgcccacgcttccactaatcccattcgcccgcttacggcgcatgaagtggatatgcggttgtggcaatcgaaatggattgtatcgtgcgtgcgttaattacgctcgccgaccgaagcggcgttaccgtatctccgggcgagacaaatctgctcacccagattcgcgcgctgctcaagtggtgtggcggtcttgaatagaccgcccattatggacaaccagagttaccaataccaaggtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgaccagaggcttgaggcagacacaatcgcccacgtggcctggcaccttcggggacgtcgggcccgagggtgaggtgtccgccctccttctgattccccccgagggggggtcgggttgcgcttgccccgaccccgagggccgaggcaccccgaccccttaaggaagtctgcgccgcatatatgggataagtgagcacaagctgtgctcacctaacagcatttattgcggtctggtcaagcgtgtcacgctgcatgcaacgcagtacagcgcgttcctttatccggtctgtgaccagtcacagaccggtcagatcacgggttaggtggcgactggcggtctgacgcacgccttgccccatcccgtcaagacgaaagcctctaggcactcgtctcaagccggagctagcgtgttatctcttagagatggcacgttagccctgattagatgaataccaggcttcatcctaaccattacaggcaaggtgttacacgaagaagggcaaacatgcacgttgttaaactgacgcgtggtggacaagaatgaccggtctgacactggtcgcgtcagcaacgggcagccacgatcccacgttgcgcccgtctccgccgggagtggaggtaggtgtgggctgtcccatcgaagtgtcattcggacggcaaccataccaatctccgttcataaagagaagaaaagtccagtttggaaagggaagggtgcatgtggtatccccttgaagtataaaaggaggaccttgcccatagagaaggggttggttgattcttgccagattcagagcttagaacgggggagaggtgggctcacactttgtagctcattcatacacagatccaccaaaacacaggagtagggtattacgcttctcagcggcccgaacctgtatacatcgccggtgtctcgcgtttcttgctagcagacgatctttccacacacagagagagagagcttgagatctcaccctaagcccccggccgaaccggcaaaggggggcctgcgcggtctcccggtgaggagccacgagctccgtcacatacatatgtatatatatatatacatacatacatacatatgtatatatatatacatacatacatacatatgtatatatatatatacatacatacatatgtatatgtatatatatatatatatatacatatacatatgtacacatacacacgcgcgtatacgtatacacgtacgtacgtgtgtgtacacacgtatcaggacatggagatgttctctttattccgttcgaatattctagctgatcggatcggctcgatcgatcgattctcgcgtacgcaactgggcaatttggcggcggtcgttacgactataggtgcccgcttgtgttcactatacagttagtaaaacattcattttgttaatccactctttagtacgtcttgaccgttgacgattgcccaagcaagccgcaccagtacgttcagtgcatacaaggactgtttgaggaaccttttgctagatgcatccgtttttggcagacaagttagccaatgagactcagcgagaaattttatattggctcaggcacttctgaaagcgggttttataaaatggtaccaacaaagtgcgtgttctataatatatcatcaacaaagcttgattcttacaataccttcgaacaacttgtctctttttcttatatgccatcatcattaagtcaacaattactcaaccgttaagggagaaaaaaagattacttttcacaaatctcaattttgcacaatgccatatcgcactaaactgtcttggatgatagaaaaacaagtggtcctatttttcatcgatgagaaaaaatagtggatcatggcaaatgaaattcatgggtacctattataccctatgggtaaaatggataaaattgagattttatcgtgcgacgtggataaaattgagattttgcacaatgccatgtcgcactaaattttcttggataacagaaaaacaagtggtcctatttttcatcgatgagaaaaaatagtggatcatggcaaatgaaattcatgggtacccattataccctatgggtaaaatggatattttctcgcccttaatggatggtatataagcaagaaaacaagttattcgatgttatataatataactcggtttttccactggtatattataaaatccataccttctaaatgatataaaatttattatctctaaaagaatataatatatttatgttatatcaatgactgaacaggaaatactatagaacggtatacctttccaacgaaataaatattgcatgctgatgtcagcacgatatcgtaggtatcagataggtacctaatccggtacctccagtacaagacataatatccataggtaccatgctgatattagcatgataccataggtaggtatcggatttggtacttgggatatcagacatgataccctctaagtatcagctagggcgttgaaaagtgcagcaatggctagggcaacaacgagtgaggcggcagctacaattgcagcagtgggagagctagtcagatccgccagcggcaatgacaggagggacaatacggcaggctctcctcctatgcggatcccgccgcctccccacctcacacatggattagcaggccgggctctcctccacgcggatcctaccacctctccctcccctccttcatgcatagattcaatggtggcggcaatgggaggggcagatccggcatggctctccccctctggtttggatcccaccgtctccccctccctcatgcatggaacgtctcccacctccctcgcatatggatctagcagtagcgacaacgggagggacagatctagtgggctctcccctacccacgtggatcctatcgtctctccacttcctcgtgtgagggtctgttagcggggggaggccgggaagggcgtcggtgatgacagtgatgacggtcatcgggaatgggagcagtgtggtgacgacggccgcagagcacaggagcggcatccatccctttttattctaggtttttggaatctttgttttttggaattttgatttttttttcaaaaattccttttgcaggcaaacgacataacgtgctcacttgggaaaatcccttttcgcacgaggttgtgctgctgcccgcaaaaattcctattttcacatacaccttggagcaagcagttgctatatatacccccgcctacgaaaatacactttagctttttggaaaaactttattttagtagtgtcgggtatatagtgacccggccccgaacttctaaaatcgtgcaaattgtgtcccacgatagtattgtaggcgattttaaccgacgtagcgcctacatatgttgtttgatttggtcttcatcccatataatgcttatgtggcactagaagaaaaataataaatgaaaacaatagtgtgacccatatatcaggtgatagccaacaaatatcttgggccaatatatcatcaccgaccttctatctctcccccatcttctctaccacctgcacactaagctgaggtggccgtcaagctccttgcgcaatattggcttggtctccagaacggtcaacagtatcggcagtggctccacgttgtcgacaaggtagctctccttgtcccctgaccacctgtctaaaccatgtcctcctccccttccccttcttctcctatgcaccctccttggccctgacgtgcatgcagggatctcgggcaatgatgcggccgctagatgttgatagattcacatcaggcggtgctctaggttggaatcagtctagcatagaggttatgccggtggatagtgatgctgatagctgctggcgggaacagtagtggatggggagggaatggttggggcacggggaggagcaggctagggttcgtaggagtcatggagatgggagtagggttcgtgttcggaatacaaaaattgtcgctctctggcgatgagtgaaaatagtgggagtgaaggggaagcaagcgatgtggcgttcagcacgaggaaggtcggtgatgatatgtggactccacataattgttatactttttctagctggtcacccactggacatatgggtccaactgatatttttttattatttttcatctagtgcaacgtatgcgccatgtgagatgaaaaccaagtcaagtcatttaataacatccacaatacttccgaatgatgtaatttacattagttttagaagttaggggatactttatacatggttttgtaattgagtgatatgaaatggaactcaacccatatttgagggacctaatgtgaacttttgaccaaccttaatttgtactagctctttgtgggcttttatttccaggcttcgcctggctcaagtgagcctagagctttgagtccacgttgaaacgcttgatattacaacttgcatgcgtcaagctaccaaaatcagctcctgagaacgtgagagccattttgatgtcgaatcatgctgtggatatctttgacgtcccatcattcttagacggcacaaataaacttgatggatggaccgaccagtcgaagcaagcaacatttcaattggcgttggaacacgtcagttcggcaagttgccaaatttatgaccaactatcctgaaaatagcccagtaaactattcctagcacctgagcaccatgtccttatctaggtagtatgttttttcttccttgtgagaatttgcaggctattatatttgcaataaaatgaaggaatactaagctttaagatttattgttgtgttttgcgaatatgttatagtagaatttatagtcaaagtgtccgtgtctaattcaaatatggaaaaggatgtgatggctcgtcttattagatttcttgtggtgaaatttgttcacatgggtttaagttttagacttgagacatgtacttgtatttatagaattattttttcgatgataagtgaagtactcatcaatcagtaaggcatccgttataactttcattaatgaaggtggtcgtagaagtaggatgtgtatgtatgtttatatgaataagtgtggctcgtgtatatgagctttcacgtttgtgttgtatttcgcgaggatctatacttataaattggaggcgcaagatgtgctttaacatgttatgaggcattctgtttagtaattaaatattatgaaaaacaataagtagatttcactttggactataaccacttttactaaattaatttcacgtaatttacaaattcattgtaaatagtatatatacattcactatcgctatgctttgctcattcatgctgctgccggttatattctatcctcatcagacgaactatatatcaatagaatatactccatttttagctatgtcaaactaaacaagaaagaatactgcgcagctaatgacggatggaattatacaggagaataaaacatataagttatggatggccgacaaaattaccaagatgcagcagttgtgacgcttttgtttaaacttcggaaattcattgtgtcctgatgcaatgattttgttttctttaaaaagtataaaaatgcatganaacgtccagcgatggaaatgaatgttcacacactatcgtcatgagctagggggtatagctatatgtttttttttttttttggcggggaagctatatgggtatttgagatgtccaagatcatcattgaacatttatcaaagcaaaaaaaaaaaaaagaaaacgcccattctaactagatcaagaaagagggagaagaggaacttaaaagaaatacactgatgtgagctaagtgcgcaggagatgagaattaagcggatcagctcgagagtatagcgtcaaaaaggtacgggatgagttagcgatggtttggctaaataagtagtaaactacccctatttacattgaactttttccagattatccctctgtacggtagactgggaggtaccaggcatacctcccaagcattgttaaaggtctcatttagccaaggctctgttggtttgttctggtttgactctatgtactgttagaattaaatgaaatatgcccaatataattctagtaattctagaaccacgtagccagcccatctgatgggtgggcccacttacacaaaccaaatcatttacactttgtcctcgcttcgggtaaaagggtaatccgggagtggcatggttggagggacaagcccttataagttggttccatccttgataaactagtaaggtggtatactaaacatgcgtatacaactcacatgggtcgcacaggcctcatcctaattgggccaggatgtcatagttttcatctcccatctccgagatagacatagaactctctattctgttcattttcctgatactctggttctcatcaagtttttggcaagtgcttctttggcgcgattgctctgctacgtctccactgcttcctatgcgccaagtgttttttgtttccttttcatcattgtgactgggaatggcaacggaggggagaacgacgggaacggtgacaccaacatcaaccccaacaccaacaccgcctctggatcccgggtatgtcactctattcactttagtgttaaacatgttactctatcatctttttattcacatctcatgtttagtattttgtttttctagtttaaaatacttccaacatatgaattatgactatacttccaacaggtactatgagcggagagcaagatgcttagaaagatgaacatccagcttggcccaaaaactggcaaggcatgttttcatgtttcttgcggggattaaacttttcatataaatcggtgcaaaaacttagttccgatcaaaaatttgaaaaatgacctaaaaagagaatttcttggtccacatgaatatgacgaaacaatgaaccatagccgaagtttcttatatccattccttcttcctctcatcacttcctagtttcctactatgtgccactaacaagaagacatgaacactataagcgtccaccaaaagagaaacaaatagaagagccttcagcccttcgtgctgccaacgcttttaacccatagtggatatatgtcgtcccagatcgattgatcgagtaacgaacagcaagtagccaagctgacattccccggtttcagagttcagaccgacgacgatgccaaaacgacgtgtgcatcaattactgcatttcgcccatgtcagctcagctcgatccgatccattcatgccacaagtcagagcggcatctgaacccaacaagtcagaatttgttgcgtcgcccaagctacacagttgctcataaatacacgcagagtcgcacagggaatgagatttgagatatcatcgatctggtagttgcttccagtctctactctctactccttgctattgcattccaccagttcagttcggcacgacttatcgacgacaagatatatggttaatccggcgacgatgatttcacctataaatacagggcagccaccgtgcatgatagatcatcgctagctgcagtcagtcaccacgtcaagccagtggacacgacaggcaagacgagagagctagcatggctttagctcacgaggtcgctttcgaggtgaacctgatcgaggacgacggcggcctcgccggctgggcgccggtgggcacgcgcacggcgctgtcctcgcacgccgagcgcgacacggccatgctgatctcgggcgccgtgtcggccgcggagccgaatgagcgtattagacgatcaagcggacggtacatcgtcgcgtcgcgccgcgccgacgaggaggacgggctgcggcgcgcggttccggcgggcgcgctcgtgccacgggtcacgtaccgtgtcgtcgggtgggtcagcgtgcagggccagggcgacgggaggcaccatgcggtgcgcgtcggcctccgcgtggacggcgacggcggcgacgacgagcgcggcagctggctagactgcggcgcggcacgcgtcgaggtgggcggcgggtgggcggagatcaacggcgcgttccggctcagggcgagcccacgcgtcgcggctgttcacgtccatggcgcgcctgccggtgttgatgttaaggtgatggatctgcaggtctacgcgacggaccgcaaggcgcggttgacgcagctcaaagagcagactgacaaggtgagtgagcaatcatcagctcactccgactccgcgcgcacgtttgcatgatcaacttcttcgttactgctttacgtgctaaattaatatttcctccagtcatatatagacaagtgtcgtttaacaatccatgtaggcaatataaattacatttgatcacaatttctgaaaagaacaaaatcattcgtaacatgtcacttatttggatttttaattcgcggtaagaagtcaaatgactttttggaaaaaacctctaaatgaaatggccgtttaagaaagtgactgatatttagggggaaaaaaatactccagttaagtgatgaattagcaagcccaaagtaaaatgacattccctggatgcgctcatgcaggttcgcaagcgagacgtgattctcaacttgggcggcggcgcgaccatggccggcgcgtcaatccgcgtggcgcagctgctggagaatcgcttcccgttcggatcctgcatcaacaagacggccatccgaaaccccaagttcgtcgacttcttctgcgagaacttcgactgggccgtcttcgagaacgagctcaagtggtactcgacggagccgcagcgcgggcagatcaactaccgcgacgccgacgagctgctcgacttctgccaccgctacggcaagtcggcgcgcggccactgcatcttctgggccgtcgacggcgacgtgcagcagtgggtcaaggacctcggccgcgacgacctcgccgccgcggtgcagggccgcctccacggcctcctgtcccgctacgccggccggttccgccactacgacgtcaacaacgagatgctgcacggccgcttctaccgcgaccggctgggagacggcgtcgcgccgctcatgttccgcgaggccgcgcggctggacccggccgcgcggctcttcgtcaacgactacaacgtcctgcgtgggaacgaccccaacgcgacgccggagaagtacgtcgagctggtggacgcgctgcggcgcggcggcgcggcggtgggcgggatcggggtgcaggggcacatggacagcccggtggccgggcaggtcatccgcgccgcgctggacaagctcgccgcggcgggcggcgcgcccatctggatcaccgagctggacgtgagcgagcccgacgtggggctccgcgccgacgacctggaggtggtgctgcgcgaggcgtacgcgcacccggccgtggagggcgtcgtgctctgggggttcatggaggggcagatgtggcgccgggacgcctacctcgtcgacgccgacggcaccgtcaacgaggccgggcagaggttcctccagctccagagggagtggaggtcggacgcgcgcggcattgtcgacggcgatggccgtttcaagttcaggggcttccacggcacgtacgtcgcgcaggtgacgacggcgacggggaagatgctcaagacgttcaccgtggagaaaggggataattctctcgagttggatttggatatcgaaatttgaaggtttaatgtgatgatatcgtcctagtcgtaatgtactgtgagcttaaagttcatctccatcgtgctggactactgaataatgacgtgcatgcatatactactgcgcttgatacattattgtgaaggaacaatggaacatggattaattagttcagtaaataaaaatgatacgattggatataaaatttataaacgagaagttgttggtcgcttttgacttgtttttcctacttaaatttctttaaatttgatcaaatttatagaaaaatatagcaatacttttaacacaaacaaacatattatcaaaatatattaaatgttagttttaatgaaattaatttgttgttgtagatattgttaatcttttctataaacttaggttctgtttctttcagcttgggattattataatccagattattgggagtaagctgaaagaaacccagacaanncnttattgaagggtaactntattataatctggagtccaacttattataatctgataaactcatttaggtgagctttttccagattattgggtgaaaaattacccaccatgccaccccactccctctttagggcttgtttggtatagctccaactcgtaaatttaactccaggagttgagtctggagtgaagttgtgaagctgcctaaacccagctccacaactctagttcattttgtgagagggctccacccagctccactcccagttttggtggagccgaaactgtttggctgagctccagctccagaaggggtgaagctggagctggagctgtgccaaacaggcccttagacttgcaaacccaataatctaggctctaataatctagaaaagaaacaactaaccgcttattctactacagattataacaatctagcttatagtaatctgactcaataatctagattataataatcccaagctgaaaaaaacagggccttagtaaggaaaagtaaaaacaactgataatatgaaacggatagagtatgatatatttcaaacgataagttattatattttaacatacatatcaaagaccgaataaattcaacatctactatattaaagtatgaatggagtagatgtttatcatggatggaaattacacgtaatagctataatagggttatcttcgccttctccgatcccatccttcacctcaccgctgcccgagcacaccattggagttttgcgtgggcgcatgaatggtggtgacggggctcgttcaggtccctcttggcgcttaggatggttttggccaaggtatctctcgttggacctagagttgtgtctggatccgatgacagcaagtgcggcagctgccagccactccatgttaggcatggtgttggcacaataggactttgctggggaaatcgagggccgcatctaagtagatctaaggtgatatcgatggttgtgcattagtagtgttttggaatgattggggcagcgacaggatggcatggcatagaggagcagtggctacaacggcggcagggcgggctagactcgcatctccgctagtgaactgcggctagccgttgatggtgtacaacttgttagccttcttcttgtggctggtgagcatcagcggtggtgtgatgagactgtagtgccgacagcactggcatcatcgtgcatcggcatgttaccgagcagatcattgagagcaaaggggccaacaaggaggtaaccatgcactaggctgaccttgatgcccttgagcagtgggctcatggcagtggcaaggatggaggattagctaggcggagctggtggcatccgaggtggatggatacaatctaatggctagatcaagtaactttttggcgagcaacgagaggatgagggcgggctcctttagtggtgccaactacgaccggggtgtctggatctatctctctggcgagcaaggtagctaagtgaggagcaacatcggcgagttgatggtgaaggcggtggagagggtgtgacgataaatctagggcctaactctcactggatccaaggtgtctgtgtttgaagttgttcgtgcaatgtgaattgcgttggagaggtctcttctttcttctctgcctcca

SEQ ID NO: 62691 - DNA, 780 bp, Oryza sativa
taatgttgacatttatgtgaaatccaagaaatgagtttgaagtgctctgaatctaaatgcttgacgcttgaatatcgagtttgaactgttcagccactgcgaaactaacttggtaaggcaagcgagggcatgaaaacaaatgaaacacagcagtttctagtttccgagtgtgaggctgtgtatgtatgtgggtggaggttagaaatcatattttacttcatgctttacattaactggatactgaacgtaataagaaatgaaggtactgttagattaattagtgaacataattttcctagtttcatccaatctccacaaaagctacgcatgcatgtgcaaacagattagttatgctgcagtgtaatgtataaagagcatagatttaccttctcaactgagatatttcagtctccttcatctctaacaatgcttgtagctctgataatttgttattcagttgctttatgtcgttctttaggcatttaatggtattcttttcagtgctaattttgagaagagctggaattcgtggaaaaattaaggagaaaacattgttgagcaaaacataatatgtttgttaacccaaatataggtaacaatcacattaacaaacatacaatacaatttacttgatgatcaactagaatgtggataaaggtgttatgcacttatgttgtatcccatttagggagttcttgcatattatagaaagcaaacatgtttactaccaacttgaggaagaatagaagaataaaacaaataacatgttgttcaaggata

SEQ ID NO: 62692 - DNA, 1340 bp, Oryza sativa
catccctagcgagctccccgccccaaaatcggcccccgcgcgccgttgctcgcgtgcgcgcgcccgcgtggtcgccgcccgtgccgcgcctgcgccgtctacgccgcccggccccgctgccctgccgcgcagccgctcggccccgcgagccagcgcgcgtgcccgagccgcgccgctcaaaccgccgcgccgcccgctgcttcccgcgcgcgcgtgccgtggtggccgaccgcctggtcgccgccgccgtcagcctctgccgcgtctgcccgcgcctgccgcccatgtcgtcgccccgctccaaaccgcgccgccgtcaccgccgtcgtcatcgcccggcccccgccactccgcgcgcaagctgccaagggacggaggcagagctcctcctccccctgctgcgtcgcccccgctccctcctccttttcccaaagaggcaagggacaagcccccttttctctccctcttttcccctttttcctcccgccggcgtcatcctcctccctcgtccctgtcgccgctttggccgcgaccgccgagcgctagccctctcctttgaccgccttaggtcggttcccaaaccgacattgtcgcccctataaacccaagcttccctctttcccttcctctcccattcgcctccacgccattgtcgccgcctcccgtgctctgttcgccgtcgccgttcgtcgttgcgcgtgtcggaggagccggcacgagcaaggacgcggaaggggactccgggcgcgccctccccctcctcttcctcggcccgagccggagagattactcccgcgccgtcggcctctcgtcactgcgcccgcccgcacggtagtgcatctccccgttctccctcctcgctccatctcctccccttagacctgggtagtagcatgagtagcctccccgtagctagccggcgccgccccgaccgttgccgccgctcgccgtgtgctcgccgccgtcgccgcccgagctcggaagcgccgctcgtcgccggcctcgctcggcgcagctctgcccaatccaacgctagcatcggattcccatagccgcgtagatgctctcgccgccgggaatcggcccctcgtgacctcgtcgctgtttcccccttctcccgctgccggttgccgccgccgcaattcgccgccgtcaagctccctccggcgaatccaagccgttggctcgtaattgttatatcatgtccccttgtaaccatctagttgcgcctcgatattcgtgcaccctgtgcgagtatcgacggtcgccttcaaacttaaaatctgaaaaacttcttgggtaaaacttgggttttacaaaaggcttggaaaacccaacac

SEQ ID NO: 62693 - DNA, 8909 bp, Oryza sativa
cagaatctgcagggccacgggcaggtagtttgccatggctttgttgtctcctcctgttgcgcagatggcgagaccatagacggtgagccaggactcagggttagtggtgctgtcatacttctcgattccagtcggcttgaagccagccggccaatccactcgatgcaggtcgcttgtgaaggcagcaactccatccacatcatcatcgtaacgatttggtgaatggtgggggttgtagcctcttgccgcccggcgctggttgatagtctcgtgaagatcgatgggatgcctacggtgtgggaagcagggatgttcagctcgactctccttgtgctggtcagggggcgagtggacagatcgtttgccatgatccctactcctgcgattggatccctcgccgacgacactgaggcttggttggtgatagtcttgagatcgaagaggtggaactcggttgccggtcggcgtgcgggtgctcgtggagttaactgggaccgaggcggcgatcatggttttggtctggttcaagatgttgacgacgtaatcagcctgattgagtgtgtcttccgtgaggagggtgtcgaggagggtgatcgctgcaaccgcgttctgttggggggtgcgaaaaaccgtcgtcccctcgacgtcttgttgcccgatgagctctcgtgctcgtcgtccagattccaaggcgcgctgtcgtcgatcctcagccttcttcgtagcctgttcgcgatcttgttgttcacgctgtagtcgttctcgctcttgtcgttgtcgttcttcctccagtcggtaacgttcagcttcttgtcgtgtgcgttcttcttccgcttctcgggctcggcgctgttctgccgtctcgttgtcggccatgaatacgccgaaaaagagaggcgtgtagtcgtcctcgtagctgtcgtcgaagtcatcgaagttaccgtagtcgtagtaatagccgaagtcgtcgtactcgaggatctccgttggtcgagaactgacaccgggggagctgaggtagccgtccagttcttccgtcgagaccatcccaagaggttggagtataacaccgacctccctagagttagattggatcgaagccgaagctggatcccgcctaggccttcggggagaagatgccttggtggtgaagacagcggccagatcatcggggagtctcatcaggattgagggatagggtccatcgtcttgatcaggtcgtgttggagtagattggatttcgtccgagtggtttggggctgactcaatcgagatgatcttggggtagatctcggccgagttcggaataccgaacggggtggagacctagcctctccccgactggttcggctccgagtcgaggagagaaatcctgccgaagtcattggtgatgaagtcgaggctgccgaaccagaacgcctgcccgggtgggaagacgaagtcgtcgatgccggagacgaaacccatcgcactagtcggcaaaaaacttgacgctacccctacctggcgcaccaattgtcgaaacaagatttcggcaatactaaaagggggtggctatcaagctagaaaagtggatgggtttggagacaaggaagtttatacaagttcaaaccttcttaataagaagtaatactctactcttgtccggggtttgatccgctgtcacatcctgattttcgttttaggatttataaattattattagaatttatattaaatgttcattaatttacatgtgaagttaaatgtgggaaataaaatttcctaaatataaagcatggctggatttaatttttattaaattctccgtggttaattatactctctgaaattttctcggatttttcggagctcaattcctaattttaatcatacaaagaacatttcagtaattacccacaaattaaattaatcattaaatggtctgattataatcttgttaagtactttgagtgtccaagtattttcaggatttttcttgaaattatttgagcattggaagtatttttaacaattgaaagatcattcagtgattaatttaattggaaaattaattaataattctttcctttccttcctttggttgtcaatccttcccggttcactctccccgtccgcggttcatcgtatccgccgaccccttttgccaccgcggtttcgttttgtatgacgagccgagtcctattctctttctggtttcgtttcctcttcctttcccaaaacggcaccgcatctgtttcccccacctttcctttctaggcaaccttctcctcccgtatctttttcccttcctcctctcggcctcctcccagccgtgcgcctctcccctctcccagccgcgcacgccttccctcccctcccccctctgccgtgcctcccttggccccacctaatcctattcaatcttcccctatataagccgtcctctcccctcctgtttcctgtttttttttgtgttgcagccgcccctagcctcctcctcctcctgtttagccgcctcctccagcaccctagccgccgctgccctagctcgccgccgccgctagccgtcacccctcgccgtcgtcatcttggtcgtcgccgtcgtcttctccggtgagctctcctctctcccatgtcatttaccggtgtagtttatccctagggacttaatccaatttaatctaatcttatttggccctagcgtcgagccggtcattgccgtgcaccgcacccgctgttgtccgctgctagccgccgcgtagccgctgccctagtgcacgtactgcagtcgccgcgccgctgtcgtgcatcgctaccgctgccgcgttcctggcttagcagagccattgctaccgctcggtagccgtcttgctaagtcgttgttgagtcgctgccgctgctgcgccttgctgtcgtgctgtgccgtcgctgctgtgccgtgttgtagccgtgtgccgcttaaacctagccgccgctttatcccgttgctcagtagtcgagttatctagccgtaggcaaggttgtcaagatcgggatactatgtagtatcgttttgctcaaagtaatatcgtaccgtaagatcgtatcgtagtatcgagatactatgatattttctttttttaagtttaattaatatttatattaattatatatatagccattctatataaaaaatgtagtaatgatatatgtcatgcaaatagagatatttatcaagagaaaccacgctggttttgatatatttaactgaattttatataaatttgagcatatttatttacattattttcaaaccatgttattttaaataatattttgtagtatcgtagggatcgtagaatcgggataccacctaagatttcgtaggatcgtgtagtaatgaatagtaggatcaagatactataaaaattaggatactaggtgggatcggtatcgtttcggcttagtaggatcgtagtatcgtaagatacttggatacgaatcgggatactgacaaccttggccataggtgcaactctaggttcctaccggcctatcgtttgccgtatcggggctttatcgtgaatcgtttctagcccaccggtttagccgcagccgttgttgagtcgttcgctcgttcgttggaacgaggtgttccccgtgcttcgttcgttcatccgtgtggagtcgtcctttagtttagagctgttcagagccaccggttccgttcgccggtttcggttgatcatttgggtgatcccgtgtcacgtagattgactcgttgagtcggtatctcatgaggcccgcttgccagatcaatccaagccatccaatcttcgtcgactcggtcaagattaatctcagcaatccaaaattgatataaatccgttctcttttttcaatggcatattattcctttttaatatatgtcatctaccaaatatgatctaatcttttccggaggttgctttaatcttttatctccattataaatcatttgtaaatgatttaattaatttggaatagtcttttctttaataggtttaattggaattaaatcttgtaaaatttgtaattaattcatatgaagttggaatgaggcagttcaagtctcataattcatctaaaatcatgatctacatgcttgtttacttttcatgtactgtttatttggtttttattagtctttttctccgttttgcgtgttagcttgtcgtttccgtcgttacgaaggttcgcgagtgcgccggaagcattcaagaagattaattgaagaacaattattgcaaggcaagtcacacagatcccaaacacaattcctttgagcatgttgattctatatttaaattctctatttattttaactgtgcatttattttcgaatgtcaccgggtggtgagcctttcccatttaattatggccgaagatgactttattttcctatgggttataatttgattagctagaaccttatatattggtttgatccagcaaatgttatatatatataattgcttagccatgcttagaaacattagctcattaatgggataaatcatgcttcactattacttatggttatatttaatggtagctcacgatggttaatcgtgttatgttaattaattgataattaaaacttgtcaatggtgggttgtgagcacatggttttgatggtcgtgcttatggcaattaaggaccggttcgcgagctactgttgtgagacattaaccgtaccaaccacaagccagcgtgggcaacggctttaccttttgtatagcatggttcattacggggtgtcagactgtgaagcggcgagaagtccgtgggggtcgctggggagtccatgcctttggttattgagggggtgattatgatccaggaacggtgcactgtggtgagttgtgttgtgcagagggtattgtcacagcctctattcggatactttctagtatccgcgacgcatagtagacatgatgtttaggctgtgtcttgtgggtacagtggtacacctctggccagagtaaaactattcgaatagccgtgcctgcggtcatgggtgggttgagcaatgtttttcgtgattagtctcacatctctcacaataattattgatgctataaatggtaataaattgcttagctcctggtttggagttagatctgtacagccaggtatggttgttcaggatggttgggcctgagcagtatgggtgtgctattcagtgtttattaaaaatgattaattactctactgttttactattcttaaatatttgctaaatgctgcttttgcaaatgagcctatattatgccatcctttggtattcttgtgcacttgcatatttgctgtgtggtttgttgagtatgtcatatgctcattcttgcaataatcaatcaacctcagttgaagaaaaaggatccagaaggagaagacgtttggtttataccccagttgagctgcctgtgggagtggagctaaagccatcgctagacgtttggtttatacaatttctaagtatgtaacgttattattatgatggatttgtatattaaattgtcagtttgtgtagctcggctgattcctggacgagggttttatgcacaaataagttcggaaattactagtgaatttctgggcgtgacatccgccgagtgtattattgatcgtatgatctgagagtagaatctcgtaccccaagaggcacccggacccctccttatataggagaaggagtccgtattacaaaatacagcccatatctctaacggaatatgtagttacagatatgacctaatcgtaaccgactaggatcccgggtacttccttaacacacaagtttggaacttaacccgggcctcattaaagatattctatctatacatggctccctatacccaatcggattatacatgccgtgtaggtatggggtatccataatctccacaggtggccagcagcagtgcggtgtccaccgccagcatgaggtggccctgcgccatgagcgagacgaacacgaagtgcgccaccgccatcgatgcagatagttcgtgttctcgctggcgatgtatttctattgcttgtgcagatagctgctgatccatccatatgtgtgtgtgcgtgctttaaagagagagacgtgacggccggtgatgtgttcgatcgtttgtttccagatgccggcgcgcgcccccgccgttgctgccgatggagctagcagcgacgacgtcctcgatctcgtgtagccgctgctcggcctcggccggtggtgtcccacgtctcgtcgagcaccaccctcgccttgccgcgccgccccttcatcgccagccactgccacgacggcgtggatggttcgcagggcgtcgtggaagcgggaggtgcggtcgaggccgttgcggacgagctggaaggaggggatagagagagaagagagataggagagctgacacgtgggtccaagggcatttttgacatttcacgtgatttctctccccctcttcaaccgaaaattattattttaatcggcgtagtgtccactgtcaaattaccacatttatggagtttttcccccaaaagtgagtttgggcaatgtactagggctaaaaccgcatataagcagtgtcctgtagcaaaatttgcctaaattgggcaaattttggcaatgcataggctcaaattggtagtaaattggtagtgtcatccgccggaagtgcccagaagcaggccacacaactaacattgtgcttatttacgctacgtaattgtcgtgatgagcaaaatgaacctaattatgtatatttcttatcatcttatttgtgcttattctgcaacaaatagtaccaaagctattacaacaaaaaaaaaatggtaacccttggttggtacatatccaaatagaaattgacccacaaaaaattggcacttcattgacggtttgacactaatcctaacattcacatttactatgctaccctatcaaaatcttggtagtacccaaagttacctagattttggcactactaaaattttggtaaggtaccaaaacaaataagcccatagttctcactaaagtgctgaattgggcttaggaacagttatgggctttcgacccactacataatttttttatttcctattccattttctcactcagatgcctgctaaatttgccataaatgttactacccttttacctaatatttgtagatattattactgccataacattatttataagaattcttgtactatttataaagtactcctatttaggagtaattactaataccgctctaatttgatggtctattctatactcctttttatctcccggaaagagacagaatgggaaccatacttaaataaataaattatcttcagcgtcaaaaaggaacaaaaaaaagtgttcttccaaccttagaacgtgacaaagacaacgaaaagaaaaatcaatatgttcttttcagctttgaggttatcaccaaagctttccaaggatgacaagccgggatgaactttgcgtccaaaaagcaggtccaaaaaatccaaaccttttatcctggccccgtctgcaatccacttctccccctcttttgcctctgcctcagactattcattcgatggccagcgagtaataagattcgctttctgctatcctcttctgcttctgcacacttctttgcatgtgaacccaagctcacgcacgctgacagttcatacagctactgtaaaaaaaaagtttccacctggggccaatactttatacggactcacagtagtacttgtgagtagaacaaatggtctaaattgttcattgattctgttatagattgcttaagccagcagcaagaaagagtactggtaagcaggccaaatatgtggctggtttcttgttttttccctgtaatttgtacatagattaatgtttccttgcaaaacttgtgcctgcattcttggttcttgccataatttctttgggagcggatgagaggagatgagacaaggtcgtccttgctggaccgtgtctttactgctatgatctttgctggttgaggcagatgtggtggatggcttctcttgaagaggtcttgggttcacatggccattgcttgcctcctcctttctccgtgacgtcttcttcctgtggggttcttccctttggagcttggcccctacctactcaggacaagcgtgtagatgcaggcgtgaatagcctttgcctgtgctcccatgtcaatcaagtgttctgtgctagattggtcccagagatggtgcctctctggtgctaatttctcttgagggtgtttctggtttggattactgagttaatgacgccatggctgggcagagtaggatgaggtttcttgcttcttcctctcttgagtttgttcttgggtaattaatccttttcctgggagcaacttgtgagttgtgactgtttcttggtttcctccgccttggttttaccccctttttttgcgttttttcgaggcatcgatttctgagccggataagtagttgagctgctggtggctgaattattaacagtccaattaattgctgacatcccaagatgggcagttcttgataaccccagtaatttaatcgctcggtttagtagctctggtttcaattgctcccacatggagtaacaattcattagttagagggatttagagctgaaacttcttctcaaaatcgcagttcttggttgttgatttccctctgttcatcgtggaaacgtgttaagctcaagttcttgcaatttttctttgctttttttttttgttttgtagaggaaaatttcttgattaggagatagtacaaggttggtggctatggaggaggaatcccaatcccaatcccatttcccgctccggtgggagagcaccggcgaccaatggtggtacgcgacgcccatcgactgggcgggggcgagcggccactac

SEQ ID NO: 62694 - DNA, 3890 bp, Oryza sativa
ggacgctcagggatcgacgatcttgcacgccgcggccgcgagggggcagcttgaggtgatgctacttcctgcttcacaaattttttatctatgaaatattcatgacagggtaattccatagaagaattagttttactttgtagctgcaacttttgttaacattttgtcagctctaatctatgaaactttctgattcttgaggtgatttgatcatatttaattgctaatctggggacactggaatgatatatatctgctacattattgtctttgatttgactgtccctgaagttgatcttgtgcacatgctagccagatttcctttcgttttacacatgatatgatttcttagtgacacatgatatggcatgttctagttaaattaatagagatggaaactagatggcattgacagatattctcaacctactactgaaatgtggtgtgtttagctgtcacgaatgtttggtgagagtcagcaactgaggtttagttgtaaaccattgacctaataaggaattttataatacatccatatatgcttgtcattggaagtgttcaccgacacgctaatgcgtggtgaagaaatagtctgttcatctgggatgccatgacaagtgtcttcccaccatctgttcttttgttctaaatttatatttattgattaaaatcgtcgtgtgttactctgtggatgcatactgaagtattagcatgttcttacttaattctacaggttgtgaaggatcttattgcctctttcgatatagtcaactccacagacgagcaagggaatacggcattgcatctagccgcctttcgaggtcatttgcccgtggtcaaagccctcatcactgcatccccatcacttatatcagctacaaatgaagttggcgacacgttccttcatatggcgctgactggctttaggaccccaggattccgaaggcttgatcgtcagatggagcttatgaagcaattgattggtggagtgatcatggatttaagcagcattatcaatatgcaaaacgacgatggaaggacagttcttcacttggctgtgattggcaatctgcactctagccttgttgagctcttgatgactgcaccgttgattgaccttaatgtccgggacaatgatggcatgactcctctggatttacttaggaaacagccaccaacagcatcgtctgagatactcatcaagcagcttattttggctggtggaattgcaaattcaatggaccatgagaccagatcagccattgcttctcagctaaagatgcactgtatcgtaggcagcccgggaacatccttcaagatcccagatgccgagatcttcctccatgcaggtatcgatgcgtcagacatcagcgaaagaacgaactcattctctagcgttggacagagtgagccagaatttccggaatccagtcgtaagaagctgaactctatgcaaaatgcagcgaaacatctcaagatcctactcagatggcccctccgcaaggagaagaaatcatcatccggtgcccgaaatgaactggacgacgacgcatcctctgtggattcagtcaagagctggagccacggggagaccccgacaccgctgaggcagaagtactccaggatgagctccctgttcaacaacaagcggaccatggcagccaggatcggctcaccgagtccatcgatgaagaagagcttcgcagatggcctcgcacatggcgtgatgcagcccgaatcgccttcaggctcgggctcctggtcgtcgtcgtccttggtcgacaggattgaagccgtccatctggacaagaatggccaagcatctcctgataccagtgtggtgatcaggcgtacacccaagaagcacgggtctttgaacagcaggctcatgaaccaatacttctgcatcggagcgcaggggatagctgtcgaggactcaaccacggggcagcgatcaagtcggatgttcagaagttcacttctgtcagctgcctgaattcgtaatttagacatggtttgctttccttgacttcactgcttacaagttacagctgatctgttagtatgtgcgagtgcatgtgagaagactgtcatatgttgtgtttgtattactgatgcaaaatggtgagatctactaatgtaatgtagtgctgttggtagtgtgtaatgattttgttgggagagtgagtacaatggaaggcatggttttcaagttctatggtttttatatcttacaatatcatatgaggttagtgagtataatttgtagcagagtaaattacattggtggtacacgaacttgttaagtgggtgcaatttagtatataaatttgtaaaatgctcattttggtacacgaacgtatctaatccgtgcgagctaggtccaaaatggcttggcaaggttaattttacctatctgatgttgattatctgatgttgattaggatgtgacggtgtatacgcatagtgagtatgcataaaacatgctatatttacaaatttgttatctactttatcttgaatttcgtatgtttctaacccctgtattactgctcggtattttatatctttctctacaatcactatatctcattctatcttttttattgaacaggtgtatgtctaagtagtaaccttctcatatatatatgtttatatagtatcctaatcagcacctaaattaacaaaaataatcatgtaatgtccttttgaccttaagtcgcacgcgcaatataagctcgtgtaccaaaacgagcattttacaagttcatatactagattgcacccacctaataagttcgtgtaccgccgatgcaatttactctttgtagcaccttttgtatcttacgactatatataggtatacagagagaggtatacagttgcataaagaatatagcgcctcttcaaataccgtaaccaaaaaagatttagcgatctttgttcacgtcatcacgtgggtcttatctcaatattacatttgagtggacattttaaaaaaagcaaggatggacgaatgatccgacatgccaactatatatgtagtcgtgctaagaaaatatgcagcaaaggctcatcaaatacgcaaaaaatcgcaagcaaatgtaaaccttgctccacttttctaaatgactagcgactaatttcagtcttggctccgggtttttttttattattttcaaaaatacgggtaagatttgcgtaccttcgtattaagactaagtttatattatagcacaagtgaagacaagtatgaacagaagaaaagaagaaaagaaagttgcaaaataattgtgaaaggcatggcgattttagatatcaatgtcatggtggtgggtttctcctctgttagttttaatctgcttatctatcgcgtgtcaaacttcgcggttcatatgctaactcgttttttttaatattatcatttgtaattacactttgtaatgattttccatgatcaataaaacacatctttctctaaaaaattaattgtgaaaagctatatcttacggctgaattgtatgacaaaaaaaactcacactagactagcgtctggaaggagtactagagtgtggcttcctttgaggtagcacttgccacctccattctttttttttctggccgttcgaaatacgattgttctattcctttcaaattgaccatgacgttagaattacaacaatgtcatagcctgctatcacactactattggaaaaacaattgcttatttgaaggagagcattttatctaactgattttctagaatgataaataaagagtgcctctagccaactagatcgtcttttcctgttgatcacaaagaacacaatgctagagatgctgcaggccacgtatgcttgatctatctgtcgtctagcaacggcggtggg

SEQ ID NO: 62695 - DNA, 1300 bp, Oryza sativa
  unsure (1)..(1300): unsure at all n locations
cttcaccgccagcgcagagagcacattggggcgagcagatgagcaactaagaagaagtgatggtgaggggaagggaggaagggatgtgcggtgagtggagggggggcctgagcagctgccggcgatggccggaggaacagagaggaagagaaaaaggaggaagacagcaagggagaaggaatgggtggttgcaggggcggcctccgcagatgccggcgacgggagggtggtcggagaccagactcaccaaccacggaaggccgaccaccggtgcgtactggcgccacgccgccacgcagacgccggcaaaccaccgcccatactccggcgcacgcgccgccgcgcgtgaccgcgctcgcgagtcgacttgcgtgacgaccccgccgctcgcacgccgctagacgctgcagcggcaccgccagccgcgccacctccgcttcgcgccgccccacgacaccaccgtcggcgcaccgtccagatccggcaacggcggtgccggatctaccgccgcctggccgggattcctcgccgccgccactctccgccgccggcaaaaaaactccacctcccccacgcctgagagggggcaccactgcggagaaagccccgccgccgccttcctagctcgccggccggctttgccggcggtgagctccggcggcggcgaggtaggggaggggacgagggtggcggcgccggtggtagggttcgcccccatgtcgcctgcgtgtgggcgacgcgggggtctttttcaatgatggatcattttgcttggcacatcatcaatcattttgccttggcacatctaatatgataaaacagccacatattataaggtttttgaagtagtatattacttttgaaacaaatctccatctcaagtcaccaaaacagtataataggatgattataattgacgatttgacgtttccatacacaacttgctttgtgcagattagtcaaaaggatgatagactcgtaacattgaccatgcatgatcctgtgcatgacatggcaagatcagtcatagatgatgaattaattgttctagatgatacgaaagaaaataaatgtgggcaaagcacttaccgctacgtattcatcaccaactatgacaagccatcaaaggaattctccatgattttacatggaaagataagggctctccatttggtgggttgtagcaaaacaaaactcaatgatggagcattttcatctgcgaagtgcttgcgtgtcttggatttaaatcattgctctatacagnnnnnnnnnnnnnnnnnnnnnnnnnnnnnnnnnnnnn

SEQ ID NO: 62696 - DNA, 17606 bp, Oryza sativa
tactcccttgcatttattctgcatttgtgggtgtgtcttgttgagtacggtggttgtactcagtcttgcttaattttcccaagcccagatgaggagttccttgaagatgaaggcttcggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacaagttggtatcagagccttccttgaccctaggacgagccgtagatcccaagccttagcaatattttcaaaaataaaaatcctttgttatttgtgaaaaccgctattctctctctgtcttgctgcttcatttatcgtcaaaatctgacctttgaaaatgtggcttttctttttgtttttgcttgtagatggccggcagcgttacccgtcgtggtttggacatgaccggcttcgtcttggagctgcgaggcatgtgcgtggtcttggaatatccacatggagtggattaccaggccaggccgctcccggagcaggagggtgaggatgcagagcctcacgctggttgggaggtcactgcagtgatcctctccggctctcccgagcggacttcgctggcagtcacagcgggtggggactccttccccgccgcttgccagaacgccgctctcctcgccatcggcacccttcaccagcgctacccggacgagttgcagcactcgtcctaccgctaccaccctcgtcgcggaggagcccgcgacttcgccaccttccgagacgccagctcggaggatgacgctaccgtcgtgcatctggcacgcatggtggaggcgtacgacgcggctcgtatcgacttccaccagatggtgcgtcgtggcatggtggagaacaacatgaagatcctggagctgcgtcaggagaatctgcagctcaagaaggacctcgacgcgttggaggcgcagctgcaccagctcaagatcgcccagggagagatcagccgtcccaagcgtcgccgcgtctgccgcagccagaagatcaccgcccgcaagagcacctccaggcccgagcttgttcgtcagtccctggcgtggacctgcttcgtcgagacccctcgtgccgagcctgcgcccgtggttccccaggagggggaagcctccggcgttggtagctcggagggtgcgctgttgctcaccttccgtcctggcccgtcgcagcggtagacgagcagttagtaggcttgcgcgtgtgtttttcctcgtttgtcttttttgagttgtgtggggcatggttacgccggtgtgtggtgtaactatgtcggagcctgtcttattttgtttgcctaagcaacttgaaccttaatgaaccaatttaatagcagtgataaatttaagaataatggtagtcgtgggtggttagttttaatcgtcagctctccttctctgtttgctggttctgtgtggggtttccagatggtgacgaccaggagaaatgttaacaccggtgaaggcaaccaacccgagggcagcaaccccaacccccaaggcaatccacctccaccaccaccaccagacaccaacgccattctcacccagatcctcgcccaacaagccaacatgatgaatgctttcctccaccacctccaaaacccgccacaacagaatgctccaccaccacctccccaacactccaaactcgccgagttcctccgcatccgcccacctaccttctctagctccaacaaccccgtggatgcgttggattggttgcatgccgtggggaagaagctagacacggtgcagtgcagtgatgaagagaaagtcatcttcgccgcccaccagctgcaggggcccgcatctatctggtgggaccacttccaggctacgcagccagcgggacaaccgatcacttgggctcgcttcacctccgctttccggagaacccatgtgcccgccggagtcgtggctctcaagaaaagggaatttcggtagttgaagcaaggcaaccgctccgtgatggagtatttgcacgagttcaacaatctggcccggtacgctccggaggatgtgcgggaagatgaggagaagcaagagaagttcttggcaggaatggaccctgagctgtccgttcgtctagtctctggggactatcctgacttccaacgactggtggacaagagcatccgcttggaagccaagcacaaggagctggaatcgcacaagcgccgcttggcgaatttccgcaatcaacagggtgctaaccagagggttcgctacaccaatccctacccagggggatcctcctcgcagcagcaacagcagcagcagcagcaacctcgctccgcgcctcgacctcaattcgtggtgcgcgtcccacagccgcagcagcagcagaatcagcaagggactcgtgcaccccgtcctcctacgccagccgtgcagcccgttcaaggccgcagggacgctcaaggtcagcagcgtctgtgcttcaactgtttcgagcccgggcactttgcggataaatgcccgaagccaaggcgtcagcaaggccaagcgcctccccgctccaacaacggcgggaaggatgtcattcgaggtcgtgtgaatcacgtgacggccgaggacgtgctgacaactccagacgtcatcgttggtacgttcctcgtccaatccatccctgctactattttgttcgactctggagcttcccactcgttcatatctgtgccattcgtggggagaaatcagttgggggtagaaaggcttagaaaccctctgctcatcaccacccctggcggggttatgacagcaaagtattatagccctgccgttcctatagaaatccaggggattccttttccctcggatctgattctgctagacacaaagaacttggatgtgatccttgggatgaattggttggctcaattccaaggagtagtggactgcgcgagacgcactgttactctgtaccgaggaccagaacaaccggttgttttctttgcacccccaacctctgtcagaagttcagaactgcatcagatagaactgtcagaaatccccatagtcagagagttcggagacgtgtttccggaagaactacctggtatgccgcccaagcgagagattgagttccggatagatcttgctccaggaaccactcctctgtacaagcgaccctaccgtatggcagcaaatgaactggccgaagtaaagaaacagttggaagagttgaaagaaaaggggtacatacgtccgagtacttccccatggggtgctcctgtgatttttgtggagaagaaagacaagacgaaaaggatgtgcgtcgactacagagctctcaatgaagtcaccatcaaaaacaagtaccctcttccccggatcgatgatctgttcgatcagcttaaaggtgccaccgtattctccaagattgatctccgttccggatatcaccaattacgtattcgtgaagaagatattccgaagaccgcattcactacgcgatatggactgtatgaattcacggtgatgtcgttcggcttaaccaatgctcctgccttcttcatgaacttgatgaacaaagtgttcatggaatacttggataaattcgttgtggttttcatcgatgacattctgatatactcacaatcagaggaagaccatcagcaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcaccgattggaagcaacccaagacagtcactcagattcgcagtttcttaggtttggcaggatactatcggagattcatcgagaacttctccaaaatcgctcgacccatgacacagttgttgaagaaagaagagaagtttgtgtggagcccgcaatgcgagaaggcgttccaaactctcaaagaaaagctggtttcctcgccagtgttaatcttgccgatactcgcaaggatttcatggtgtactgtgatgcttcgcgccaaggattggggtgcgtgctcatgcaggacggtcatgtggtagcctatgcttcacgtcagctacgacctcatgagggcaactaccctacgcatgacttggaattagccgcagtggttcatgctctaaaaatctggcggcactatctcattgggaaccgctgtgaaatatatactgatcataaaagtttgaaatacatcttcactcagtcagatctgaatcttcggcaaaggagatggttagaactcatcaaggactatgatgtgggaattcactatcaccctggtaaggccaacgtggttgccgacgctctaagtcgaaagagccattgcaacactcttaacgtccgtggcattccacccgaacttagtcaacagatggaagccctgaacctaagcatagttggtcgcggattcttggctgcgttagaagccaagcccaccttgctcgatcaaatccgcgaggctcagaagaatgatccggacatgcatggactcctcaagaatatgaaacagggtaaggccgctggtttcacagaggatgaacacggaaccttatggaacggaaagcgggtatgcgttccagatagcagagaacttaaacagctgatacttcaggaagctcacgaaagtccttactccattcacccgggcagtaccaagatgtacttagacttgaaggagaaatactggtgggtcagcatgaagcgggaaattgcagagtttgtggccctatgtgatgtgtgccagcgtgtcaaggcagaacaccaacgaccggccggacttctccaacctctccaagtgccggaatggaaatgggatgaaattgggatggatttcatcaccggcctcccaaaaacccaaggtggatatgactctatatgggtaatagtggatcgattaaccaaggtagctcgattcattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagcttggtacccgactaaatttcagcaccgcgtatcacccgcagacagatggacagaccgagcgtctaaatcagatcttagaagatatgctccgcgcatgtgtcctagatttcgggaagacttgggataagagtctcccctatgccgagttctcctacaataacagctaccaagccagcatacaaatggcaccctatgaagcgttgtacgggcgcaaatgccggacaccgctattgtgggaccaagttggagaaagccaagtgttcgggactgatatcctgagagaagctgaagctaaagtcagaatcattcgggataatctaaaggtggcacagtctcggcagaaaagttatgcagataaccgtcgccgtgatctggaattcgcagtggatgattttgtgtaccttcgggtcacgccattgcgaggtgtgcacaggtttcagacaaaagggaagctcgcacctcggtatgtgggtcccttccgtatcatcgctcgacgtggagaagttgcttaccagctggagttgcccgcctccttgggcaacgtgcatgatgtgttccatgtgtcgcaactcaagaaatgtcttcgagtgccatccgagcaggccgactcagagcaaattgaagttcgcgaagacctgacgtatgtggagaagccagtgaaaatcctggacaccatggagcgcaggaccaggaaccgtgtaatccgtttttgcaaggtccagtggagcaaccacgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaatctatcctcaaaattgtgcaaaagaataagtaaaattcaatgtgaaagcctccaacaattaaaatgtgcaaagataaaagtcaaatgaggcttggaggatttttgtatatttcctaaaagcctaaaatgcttaaataaattttagtggaattttcagagcacaaataataattgaaaagaaatgaacaaagttaaaaaggtttataaaaagaaaatcctaaaagaagtcttttccccctcccccttccttcttgggccggctcggcccattccctccctctctctctctcttccccccctcggcccatcggctccccgcgcgcgcgcgcgccgctgacaggcgggcccgcccgccactctcgctgacgggtggggcccacctgtcatcgccctcctcccgccgcgcccgccgccgcgtccgtgccctagcgccgccgccgccgcgaatcccgccgctcccgtccgccccgcgtgcaatcaagagggggaaattattccccgcgtttccctctcccgattccccctcttttccctctctctctccctcggattcgttcgaatcgtgcccgcattcatcgccggcgcaatcaatggcggccgagatcttcgcggccggtttccttcctccccggccgcgctctccccctcccgttgctatatattcgttgcccgagctccgctcttccgtttccaccgctcgccgctcgctctcgccgtcggaatcgtgctagcgccgtgctcctctctctccgccgtcgccgtcgaccttcgggtcgccgccgacgtcgctccggtcttcctcccggttcggcgccacctacctcggcataaacgaatcgccgtcgacctcgtccgcgcctccgtttcgctcgccgaccgccggagcaccgtcgccctcgtcatcccgagccgcgccgccgtcttcctccgctccgtccgccgtttccgccgccttcgccgtctcggggtgagccgtggaccgtccccttcgtttcccccttccctcctctctctcgggtgccactccgccgcgccgttggtcgccggcggcgaccatcggggcgcgggtgcgcgccgctcccgtcggccgcgccggcgaggccgccctcgggcgcgccctcgcggctgccaagtgggcccggccgtcagccgcccgcgcccgcgggtgcggctgacgcgcgggacccacggcgccgaccgccaccagccgcgtgcgcccggtccaccgtggaccgagcggctgacgcgtgggccccacttcccgtggacccggtccgcgcgcccgcccctcggctgacgcaataatccgaatttttaattgaaaattaaatgaagaaattcgtaaatatccatttaaagagcatataaacttcaaatggccatatcttggccatttgaactcggaattggaccgttcaagtctctaatttttccttaagatgtaaagaacccatttttgtgctttgtttctgctgttatgtggagttatttagtgttaaagcctttttcttttccgttggtcgtgtagacgctgcagcttcggaagatccgctcttcattgaagtcgaagccgtcgattgggaaaacgagcaaggcaagacacatcatcttgatcatattgaatcccagtttataaaattatgttgatttaaattattgcattatcgctttatttaaatccccgcgttatcactgttttacttagccatgcctatttacctttgttatgaccatattattattgttattgttattattattaccttgttcaccctagattaaacaaaaccccaactagtggacactctactcatggtatccctagtataattctaggtagatgcttcgcaatttaattaggcaacattaggtggttttataactatagactttgggaaattctcatatcatttggacactttggaatggttggcttatgttggaattggacacacacctctcttcctctttcaaaacccctaaaacctgttttcggtggggtttgggtgcatgccagttgtgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgcgaggggctcagttccgtctgcctgtcccgggggttccggccgtaggcgggattgggtcggtactcttgtctaaggctaggatgggttggaaactatgtcacgtcttccgtctgtataccgtggtggtatgtggcacgtggtaacacgtgaggaagatgtgtcttgtgggtaaagatgtacacctctgatcagagtaaatctattcgaatagccgagccctcggatatgggcaagccgagcaatgtacccaagtcagtgttctaattcttaaaatttgctcaacaactaaaatgtggaatggttggcctgggttggcttaggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaaccctttatgtcataattcccttgtactcccttgcatttattctgcatttgtgggtgtgtcttgttgagtacggtggttgtactcagtcttgcttaatttttccaagcccagatgaggagttccttgaagatgaaggcttcggtgtctagctcgtgcctgccgtcaagtgcctgtggtcgtcgccctagtcttccgctgtttttcgttgtctttgtgtgctgggccgttgttgcccgtgtaataattatatttacgcttccgcttgttaaactctgaattgtatcaacttttggtgtaccttgcctcctgggacaaggaataatacacgcacgtcaggaacgcctgttgggtgatttccggtcgtgacagccgcccgggctgaggaagccgctaaggaggaggccgcccgggctcgccaggctgaggcaacagctgctgctggcgcgtcaactgggcccactccctcgggcaaccctcaggcgacagcctccggggaggcacgcgacgtggccgcgggcacatcgcctgggcccacctccccgggcgacgcccaggatcaaacgggtccgggggacatccctgagcccagcacgtcctccggggggccgagccgcatcgccttctctccaaggcggctcttctcctcatcttccgtcgccccgctgagcgccgagcccattctgcaggccttggccgccgcaaacaccgcggtgctggatgggtttagcgcccaagtggaggccctgcgcgcggaacgagcggagctcgaggccgcatgggcacgcgttgaggaggggcggcgctcggtggacgccatggtggaggtgggccgtaaggctcaccgccgccacatctcggagcttgaagcccgcaaggcggcgctggcggagatcgcccgagaggtggaggaggagcgagaggccgccctcatcaccaccaccgcgatgatcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcgaggaggcccttgaggcccgtgccatggcgctggaagaacacgccggcgccgtggagaggggcttgacggaccgcgaggccgccgctgttctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatcttgaatgcgtccgcgccgagagagccgcactggagcagcgggctgccgacctcgaggcgcgggaaaaagagctggacgcaagggcgcgcgtcggtggggcggctgcgggcgaaagcgacttagccgctcgcctcgcggctgccgaacacaccgtcgctgacatgcagcgcgcactagattcctccatcggggaggccgaggccctccgcttggcgggcgagatggggcccgacatgctttgggactcggtctcccgcatggatcgcgccggtcggcaagcgggcctctggaaaggccagacgaggatgcgccccgccaacctggaaggcctcgctccgcacctcaacaggatggcctgggtcctcgaacaactccccgaggagctcgagaagaccatcaagtcatcctcgagggacctcgcccggggggcggtcgaactcgtgctagcgagttaccaggcccgggaccccaacttctccccatggatggcgctggaggagttccctcccgggaccgaggacgatgcgcgcgcgcgcgtccgggatgccgccgaccacatcgtcaacggcttcgagggctcggcccctcggctcgcgttcgcccccagctccgacgaggagggcgatgccagcggtgaggacgacggtggcgacgaggccggcgacccgggcgcgtcagaatgagcccccaggcccccgccaatcttttttctttttctttcttctaaggccttcatgcctcttttttgtacaaattaacttaatctgcaatcagaaatgatgaaaaaatttttgtgttagttttattttgctatacatacgagatgaggatgatctgtgccatggtccttttgcgccttagcttgaaataagggctcgtgcccaagtcccagtcctcgaatggctcgggtcggggctagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgaacccccgagggcaaggttgagtacgagtgaccttatttcaagtcaagattcttcaaaaggaaagaacagcacagacacaacctttaggaaattgaaactgcttctattgaaatgttgaaaaaagagaaataagaatgtaatgcatgtgtggtagcccccggccaaccctgcacacccgaggggggtgcggggttggcctgagccaaaacctgacacccgacccccccctcatcaggggtagaagcgacgaaggtgttcgatgttccatgggttaggcagctccgtgccgtcgcccgtggccagccgtaccgagcccggccgggggacaccgatcactcgatacggaccctccctcattggtgagagcttgctcagtccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctacgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatctctgcattggcgcgctccacttggccattgcttctgggatgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcctggggcccgtttgaacggtcccaggatatcaagcccccagaccgcaaatggccatgacagtggtatgatctgcagggcctgggccggctgatggatttgcttggcgtggaactgacacgctctgcatcgccggaccagatcgactgcatcattgagagctgtcggccaataaaacccttgacgaaaggccttgccaaccagggtacgcgaggcggaatgggctccgcattcgccttcatggatgtcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggtgcatccgtctcccctaaggggtcgggtcgcgccgacggctgggtaagcctttcttcaaaggcgcccggtggggtctgggctcgcgaagacgcgagccgtgagagttcgtcggcaatcatattatcccgtctgggcacatgccgaagctctatcccgtcaaaatggcgctccatacgccgtacttggcgcacgtaggcgtccatctgcgggtcagagcaccggtactccttacagacttggttaacgaccagctgagagtcgcctaacaccaggaggcggcggatccccagcccggctgccaccctgagtccggcaaggagtccctcgtactctgccatattattagtcgctcgaaagtcgagacggaccaagtatctgaggatgtctccgcttggagaggtcaacgtgacccctgcaccggcgccctgaagagacagagaaccgtcaaattgcatcacccagtgggcggtgtgaggcagctgagaggggttcgtgctggcctcgggtattgagacggtctctggagccggggtccactctgccacaaaatcggcgagggcctggctcttgatagcgtggcgtggttcaaagtgcagatcgaacccagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctaagggccgtacccccggggcgttcttcgtccaagtggcccctcggggcgcactcgtcttctgtgccgatgacctcggggtcggaggacgacaggagcggccttcccacagtggcctcggggccgtcctgggggtcgggggctcctggcgtcgtcagacaagcgggcaaagggccagctccggtcgtcaggggcctcaggcctccgttcggctcgggggcctcttctccctgccctctcccgggtcgaatcagcacagggttagcctcggggtcaaagggtggtaggtgcggccttcccgcagtggcctcggggccttcctgagggtcgggggcatccggcaccgtctgacaagcgggcagagggccgactccggtcgtcgggggccttaggccaccgttcgactcgggggcctctcctccctgcctgctcccgggccgagtcggcacagaatgggggtgcgcagaatgaggattgtcctcatcgcgctccacaaccaacgctgcactaactacttggggggtcgccgctaagtaaagtagcaggggctcatttggctccggggcgactagaaccgggggagagctgagatatgcctttaactgagtaagggcatgttcagcttcctccgtccaagtaaacggcccggagcgcttgaggagcttaaacaagggtagcgccttctctcccagccttgatatgaaacgacttagggcggccatgcaaccggtgacgcattgcacatccctaagtttgccgggggggcgcatccgctcgatagctcgaatcttctcggggttggcctcaatgcctcgggcagagaccaagaacccgagaagcttgcccgcaggtacaccaaacacacacttatcagggttcagctttatgcgggcggagcggaggttctcaaaagtttccgctagatccgaaagtaaagtttcttggttgcgcgtttttacaaccaagtcatcaacataagcctcaacattacgtcctatttggctacccaaagaaattcgagtagtacgttgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgctgtggagtcgacgatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttctggggcctgccgccgcactttctgccggaccggccttgcgcccggccgcacggcgagacggtgctcaatcacctccctggggaccccgggcatgtctgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcgatccgctgcctcggggcggtgggggcagaggtgccaagcctctcgtcaccaccctcgggcttggtcgcagcagcgaggtggtccgcgcgctgctccatgcaagcgagcgcgactttaaggtcgccacggacggagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtatgccccggcgtcacaccgataatcggctgggacggtcggagcaccatccccggggccttgatggcatcaaaggccgcgggggaaaggatgttgagggccgctcctccatctatgaggacacgtcccaacttcacgttgcagatggtgggggaaaccaccatcgcaacctgccctccccgggcaatgcacggtgggtggtcggtctggtcgaaaatgagagcaacctccgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggtcatcatctccatcatcgatgtcaacagcgggggccttctgcttggcctcacttcgccgtttgccggaaggaaccgccggggacttgccctcacggcgttcctgcctcctgtcctcctcccacttcctcgttcgctcagccaggtttttgactgcacgacagtccgcgagatcgtggagggaggtgttgtggacggagcaccacctgccggcggggcgctccctgctgggagtaccagcctctttctttttatcgctcgcaggcctcccctttcgagtggcccgcggagcgccctcgacggcgaggacatgactctcgtcgccggaacggtccgacctcttcttcctcctcctgtcacgccgccctgtctgagcggcggatccgggggcggccgaagctgccactccggaaccggaggagttccatgtccacgcttcctccttacgagccactcggtccgcgagctgaaaaagctccgcggtagtctggggctctttggaagcaatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggcgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccgaccgggggcacggagggctgatcctcacgtccatgtcgaggtgacactctggacgaagaggcgccctccgttgcgcggggagtacgccggttattacgccggcgctcgatgtcgaggcgggcatccggctccccatgctgatcctcccgagttggaggtgtcgacgagggagtggcagccgaatgacgtgcagccgccgccgctcgccgcgccctccgccttgatgacacggaaccggtggtggcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccggcagcctgaagcgcgccctgaggcgtgctgccgtcgccgtagacgaggaggcgacgctccccatctcgccgttctcctgcatcacccacgaccggtgatgctgcggatttatctac

SEQ ID NO: 62697 - DNA, 15692 bp, Oryza sativa
  unsure (1)..(15692): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactgatacttgttagagcaagtttaatattatagcccactactagctttaattcatctatagccaatctaatagttaattcatacaatagttgtttattatactattaatatatggtcccacctgccatacacacattatgtcttggagtccgtgctgcagctgactataaatctgtaggccgctgctcttctctctcttcctttatctctttaaaatatgtttacagctggcttatagcctctattgtacctgctcttagtaatcctccagatagaatcaatagtttggtttaatttaatttggtgttggtttggatctgaaatccccaggaagctacggaacaaaaatcaaaatggcgatggcgaagcacatgatcatcctcatccccggcgccacatcgcatgcattttcttctcttcacgatgttcgtgcttgcacacaccggccattgctaaccttcacatgacagcctcacatggaatgttctcccgttgttgctaccactagagtttgttgagtcggcgacacgcatcaatacaaaacattcgtcagttgagttttgagacattagggctgcaagttggagactattatgaatgaatgaatgaattgaatgtatatattgctgcgtggaattattgttgggatgcagatctgataggcctctgttgtcgtttctaatttctaacaggggtacaatcatatctcatctagaaaaatagtactacaatctctgtttttgtggtagcattccctgtaggctgtaatgcttgttggagcttcaccatgcatgcaagctaggcagaatattttgtcatgatttaaaaaatttatccttcgatcaattttatattagaacaaaatttacaaaatctactatgtaataagtttatgatattgtgatagtatttttcaaggtaaaactacgacatctcaacatttattatgctactatacgagtagtaccagcttttaatgccataaagaatttatccaatttcttatttcttatttgcgtagcagttgagattgtgctgaaattttcaatggtgtaaaaggaattgtttttttattcttacgtatacaatttttgttacattttttcaggtccctctgtaatatgggattgagaaaatgaaggaaaaaacatagaattttaacatgaatgcacgtgtaaaacaaatagttacaaaagacatgaaaaacataaaaaatatcatttaattggatcacagtgaaaacacataaatttgaggagatataaagactcgtagaaaactttccatgaggttctacttcatgttaaatttcctcgaaaacttacatgaaatgaagttcctcatatgaatttgggattctgtagtgtccattcatttgattcaacgatctatatagaaaaatcctataaaatgaaacctcctctaaaattcctactattttcctttgaatcaaggggccttatctttaggacccatttgaatcgtagaaataaaaaaacgtagaaattaaaaaacacatgattctaactaaaatgtaattataaaacatataatgcaaaacaaaacaaaaatactggaatgattgttcgattggaccatgggaaaaaatacatgaatcaaatgagaggtagaatcaaagcaatttgttttcaaggggttagaattcttgctaagttcccttcaaaatctctatatgattgtctattccatagaaatttcaaatgatgagaaatgattcgataatctatttcaaatactttcatatgaaattgttctatagaattaaaatcctctgaaatttgtatatttttttccctacaaatcaaagaacttgttaatgtgtactccctcatcgcttgttcgtaaataagggattctaggttgatgtctttgaagtttcacaaattgaaaaggtcatgtttgataataaatgtagtggttagatggattatattgcaatattttcccaccttatgttctgagcgaggattgccatttgtatcaagtgaaacaggataaacaccggatgatttgctttgctgtgggctgttgacgagagaccacatggataaaaattatccaaatctacagggggtatttgtgtcaatcaggccattgttcatgtcgtcatcctacagttccaagctacacgaatctccaggtgagaacaaattttttttgctgtagctcctctttcgtcagtcccgactcccgacacgaggcctcgcaacccgggtcacctggtcaaaaccagagggcccacacagcgcatttccggggaacacccgggcccaccctcgtgctcccacccaacacgcctgaccagaaaataccattctttttttatttttaccaacacgtattgccaataatatttttcaatgttaggccgcatttagttgtattttttttttcaaacttctaacttttccatcacatcgtttcaattttaaccaaacttccaattttagtgggaactaaacacagccttacagcaccttacttcaaccatactcgtataataaaatactactccctcaaatattaggaaaattgatgtcctcaatttgtatagcaagagaaaatagaaaaagtcgctctcaatacaagagatagttaaacatgttttcatgcattgaacatatagtactactgcatttcagtataccttccatttcaaaaaaaaaaactcaattctaattacgaacttggacacgtaggtgttcatattcatagttaatatgatttactactatttttttttacatagtactagtgctcttgaataatgcgtcatttcatggaaaaaaagtgaagctgaatttatatatggaaatgaaaaaaatcgttttagtgcagtcgctgtcacatggaggtgggcccgggaggcgccgaccggcagtgaccacgtcagcaactgaattttatacttacgtcctcagtttaaggaatgtgtttttacaagtggcagaaagaaacaattctcgcactgtcatttctttgttcttggttatatacagtacggattaggagcccaatccctttctttaagtactcaattgacaatattttactactccagtttctgtacaatgttgatgcagtatgagtggttttaagtcattcctaaccccggatgctcaggccagttgggcattgcttgatagagaccatagtcgtaataaattcaatggtagaagtactaactatttatgccttgtttttttccttaagattattcaccaaaattttcaaaatggactagtttctccacttgcttaaataaaacattttctaaaaaaaatgcttaagctattacgactgtgctgccacagctagcacaaacgaacaccctcaatctttttggctttatattggtatttgtgggatgggtgagaaatgaacttattttgggatgaagataatatataataaagtactccctccatcctaaaatgtaggtatttttagttatgaatctagacatactgattcataggtaaaaattactatattttgggatggaggtagtacataacacatagcaataactcgctgaatagtctaaaacaaacgtggtctaagtaaatttatctttgtgtaaactttttatgtactacattcagctagtactataaatttaaatttgtagacactgtcagcactaatcaatcacgatagaaacatgggggaatttgggcaaatatcataacaagaaagtgttacactcgatcagtgtcacaccctctcttttggagacgcacacaacacaagagaaaaaaagcaaagcaaaccaaaccaaaccaaaaaaggcgtaaacacaaaagcaaggcagcgttttgcgcgtgaacccccaaatccaaaaaacgagttttgcgtgacacggtttacgaggccgtggcacgcgaaaagatctgagccgtcgatgaggagcagtgtgcacgcgacggcaaccagcgccgcgccgtgggtggcgttcacacggtgggccccgatcggatgacgcggcagcctttcccgattcggccgtggggatctcgccacgtggcatgatggcgatggccccaccggccaggggcccagggatcccttttgtgggggccatgatgtcggcgtgtcgtcctgtcgatcgatctctcgtgggttttatgcatcgaccgttatttcggttgagctcaaatgcgtacggagagtggagtggagtacattgggaatcctattgtcatttggtgcttttatctcggtttcatctcatgttacctcacttcgtcgtgaggattagaccattcccaactcgatgaatacgatgatgtccataatattaaataagctgtcacctataatgaaaaatgatatgacaagtggataaatgaggaaagagaaggaaaccatgtcttacatgagacatgatttctacacaacatacaagacatcatgtgagataagtagcattaaattcaagtatggaatagtggtgtttgcattggaagaatagtgtctagtactagtttcttgatgatgtggagtttatggaaactatgcctagtgtcttgggttgggaatagccttacatttgagtacttcggtccggttgtattcttaagtcaggccttgtttagttcccaattttttttccaaaaacatcacatcgaatctttagacatatgcatggagcattaaatatagataaaaaaaataattacacaatttgtatgaaaatcgcgagacgatcttttgagcctgattagtccatgattagccatagtgctacagtaaacaacatgtgctaatgatggattaattaggcttaataaattcttctcgcgttttcaagcgagttatgaaattagttttttcattcgtgtccgaaaaccccttccgacatcaggtcaaacatccgatgtgacacccaaaaaatttcttttcgcaagctaaacaacgcctcaatgtttcaacttcatttatcttgttttccgcaagcaagtttttcaaactgttaagtatcgtttttctaaaaaaaatctataggaacttgtttttttttaaaaaaatattcatacgtttttaacttttgttagctaatacttaattaattatacagttatgcatgcttcattttacatgtcaggaaggaggggttcccgaccccttctcctgaacacgcctagatggttctaatagccggtgagtggcaaacacatccatcaaatgtaatttaaaggagtattgtgggttttttttgcccaagtttatattcgttgttgatgtggatactatagccatgtttagttcctaaaaaattttgctaaaaaacgtcacatcgaatctttagacatatgcatggaatattaaatatagattaaaagactaattgcataatttgtatgaaaatcgcgagacgaatcttttgagccaaattagtccatgattagccataaaagtgctacagtaacccacatgtgctaatgatggattaattaggcttaataaattcgtctcgcggtttccagacgagttatgaaattagtttttttattcgtgtccgaaaaccccttccgacgtccagtcaaacgttcgatgtgacgtccacaaattttcttttcgcaaactaaacacaccctgtaatagtcaccgtagacatgtggttttttctctctctttttctttaagaaaacaaattgttatcttcttgattgaatgattgccatatatgccaagccaaggttatcttcttgtacgcttatatttgcgaagcactaccaatatgcgatcttttatgtgtttatttgaaacatgagtattctcttaattcttgtaaaatataaattaattactttgaaattttgatgaaattattgcatttggaaggagctctattaaactattaaagtaatagaaacccaaaagaaatagaaactattaaagtagtccggtaattgtgactggacaatgtaaagaaatgctttgcttttattagcacacaaattactatagtatctcccactattgtaccatttaggttctcaatcccttttagcccaacaatttaataacaacaactgtagttgtagtttttattataggaattgatgagactactattggtgatgttgttttgccctagcagatatgggcagctaggcaagggggcaatcatgctcctaaatattcccctgagcaagatgcccataacaaaagatgaagctaagcaatgtaattagtttaattacaagtgggggtgattagtttaaagatgtgcacatggcaatgatggagctggtgaggaaggccacaggagattagttggcctgtgcatatgcatgcttgcacacctgtgttcccggctttgctctctccaattatcaagggccacactctttgtgcttacatcgatcaaacccaagtctaaaagcaggggattaggggcagtaggtttggtgaaagtatccaaaaacggattagtttaatcttagattgtactagtagtagtaccaactagtatgtgtttgcaaaaataaaaatgcttattggagatgttttcaggtgacctaatggaacatttcttcggagaacatggaatctgtcccaaggcatttcttatttgtatgatagggatgtgaatttttcttgtactattacacttgacaatttgattttttatttgactctatggtgaggttacttccaacaaatgtttgtagcagtaacttattactgtgcacatagtgaggagtatttttatgggagcatttcagattttttaaggaggaagcaaacttttgctttgatccttgggattccaagttcctgtttgatttttattcatgttgattccatcaatcccccggtcccatccaccaaacaatcccaattcccaagcttcaagtaacctgtgaaagcttcaggctgcgtcaaggtcaaaattagcggcgacgatttatactgctaatgatgctcgtgccagtgagattactgtttgttggtagataaacacacaaactatactcaagtcaaagggctcaaagaaaaaaccacgaaaagttcagctcccttcacttcagcggtgaagaggattattaaaagttgcaaatgtttcgtttgttcagatgaaatcatggaacggttaaatatgataatacagtatatagtattgtactagtaatgattatatatggttaacagaagtagagatagaatggtctgaagaattgcaaaggccacatggccaattcaactcaaaaatgattctcctactctttccacaatagttcaaccgttttgttttagtagtagaacttcatcctgcaattctacctcacaatgcgaaaatacaacatactgtgtaaccataagttcttttgcagtataaccatatcttcttgtttaaaagaaatcaatcactgtactagaataactacagtcaaaccataaccgtccatttgagtactctaatatttagtgcataatatgtcaaagaacaattgactattactgttatatctccgaattatcggggagcacgtttaaccaaggataaatttctaaaagtgtgccacaactttagaaggaatccaaattttgtactcaaggaaaagagctaaattttcaacgcggagagaccatgttctttcctgcttagggatgaatggatgaattcgctttcggatcttgtagacatgcaattatttcaaaaagaataattcttagtgaactattttaagttcagttttgaccttcaaaataatagttactcctaattcatgtacttttaccctcaaatgttttgtgtttgagaggagaaccaatccctcctctgcacgcaaaacagagcggccttttaatattagttaatttttttaaaaaatagatcaatataattttttaaaacaactttcgtatatatattttttttaaaaaatgcaccatttaatagtttgaaaagcgtacgcgtgaaaacgattagtaaggtgggttgggaaaagggagcgccgaactcagccgtaacaagaaacaatatgagagttaagccattaacactaattgattatttaataattactccaaacttaaacaatactctcagtacgagagtatattaatacaatttactccctttgtccttaaaaaaattcaacctagtaggatgtgtcataatataacgaatctggacagagggtctaggttgcatttttttacagagggaatactaaataatgttttttaaaatctgatattcattgtcctgaattcaaaacactgtaaattaatttggtgtgagcctagcaggagagggtgtaggacccacacaaggcagagagaacaaaatgggagcagaagtgagagaagaagaagaggatgggtgtagctgtagctgacctccttccacctctcgcacacgcacaataacaaaccacttttaattccccgaggagagcagagagctcgaagcaaacaagaatcacaggagcgagcacggcaggctgcagcatcaccaccaccctactctctctctctagctagggttgcgctgcttcggtctcggtcttggcgccgcctgcctcgcccttcttgctcgcccctgctcccctgtccctctcgtgtcggggcgacggacggacatcctcacccgcgcgcacgtacgggtgatcgatcgattgattcctgctccgacgaagacggcggcggcgccggtgacctcgccggacatgcgcggggcccgctgaggtctttgttgccggcgaaaggggtggagtgattgactcggtcggtgtctgcctgtctggtctgaggtcatgatgaagcaggcgcagcagcagccgccgccgccaccggcgagctctgcggcgacgacgaccaccgcgatggcagccgctgcggcggcggcggtggtggggagcgggtgcgaaggtaggacgagttcttgctttgcttgctgcttccaatggcggttcgggatggagcagtggttgccttgccgtgttcttgtttctgcaatctggtccctgttttatcgcgttattatttcgccacaaaattaggcaaataaatcctttcttattcttcttggattttggattactgcatttttttttctctgcatttttgttcctgtgatttctggcgagcgtcgcagcatttactgttccacatttatgccccctcaaagtttgagtaatcgcaacataggagtacgagtagctgctactgcagtgctaagccatgtgcagagattaattggtttgtgtaaaaacctggtcgtttagggggcgaactgcaaattacacacaagctcgccggcggcgtagggcaaaatgcatttggtcatttggatcatccagcttacggcgagattattagggaaaaaagttttcactgttttgtttggttactgattggccgtggtgttttgcaggggagaagacgaaggcgccggcgatcaactcggagctgtggcacgcctgcgcggggccgctggtgtcgctgccgccggcgggcagcctcgtcgtctacttcccccagggccacagcgagcaggtgacttcgaagttctattgatttttttttcttctttgtttcattttcatagccatggatggcctcgttttgagaccctttttaattgactttttgttcttatgattctagtttttttttggtttgctttttttaaaaataagaattctaattcgtctcgttctgaatgttgatgattcttgcacgaataagttcacaacttgctgtccttttatgagttcttgagaggtggaatgcttttttttttgtttggtgttccattttgttcagtagtggtggcagttataattatatgatgggaataatgggatgtgtttctagggccaaaatgatatattttgttcacatctttatttctgggaatgtttcacttatcgcctaggagtatatgtctcctggaatcttttctgaattcatgtatcttctgttgccgaaaagtagtagtattatcttttcatgaattgttttttttggttctttgatattacagccatcattgatctatttggtaatttgattttctatgttttatacgatgtgggagatctcgattggtctgtttgttcattgtactttattttgtttcattagctaccaatttttagcttatggccaaagtggttggaagtattgggcatactggacccccttcttttatgggtttatggtgtgtggcaccattctcttgctctgtcgtttggtagatgaagcagccaagcagcttcgatttttttttcgcatttaatggtaattacattcagtagcttcttttgcaactttcttggctttggtgttggggctaccttattttgagcaagtttgaagtatggggtgatgaactgtttggatttggaaaagattctttatctaaaagctagtgctggaaggtgcctaattctgtattggtttttcctatcccttttgtgatgatgagaaaaagggaacttttttagtaaccgtgtgatggctatgtcctcatagcacatgccgatgtgaggcaagagaaagttttgctgtggcttaattaatataaaacgaatttatgctttaaacttaaattcagcctaatgttggtcatgcttttttgtgtggggaaattgctgtggttgaagtagggaacattttgtaaaagggagaagagttacatagagaatttaaaataaaacttaagcaacataaaaataatatttgtaaaaattcggttgccattttttcctgtgattttcatcgtgatcgagtaccctttggcctttgtttccctgtgactgatgattttttgttgataaggtcccagtatcaacagatttatatctgcatccttctgattccagtgtgaaaattgttgcttagagccacagatttaagtatctttcatattgcaggttgcagcctctatgcaaaaggatgttgatgcacatgttccaagctacccaaatctgccttcaaagttgatttgccttctgcataacgtcactttacatgtaatctacagacgtgagatgttattatagtttctttttacctttaaccatctatgctgaaagtatggtccatctatatttcttaggcggacccagaaacagatgaagtgtatgcacaaatgactcttcagccagttacttcagtaagcatctgatgcccttgcagatccccaacaaattttcatcgatttcccttttgttcatggattgtaacccaccttttgtgtttcaattgattgtgtattgaaaagtatgggaaggaggccctgcagttatcagagcttgcactcaaacaagcgagaccacagacagaattcttttgcaagacactgactgcaagtgatacaagtactcatggaggcttctctgtgcctcgtcgagctgcagaaaagatatttcctccactggtatgcaaagatcagagtcatatgccattgtttacttcattttctgcatctttattattaaatcactggtgcttgctgtaggacttctcaatgcaaccacctgcacaagaactacaggccagggatttgcatgataatgtgtggacattccgtcacatatatcggggtaagcaaacaatagcaacgataaaaataaagaaaatatatagtataacaaatgaaaaattctgctgttgacatcctactttatagttgttgatacttaatatttggcatgattggctgaaattgtgtgcatatgcatgttttgttctttacgcatggcagttcctgtattcaaacttcaaattattgtgtttttatgtaatatatgtggctcgatatgtattttgtccagacaaaatatttaatcgcccatgtgttttgatataaacaggtcagccaaaaaggcatctgcttaccactggctggagtctatttgtaagcggcaagaggttatttgctggagattctgtcatttttgtcaggtatgctacagcttatatgctatatctttaaagtttgaactaaatgatgagaacaagagatgcatgatgttttcttgttttttgtggttattcacatcgatttaacggtggtcttctttctttttcctttttattttttagggatgaaaagcagcaacttctattaggaatcaggcgtgctaaccgacagccaactaacatatcatcatctgtcctttcaagtgacagcatgcacatagggattcttgctgctgcagcccatgctgctgccaacaatagcccatttaccatcttttataaccctaggtcagttctgtactaaagtatgttttgataattctctagtagtaactactggagagctgttgaaatgatggtatgcaaattccgtatttcagggccagtcctactgaatttgttatcccatttgctaagtatcagaaggcagtctatggtaatcaaatatctttagggatgcgctttcgcatgatgtttgagactgaggaattaggaacacgaaggtacttttttctcacttttccataaatggaaataattgtggactgaattgccatattatatgattatacatgtcaatgacaaagctgggaatgattcttaattttctttttaaattttttgttgttgttttcttgcccttattgcagatacatgggaacaataactggcataagtgatctagatccagtaagatggaaaaactcgcagtggcgcaacttacaggtttgttctctggttaattttggcagcactataacctagtatttcttgtgcccattttctgctgctgatacaatatattttgtgttttttcattcttgaacaggttggttgggatgaatccgcagccggtgaaaggcgaaatagggtttctatctgggagattgaaccggtcgctgctccatttttcatatgtcctccaccattttttggtgcgaagcggcccaggcaattaggtgagctctcatgttacattgccattacttcttttatattctttaactgctcttgaatccagttattgatccaggagaataccccttagtcatttgttatgtctagctactagcttggaaaatatacctgcaaccaagctttacctttgagatgacaatctggataacataccttttgagttgtacgcacccaactgatttgagctaattatcgaattctagtggtgttgtgaattcaaatagatgaattgtttcactaaactgcttgtatgtatgcttaacttttgatccctaccatgtaattacagatgacgagtcctcggaaatggagaatctcttaaagagggctatgccttggcttggtgaggaaatatgcataaaggatcctcagactcagaacaccataatgcctgggctgagcttggttcagtggatgaacatgaacatgcaacagagctcctcatttgcgaatacagccatgcagtctgagtaccttcgatcattgagcaaccccaacatgcaaaatcttggtgccgccgatctctctaggcaattatgcctgcagaaccagcttcttcaacagaacaatatacagtttaatactcccaaactttctcagcaaatgcagccagtcaatgagttagcaaaggcaggcattccgttgaatcagcttggtgtgagcaccaaacctcaggaacagattcatgatgctagcaaccttcagaggcaacaaccttccatgaaccatatgcttcctttgagccaagctcaaaccaatcttggccaagctcaggtccttgtccaaaatcaaatgcaacagcaacatgcatcttcaactcaaggtcaacaaccagctaccagccagcccttgcttctgccccagcagcagcaacagcagcagcagcagcagcaacaacaacaacaacagcaacaacaacaaaaattgctacaacagcagcagcaacagcttttgctccagcaacagcagcaattgagtaagatgcctgcacagttgtcaagtctggcgaatcagcagtttcagctaactgatcaacagcttcagctgcaactgttacaaaaactacagcaacaacagcagtcattgctttcacaacctgcagtcacccttgcacaattacctctgatccaagaacagcagaagttacttctggatatgcaacagcagctgtcaaactcccaaacactttcccaacaacaaatgatgcctcaacaaagtaccaaggttccatcacagaacacaccattgccactgcctgtgcaacaagagccacaacagaagcttctacagaagcaagcgatgctagcagacacttcagaagctgccgttccgccgaccacatcagtcaatgtcatttcaacaactggaagccctttgatgacaactggtgctactcattctgtacttacagaagaaatcccttcttgttcaacatcaccatccacagctaatggcaatcaccttctacaaccaatacttggtaggaacaaacattgtagcatgatcaacacagaaaaggttcctcagtctgctgctcctatgtcagttccaagctcccttgaagctgtcacagcaaccccgagaatgatgaaggattcaccaaagttgaaccataatgttaaacaaagtgtagtggcttcaaaattagcaaatgctgggactggttctcaaaattatgtgaacaatccacctccaacggactatctggaaactgcttcttccgcaacttcagtgtggctttcccagaatgatggacttctacatcaaaatttccctatgtccaacttcaaccagccacagatgttcaaagatgctcctcctgatgctgaaattcatgctgctaatacaagtaacaatgcattgtttggaatcaatggtgatggtccgctgggcttccctataggactaggaacagatgatttcctgtcgaatggaattgatgctgccaagtacgagaaccatatctcaacagaaattgataatagctacagaattccgaaggatgcccagcaagaaatatcatcctcaatggtttcacagtcatttggtgcatcagatatggcatttaattcaattgattccacgatcaacgatggtggctttttgaaccggagttcttggcctcctgccgctcccttaaagaggatgaggacattcaccaaggtcagtacctttctgtttctttatctgaagccaaccaacagcttcttctgtggtcagcgtgaattttaattataagtaaacatgaagctttttatctttttcattaccatggtaacaataatttaaacttgcgatggtagtttcatctactggaaactaagttctcatttattaaccttcaaaacattgaagtaaatgtgcatatggataagccgaattgcatgataagtctgagtcagattctgttccgtgatgtgatgaggacagtatgagtagtttttttttttggttgcctaggagatgttaagaagttttatggttgagtttctagccgaacataacttttatgtgcgaatctcacatgtttgtattaattatactctttaagataagagttttctaagtgtaacttcaggataaatctgttaaacgaagcaccgtttctttgttgtattatagcattttatggatgcatttgcagttgcatctt

SEQ ID NO: 62698 - DNA, 3907 bp, Oryza sativa
ccggtaacccttccaaggttcatatgaacaattcgaatgaccaaattcaccagtccatattgtcatgctgcgccggtgtaagtagacaatcaccggagtgttgttgtagatgttatcagcttacatccgggagcgcaaatggctcggcggatcagtagtgttttttttgtctatatgtgtagtttctcacacatcaaaagggagtagggatggtaaatgaaacttacctagagtttcttaaggttaggcgaaagatgattgtactgttggaaaggcagttctgtagtacaatgattcttcttcagaggccattcttaagatctccatgatgaaatcaaaagttgaagatgtcaggtctgtgttttttgagtcgtatgcatttgctttttgcaaatgttatgtcgggttattcttcaggtattggaatactgcgtaatttccataggacaaacggtttttgccaacatgagtgctaatttttaacaaaaaaaaaaataaaagttactactgcaaaaaaatacagaacacaaagcccttccctaacctatgctaaagatcatgaatcaccacttcaccagcacacattggaccaacagaaatcacagtagaaactttattcttacatgtattattaatggatgatgctataaagtataaagattacactctcgaggagatgggttatttcatactaacatgctaatacagcgaactgccatttcactatatatatcggctattggcgaatattgcaatgtagtccttcaaatctcaacctgggtcgtcgtcgtcgtcgtcccaggctgttggatttcctgcatgaatgattggtaggtttcaaccctggacttggattcaggctgttcgaggccatccatgaacccgtgggtcatcgcaaggaaatctttcatgtgcaacctcttccattcctgcaggggaaaaaaatgaatgagctcaaaatggatatcacacaatcgtaataaccactgtcaattttatcaattcagttaagcatgaagacagtttaagtacaggtgtgagaatggaagaactaacaaaataacatgggcttaagatcttgtatatatacaaaatggcatcaggtatgaatacagacggaaataccctcacctcaaaatcccattcaccataaagatttggatcctctgcatcagcccatacataggtgtcagcaagcattgtctctgaagtatcctgcaaggacaaatcacctttgtttttagcaaaaccatatcgattttttgacgacgtatcaacagcaaaaaatgtacatgatgaacagaggaagaacattattgtatggcaataacaaataatttcctaagatgtatttttgtgtctcctgcataatacttgctgccagcattgattatgttgacaacgtcagtgaaaaactcacagttaatgatatctcaactcttgtcctcacgtactccacatcttcaaattcatccagaatctggagctctgcatcagtaacaccggtgatgacctgcagaaaaatagtaaccgtaggtaagaggagagagaggttaaaagcttaacaacttcatcttttcgcttatgtttgtacttatcagccaaaatttaaatttttgaccttaaatttagagttgattttggggtttttttattcatcgaagtttattttttagaacacgtatataaaaaatttattcataaattatttttcgtttgtaagtatattgaaaccatagcttcttttcaatgagatttaaggaattgcttgctgtcataacggcctaccgcagttactgtcgaacagtgaacataatagcctaattatatcatgagaatattaaaactcagtaatacaatcagatgttcattatactatggtcaaacttcaaaatagttatttatatatatactctctaggaaagattaatttaatttatgttggaggaagaccaaaaaaaagaaagagaaatagtgtagcaaaccttgccagcaactttcttgctttgaacaggtaggattgcaggataaatcctacccttgatgttgaacctgtggctgcgacaatctcacactttcagcttattgcatctttattatcaatatgaatgaagaacagaataagcacatagatcaatattttttttttgaaaaaaatctcaatctcaatgacgctatcacgcgtcacgatcgacgacgtcaccgggcgcactagctagcgcgagaggaatccattcccggcgagggaggcgaaagcgaatccgcaaaaggggaatctctctctgcagaagaaatcaagaaccctaggagaggaagaggaggaagacggcggcgcttactagttggggaggagcgccggggaggagggcgggacgcgcttgatgatggtgcgcaccacctcgtcctgcatcaggctcccgtacacgaacacgctgtgcgccccgaccccgaccccgactccgtccacggcggcggcggcggcgggtggcggcgccatggcgaggtgggcggcggcggcgataaggactagcggttgccacgtggcgagcgaagggagatggaacgaactctcaactctggctcactcgattcttgtgcgtgtgtgcagactgcagaggtgcagaggaatgcgtgccattatatacaagctgggctctacgtcaagattcgtgctgtgtggtgtggacgtgatcgccgtggagattcccgtctctgcctctccaaagatctgatcagtgtggacatgatctgattcgttttttttttcttgaaaaaaaatagacccgaggcatatataactacggttgaccttaggctgcgttcgggaggagcggttgggaatctcttctccccggcacgtaaaacagagcacgcattactgaatgattaattaagtattagctaatttcttttcgaaaatggattaatttgattttttaagcaacttttgtatagaaacttttttaaaaaaacgtaccggttagcagtttaaaaagcgtgcgtgcgaagagagagagaaggggttgggaggttaaaggtaagaacaacttgagcaaatacctagatacgtaaaaataaattgggtcgtcaagaccaattgagtggaactgattggagtgttatcacaaaatgaacttcagagatagagctgggttaacttcactacaggcttaattcttaaagttaaatttataagttgaaaccttaccaaatagccctcaaatatattactgacataaacccgtgtatgcgctcctttatactagtaccgtattgattgtgtattgtatggcagagattaggatacaaaccattttcgttataaaaaaacatcgaactttttaagagtacaaaaatccagacatgcgacattgcttgataattctaggcataaggtcgttctcaagggaatacaactagtgataatatatgtgtccatactctgctttttcatcgagacatacttatcaccagtatgtatgatcccatgttagttgaacactattaatctatgaggctctaatgtccaataacaattgaaaattcctccaatagaaaggtatttggaagtttggccatggacccttactaattctaagctacattgttacataatccttcatgtgaaatcttgactaatcttaattgaagcttcaataaaaaaaactaaaaaaaaattctatacctactacatatttacaacccattacattctaaatcttaatgtacaaacaaaccatatcactatccgctaataattattacatcttaatactcatgcaaacattccacatcatctactacaatttattaaattaaagctccacatgcaagcatatcaaattatcaccccttatcatttctaagatatctcaacatataccattcatcatttctataatattaa

SEQ ID NO: 62699 - DNA, 2245 bp, Oryza sativa
ctataatgtgataaaacattttattagatcataatttggttggaactctgttttattgttttatcatgtactccctccgtactcgtagaaagtcgtttaggataatatttaagtcaaaccttgggaatataaaccatgaataactctcaagttgttgcgtttgaaaatgtaaaaattatatgaatatatttgtcttgaaaaatactttcataaaagtatacatatatcacttttcaataaatatttttacagaaacaagaagttaaagttgtgttttcaatactgtgtcgctgtccaaaacaacttcctttacgagtacggagggagtatgtattaaaagaaatacaataatcctctatttctaaataactacaaccaactaactgcaattattgtatactaagtaagttcgattgaattaagtaaaatataattttgctgtggggtctccagtttagacctgaccaaagacttgaaacttgaattcttgaaagatgtaacgcaagcatatgttgcggtcaagttgatgcgcttaatttgcctttggctctctacacattcaaaaaggggaattcaaacgtatttacaaagtgtaacattctagatgaatttgctgccttgtcaaatgtcatgttagtctgatagtctcatgccttgactctgctgcatcaacttattatattcgagtgataactaatttgccttcttttcgaggacctaaatgctaatttgcttgcgaacagaacatgggccaggatattccaaagatattcgagggctggaaaacatgggccatgcccaacttgagcaaaacggacagcccataaaccgggagtacctatacatctttcgaaagatttttatgatcgtatcacatagatttttaatctttagattaaaatccgatatatataataaaaggcaaaaagcaattaagaaacaccataatggatactaaattaccatatcctcaagaaaaagaccaaatccaatacaaaatttaaaatttacatgcgaagattcaaaaattacagtgtaactaacaaaagttacagtgtaagtttcataaattacactgtaacttataagaaaaggcactgtaaatttgagtgagaaaatcgagtgagagataagaaaaaatctttcgagtgagatatagcaaaatcgtaaagggatatattcatggccgagaagacccaacaaacatgggccaggcccaaattgagcaatgcgggacagcccataaagggtgctatttatggcccagaaggcccaccaaacatgggccaggcacaacgtggaacaaacaggacggcccatgagggcactaataaggcccatccgatcaagcggcccgcccatccactccgtctccacccaacggcggaggcgacgacccgatattccgatccgccggcgccggcgccgccagtcgccgactttatcggccgtgcggctcactccactccgggcgccgccgccgctgatcgccggcttcatcaaggattcctcctctcctattgggaagcttcgggctcctctttttttcctgtgagtagcaagggctcagcgcgtttattatccactccgtttattacaattccagttgcttttttttattattattatttcctcttcttctcaaccacgtctcctcctctccgacgcagcaaggaggagatcccctgcggcggcgccgtcgagccggtgggggaagggagagcttgaggcggaggcggaggcagagcgtgagctccgaaccaccaccatggggacctctgcgcaggagccaaatctctggaagcaaatcgacgacgccgagcagtaagatcaaatcctcccccacatggttcgtagtcgcattagcctaggtcttaaagtagttcatcttggttgcttgtttagtcaggtaattgaatcgcgagttcgcgactgcctcgctgaattatgtagtataagacggtagcgaattgagctaggttttcagttcgcgtagcgcaaaagggcagggaatttagccggatttgtagacatgcttgccaggatgaatgccatgtaaaatacactgttcttattctggaatctggatgactttaggagcagtcaaccatatactgtataattgtgctttacaatttacgcaagcatgtaaagttaccaaatggtgaataaaaggttttaaacttgtttacttagagttgacatcctgataggctcagctatctggtcagcggattgttcgagc

SEQ ID NO: 62700 - DNA, 1099 bp, Oryza sativa
cattcggctgccatggagaattcatgcgaccatgatgagcttctggaaatgcttgaattagctgggatggtacttgttcaggcgcttaaagaacttaagaggtaaatccattacctttcctcattttattgcttttatgctctgaccaaatctaaggttcttatacattctgtaattagagagaatgctgcctggtaaagcaaatttaagttttccattgcttctctatgataatacaagtataagttattttttatgggcttctgattttgcccaagaaaaaatatcttcacgagtaactgtatataatcataatatctgtcttgtttcctggtgaaacttccttaataccctgataaaaggttaaatgaaatgtactgcgtactaattgttagctgatgtcccattaatacgtaattcatccaggtgccttaaacccttacctaacttagcttgcctttgaaatgataaaattgaaaaacaatagatgtacacatgcaaaaagaatgatcccatactttctaatgtctggttcaggtttgctctggatttatatggatggatattgaaaaaatgtgtttttgtactaaacatgcaaacaatccttaatacttgttgttattatcttctttatccactgtgtagaatgtttccatagtttctgaagtctggtttatattctggtgtgtgtaacacattatgctaactgttccaggacatctgagatgtttatccagctcaagacaatctacggttcagtggcatcaataccattgaaaattttcattacagggtacttgttacagttacacagaggccccatgtgttgttggtttttcatggagtgttttcatgcttccccttctttgtatcaattactggtatttttcttctcgtagggctacgatgcacatggcaggaggatctggatctgatcttagaccaatcttcgatgaataccttgctaaatggagatatactgatgatcaagtttatgttttagatgaaggaaagaacagctcctcaaatgggttggttgttacatcggttatgtcacctgaacaatattttgaggtggcagagttgtacacggtaacat

SEQ ID NO: 62701 - DNA, 14552 bp, Oryza sativa
ttggcgccttgtagtaatagatacaacttaggagtttcagatttctatattgttttttttctgaacttctattgctgctctgccccttaagttttgctcctgaggtagagatgcactgtcaattcttttgcattattaagttgtttattatattttcctctacaggacctattgagaaaacttcatgcgttacaatctgcagctaataagaagtccaccaatcagggtgcaaaactatcagaatcagcagaaagaaacctttccacttctcagaatggctcaatatcaccagcacatgaggatgctactaaaagctcagcacctacgcacaatgggaatatacagggacttagaaaggctttgccgaaatccattcaaccttcttttcaacgcgtcacaaatcaatttgatccattgttctggtggtttcattcatttcgcataaaatttggaaaggtgcatgtggttctaccaagtggtaaagtgatgtttctattttcactgctgttctcgacattatacatccttaggaggaaaggtgctgcgttgaagaggtatggatgtctcacacttgcaatcgacattttcaatcgtaatgtttttgtgcctctatgacccaaaagactcattgggagtgaatgtgctttgagcaggactgcattccaacaaatttcatctctgcgacggggcttccttgatgccctgcaactcgccttctccacccagataaatccactcgcagctgttcaacaggtgccacaagccccgcgtgctagctggtgatgtagtgtaattattttacatatttatgccgacatcagacttgagatatgagtgtatgacaaatgtgatacctgattttgtgccattgaaaatgtaaggcaatggtaagagagctgcttaatacttccttgtaaggatccagattgagactaatatatatgtttttttatgacttctggtacctcctcttggcctcttctatgttgtcctagatgttaggctgacgggctcaatttggactaaaaaaccaagcaaaaacagttcaaacttgttgttcagtgattctgtttgcatttatagagtgagaagcggtttgcaataagtgacatattcatggctgcaagcgatatgtttatgtgtaagcctggagcatatggtggatgatttgccatggtaataatatgaagtgtgtcaagccacaaactatactgccttcctaacataggtgtagtaaaccaacagatatattttaaatattatactattttgtaacacattttgtaacacgaagtggctgtagtttagtggtgagaattccacgttgtggccgtggagacctgggctcgaatcccagcagccacactatttttttaattttttcttaacactttttattttttatttttacctttcagtcattaacactttttaatttttttcttcagtcattagccaactaataaagccttgatttgattcattagccaccctttgattcataaactttttgaaaaatatattttgccttgattggattcaatcattaacactttttaattttttttcagtcgttagccaactaataaagccttgatttgattcattagccaccctttgattcataaactttttgaaaaatatattttgccttgattggattcataaactatttgtcattaaccacgctaataaatccttgatttattttcagtcattagcattctttcttgatctttttcttcaggcatcagccacactaataagttttcagtcattagtcatgattatggtaaatatcgatcgaatgatttttacgtgttcgcttgacagatctagctttgtatgctatcgcctcctggttgagctgccccgtgacagtttacttgagcatcttcgtgctggcttctattgaaagaatggctgaaagaatgctaatgaaagaaggtggccatcttctagggcttgcttacctgagcatcttcatgccggcttcgactcacttgtcctttggtctcttggcaactgtggaagaaacgcaactgtaggggcttcgactcacttgtcctttggtctcttggcaactgtggaagaaacgcaactgcagggtttacgactccgcgctctcttcggtcttagtggttctaaagtccatcatcttagagagtcatatgtgatcgttagctggcattgctacttttggggattcctcgggagtgtagtgtggctttgctctctcccgccgatcggatttgtgtttagccatcctagtagtttctttcttcttccttggtttttgtctttttttctctcttcgcctggcataagccggtctgactgattgcgttgtgtaacaaaaactcttttcttttaggtaatatattgacgtgcaatttttttcgcgtttgtgactcttttcttctaatatattaacgtgcaattttttttgcgtgtttggaaaaaaagttcgaatgattttgttgacgcagtggcctcattaaaattcgttctttgctatgcctaaaccgtgcgtcatgcatagatagatcatatataaagaccctataataatattacgtaatcaatgatgaaattaattaattcccaaacatgtacatctatacatataaccggccggcggtggcggtggcggcggcggcggcggctgccggccgtgcagcggcggcagcagcaccggcgtggtggtggtggtcggcgaggacggcctcgaggacgtgcacgaccctgcccatggtgggcctgaccttggggttctggctgaggcagtcgtaggcgaggcgcgccacccgctcgacggcggcgtcgacgccgccgccgtagtccgccgccggcgccggcagcgccatccggcggtcgacgatcctctccagcttcttgggccggatgaggatggggcgggcccagtcgacgaggttgcacttgctgcagccggcggccggcggctcgagcgcgcggcggccgacgagcatctcgagcaggacgacgccgaagccgtagacgtcgctcatcgcggtgaggtggcccgtggcgacgtactccggcgccgcgtagccgtacgtccccatcaccctcgtcgacacgtgcgtcttccctccccgcggcccctccttcgccagcccgaaatccgacagcttcgccttcatatcctattacacccccaaattattaagctaaattaacatttgaaaattcagattgttctctcaatttatagaaatactaaaaaaaggtattaccgttttaacggaatagttgacatcaacctagtaactatatctataaggtattcatatacggtaccgatatcaaatctggtacttacgaagatacctatacctacaaactacaataccctactgatgtcagcatgcataaaactattccatccatttcagattatacatcattttgacttttcaaactattttaaattgatcaagtttgtagaaaaaaaatattttcaacccaaaataaatatattatgaaaatatatttaattatagatttaatgaaactaatttggtgttataaatattattaaatttgtctataaatttagccaaacttaaagtactttgactttaactaaaatcaaaataacttataatttcaaacggatgaaatattttgttgcaatggtatagcgttatgtagtaaccctcatgaatttgtatttgagtaagataactactaactgtgtcaagcaaaatgttggaggtcttgaagtcgcggtagatgatcggccggtcgccgccgtggaggaaggcgaggcccctcgccacgtccaaggcgatcttcatccgggtcgtccatgagaggttgcatgaacctggccgggatcgttaaccagtttcaacctttgcattgcatgcatatgctcttgatcatagtgatcattagcaacatccttagcaaaataaattaatggcgagaaattaatttaagctcacgtcggaagaggtggttctcgaggctgccattggccatgtactcgtagaccagcagccggtgatcgtcctcgcagcagtagccgatgagctccaccagattcggatggttgtactgccccaggtagctcacttccgtcttcatttgattaatttcaattttatttgattaaattagtgcaacattatagcaagtacaataaacacatatcaagaaaaaaaggaagaaaacgggctacagattgtagccagttccaacacagactccattatattttatgtgtatgagagatatgaccgattaataatggtgtagtatatttataattattgcatgaatggactattaaaatagctataaatgattagcagcttgcatgagcacaagaatggcgagatgatgatgtgtgcacactgaccagccattccctgtcgccctggtggcctaaggggttgagctgcttgacggcgacgacggcgccatggatgaggcccttgtagacgacgccgaagccgccctcgccgacgatctgttcggggctgaagtcggcggtggcggccctgagctggtcgtaggtgaacagctcgaggttggtcccgtacgccggcatggtccggaactcctccacgtccttgggcacggccagcatcaccgccgccgtctccgacaccgtcttcctcagcctcggcggcggcgacggcgacggcggcgccgacttgggcgcaatcgcatcgcctgcattcacatacacacatggcaataatcaaacaaacgacccgaggcacctataaatcgggcgctcgatctttttttaaaaaaacggacggtgtttcactaagcggatcgaaattgtttcattaagtagatcggaaatgtttcgatcgtttaaaatgctgaaacataaccaaatcatctcatgagacattttgctacaacgtatgaaacagcggtttttaaagctgtttcactatatataaaaacaatgtttcagcaaatagtgaaatgatgtttcaattcactgcaacatttgatctatacatagtgaaacaacatgagtatacttgctgaaacattgttggtagaaaaaaaaatgaaacagatccccttaataaaccgtttctgtaatatatgggtgatttgttgcaacggcacgtgtgatggggacggcgcggaagcgcgggcatccgatgcatgcggtccgatttgaagaattttcgcaaaccaccgattcagatcatcggaatgcatgcgtggcgtacctcctcggcggcgggatgagcgcgccgccgccgcacgtatgtctccgcagctggcaatgaaccaccggtgcatcttgaagatgaggaaagccagcacgccggccggttgattagtttctcacacgcacgtagttaatcaatggaggtcgttggatatagcaagaatgtgatggcggtgtccctcctcaccggcgggtgcggtggtgggggcggccaatgaatggcaacctccgaccaccacacgccgggagggaaagggaaggggggagaggaggaggagagaagcggtgggcaaaagcgcgcgatggcaaaacacaagtcatggaggggatggaggttgagatggtgtcaagagagggaggcgacgggaggaatggtcggagttggcgtggttggctcacctcgccccgcgttgctagccgcgcgcgcgcatgcatgcagccacccacacttgccatcgtcagttttttcaggccgttcgatcgcaagcagagacagacagctaggcagaaaatgcttcaatccagtcgtccgatctcttgaaaaaaaatcgaacctcttgctatgactttgctgcatgcagcctttttgtcagatcctctctttatatacatgttatatatgcttccttactgagcagtatgcatgaaggagagatgacacgagatatttgcatgtacataatacccttttagcaaacttgaaaatgatttttcttttagattactgtcttcaacgcaatcattgccgccatgtcatcgtcgtaggataccacctccgttgagctgtcgtagcttatctcgccaaaagtctacaacgctacgccgtcatcacattgcacacaaaccatcatgctgccccaccatcattgctgcagaatctcaactccaccgagccaccgaagcatatatcaccagaaaatcgccgctgacatgtccgggcagcgaaggcagttggacgtactagttccgtaccttgtttttgctcatggcggactgaggagctcgcattggtagcgagagggcgtggaggaggaagggcgaattagttccgcatctccaaaatttgcaacaactaggaaaaacttgaagctagtcatatagtctttttcatttcggttatttgtttttctttgcatcttagttttgagatgttgagtgtatgcactcgtataattttgattgtgtatatccaattatggatatagatgccggatttctatccattgtctaaaaaaaatgtcaagttctgatacaatggcaagttctgaatggtaagacagccagggaaatttatttttcaggttattctcgagtctttgacttcaccacatgttatttttcaggtttacgatggtgcagggttgaccccatcggtttatagttgcagcctcgcagtgaaactcaattacgacactatctacagtccagggggccatttacggcctcaggggattgcaattgtaaacaagattccagagaagtttcagggaggtatttccagttgtggggatcatttacaatcccaagctcatcgctatatatccaaaatagtttgtgaacgttgagttgtggggagtaactaacaagcatcattctgaaaaaccatatatatcaaccaggatttaaacttgaatataaaacttggggcaaccgtagtagattaccaattggtcaccattgccaatttttttttaagaaaaaacactcaccattaacaccatgtttgtgaaaacatacagccttattgaaacagcagtaaacgagggcgggcagggatctcaccatatatggacgtagttcactgatgactaaatttattttgaaagtagttcactcaactctgatttatgaaacggtaaatattcagaacttgcacagcaaatatatctgacggccacaccgaactgatgaagctgtgactagaagctggccggaaattacagcactgaaacagaagcctggtatggcgtacacacaagaagtaaaaaagtttggttagtgacgctgagggtgatgatgaatacttgaaacattttgcaatggaggatagaggtggcacctgcctgtggtgagtgaagcgaacggatcggcgattatggcttagcttcccccttgcacgacagctctggttgacgagtggaagtggtgctggaactctggaaaatgcacgagcttcttggttgctggcttcatgccgtcatagaatccttgaggcatttgagccaaatgcacctcccggaggaagtttagttcatcaagcttcggcggcgggctgctgagtcttgcacatttagcaaaaacaagcacctcgaggtttgccatgttcttggtgccaaacgtgcactcattgagctttcccatcgcgatgatggacagcttcttcagtttgtggtagccattggtacaagtcaacttctccccttcgtagacgttgtataacgagaggaggagaagctgctgaaggccttgcagaagctgtagtggatctttaccttctactggcagtttgctgtcccagaggtagaggtatgttatggattgaagctttggttgtagacggtcaaatttctgcatacgacccccaagcttcagcttacggagattcttgttgacatttagataactcaaattgaaccccctcttctcaccagcagcacatgttatagtgagcgattgtaggaggtccatcttgttgattgcatcagagatgcctttgctgcatgagattgatgccttcttaactgatagcttcctaaggagcttgaggtatagcagttcttgctcgaaaggtaccatgcctgccttttttcgttcagaaggcacctcgtgtgttgcacctgacagcgtctgcagatgaagcagcgacagcaggccttccttgatgagcacggactggtcgcggaaggagtttgcaagatagagatgcctcatctctttaaattcagacacatcgttcacctctgtgatgccagtgtccctgatatcgaggcacatcaagcggcggaggctctgcagagtttcagggagatattccagctgtgttcctcgcaggcctaggtagcgcaggcaaacgaggcaggtgatactggagtgcaagcgggtgagccgagttccctgaagatccaacgtgcgtagaagcttgtacgtccgaccaaatgacagctcaagcttgggaggctccttcctctcggttctgaaatacagcagggagcgcagccgaatgtctttactcatcgcactagacatttcttggacagcttcattgccgtctccatctccatgcacagcgagtacacggtagcggtgcaacagtgctgtctttctgctgaacaagctcgagctgggtctggttcggggtgccgggtgagcggggtcccgtgcaaatctgcagattttctgtgcctcacacatttccagagccagggatcgcatgtgctcgttgaccttgcatttcagcacctcgccatccaagcctgttttcttcaccacgagcagtttgtagtcaatgagtctttgtagcaggttctctgcctcttgctcttggctctgaagtgggctgtcgttcggtgggaagccttctgccgtccagaggcgcacaagcttccgtgcagggatcaatgaattctcagggatttctgatctctctggaaaagccaggcagtacaagaagccgagccggatgtcagcgggcagttgggcatactctgctggtatgagtggatcacgcttcttatctcctattaccaaatcatcaacttggttttcctcgatttccttccatttatcgacgcgattagcaccaagcaacgctcccacggcccgtatgttccacgggttgcctctgcatttcctcaagatgcctttcagagtctccaccattggcgtcaagtcatctccatcgatgttatctgtctctgtcttccccttgagagccttttccagttgatcgtattctcctcctccttgctgcccatcattgtttctatcgacggccacaggagcaggggtgtcatcagcattgcgaaaagctacatgcaccagtagctgctgttggtaagccagttcaagagggcgaatctcaaccttggcatgcaactcttcgtactgtatacgtgtgttcctggtcaggcacacaatcttcccctcccatcctcctaggacatgtcgtaaaacatgcagcgaagatgtatcgtcgacatcatccatcaccatcaagtagcgattgcccacagtccgaaaggtacgctggatctcttcaattatcttcaattcatcaatggcatcgggatacatggagtttgtctcacgctcttcgtgtttcagcacagcccgcagcaagtcactcaaacatctagtttttgacatgtcgaccttggaacgtattttgaaatgattcctgacatcgatgtctttatacacctggttcatgagagtagtcttccctgagagctgctctccactgacaaagatcactggagcagcatctcgcaacaatatattcttcaattcttcaattttttccataaatccaattggtactgtatcttgttcttcacaatgagaatgtggggtgaaaggaaggattgcaggaagccgctccatcacttcttgatgataattttgcacctcagtcggcatctcgttttttcggtctctgatgattttcacaagtttgtcagttgacaacatcccaatagccgacttcatcgcatataaatgtcccacataaacaccacgcattgcgtacatggcgatctgatcttccaagcaagaggcggccttcagggcatcactgatccaggtgtgcaagcgcgacgtttgccaactctgggcattgatccttccagttccagccaagaaaaatgaagccttgttgatgcaattctgtagttcctgtagatcttgtttagccaaggtaatcttgtgtcctcctcctgatctgatgaccctaatatcttcctttagcaaaaggtaccaggacagttctacgagtttgggtaataaggtagaagacggcagcaatgcggcctccatggagcccaaacgaatgtatgccactccctggactattgaaaaaaaaaagagaggcaaagttaaattcccagcatgaaatataattcattttcttttgttgctcctaaatatttcacgtttttgttgtcaccacacatgtaatgaaacaattatcttgaaggggaaaaaatgactataagcaaatctggaaatacagaaaataagtcctgaaaagcaccctagacacatagtttcatatgtgtgtgctgtaattttattagtgacattactatgaaatgatcataattctgttaaacagattttcttatatgcataaaacctgtcaagtatcgctacagctcacctacattgtttacacagacaaagtaagggacacaaagtaggcatatatgttcaacatggaaaagtagttttgtttttctaagcacctgaatttatgtccacaggttagggatgcatttgtgcagagctagtgtaattccctttattgattgtttaattatataaatgcatatagaggaatttcctattaagccattggaagttgaattcttgtatgccactgatgatcatgtgtcatgtgaacttggacccaccatgcatagagactaaaatttggtggcatatatcctttataaattactagctgaatgcccttgcattgcaacaggacattgaaagtaactatcatatattataaatcccaaaaagcgaaaagtcaatccaacggaaagctccaataactccttttctttttttttaaagatcaataccaagttagctacggtttaatttactaatttcagacattggcgagattggttagctgatatcaacactaacaagtgtgattagtaaagtgtgactcaatcattttctttgaaaggaaaacagtagctcttctatgcattaaggatagaaaaaaagtttgcaatattctccaaattaagtttcgctggttctttgaagtgtgattcaatcattcaatggggataccgattggagaaaattgaaggcaattgttttttttttggggggaattgaaggcaattgttgatggtctacgacagtgtgaagcctcttgaaatcatgattggaaggccacacaaatagccgaaaccttaggcacaaaatactgatcttacagtgagagaagaaaagaatgagttcaccatcattttctgaaacaaagatcatagcaattcaaataagacagttttaatcttatctactgccacaaaaccatgctataagtcaagtagccaactaaagttagaaaaaatgttcgtctcaaagctggtagccaataaaagcaggacaccacagtggaagttcatttcaacgcatgtaacagaattaggtccacgaaataaaaaataaacacaccatatatcttctacagaaggtatataccgcaaaagaaataagaataaaaaccacacataggctagcgctaaagcacggccatacaaagagagtgaataaagaactacctgaaatcccccgttctacagttgagaaaatatacagggggaaaagcatagcaagcaacccattccagagaaggaattcatgacactaatctagtaatttactcaggatgacaggccacacgcatatttcgtctacctgactgatttgcatactgtgtaaatggcaaatatagtcgaaacaggaacacagctacccttctatgcgagctaagaaaattagttaaatggggggcataacataaagcagcttgccgtatgcactgaattagtcacactgagcgtatttgatcgattcacattctcattagtcactatccgtaaatccctgcattcctctgaagcggacaaactctctcaagcagaaaaacttggcataaacgagttatgagtgaactagtgttgcctatgaggactcctggatggcgtcaaaatccaacaggctctgacgagcacccatgaaaccctctgattgaacccccccccccccaacccctaaaatcctcacatagatcctacttgccgccacgaaatgcttaatccgtcgcaggtcggcgccgagcttgatggtcgggttggtcatctggggaactcggagtcaatggtgatgcaagtgaaaaatcgaaatccacagggggatagaaagttggaaggtcggggtaaggtagaagctggggggcgcgtaccatgtggttgtcgacgaaggcggacggcggcggtttacttgactccattgctcgccggcggcggcgggcatgccggcgtgatggaggctacttcagcgaatgacagttttgcccctgtctggggaacggggagtgtacagtggcaattccaattataccttttttaaaaaaatcaaaaaaaatatcttcttttttcccctccttcctctctccctcttctcttcctccttcctcatcgccacccttagggcgcttcatcattatcgtcaatatggcggggcggagttcgacggacaaccgacgactctagatctagagggcggccgacgagtgcacactcaagccggcagccatcgcttgcaagctaaggtgatcattgtgcagtgcagtgcacgccccattacagttcaatctcactacctcactggcgtccaggggcgtcaacgtgcatggagacgaccaacaagaagaagatcgatgtcgtcttcaattgccttaaatcgagtaggcaccaagcacactgggcggcatgatcgtgtcggaggataagaagctggagaggatgtgctcgtggccgtggaggtaagctactcggcaactgcttaaccatcgatgccaccatctcctccatcttcgatggttttgcgtgcggtggtggcaaggaggagcttgagctccacagtgattggaggagtacatcctgacaaagcaatgaatcgcaagatcgatctaggatcactacgacgctgtggtgcatgggatacggtatagcgattgaagtgtggaattaatctcgtcaatccctttttcttgtggattggattaattgaacaagctactccatataacggaacgtgatcctcgtgaattcttctatgaggggatgagaaaaacgttaaccctgttagcttaaatggcatgggaacagaaaggcatttccatggaggataatcccatatttccgttaattgcagtctacttcatcccatgatcccatctcaaactaaacgcatggatgagatctaatcctaaaacgtttcagttccatcctacttgttgcagcaactaaaactaccttactactacttccgcttcaccgaggtattgacttttctttctttcttttttttcaaaatcaaattatttaagtttgtgtaactttataggtaaacatagtattattttcaaaagaacaaatgttggattcaatcatactaattttatattagaaatattactactatttttataaatttgattatacttaaataagtttaactttaaaaaaaaagttatgtgaaaacgagaaaatagtacttacaaactatttgctataatatttactttgaggatggagcgactctcgtagcgtaattttaaggagcggagcgatagctccactaaggatattgaaattgtttaattcacgagtcacaacacactatagtaggcctcttcttgtcaaagctgcttgcctttggtgagctcggcaacgatgacttttgtgaggtctcaatagttgctttcttttccttttctatataggtttttgccggtttcccgtttaattaaccgtgcttgttcggtttttgggcccgatttcccttattaactgggccaattcttttcttctataaatttcggcatgagaaactcctactatctgttccttaaagaaaacaagagtgaataagttgtcctagtataaaacaatttctgtgcagagaacaagaaacattgaatgttgctgcctctctctgctcccgttcacacgagaaatgcttaatctctctcctctttcaactagtaaaccttattaagggatgtacttgatgagggtatttctgacttttattactaattttgaattgggaatctagggatcgtgttttataggggcagagggagtatggcattgagggcttgtttagatgccggttaaaattttcgccctattacatcgaatgtttggacacatgtatggattattaaatataaataaaaaaatacctaattacacagattgcgtgtaaattgcaagacaaatcttaagcctaattgctccatgatttgacaatgtggtgttacagtaaatatttgctaatgacggat

SEQ ID NO: 62702 - DNA, 10093 bp, Oryza sativa
gtaaacattctctaattatatattaattaggcttaacaaatttgtctcgcaaaatagctttcatttatataactagcatgatggcccgcgcagattacgcggctagcatcattatattttctctcaaataatagcatatatattttctcattatattattcaaatatattaaaatgacaatataattttaaattttgcaataactttacaaaactactaatgtgtaatatttatattgtattttatatacgtgttagttattaattatttttaatatcaaattttagttatttgtaaattatatatattcctatatggactctagactcgtcttttaatatttctattttttaattccgaattttttgtaaattgtatttttatatagactctatgctcttctttcaatattatttatatttatttctgaatttttattatttctaattgtatttctatgtggactctaaactcatctttcaatattctttaattttaaattttgaatttcagttacttctaaattgtattcctatattgactttaaactcttcttcccacgtttttcttaatttctaattttatttatttataaattgtatttttatacggactctaaactctacttttaattttattatgtttattccaaattttagttagttttaaattcctatatggactctatactctacttctaatattccttattttttaattccaaatttctattttattttcttaattgtatttctatatagactctatcctctacttctaatattccttatttttaattacgaatttaagttatttcataattgtatttctacgactctatactctacttctaatattccttatttttaatttcgaatttcagttatttcctaattgtatttctacgtggactctattctctaattctaatattccttatttttaattccgaatttcagttatttcctaattgtatttctatatggactctagtctcctcttcaaatatttcttattttttaattccgaatttcagttatttcttaattgtatttctatatggactctagtctcctcttcaaatattccttattttttaattccgaatttcaactatttctaaattgtatttctatatggactctagtctcctcttctaatatttcttattttctaattccgaatttcagctatttctaaattgtatttctatatggactctgctttttctttttcttcgattaatgtgagaatttctaggccatgagagcgaacgtggagactccttttttctattcctttaataatataatagattagttttgtaagtagtctatatttaatactctaaattagtgtttaaacacagagactaaagttaagtccctggatccaaacactaccttagtcgaggaacagcttgccactggataaagaaaaagacccaaactcgtcaacttcaacaaacactgtaccatcagacatgtgacaggtcagcaataatcatctcaaaacaagggacaagcagtaaacaagtgtgacaacatgtgacacacggacacacggtatacaatgcattgcttcttttctttatagcaattgtggtcatcaagcatgtgtttcaccatacttcgttaagagtaattaatggtgttaaaatttagggacaattgcttatttatcctattttaaagtccaactatcaatttaaccttgtttttcagatttacttatttaacacgttaaaacttttcacctattagatctaaacacagcctgaataaaattttcggtctctgcccttgttaggtgaactcattttaaccccgacaaatctagcaaatgtcaaaaatgccccctcgtcttcttcccccgacccgaattctctcctcactgattatctcctccttctccactggccagccagcatctgctagcttcggctctgctccagttctgccctaatctgcttaacgccactcctctactcctcgaccctgctcgccatcacagcatcactgccaggttgcataggaaagccaaacgcggatctgcactgcaagctaagctaggagctcacacccatctaaattaaagatggagcaagctagctagctcgtcattactaatcgtttcatattttctttcaaaaaaaactaatcgtttcatattgcacatctggtctggagaagacgattgagctagctagctgttgagtattactaatcgttgcatattttacttcagcggatgttacttaagcgagagtaaatcaatagctagctagctcaatcatttcttcaaaccagatgtgtaatatgaaacgactagttttttttggaagaaaatatgaaacgattagtaagattggcctcgtacctgatcgttagtcgataaatggctagctctgtttttagctccaaccgaggtcaaactttcagacttggagtgtcaatttgtcgattgacgtttcatgcatgcgaagatcaaaaagaacagaaaatgcaactaattaaccaaccagttgtttgagcatcgggaacgcacctgcttacttgttattcgccgctgttgcaggcatcaaccggcacgagccaaggaggaatggcgtttctccctagcttctactggagtacatagccttcgtaatggagtagtcctaccttattagatagagctatgtatcttctgtacgtagcatcaaagttaacacggacgtctccccacaccctccacggcagttgacttcgaataaagagtaggcacatgcatgttgccgatccatagtttgtactactacatctgatttcaaataattaattaattaattatatgattgagtaaattttacaaaaccacacatatttaaatatgtatatcacaaaactacatggttagtatcaaatttatcatacaactacatatttaaagtatcgtaccacaaaactataaatttagtgatgaatatatcaaagaaccgtatattttagagtttatatccataacatattaagattacaaaagttatagttttgtgataaaaccgatgttaaatctgtaattttttatacgataccttgaatctcttaagaggtccgtttgcaaaaataaattttcgcaggccgttgccaacaatctcaccccacagttgtcattttcacaggcggccatttagctccaagagacctacccgcttgaaaaaaagaatgacagtgtttggaaaaaaaaatatttttctagtagtgcatcctctctctatgcttgggcactcccacgagcccttgtcttatattgttgtctagtaagttatttgccataacaccactagttattaacaatatattatgtgagagatgaaagtactgtaatactgaggataataataagtgaaatttccggaagatttcggtcctatcagaccccccccccctcccccgggcatgatattattttgaccaaaattttaaattttgttgtgaattttgctcagatataatcaatttttgttcaaaatttcactatatctacaccctctaatacaaacgccgaaaacaaaagattgaacagtggtgctatgtgtgctccttgggtaccaaacgcaaatcattttagcattctcaagtcttaaataaatgtcaatttattttataacttccaggcacttgtctctcttttctttcatgtatgttcttgtcaaagtgcattgataacccttgtcacgaatacatgagtcatcctttttcaacactcatttatttaaaaggaaacatcaacgttgttttttgctctaatttatttttcatacataagcccaaattatttaaagtcatatatactctagtatcccaaaatataagaactgtcggcgtgtttaaaatttatctcaaaatataaaatatacctcatttatttttgggacgaagagaccacattaattttagacaaatcatatgacatacatacttcttctaaaagactctagtggcggttctagtggcgatggtgagtctgtctctgtcacaaccaccctgttatgtggggggtcattacatcagtacggacatacataagtggcctacttactctatatgtaatatgtgtaagactccacttttttttaccctgattaaagtgaaaaactcagaaacattttggttttacttttgattttaaattggttatattgcataatttattgttagaaagtatttcacggtcacatgaaaaatgcatttaaggaattaagggttaatgtcttactttgggaactacaattctaacttcctcagtgtgtttcttttctttttataagatggaaaatttttgtttcaatcaagtagaagcaaacatttttttttcaaaaagcggcctcttgaaaaaaaattaactcatgtatttggctcctttttaagaagttgcaaactatagttggtcgtccaaacaaatgttggtggggtgaagtactactactctccattagagcaggttcaaagttcaatagtgtcgtcggccgtcggctgcctccatctatctttgcagctagcactggaaccaacctatacaatagactagctgttatgttgatcacatatcactaatcaaataattaattctatacacacttgtatcaatataccggatccaaactgaactcaattcttgtggccacttgaaccagtcgaatgagaaagcggaagaggaaaaccacaaactaacataagatccaacgggcttttcatgggacccacaaagtgtgtttttaattgctaacaacggcagcatgcatcgtaagacgtgctaccgcccgacgatagatcaatcgcctgcttgcttctctttccttacttctctctaagggcaagtacaataacttgaaattatcggctaatagtaagcttacgttggattttatacctatgtggcggagagagagtaccaagagagaaaaacatcgtcgattaatctgtcgacgatcatgcacgggcaccaatgcacctagcgctggcttggagccttcctatcgacagcaccatcgacggaacaagaaattagcatgaataatcttccctgattggcttggagggaagagaaaagctgggaaggagtgagagagaagtaattaaataattattgatatgtgtgctgcaataaatgtgaggagacaactattatatttattataataaagattagagtaagctgtacatgctcttagtcaagggacagcttgtcattggataaagaaaaagacccaaactcgggtatttgttgaagtcatgagacatgtgacagctcaccaataatcatctcaaaacaagggacaagcaataaaacaagtgtgacaaactgacaatatgcatgtgacacacggacacacggtatacaatgcattgcttcttttctttaatgtcctcaagcatgtgcatcaccatatttcgttaagagtagttaatggtgttaaaatttaaatatgtcgttacatatttaccctcaatcttttttaaggctttcgattctacctatatatgttttgacatgaattttgcccctgttaaaacatcaattttactcattccatttagtaaataaggacaagcataagcttgacatgaattttaacactaataaatactccttccgtttctaaatattcgataacgttaactttttaccatatatttgattgttcgtcttattcaaaaacttttgtgaaatatataaaactatatgtatacatataattatatttaacaatgaatcaaataatagaaaaattaataattacttaaattttttgaataagatgaaccgtcaaacatatttaaaaaagtcaacggcatcaaatatttagaaacggagggagtactcttaacaaaaatgagaataattataagcttcagttaaagaattaaggggaaaattataattgagtttgaaaacagggtaagaacgcagatgcacccttttatagagatagtagcaacgatccctaatttgtacccttctgaatctccaaatattaaccacagcataaactatcaacccacatcaatgcaactgggactgcagcacaaataggcccatcacccagccaccctcctcacgccgtgcaaccacacgatagaatcgctcgccttagacacatcgcgcgcaagtgcaccactaacacgcgagagcccatcacgcacggcgacaccaccctgcacgcacaaaccccatacccatacggcgaagaacgaacttgctactccaaggatatgaatacgagccggctatgttctttaccacatcacagagtgcattcttctatctgattgtgctaatttatgtgccaccttatttgtatcctctgctgaattgacatagtcttacctccggtcacaaacatattaagtgaattgatactactcccttcgtaccaaaatatactagcaacgtgtcctcattcaaattcttagtactagctggtatctaatttactactccctccatccaaaaaaaaaaacaatcctgggtttaaatctgaacacggtttgaatctggacacacattatatccagattcaaacctaggattgggttttttttggacgaagggagtacagagtaatactactagggctgtgtttagttggatccaaagtttgtattttggttgagattagagatgatgtgactgaaaaattatgtgtgtatgacagattgatgtgatggaaaaggactgaagtttggatccaaactttagatcaaaacacagcctagtactagtacaacagaatgagtatatcacatgaattagttggagtgagtatgtcacatgaattaattgcattgatagcaccgcacaattagattcttaaccaattcattcatatgggcacgttgatccacccattccacagcaagccctggtccctctctgcatcccatcaaccaattctgggtgttccatccagttggaatttgttcacggtgatcactgagaaggtgaaattaaacaggggacatattctaatactatgaatctggacatatatctatccagattaattgtatagaacgtgtcacatctaatcctagattcgtttttttcgggacgaagggagtacaaaacaagccattagtgttggttccccaaccgacacacatgtgttctccccgagaaaaaggacgggttgataaattgacaaggttcatcgagctgatgctttgagttatcctcaatatttatatccatggcaccgaatccccacccacatttacacaccagggaataaaaacacaataatttccatatccacaaatcaaagataagaacaaccacatcacagataagaacatactatttacattcactaggtgaaaccccgcgcattgccgctggaatttagtataataacaataaaaaataacgtgtaagatagctagataatatcagattaagtaaattaatgtggtttatgataatttaaatttaaatagtatgtagaatgatgattcaaacgtaaaaagtaaggtggtatgactttatagaagaagaaaagtaggcagatagtttggaccgtagattaatcatctaaatgctaaaaacaattgatgtgatatgacttaattagaggaaaaaaagagaaagataatttggaccatagattaatcatttaagcactaactaagtgaggatgaactatataagtatataggatatcataaaacataataggatatacattgaaatattatgtgaattatgttggatgataatttaacatgttgtatttgaaaagctcttaaattataaaaactataaagatatatcatgtttgcatgatgtttaaatgtgatgattgttagtggataatgatgtggcatcttgttaattagtggatgatgatgtggcatctttgcatgttaagcttaaggagttagtgggggataactttatagtaagataggattcaattattcaacaaacaccatcgataacaccaaaaccacatcatgcatcaaaaaaacctttgctatattacacattcaacagaaaaaaaatataacaaaaccggactcacattacactatgggattacttttctctgcttaagggtgataaacagtaattagcatggtgttagaaacttttatcggcgtcattagaacctggtaaatatatagtagctccgcccctgatatcgagataccatttataatacctacttcctctcgtcccaaaatactccctccatttcacaatataagtcattctagcatatcctatattcatattaatattaatgaatctagatatatatatttatataaattcattaacatcaaatgaatgtgagaaatgttagaatgacttacattgtgaaatggaggaagtataagaacttaggactggatgagacgtttactagtataatgtatctagacagacttcctatcaagatatattgtactagaaaatatctcatctaatcttagattcttatattttaggatggaggtagtagcatgatataagatataccagcttagatgatactcccaccgtccttgaatattcgacgccgttgacttttttaaacatgtttgaccgttcgtcttaattaaaaaattttgggaatattattcaaaaacttgagtagtagtagtatatttaaccatgaatcaaatggtaggaaaagaattaataattacttaaattttttgaataaaacgaacagtcaaacatgtttaaaaaaatcaacggcatcaaatgtccctaaatataagggattttagttgaatgtgatgtattctagtacaacgaatcgtgggcatgaagtctatctagattatttgtactaggatatgtcacattcaaccaaaatccattataattagggacggatggagtatacaatagcggccccattcgtttttcccggctgtgttgagttcctgaaaaaagttgaaagtttgaagaaagttgggagtttgaaaaaaaaattgaaagtttatgtgtgtaggaaagtttttgatgtgatatgatgtgatggaaagttgagaataggggggaaactaaacacggcctcaagccctcaaccaaatgccttcctggcttcccgtgagcatccgcggtagctgctctgcttcttctccatgcccatggtcgactttcactgagagtggtgtgctacaaacagtaaacagttggtggcacacggccagccagtgtgagactgagagaaggagctgatcgagatctagtacgtacgtagcaatatggtaggaggaggtgggtacaggcagaagctgatccaggtatggaacgattggcaggtgagcgtgctggtgctgctcagcctcaccctgcaactcctcttcctgagcacggcgggcgcccggagacgggcgcagccgagctgggggaagaaaacctacttctgggctctctacatcggctccaggttcatcaccacctactccctcggcatcctctcccgcgcctccacgggcgacgccaacgccgacatccaggcgttctgggcgtccctcctcctgttccacctgggaggccccgacgacttcaccgccctgtccctcgaggacaacaagctctgggatcgccgctgcctggagctcttcatccaggtagggatgcaagcggggttttttttagactcacttatttacttctagtttatttttttaaaaaaatttacactatcatgtaggaaataggaaatgaactagtaagcgggtttttatatccctaagtgcaggtctcgaccacactctatgtcttctcccgctacgtgctcgaccccggattccgccgcttcatcgtgccgttcgccctcatcttctccgccggggtggtcaagtacgtggagcaggtcgtcgcgctgcaccacgcgacgatggaggcgctcatcaagtccgtcctgggaaagcccgacgctggcccggactacgctgacaccattaaccgattggacgggattatgagatccggcgcattgccgtccctcgacatcaagaacgaacgagttgaccgcccaaactctggtgagtacgtagtaactaatcaacctaattaatttgtttgcggc

SEQ ID NO: 62703 - DNA, 3526 bp, Oryza sativa
  unsure (1)..(3526): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaagagcagagtcccatgagagaggcggtggcaatgcgtgtcgcgatggctcccgcttccgcggcgtgacatgaggagttttctcatgtaatcgtccaaacgtgttgctcgcagccgcaatatctgctcgtcaaaaccatgtggtcgggaagacttttaaggctgactacgtttgttcacttttctaacttatctacttattatctattttgtttcttacgtatatatttttcaacctaacggtgtgtattttaaaaaaatttatatgattgttgctttaaaaatttatattaatatatttttttaaaaaaatacttaattagtcatctgctaataagttagtattctgttttgcatgtgtaagatgttagtttctaattaaccttaacaaagaaaacttagcctaacacctctcgagtgtattaagggctgtctttttttctttcttttaacgtgtacgttttctgaactattaaaattttttatataagttgttttaaaaaattatatacatttatttttagggtttttaataatatttaatttatcatacgttaattttatgtcatgttttacgtgcagagggataggtttcataacccataaaaagaacacgccgaggggaaggcaaacccatcaaaaagaacacggcattacttgttgaatgaataaacctacctgtgttgcgttgatgtattatttcggtactccgcgagacgagaacacgtgcattccgtatctgcagaattcgatctccagtatttacagaatggatcagtcagagctgggcaaccagaaataatccaacaaggatcaatagcagcattaaagctaatcactacaatccaatgctgattaagaaaactagtactccgtagtagactctagggggaccatccaaaccgtttcgaacttacatctggtgccttttcctcctcaatgcccacactattacgaaaagccattgcctaagtgtgatcaatggatgtcattagggccagatccaacctaacctcttcgatcaatggacgcgtgactataatactgtttgaactaattaatgggctttgtagtatgaacattgctcgtgaatttcaaggcacagcacacacccacctggaccccaagctaagacttcttcaaatcaaacacttgaactgaagcttcccttggttaaaaatgaaaaataaaaaccggcgcaagcagttcaagagcgccaatgcatatgatgtcacttgtaaatatcgaatggcagaaaaaaaaaagtcagaagtatttttcgcattcattgatccaattccatcattaattttaacctagtagtagtagtaggattaactgtacagagggacatgatgcatgatgtgttggagcttatcttgtcatgctgcattttcggtccatttaatacatgagacagtattacaggtagatcaatgggccaagttctttgcatggatgtatcattggatatttggatcatggcaatggcaatgtgtttttgcatttgaagtagccaagggaccacggaatgatccgaccagatcagcacacaaatcccagacagcatatatatatactgccctacgtacgctattacgcttgatcattcaggacaggacagggcttggcccatttgctagtacgtccccttttttcaacaccttttggccttgatcatttgctatgtcactgtcagtctaaaccctaaccatggccttgatgagctaaaactaaaaaagtgatttttgcattcgtcgtcgtcagcacaacatactattggtcgggattgagatccagtgcagttattactatcactacaactttagcagttgcaaggtagctaatggatcaaaaaccagcggctcagattatcagaaaatattgttcacgaatcactgtagcaatcttctactgtagcgattactgtagcgtatactgtgcagggggtggcagagcaaatccaagctgttggctgcatcgatccaacggttatagtatgttatcactactaaagttgcagtcgttattataactgcattggatctcaattctattgctcggctgctcgcttgctgggtcacagctaaaattttaactttgaaacttaatttaaaattaattttaagggtttctcaaatttaaaataactaaaacttaattaattatatgctaatgattttctcgttttacatgccatacttaatcttcactagattcaaaccggcactaatcaaatctacatgaatgttggagttcgcgagttttgcttccatcccttacggtagcccagtgatctttagccgcagcatagtttgttggttgcagaaaaaacaaagcagcaggaggagcaaagcaaacagagcaaaacataggcggcaaatagcgagagatcctccagaaaccggagagcaaaaatgctactacggctgtgtttagatgtgtttagatggtggaaaagttagaaagttagaagaaaattagtagtttggagaaaaagttatagtttatgtatgtagaaaagttttcgatatggcataaaatgatgttaagttgagaatttggggtaactaaacacggcctacaacacattccaacctatttagcgcccggccgatgattaaattcgccgtacatagacatagtaatgtcgtcgtcggccggcgtgtcggtctaacactccgaccatgcacgagtgcttcccttcacttgggttttcctttcctttctcaccacaaaaaattgccgtccttgcatcgcagctgtagtagatgggggagacacagggcccgtgtggtaggtgacgagaaattaacgaggtgtttggaattggacatcgtcacgttgcgaatctgcgttgctgtagcctgtagctagcgtaatggtgttggttttgtgaacccatttggatgtacatgccgagtttatcttattttctattaaaaaaaaggctagtgtacgtacctgtacatggttttttttttagaagaaaccaatttaatttgcctttgataaagcatgagaaaatagagcgtaaaagaaaagttacttacaggaggatttgagtctcctcacagcaacagcatcagcagtagagaattgcttcttctttgatctttgataggatggcagttgggggtatttgctaggtgtttgaatgaagatctttcattccgtagggttttctttcgtaaactccacttgaagcgcgaggtgcagggcacatcacgatcgtccgaccttaatcggaggcagccgatcacttgcaaagaagacatgttgaatccaaagaaaatattgcccatgattccgatattgtaataactattgttttctttcttttcaatatcttcaaaaatggaattgca

SEQ ID NO: 62704 - DNA, 826 bp, Oryza sativa
aagtttcatttactagatatttgtactgttacatggaagaaagatggcatataagctttcacctagtgaaattataaatattattctattgaggggtagttggaaagaatatgcttgcgcctaattcaaaaaagaagttttcaaaagttctgcttgatagtaggtattgtggactaagattttcaaaatatctattctaatacatctgactattttctctttcatctatgttcacaggcttttgttccatgattccatcccttctgggaattaataactattgtgttgggttgctatttaacttttagaattttgcaggcgtatttggaaaccagggttcaggtcaaccatttgggagctttcaagccccacgttttcccagttcgaagtctcctgcttcctctgtccagcacagagacattgataggcaatcacaagagttgcttaatgggatggtaactcctcctagtgtgatgtttgaggaatctgttgggtaagttctgtgataattataactgtatacttgataagaatgtatttctgctgatgggaatacatgttgctgtgttaaattagcttcgcatcatgtttaatcttctttgtttatattccacaggaacaacaaaaatgaaaatcaggatgatagcatctggttgaaggaaaaatgggcaattggggaggtgtgggatactttcctcttggtcattttcgaagttctgtttgctagaaatgtttgctcatttacaacttttgttcctgctatggtacatttgtagttagttctctatctccttagtccttaatattgtacgcatgttcatttagt

SEQ ID NO: 62705 - DNA, 1142 bp, Oryza sativa
ccaaacattctgaaaaaaaatgaatgtatatatcaccgagtcagctttttgtcatgcaacatgtaatggaggtgatagctttgaagtaaaacaccatgacaataggttcacagtacacctagacaagaaggagtgttcttgtagatattggcagctgtcaggattaccatgccctcatgcaatatcatgcattttcttcaagactaagactaattcactggatgagtacattgctgagtgttattcagtgaaagagtttaagaaaatctatagtcaatgcctggaaccagtagagggcatgagcagctggccagaagatgacaaagagccacttaatgctcctgggtatatcaagatgccaggagagaccagaagagaatccaatgaaccattaaaagccaccaaactgtcaaggattggctcaatcatcagatgcagcaagtgcaagcaaattggccacaacaaatccacttgtaataagcatcatggaggaggctctagcacaccagattctctccaagttgtaaatccagctgataatttaatgctctcaaacacacaacaaagctctaaacaaagcaggaaaagaaagtcacgtacagctgctaacaccaattctgcaagtcagtcaaggaaaacagtgtcttcaaagcaaaaggttagctagatctagtgcaatttgaattcaatttatatttgatttcactcagagctaacaattctatgatttgcaggcactagtggaattgcatgcccattctcagggttctacaagtgcaacaattaaggtcacttctgggcaagcttttgtcaatgtttcaactcaagaatcagcaaagttcaagccaaagaagcttacacctggtctactgctgcttatgcctccatgggaatctgacaaactgtgatgtaatgttagatcaagttatctgttattaaacttgtgtgtgatgtaacgccagacaattaggccatctattagacttatctgtgatgtaatgcaagactttatggcctgtcattgtagttgccagacttaatggcatattgatgcagtcaagaaaaccatctgggagttttggctccagctgttccagcatcaacaattttctgaagtcctctgcaggttattagcagttttt

SEQ ID NO: 62706 - DNA, 1701 bp, Oryza sativa
tgcgatggtattctcttgcggaggacagatcgactttgcagccttcaacttggcagtatgagctttgtgtgctctgctgagacaccttcatcttcttgaccacagtagatggacaagtcacacctgaagctgcagaggagctcttgacattctgccctccacaaacattttcaaagtaagttctcttccctaacttgagtcctattaccggctcaccatggctaactgccacagctggagaagtgcccgagtcttcaactctaccggcctcgccatccttgcacatgttcttgccatgccctttgacagaagcaaacctgaactctaagctgttccccagcttggatgaggaatcgaacgacgctgacaaggagctcttcgatgaaccattggctagctccgagctagaagtgaacgtgccaccggatgaattggtggatccatgatttgcggccgcgacaactacacctcttggttcagggtgaggtatgctcttgggattttccattgtattcggaccgaaaggcgctggattttcccagtcccaaaacacagggctcttctgattccagttcatcccaaaagaagccatggctgaattaaggatctcaactgctgctgctcacacttgtatatattgcaaatctgataggatttcaagaaacaagaaggaacagaaagaacacacgtcacaacaaattgcagaacttggatgagaaaggcaataaacatatctcgggtaccaaaatcattttgtctttcagataaaaagacaagtacaacataccatccaaaatgaattatacgcgctttattgtggggatcatagcaagagaagaaaggcgaaaacgatcaattacctcaactttcctttctcccagaaaagaaacacagtggatccttcctctccctgcaaatcttgccctcaatcagcatgaccatgcatagcacaaccttgagcataaatcaaaccgatccgaggaggtgatgaataacaagtagcagcgttgaaagttgaaaccaattggctggcagaactaaagcaacagagactccattgttgttcttggctgagttctcactcacctcgacttgagagagatcctatcccacttgtttccccgacctaaaagacgacagcatcaaccccatcaaggctggcccccattcatcaccacaaccacccgctatttaaaccctttccaatctatcaccacaacaactaccccaagtcaatcagagctgcattatttgctccttgttaccgcacatgaaccagttgcttgttggggagcataaataaaccaaaccatatatgaaataaaaagcaaagaaactattttgaaggaagtaaaagaaagaacaataatacttgatgtgaaaccaagaatctcacctcctttagctgagagagaatcgttatccccgttgtattctacctggatgaaaacaatagccataagttttgtggcaaaagaagataggagaaagaaaagaaaaaacacaagaaaaagcaaaagcaccaagataaagaggacatgactcacaaagtatccaacacacacaagatggcaacctttccctcctaactagtatctcccaaaacctttcctgtgagcctgagagcctgagactgaacagtaacaagaggaggaggcagcaacaagaggagagtgaggcccagtggatggctgcctcctc

SEQ ID NO: 62707 - DNA, 2216 bp, Oryza sativa
atcgtagttttagaaaacatgaagcaaataacccatgagaaaaaatctggacaaaaactgaaaagaacatgtcctgatgataaactaccactaatcaagagacagttcatgcttagggttagggagtataaaatgtaggccaagacaagcaagaacacaacaaaagaagaggactgattgtgccaagagcagagagagagagagaggtaggaggaggagcacgaggaacgaggagaggataggaccccgacctaatccaaacaaaacaggacgacgcgagatctgatgaaaagtctcccgaccacaagccaatcaacgcaaccaagaacagaagcatgattgcccccaagctactagagtccagcaagaaccctacttggatcgaagccaatcactactagtagatctgcccgcaagcagccagcggttggccatggcgatacgctatccgagacgaagaagacgagacgagacgacgacacgaggtagtacaaaatgtatacagtggcgaagcagagcaaattgcatcgtcgccgtgaggcgcgatgagtccatgactcgatgaggaaattgcgggagatttgttggattcgccatggtaagcgagcacgtgaaggtgaagccccctccgcttcccgccgatccgccggggggaaggggaacggggagaccatcagactcgtctttgcttatgcttattcgataaaatttgaatttttaaaattatatgtagagttaattttgtggttttttaattataatttattttttagcctatacttttatatcattagcaatatgtatataaaagttttattcacaggttatttttcatttgtaaatattcggttcgcttttttcttcagtatgcgaaacgatggggctgcaagaaaccaggttaggttgttgcaggtttcatatttttctgttccaggattgcgtgaacgattttatatcatttataaatgcttttagaggattttaaattttaaccaacaatttcactaggcaggctccaatctcggcccgtagatatggatgggctgcgattttgttcgggccaaacaaggccaccatgacaattaagaaagttgagtagaagataagttgtagtttatatttctcttcaatttcttatatcttttaagattattaaggaaaataaggagtataccaatgtagccttttgttccaattatgaagtttggtcaagccagccagccggaagcattgcaccattgccttttttttaaccttggattgaaaacaatttggggcattttcgcaaaaactgaactagttttatgtaaaatttatgtgttctaaaataacccaatctcattccaattgacacactgatttgtttgtgttaatttttacgattttatttactgatgtataacatcataagtgagtatttcaacaaaattaagttatttctgatattactacctaactataatttcatagtcaggtttaagttttaaacttcatataaatagagaggtatatgtatataagcgtctgcttttatattgtactatacttcacaagaaaaataatttcatctatcgaaaaaaaaatcccttgaacatatatatttgcttaagagattaaagctcaagagccgattgggcaaggtcaaaattgaaaagaaatttaccagcggtcaaaattgaaaaaaaaagacgaaaaaataaaactagtaatcctagaaggtgacggtgtcgagcatcatgccgagcgtctgcacgatgttggcggacatggcgtccatggccttctcctccagcttccccttggcgtccaccttgcccgccctcaccacggcgagcctctccggcggcgtctcgtcctcctccctcacctgcgccccgtagcccacggcgaggtcccgcatcccgcgcaccgccgcctcgttgccggcgtcgtgcgcgccgaaccgccgcagcgcgaaaccgtcggaccacccgctccggctgaggcacgccagcatccgctcctccccctccttcatccggtagctgatggcgagcgagtagtagtgccgcccgaggccgtggacgagcgccaccgccgacggccgcgcgacggcgccgacgttcgacgtggtctgccgcgcctcgccgcccgcggcgccgccgagcaccatcgccatgtggtcgacgaggcggaacgcgtccatgaccaccttccccttgacgctctgcaccggg

SEQ ID NO: 62708 - DNA, 4494 bp, Oryza sativa
tggctattagattgattatagatgaattggagatagtagcgggctatacatttaaacttgctcaaaaaggtgttactagttaattaacacgaaacctaatgctaatctacagtactatctaatcaccacgtggttagcttcgattaatgtgcacgtgcgtgggggaagtttcccgaagagtctggagacgagtgccaaaaaaagaaaaggaattgaacgagtcaaaagaggttttttttttaattatttttgccgggtctcgccgcgaagacgccatcggaggcaggcagcccggtccagcccaccaagcaggtgaggggcggagatggaggagacggcggcggcggcggcggagaaggcgacgtcgtacagttactgggtgcgggaggccacgggcgacgccgcgccgcttcctgcgccacgcaagatcgacgccgccgacctcgccgccaagcccgcgcccaccaccctcggctccgtctggaacaaggtcccgcctcgtcttgctcttgcactgcatcctggaaataggggggagaaaaagaagtcgttgggttgattgattactgtagtatcggggaatctggaatttgattgattactgtgtccctgaaagtggaatggttcggttttgttgttagttttgcatctgaaatctgaaatggaagttgtacttgcggttttgttgtagttttgcatctgaaatttgaaaagaaacttgtagttgcaaggagggtgatatcatcgttcatgctggggagctagttcctatgcccatatcgagctatctatgtcatgggcaacttaagggattttcaacctggaagcatgctttgccttgctatgcagtaatccctgataggcaaaacctcaaaagcagccaagaagctgaatcactagaacgtgccatcagaatagttcaaacttcaaatgcaacaacacctcacaaacatgtttgagtcatgttgcctttagccctttgatgcaacattgcttcgacgaagcggtttcttgactgttggcaccatctttcctagccaattcttatgcctgtggctgtatcttaaatgatgtttgacaccaaacagggcgtagtgtattatcagctagtatttctttctttggtattgctatggaatgtttattatcaccatttgtttagactatgctactaatacatactgtgcaacaatcaacaagataagttcacaatggtaaaatgagagcacagtatagagattagctttttttaaaaaaaaaaattcataaaacctaatagctctgtgactatatatctaaccaatttcccatgttttctgtgcttcttgtaggctggaacctgggaggaaaagaacctcaattcatgggccaacggtaggataaaggtgctgtagttcagcaatcaaatgcttgaaatccaaatgtcctaactgtaatgcttatattgttacacatttcatctgagtgatcttagataattttaaactacaggatttgctgggctcattagaccctttggaattttctactgggaaggcatctgtttacgaagtatccaagtgttcaggcgatgtgagtagtgtatttcacagagccatttgatagttttcatcacaagtgctttgtcgtggaataaagtgctcttattgttttaccaacctaatgccgtgtggtactgaacctgaaaacactacttctaatgaataaaaaaccattacttctgatagtaccgtctgttgttaacatataccgtaattcttttttgggcttttagggaactcttacatctttagatatccttgaagataacctacaaaactatcaaatgctaacataaagaggaattttttattcatggctgttggggcaattcttgcataccttgacatccttgaacataacaaggacactgttgaaagatatcaaagttaataatccttaaggatatgaaagacaggaatatcaaatttaataatcctatattgatcttacagagacagaagaattttatattatcagcattcatcctcagtgtgtacttctcagcaagcatgagttgtggtcctgatatttttgctgtgttagttgttggtttgaacattgaaaaatggcgtggacaaacccattaaactaggaactgatgagtagcaaaaatgtggcaactctccgtgggagctctgcaaaatgctggtaataatactatgtggattcagcatgagttcagctttgttatccctgggggagatctacaaagcttttctctctgttcagtaaaacattgattagggcctttctcaatccaactggggaattcagtaacatgtagcagatttgttttctcgatttggtagtgatgcttgttcctatattcgagaacaaaaatgtatagctgatggagtgccatgttcttgaatgtctcactgataatccagctagggaacagtgctttcattttcatgcaccccttgtggttccaaatccattggtagtagaatttattttcatgaacgtactgttttacggacccttcgtttcgcttattccccgaataagcgaaacggcatatttgcaaacgaaaaataattatgaataaaacttttatatacatgttcttagcgatctaaaagcaaaggctgaaaaataaacttcgatgaaaaaacccccaaaatcaactccaaatttaaggtcgaaaattcaaatttttgctgataagcataagcataagcgaaaagatgaggcctttacttttatgacgatttaacattgtatactactatcagtggaatgttgtgttttgaactttttatatattctagttttcagtataacacatgttcgatgttgtgtctgaaatcaatgtgttggttactttggcaggcatttctggtcactgtccgtaataagaagagagtaggctatacttatgagctgggcttaaaatttaaaggtaaacaacctttagttctggagttcacatcttcacatgagctatctcctgctgaaaattggcactcatgggagtattcttcaggtgaatggttaattaaggaagaaaacaagaaggtgaaaggctatctggacattccagaattttcatttggtgaacttgaagacttagaggtacattattgctttccataataatattagtagtattcttttcctgagcaacttcgaatgtgcccttttaaaacgatgaatctgaagatgatatcatctatggaaatgaacattttgcctatgttctgtcagagttcaaatggtaccttttgcttattcctttcaggtgcaaataagttttaccgacatcaaggacctctcgtccgacaacaaggcacaaatcagcaaggatttgaagtcgtttcttgcaccgatccgggagaaactgcgcaagtttgaagaagagctcaaggatagatagcaaagctgcaaacttggttggaagcatcacgtatcaaaagatgatggcttaatctatagccatttcacgtatcaaaagactgcttcagacgtttactgctaaaagtttgttccaatacttgctgcaatatgcaccgtgtttgtttcattgccgatacattcatacttgtgccactgttgaacttacaagaccaattgagcagaaattttctgaagctatattcctgtcagttctgtagtttgtattcaggtagccaggcccatgggccacaactcgaaacaggtttcggcccaatcggcttgtatatctgattcagtagcactgtggcaattcaccaatcagaactcagaaattcagaactgaacagtttgttttccatatgaaggagagttgcaaaggtccaaatacagcaatgaaaaaaagaagtataacaacgtagtatcggattggaaacaatctgatactacaaatttatgtataggcataaaggtctaatccagatctatactacaacttgtatactacaaatttagagacagagatgagctgaagtgaggtgagctcagcagcaatggcgagaggaagaaatggttggctcagagtggccaactcgtcgctttctccctctcggttgaagcagatgcaagttgaatgcggtagtatttgattctgttgcactgtgtgcgactgtgtcgcgctctgtccatgacgtcctgcagctccacttgcacgtgaaggaggacccatctccaaaagagaagggacccaggtagttttactgaatcactgccgatgtacttctaacattccagtaaaactttgaatcgttgccgatgtacttctaacatttaggcccgttcttttctttaactctgaatttaaacttcctcttttttattagcacgttttttttaactgttaagagatgtattttttttcaaaaaaagttttatataaaagttgtttaaaaaataaaataaatctattttttaaatttataatcattactacttaattaattatatgctgatgagttttctcattttgcgtacaactaaggccttgtttagtta

SEQ ID NO: 62709 - DNA, 9987 bp, Oryza sativa
  unsure (1)..(9987): unsure at all n locations
cgagttgcgtcgcgggtcgatctgcgcctagcttttgggagaaagcgagagcagggagggaccagctgcgtgctgatcgagtgagagtgtgagagtgagctgagctcgatcgcttgtctgctctgctcctcggactctaccgggaggagatcgatcggacccagctgaaatgaaacggtggctatagcttcagctacactgctagccacaccctctgcctttcatggcttgatgcatcttcattagatgctctaggatatgctcctcttgtaccactccatcggtcaagaatcaacgttacgatccattagtactacctaaatctctcggatgaatcatgcacctctgcgtgagactcgttataatcatgcacctctccgtgagactcgttattaacgcttgtgagaaactattctaaactctttgggtatatgtactcgttatatatttgcatatcactcaaatgtaaatgttaaattttaacttttataagttgcagcagagaaaacaaatttaactgtaaatatacattaattagctatagtttaaattttttcgttgtaatttgtaaaagttaatttttaacttgtattttagagtggatatcatatactaatctatcttctcatttttcttaaagaaaaattataactatgtagatgttatgtaactaacgagggaatatcctttaagagtttaaaattcacttccttacatttattgtatataaaaaaggagcaagcagatctctccctctctcaggtttcctgaattccagatctttaccctgatgcaatcttgttctgaatcacaactagcgccttttttataaccatgtcagcagcagaacatacagaaaataaaatcaccactaagaactcgtataaaaagtacttaggagtacatgactccttttgttgtacttacaaatataatccctccttcccataaaaaaataatctagtatcggatgtatcatatccggtttctacattcactttttataggacggagggagcactcaataattccattataaatgaaccttgtttagatcattcgcagctaggcaagcttgtctatatggatcatggaacgattgcaactgcggaggggaaaaagaaacaaaaattcagctttgattgttttcgctaagctacatgagacagacaggaggtatggtgacatctctttcttcgatcgctacaccagcattgcaacttggttgacgacgaactcgatatgccgcagcatattccagttttttctaccacctgcccaggcgccgcctacatgcattgcatatatattgcattgcagctgcaggtagaaacagccactgaaaagagatgacgtcgagagctagagctagggaaaattgacggctgagatagatagatatggatgcattcacctcaccaaatgtggcacatatatatctaggctagctatacaatgattgtcatttttgcacaagtggaaaaggtctgattgatcaaggcatgtacctgtttgtttcaaagaggcataaggaaaaatagtaagggggtgtatagatgtaaggatataaagttttggcatgtcacatcagatattatatagggtgttacatagggtgttcgggcactaataaaaaaaactaattacagaatctgtcagtaaaccgtgagatgaatttattaagcctaattaatccgtcattagcaaacgtttactgtagcaccacattgtcaaatcatggagcaattaggcttaaaagattcgtctcgcaaattagtcgcaatatgtgcaattagttattttttggcctatatttaatacttcatgcatgtgttcaaactttcgatatgacagggtgaaaaattttagagtgggatctaaacaaggccttactctctcaggttgttttcaatgtaacactgttgattttgatatagtttgagcatttgtcttattaaaaaataattattatttgtcttatcatgatttgttttataaatactccaagcattacttatatttttttatatttgtaattttttaataatttgagtgatcaaatgtataactcaaagttaacggcgtcaaacattaaaaatcgaatggagtactataaaattgttgtgtcaatacatatacacgtggtatattaatatgtacatgttttgaatttccgtgtgcaaatgagcataaatattccgttcgatatatgttctctacatgacaacacaaataaaaactatttagctaagttggcaatctagtctatgaattggtggaccttaaatcttctttttctagtgtaatggtgtgtgttttggttgtgtgcatcagagttcgggagtattctcagtatgattgtatcaccttaaaccttccattatcttaaaaattattttttttcatcgctaaagagaatcaaagaatcatttgttgagcagtaccattgacatgtaagtaccgacctcagttttcagcaatattctggtagccctggaattgggaagaaatatgatgtcagtctagccctatcaaagcgcattgtttaaataaaaatgtatttcctccatccaataaaaaacaaatctagaataggatgtaacatattctagtgctattaatctgggcagatgtatgtctagactcgtactactagaatgtgttacattcgatactagattggtttttttatgggacaggaagtactgctataattgagaatagaacggcagtaacgtaaatttgtagcctgctgaactaatcttgtcctttattggatctgcatcgaccaatcctaggtcgaggttgaaagatgccctgccaccagatcaattagacagtgtacaaaagctttcacatttttttctctaggcaagtggattaatggtggggacaacatccaataaaaatggagtaatggaacaaaggtggatcaattaggagtgcatgaaggaagatatctgcctgactgaatgagaaaattgctgtgtatacatccatttgacaaaaaaactacaattagctaacgagccagggcacaattgagatatgaatagtttacataccttataaaatttcccaaataatgcaatataatatggtagggtggaattaatggtttaattagaaaattatgttcttaataaaatatatggtaataagcctatgaccagatgtccagatctaagctataacatagtattataatcctattcttcatggttatggatgtaattacctgatgttagcctttttcctccattttaaaacatactgtagctatttacttgttcacatatatagtcagaagttatattttgatatgaagagagtacgagtgtataatatgaatacatagatgcataagactaacgaagacctccgtctcacatagccacatgccacaatttgtaaaataccccctttgtctaaaaaaatttaatctctaaattcgtagctagagtttccctttttaagatatagtagcttttttcttacacgcaatacttgatgtcccatgactcttttttgctatgaaatcacctcacataggggtcatcctagacctacacaaactagcagctagtggtgttgaatattgatcatgaagcaattggcccatcttatccaatgctattctccaagtggttgtcttaacactaattgaacccaaaattctggctgacatcatctaaactaaacgaacctccaccatctccttgtcacaattttcatgatcaattgcatgacagaccagccccaccactaatttgtggatgcatctatcactataagcttttagtatagctaagagtgattcttccaaggtaattattgatcatatatattaataaaacccgattcctcagtggtcatgtctttgcaagcttgtcggcctctcgattacatcagaggttgctgggattccatctctcattagcttattgcagctagctaaccatgcttttgttaagagtcaaggtacattaattaactgaaggactagttccctaatggtcacttgaaaaatgcaaccactataagaaaattcctttcgatcgatctatgctggttactcagatcgaacggtttccattcatattttactatattatttcatttgaatcttttgctgaatttatgcagttcaaactagacaaatgttcttcggtgaattttcacggagctatttgaagtagaattgcatttcattataactcttgcctctgtttgtataaatataaatatttttgcctttttttgtctctttgacacagtggccggtttaaatcctaaaaatgacacagtgtttttttatataatcatattgatcaatttagaccatatccactttattctttatcaatatggcaatttctagacactcaaagctaacagagtgactctttttagccttctcttgataatcagactctaacaatcatgcgttgcatcaggcaaattaattcccatcctttccttgtctttatagtgacaggtgataagtacctgtagcaaaggccaaaagtttgcctctcaatatgttcaccaaggtatttcactactacatagtagctgttttctttattaaaaaaatcactttctactgcttattggtttctgcacgtttctttctgaaatataacaaagcaaacgtatttgaaatattaacaaagaaatcatagtagttccatgtaccaatcgtctcatcatgatctaagccaaatctaaacaacttcgtgtctaccgctcctgttttctcgtacatggtttgcaatagaacaatattaatattaacaagtagccaaacatctttcctagacagcaaccgggtgaatttgctttatatataaaaaaagggtataatagtagcattcaaatcattgatgcacactagcactaaccacagccagaaatggcctggttagagcccccaaaatattaccagaaatgcttggtgggcttttttgagggaccttaactctctccttgcttcccaaacatggttaaattaaataaaaaaaatgtgctgacagggagagcaaacatggacaaaattaagatacaatcagaaaatgaaaaagaaatgcttcaagaaagggtagacaatattaactcctccaatgaccaaagcaaaacagccagccaaccaacctctgagtagtagtcacaccatgacaccaaaggaaggagtagtcactggccaccaatgatttgcagtagtaacagatataggtcttaggcctccctgagaggctgagagagagagagagagagagagagagagagagagatttggtgttggataggagaagagagtggagacagtgggggtgagaggattggaagcatccagattctgaatctcctgcaagcctacttcctgttatcttctttgggctttcaggtgaggctgagatttcaaagatccatccttttatctgcactgctgctgttctctctgttctttggatttcttggcatcgttcttgcgagattcaactgctttcattcataatttctgctggtcttactaatttgtcagggattcagacctcatttcttgctttaatcctctcccatttctgattctgttcactctatctcatttcatatgctttcatgggaatttcttcggttgttgtactagatatgagagatatccatgtgtgattcacttgaactgttccaagaatttcatgctgatttttagttgttttttttcttctgcctctgaatatctgatgctgtgaatctgggcttcagagtttgtatatgctgtccatgcttctctcggacagacaggacggcatatactcaagctgtacacgggaaatttctccaaaaaagagtgccgaatgtgagaatctcgtgtgtcctttttttttcttcttttcttttttgctttttgcgaaactccaaaaacgttcctttgtgattttttatgtattgaaaagaaatttctgtaactcagatagacagttggaaaattactgtactgtagtcaacagacaagtaatgttatctgcaacttttacatttttttttgagaggaaagctttttttttttgtgatttttcgtgttccttttactagtgagcaaatatgtggaatcttatccgtgatttttctagggaactgatttttctgagtatttatgttaatgtaattactgcactaccagaacttaatagaaatgattaataactcagatctaaatatttcggcgtaatacataacatactcagggtctcagacactagaacctcctcttgtgtaaattgctagttatctacacaattttttttattataagcaagcttcttatgaacgcatatatctgagaaatatttagattacgaatatgtttcgctgactattaaaatttatctcactgtactcttgcagcaagcatccattgtgatgcactggccagtggatgataaagccatcaatcaactgaaccagcatgagctcccagagtgttgttgcagtgaagcagattactgctccggacaaaatagtggaaacctgtccatccacaaaacattctgcacataagctgttcgatgttaaaccggattttcaagggttgatagatgacaatttgtcatcctccagtcagtcctcaagcatcaagattgagctgatcagatcatcaagcttgccaaatatactgccgtttcagaaaagaagctctgaacctgaacctgaaagtccactgtctcatgtttcacatcccaatgtttcagagccagtttactcaaattcttcaaccttctgcacaagtttgttttcgtcgtcgtcgatggagacggagccgtgccggcaattgggcactctaccattcctgcctcaccctcctaagtgtgagcagcaggtttcagcagggcactcatcaagctcctccctgctagtacctggtggtgatggtgatattggcaatgctcatgatgaacctgaacagtcagatgatctgaaggatttcctcaatctctctggaggagatgcttctgatggcagcttccatggagaaaacaatgccatggcttttgctgagcagatggagttccagttcttgtctgagcagctagggattgccatcactgacaatgaggagagccctcggttagatgtgagtttattcattgcctttactgaaacattttcttcactgtaaattgagtagtccattgatcttcttacacaacaattcttttattttcaggacatatacggcacgccgccgcaactttcatcacttccagtatcatcttgctccaaccagagtgtacagaaagcaggatctcctgtgaaagttcagcttagctcgcctcggtcatcttcgggatccgcgacaactaacaaggcgaggttgaggtggacactggagctccatgagcgttttgtagaggctgtgaacaagctagatggacctgaaagtagggtggccataaatgctttgcaattttcagtaccttaaaaggaataattttgaagttgtctaaatggtttatttcattatctcatacagaggcaactcctaaaggtgtgctgaaacttatgaaagtagaaggcctgactatctaccatgtaaagagtcatttgcaggtatcagtgtatcactttatattcatttactaccatttttactggaaaatcaagcacccttctatgttttcatattttgcttacagtttctctgtccttattgtgcagaagtatcgcctcgcaaaatatctcccagagactaaggaaggtaaattgagaaaatagttgatatcttttttagattgttttgtcattctgaatactgaattactgatgcatgctatatgcagacaagaaggcatcctcagaggataagaaatctcagtcaggtagcagtggaaatgattcagtcaaaaagaagtaaacccttgcntaattgctagcnagcanccagaaagctgcagagaacaaataagagcacatgtagatcttaagaagcttacaactgactaaatttccnattgtacccatttncttaggaacttacaagctggcagaagctctacgaatgcaaatggaggttcagaaacagcttcatgaacagttagaggtgcgtatcagaaactctagaatgcagggtttgcaatccgtctgatgttgtagtatcattcttcatctgcacttgtgatcattgttcatctgccatcactatagtgaatttggtcaaaatcaaataatatgctgcaagtgttcagtgaccaaattttcagttaaatcagtacacatattcaggaaaagcatgcggctcacaaataatccgaactagatatccccaatccatacaatttatacctttttcaatcaccaggtgcaaaggcaactgcagctgcgaatcgaagaacacgcaagatacctgcagagaatactggaagagcagcacaaggtcagcatcagcagcaactccctctcactgaaacccccagccgaatcgcaaccggaatcgccaaaaccaacatcagaaaagaaggaggccgaatccgaagcaggcgccgccacttcagctcagccatcatccgaggataaatcaccagacgcagaatgcaagtcgtcgccgccggtgggtagcaagagagctagggttcatgtcggcgatgagcaccagtgttcatagcttgtgtagagaggaagaaggcaaggatttctcagctgcatgcaaatgcatctctcttcttgagaattttagccactgtatataaatttggacttttggggaatgagaatctgaatttggaagcagataaattataatcaaaaatcaaaatatggacttacaaaattttataggatttgttttgcagcaagtaataaattgaagctaagactgagtgtgaacgcgtgctagggatttcttggtcaagccatggtcaatggggagtcaatttctttctgccccctttctttccatgtttttaccaaaatgcccctcgacctcacctgaaacggcaaaatgccaaaaacccgcttcgatcatcttgctccaaagcttacccctttcgggctttctcctcatcgcttctcttctcatctccacccgtgaagagcgaattgctcaagccctaggaggcgacgagggggagtacggcgagggggggaggtcgcggggatcgtcgtcggcgggaggaggcgcggcggggctgccggttgctgctgcgcgcccccctttgcttcgttcgcgcatgggagaagaggaggcaatggtaaaaattcttttgtagatgttggggttttggagtggattctggtggtgatccggggatgtatgtaggagtaggagcccatctatgctgtgggagaaatcggggttggagcgtgtagaagccgtacccccctcctcccctttttttttactcgttttaggttttaggttttgattgtttaagagttacttagtttgtataatgttggatttcagtaggcttttgagtcgattagattgagagatcatacggctaggttatccgaaatggagaattttagcaaacgaggatttccaggaagggggtaaataataatagttcttaacaactttggatcagtgcacagtctcacatcttttacacgctttgcgagcgaaacggaatggagaattttagcaaacgaggatttccaggaagggggtaaataataatagttcttaacaactttggatcagcgcacagtcgcacatcttttacacgctttgcgagcgaacttgtttcgctgcataaggtaattttggcatgcccatgtgttgcctctgatgtattatcactatagagttagatatattttataaattttgtgctgaaggtggtttccacgtttgccgatagctttcgttactgtagagtatagactaagagaggaacattggccatgtaatgatctatttacatgcttacagaaggaagtatggtgagagtggaaattcttgaaccgacctgtcatggttgctgt

SEQ ID NO: 62710 - DNA, 1275 bp, Oryza sativa
ttaccatcttgttcagcaccagcttcaaaaacaacatcatccaacttatctacttttcctgtctttaacttctccttcagttctttaaaacgcttgtgtatctgtgcagcctcttcatcatcatctgatgggcaatcatctccaagaatgcaatcactgtcactgtcactccctgaagatacctcactagctgattcatcgtcagctaatgtggacttgcataccactaatatattgtccattatgtccaattggattttgtcttgccacctgtcttgaatttccgttatgaagacgctgcaaaagagatagtagaacaataaataataaataaacaaacacaagaagacaatcactttatcccagaaccacgtaacagtggatagtaacgcatagctttttattctgaaattagatggcaggagctctacctattcaattgaggacagaaaagtaaatttgttgagacacagctgatgtatgtatgtctttggataaaagataaaaagtatcaactagccgggaccatataatgctactgatttccaacatgcaacaactttactactcctagaaatttaatttacccatccctcatccacaggttcccatagaaagtgtgaacaattgcaactatagacataaatttgcacctggtaaacagtaaatacaattgaaatcaaaatttgaattctataccagggcaaatatgagaaagtatatataatcaatagtagtagctgggatggaactacaaaccaaggttctgagttgtggaattgcattagggaagaaatgtatatgaggttgattggtccaagttaagcaattgatcatgccaagagttctaaaaagccaccagccacttatcccaattatttccggaaatacatgcaatgtagaagggttctcaactagtgcatttccagtaactcaaaatcacctatggtcctagtccaacaccatgcaaatatattcgttgaatgaaaaatatttgaatctcagaaccagcttgcaaagaaagtactgagaccctgaccattgcaacactaaatttatatttggattcttaccatctgtctattttggaaaaaagatattcatgttcacagtttgaaaataaattcatgggactctttattgtcttgctttgcacttatcgtcagcagagataaaatatgcagcttaggagaaggcaagaagcaatgttatcaccagcaaagatcagctgggaataatagaaagctgcaacctggagttgctctcagagataaa

SEQ ID NO: 62711 - DNA, 15565 bp, Oryza sativa
  unsure (1)..(15565): unsure at all n locations
tgcatattgttcctaaacctgtcaaagatgcaaccgaacatgccaaatcttctgtgttgcgtctataattatatacacagtctgttacaaagttctcctttacattttcacaaactgcttttaaaatgttatctaccatttcacaaaaaaacacaagcggtaggggtcaactatagaaatcataagcaccgtttcagaatttccacacgatcttttgctatgttcatatgggaattgttgctaataaaggtacagtcagggtacaaagaacttatttgtgtggaaacaagagcacggttatcactgaactcacaagcatgcactgaggcagagtattatctagacataagggtcctggcagaaaattctgcttaagcaggccccaaaagaacatatcatgaacattcgctcacttcacatgctatccaaatattatcacaaggcataaaaagcagtaaatatgagtgcatcgactgctaggttcatgaaattgcatgcttccttagctaacatcacccagaaaaccaaccgcaaaagtctaaatgtgtaggacatgatctgcaacacgatttagacctcaaccacaaagccagctctaaccctcacgaaaacctaatttacgtgctgtgtcgcatcaaatacactaaagcactcaagtttagactacaaaagacccaattccagttctcaattgttgtgagtttaggcatttcaatagtaaaaggcacgagcatgctacgcattggtgaagaaaacatggaacattcttgcacatgccaataactcttttaaaaacgagcgcatgacatattaatcactcggaacagttgggcattggcagaaaataagatgccatattcagttgaatctgcattttcttatagattggttttgccttattttgcgcacaccctctacgcacaggggcggatctaacatgggacatgggggcgaaccccccaaacttaacaaacaaactgctgttagtattaagattacggcaaatttctagaacagaaagttagggttaacgaaaattcgagggaaaaaagtgtgcgggtcgagagagagagatgggaaagaggatgcggatgcggtgggtgctcaccaggatgcggcggaagcagcaggacgaacggcggcgccccccctcctccgctccgctcgcgggatgggtggggatcggcggcgtcggcggcggcgaaggcgaacgaactcacgaggagtcggagtcgacgccgctctccttagcggacggggaaataacctcgaggcacaggcacacacggcgatttgctcttttttttttctttggcccaattaggcagggatacggctggcccgaggacacgcgcgagtgcgggcccgataggcccattagtgtgtactatttttttttacttttcagattcaagcaatttttttaaataaaaatggctcattttttaaattcttttgaaatttggcgcatttttaaaattaaatttcgttaggcacctcacctaccaatttcttcagatggaccgaagtggtagggcgaagaaattcgcatttcggtacaaatttcaaaagtcacatgaataaatggtaaatttcaaaagcttgcatattcagtggcaagtcgtgaaatttctcgaggccggaccaatctcctgtcaccaacatcagtacatcatctagagcaccagccaaccaaatccgatcagggcgagcatccatgtgcaatcctaatttagctaggaaatgccccctaccctgtctcaggttcttggacaatacttattaattgaagagtagagtccatcaccggtccctaaacttgtactgttgtgtcatcctggtccctaaactcgcaaatcgaccgtttagatcctcaaacttgttcgactgtgttatcccggtctctaaacttgcatatcactcgtttagttccttcaacctgttcagttgtgtcactctggtctctaaacttggatttgaatatcatctgggtcaaaatggatggtctaaaaactttatattcaaaaataagtcataactcttccatgtgaactctaatgaagataaactttatatcaaacttgtagccctcgacgctatctacaactttgtagttgattttttttattttaagtcattttttgtcccaaaatgtaattttaaaattaaaatatcaaaatctataaacatgcaacaatattttgggaccctaaacagttttaattcaaaaactttttaactacaaagttttaggtcgcgtcgagggctacaattttgatataaagtttgtcttcattagaattcacatgaaaaagttatgaattatttttagatataaagtttttagaccatcatgtttagagaccgggatgacacaactgaacaagttagagaacctaaacgagtgatctataagtttagggaccgggatgatacagtcgaataagtttgaggacctgaacggtaaacgagtgatctataagtttagggactgggatgatacagacctgaacggtcaatttgcgagtttagagaccaggataacacagcagtacaagtttagagaccggtgatgggctttactcttaattgaaaatacgtcctatgagttctcaaaataaaaaaaaaaagtcctatgccctaccatgttgtacaggttctttgacatcactcgattgagaatacgtccatagaaaaagacaatactcaattgaaaatacgtctagaatttaggggcctagacaggatagatcgtagtcaacagaggtcagtaatcgcttcataagtccacattcaactttaagaaatcagtctccaggataattttgttcgatcggatggctccgagcctctgatggtttccatgtcgggggaagagggcgaatcgaagggcacatcaggatcgtccgatcttaatcggatgggtaacaagagcgcggacctgccactgctgatgctgcaaacgaacttgttgtatccccaggtcctgctgctgctaaggaagttggctcactagaaaaagaaagaggatatgttgcacgaaaataatcatttggacaagacaatgttacccggccaatcactcaatattgcaatactgtttcttattccaataacttcctaacaagttttggaataaacaattacagattaaaaaaaaagaaaaacatactattggaataaacaattacagattaaaaaaaagagagaaaaacatactaactcgacaggcaagactgcagttagctggttgttagctctagttgcccacattcatgttccaggaataaataagtggtaccaaacaatgcattggttcatcagccttccttcactgttcactcttgcaaattctcttgtttgttgtataattcctttgtatcgtcatgaagctgcaacatagcagccagaatcaaggcccactgataaatggcatacaaactgaagggaaaagggtataaggtgagcatatatacctcgggcaagaaaagtacgacatatggtggcaacccaactacaaggaagtcagatcatagctgagtagttcatggtctcatgcctcaacaacacaaaaaaaaacacctttgagttcttaaaacacatggctaacgtgcctctgaggtggttcatccagcggtatctgaaaggaagtttcgtatgaatttaaattgtagaaacttgccaaatataaagaaagcacaagttagtaaagccaatgcttgttcaaactcttgataatttgcaagacgggaagatgcacactaagcaaacatgtacgatatgtagagatctttctaagtataatcttgcgcatgccacaaattcataatctagaccacagtctgtgcatgatgtcaacactactaaatgaacatgcgtacaatattaaggactaaggagatagagaactaactacaaatgtaccatagcaggaacaaaagttgtaaatgagcaaacatttctagcaaacagaacttcgaaaatgaccaagaggaaagtatcccacacctccccaattgcccatttttccttcaaccagatgctatcatcctgattttcatttttgttgttcctgtggaatataaacaaagaagattaaacatgatgcgaagctaatttaacacagcaacatgtattcccatcagcagaaatacattcttatcaagtatacagttataattatcacagaacttacccaacagattcctcaaacatcacactaggaggagttaccatcccattaagcaactcttgtgattgcctatcaatgtctctgtgctggacagaggaagcaggagacttcgaactgggaaaacgtggggcttgaaagctcccaaatggttgacctgaacccctggtttccaaaatacgacctgcgaaaattctacaatagttaaatgaggcaacccagacagcaactagttcattgattcgccagaatgggatgggagatcactggaaccgaaacgcctagtggaatcatagatcgcaaagatgcaggactagtacagagtgtactctagcaatagagtattcttgaagaatactgtagtccccacaagtaccgtagctacgcaaggcagacgctttctggcagacttacttttttgaagttaggccgcaagacatattcctttccacacataccacctcaaataggaataactattatataatttccactaggtgaacagccttatatgccgatcttatcttaccatgatacacagctacgaatatgctagtaaatgcacaactttcagcaacatactcgaaactccaaacttcatttgagaactgccaaaagtaggggcagcaagtggtgcagagcttggatgaccaaaaggactactggctggcattcctggtgcggtggttctgcatgagaggcagtcatttaacacacatcagaaccaaatgaacagcattagaaaattgatcaactatatgtgagctttgcaattgtgtttaaagaacttttctaagcgctgctttctgattaaattgtctttcttcaatacttcctccgtttcacaatgtaagactttctagcattgcccacattcatttaaatgttaatgaatctagacatatgcatgtgtttagattcattaacatctatatgtatgtgggcaatgctagacagtcttacattgtgaaacggagggagtagattagtaacacaatcactgcatattttacaaaagaactagtagagtagtaccctggcccaggtccaatattagttgctgctccaatttgactgaaactactgaacacaggtggtccattggtttgagaagccccgaatgatgagttgtttttcacttcagggaaggaactcatagtaggaaagcttggagtttgtgatggacgtgcactattgagcagattagtaaactccattaactttgcgttttgtagatttctttctccctcaacctgaaagagatcacatcaattcaaatttacatagatcagaccatgtaagcaaagctaatgaaagcaggtattacttctgctaaaatccacagataaaactatcaatgaattgggagtgctggaaaatggaaaacttactattgattgcagagaatgcccttgctttccttcctcataggctttagctcttagttcctcgaagctaatgtctcccttaatattgcaagggccactgatgcaaacaaaagtgcattattaagtgcacaaacatttggcatggcctagagcaacttttgaaggcttgaagcataggacatgaattatttactttctgagatgagcataacaagtaagcttccaaataggagcctcgttcttaaaatcctcagaaatttgttgtctgcatgactgagggtcttcacaggagctggaaaacaaacatgtcggtgattcgcccatacccaagattaatcaggtgagatcaaaagcaaaacatatagcatatggactcacgtgtgggcagcctgcgcctgcggtggctgcaccgcctctgtttgcttcgtcggggccgaggggtcccttacccacttattttgaaaaggctgattcaacaatttctttattagtcatacacaacacattcctatacatggaaaaacactgcaattgaagaatttcctttgttctgattagcgctgacaaaccttcgcaggaccaggagcattacgtgactgggcattggcaccttgtaccccaaaaccaaaaggattgggcttctgctgctgctgttgctgctgctggaactgtgagccaaatgacggctgctgctgctgcctgcttccggtgccaaatccaaacgggttgggcttcgcctgctgctgctgctgttgctggtgaggggaggcatgcaaatacctgcactgcgctccgtacttgcaactgcacgcatcattcagaaacaagcattgcaaatcaaaaactcgaatcaatggctgggtaatcaatcgatggcgtagttctcactgagagagatgagagaggggggggatccggtaccttccgcgctggaagttgcggcaaatctcctgccgccgactcatcgccgcaaagcggaaggaaggggggggattcgattctagagctccgcctctagggtttagctcctcccaagcgcttgctcctcctccttccgccgccacgggattggcgtgggcacgcgacgcagcaagcgcggccgcacgacgtcggtgggtgggttgccctcgccggcttgccgcctccgccgagaactcgagacgcggccgccggccggagtagtcgtgcctcctcccttttgagaggcggtgacgacggcgagcagccagtgggccaggcgggccgcgggtgattcggcccacgagagggcccggcccagatagaacggccgtagcgcgctccaacaccaacaccaatacatagagatttttttattctttgaactttttaaatttttaattttaaaaacaaacatttcaaaacttatttttaaatctgaacctttttactacgccgaccggactaacgtggcaacattacacaccaatctaactagcgtgacaccgttatttggccacgtcgtgtggtagcgttatttcaccacatattcacaccatcttagctgacgagcataataaaactgtcaggtctgcagtatgggacgtgtcaatattgttttgccattctaggcgggctcatgtcatcaaaagtttatattttaaaaataagttttgaaaatgtttatttctaaaattaaaaattaaaaaagttgaaaaaaaaatccgctacagagaggcgcagcgcccgccacacacgcgcccgcgcgcgcagattgcgtcgtcggagacggagaggatgaacggcggcggcttggcccgcgcggcggcgccggcggtggtggcgctggcgctggcggcgatcctctcgacgccgccgccgcagccggagaccttctccaacatcccgcagacgctctccggtaagcgagaccgatctctcgcggtttttctcacgccttttgctgggggatggatcgatgacgacgacgaggtgggtgtggggatgattttgcaggcggcgacgggaagcagcaggtgaggataaagcggcccaagtcggcgaaggcgctgcagtgcacctccaagtgcgtcgccacctgcatccgcggcggcgagggccccctcaacgtcagaaagtagcagtaccctctctcaatctcatgtagcctgatcaaatatgttcactgaattcctgcagaaaatatgttcattcgccaataattcgagctcaattactgttaaacctgcaggcctctggtagttttcaagggacaattccgcagccggcagtactggtacctgttctatcgccattgcacctctcagaatagctcaattcaattgtgcagtcctagtactatgtgagctccactctgattatatatttatgtgtttcatatgcaattagcttggcagagtgctcggatgtctgcaatctcatcaaggatggagaagatgggcaatgaggaaagctttgacaaggagaagcagcaggtacagttgaagatggtatatccaggcaacaactaaacattgctgctgctctaacattgtgatagtctgctattgcagcaattcaaaccaaggcaaggcatggattcaaggatggttactgactgaattttacacaagaaactgaacaatccggtaagattgttccgtgaagttacagtgagaagaattagtgcaaaaaatacggcaccgaatcctgtgaacttagtgcacaataggaaatagattgttttgttaaatcattccacagagaaacaccatggaatgaagcatcataatatgttatggatttgttcttttacttttacttgattatacatgggaccaaatgccatagcaggcagatccaacatatgcaatagtcgaagaccatgagcagtaggctgtacgcacacaacatcatcagtgaattcctttactaacttcattgtttatttgctactacacatacaatgtacaacatgttttgctgagttcgacaagaagtcgaggcaagggaacctattaagacatgctgaagattttttttacatctgacatccaaagatgtcaatcttaatccagtgcttataccgattcaaaattttaccaaacctgcatttccaagatcactggatgtgcatttgcttgtttaagaaatactgtaatccagatacttgcttgctgcaaaagcttgtttcaactgtaaccaataggtttgctcaggagacttggtcactgtgtttctcatgttaggctgttagacacgcaaatatgttagtgcaggacatgtaaaattgtaatacattttattacaatcaaccatttagagtgaaaacttaaaatagggtaacaatgttgtactttaccttctatgttatctggatggggaaacatgtcagggcagttaatttgaaaatcccatatctggcaagaagaggtaccgaaatctagaatcaaacggaatgatgccaaatgtgcgggtgcccaggagactttgccgcctttgagacacacagtgctcaacaaaagtagcttgctgctgaggtagaaaatgtgatatccagatagggaagctgttgtcgtcaacaaaaccgcgggcaaaacagtgcagcattttagggaccagaagtttcccctttcgactgactcctaccgatgctctaataaaatcacgttgtgcatcttggagttcttcccttacattgcctgctgtatatatcttcacctgtagtgataattcgtcctttgttatcattaagctcagcagaggaaataatcaggatgcatgctatactggtcaatgccaatgaaggaatcaacaaatgagtgagctagtttaccgcaggagaagagtacaatccacagctgagagcaaatgtcaagagtggctcaggtgacccaatgcaaaactttttctgctcctcaggcacttttatcttctgaagggcaagaagcagagccttactcaaaaagaaagaagtagctgccatcagtttacgttgacagggcaaaatgtaaaaaaaaacaagcagctttgtcagttggatgccagttcacataccatttgtggcctatgatttggaggtttcatcttcagaatcacatactcgatgaatgcagcgctgaatgagtgacctccaattgtatatgcggcctaaaataaatcaaaggcgatattattattcagacagacgagcaacatcattcatcgaacagatgtatcgataagtaaaattagttgtgtgttcattacttcaaacaccaaatgaggggagaaacaaccagtaaataagaataaagttttccaaacaaaccttttgcattagggaaaataattttatgtcactccgtggaacgccataagcaagataagcctgtaaaagagataaagcaagcattatcactcactgtaacataatgttatatacaagtgaagtgaatttgcaaaatacgcacatgcatcatcagtgcattgtataaattgatccaaaatgccaactttgcgtcatcaccgaggtgaattgggtttacttctgccaattgttcaatcagcaatctgcgctcagataagtgccaatagtatggatgagtggatccaaatgttaagaaggaaaaagaaaatcaagaaaacaagaatgttcccatgttgtaatacaaatggaacagaaataaaagtacaaaggtggtgtttccttgagctaaaacaagtgcattgaatcatttttggtacacagattgtcagatatgttacctgaatttccttagtgattctgcagcatactcaagttgtttcttcccaactgacatccacgaaacttcagccgctgcaccgtagctcccaatgtcagcccaactaagcttctcgcgagctttgtacggatcaaagacggtctctgaagctaatagattattgttgtagttcaaatcgacctgaggactctgcacccaggaggatatggaagttggttcggacagcgaccagaatgcagaaattgaatagtttccgctaggagatggtccagactgctgcttctccgtcgagggagtcctcgaggactccctgcaggaatctgacaaggaaatgaagatgttcttcatgcagcgaacgatgtcctccgaaagctgattaggattgccaaagcatttggatgaaagctgcctctgtagtttcatagctgagtcgtgcaggacagcaaaaggataaaccttgtccactctacatgacttctcgtttgcggtgtcctagtagcaacatgaattcacaaagttaagcatcaatagcatataggtagtgtactcaactcttcatctgaattaggtccatatatgaatatgaaaccataggagccaattcttggaaattggagttatggaccatgttgaaagaggatggctatgctgaattcagtcattgttaatgatgattcagagtcattgttattcagcaatgcatatactgaagaggacagattattcagaaattcagtacctatgcaaatactattcagaaatacagtactgaagaggaaaggagaagagggtccatacatctgattcggatttggtggagtggcaggagcagacggagcgtggctgctgcagctgcagctgcggtggcggcggcgcctgcttgaggcggtactcgacgagcctcctctcgttccgctcctggatgagctgaaaatgcagggacaccatgtcgtcctccagcttggagatggtgccttccaggatggagatgttggagagcagctcctgtgcctgcaaactcatggagcttcagaaaccaagaacacaccaatccaatcaatcgaaatgcagatcgacatgggtgcgcgcgtcgtacgttggtggggaggtaggacatgtcggcgagagtgagcgcggcgcggtggagcgcgttctcgaggatggcgtgcagcgtcgtctcctcctgcagcgccttctgcagcttcttcacctgcaaaccattgctctctccatcctctcaatcacagtcacatcgcatccgattgaaaacgagggtaggaagggaagtggatcactcacgtcctgctccagctgcgacctgcaggaggacgcggcggcggaggcggaggacgacgacgaggagaagcccctcctcgccttggccgacagcgacagcggcggcatggtggcgcgcgaacctgcactccctgtcaccgtactcggagaagagaagagaagacgaagcagtggaggtggaatggaatggaatgaagtgcaaacactgcgacaatggcagcgtgagcagtgtgggtgggagtgggagcgaggagagagtaaaaacttgctgaccagtacttcaaaatttgaaatgtacgagtagtgtagtgtggcgtgtcgggggaggcggacgcggacgcggagtgggtggccaaacccaacccgcagctcgagaaaggcgggggcagacgagcgagcgcgacaccacgacccacctgggaacacacgtagtaggacctgtctgggagcttaataccgtgagaaacaattgataaagttggtagccggtttttaaggatttgaaaaagctgagttttcagctccttatttctatttctagtttattttttaaattttatgaccacaccttctcgtaatctaaacttaaaaaattagattgttttgaaaagtttctaatttagaagctccccaaagaggttcagaatctcccatgaaaaaacgaagcagattaacgtatgattaattaagtattaattagaaaaacttttaaaactagattaatatgattttctaaagcaaattttctatagaatatgtttttttataaaagatgtaaattttaatagtttgggaagcacgcgcgtgaaaaacgatacagacatacagtgaaggctgggaagcaccacaagccaactcagcctgtatattatactccctctatttcaaaatgtttgacaccgttgactttttagtacgtgtttgatcattcgtcttattcaaaaaatttaagtaattatttattcttttcatatcatttgattcattgttaaatatactttcatgtatacatatagttttacatatttcacaatttttttggaataagacaaacggttaaacatatgctaaaaagtcaatggtgtcatttgaaacggagggagtagttgatagttcgtagcgatacgtgacgagaggaaggaagaaggggacaggttgggcgggggaggcatggcgccgcgaaccgcgcgccgatgcccacgaccgcttcgccatccaaccccaaatacccaacccaagagaacgagagctaagctagccgctagctaagccaggagtccgaggcgagtccgttgttcggctcgctcgttgagttgctagaacgcttacgctttccactttgtattgaccggttttgtttacggttaccgtggcaaagtggcagccagccaaagcttggcccttccttccagcacgcggcccggagcccaaggatcggatcagaggcagcgaccaccccactgtcacggatccagaacaaattccacccattttagcatggtacatactctaggattaacctgcttttaaacctgaaaaccccacaaacaacaactagtactagtaattaaacacatcctaagataacttactacagtacaggctctgacatatgtcgagggtccaacctcaactaccattcactcctgtgaattcaatggcaagttggcaacactggggcggtgacctcgcgacagggagagtggagagtggtgccggcagagccgcaccgaccgagaggggcagcagacactgagaagagtcagatatgcagtgaacagtgaacactctttccttctttctggtggtcaatcgaaatggaatgcagataagctctactactgccaagtgccgaaactcgaacatggaaattactggaaaaaagaaaagaaaaaaaaaaagctcctccagctgaaactctgaaacatgccaaagcctgtcggcccattaaatatactaataatatcactaacagttttcgtaagtatataagaagcatatgatgagaaaagacaataaagatcatgcatactccctatgttaaaagaaattaattttgggttggaatctagacatatgtacatatatttgtattaacagagaaagcatgtattagatataatgccatatgtcgatatcataaatgagagtaaacaaggagggtaattcaacacaggtaatgccaccaaaacactatgttcacctgtcgttttccattttgtaacatggttaaactacagaggtgatttgactgaaactaaaccaggtaatccaacaaagaaacagcatagtacgagcactaagaaatgctttgtcagagtctggaggataagcataatgccagaaagacccaaaaaagagctgaaagcactgcgtccagnnacctattagcacngntttcttcacttttggtgatataanggaagggtggntnnctgccttnctggatgagnnatccatggtcgaccgctaggttggagcttagtnggagcctnnactatgctgttgagccccagaagcaccgcgtacgcatggctcacaatgggcgaggcgaagattgtagtgtagatactccatcgttctgaacctctcttgctcaggatatgtcctcttcacaacatgcagctgctcggatatgctccggtcaatgttgtatatggaagcaccgaagcatgtttggctcaagatcctgatcgcaaacgtttgcagctcaggggtgtcagtcccatgtgccgaccaccaacgaactgcaattaaaagtaagagatggtaagagaagtgtttctttaatatgaacaaaagcaacaactgcattcgttagttaccagttctaaacatcgaagagaagattttctactactacaacttaagcaagtcaaacagttcaggctgtggcaggttgcctattacatgggaagtgtttgcatcagtgtaacacgggagggaaccagttttgggggggggggggggggtaggagtgaagacaaactagaaagataacctcacattaatgcccaagtgaaatgaaagataaaaccacttgttctaaaggtaaccttagtgtccttacgtcaattagaaaaggagagccagtataaaaggtgcaaaagagacctcatatttgcatcgaaggggatatcaaagcactttgtttaaattcactcttatatatatgttttgtgtatcgttcaggcggagaacagaacctgatttaccatgttgacaagtagactaacagtctaactctaattgacttagtacaacattctgactttttcttagaactacaacaacattctggctttaacaaaaaatatgataatctttatgccactttgcacataacaaatatgcttttgtagtgcatcttagttagtaatgcacatgccagatccatggaaaaccttgtaacattattatatcttgctgtgtctaaacactgtacatgagctcgcaataacatgtgattgagggacattttacatgagaatatgctatactttaccttgtggtatttccattgtttgctgaattgctgagtctgaatcaaaaggagctgatttgcgtcgatacctatccatttgtatggccactttcttaggatcataatggtttttggccagacgggttacacaggcattggtcccacttttgatttcagtatcataactgaatctttctgtgtaaaagatccttggattcagaatataaccggcagcatggactggggtatgcaagtaatgatcccatatctcatcaaccataggccaataatcaccatgtttgtctcgaagattgcactttatgtcttcttttgcgcaatccatagcatcatacaagatacctattgggcaattatcagcttccagtttgtacaacacagtgataagtggatccgtaagcttcaaaatatcagcagcagcactccaaaatgcattatcagtttttactacttcatagacatgcctgaatgaacttctagaagccaa

SEQ ID NO: 62712 - DNA, 743 bp, Oryza sativa
tagggattgccacctgggcccaggcaagcacatcaaccatgtccttgaaagatggcaagtggagaataccaggctcaagtccagcttcaaagatgagcttgcctattgactttcttgcctgagaattcaagtaatcattagttggctcctttgaggattccgaatcttgcatctgtgatgaagaattctccatagagaaactcaatggatcaattctctgccctgaagatatttccggtggcttattcatcatacacggattttgatatggaggcctagttacttctatagtctggcctcccttctgagatgaacttgcattgcaagaaacatcatgggcatttacttgtgtagtttccccgggctgcaccaaattatttgtgaagtgaacaaagcagcggtgccaactaacagagccttcttgatccgtaccggatgtaattggctgcaaaagaggtcggcaggcatgagcagatgtgagggatagatttcttactggaggaagctcagaagatttatgttttcctatttttcgggctatccaatctttcttgcgagcctctagtgaactctttatgctttgcctgacactgtcaggtactaagctgcaaggataaacattgcccctgatgcccgctaagtggtgctccagacggttgtatgtcctaaccaccttcccacagtaattacagctcaccttctgtgtttccttatcgacagttttgccatgcttttccttttca

SEQ ID NO: 62713 - DNA, 930 bp, Oryza sativa
taatggtattagtactgataattatgatatcagtactgagatagaaatagctggacaatgtaaagaactcatctttttgatgaaggtccaagttcatgtttattctgtagctgtggtttcagaggggttcagaataagcaaaaggcatcggtacttggtttggtttcttttttcaatgtgcatctaggacaaactttgtcctcaactcctagtcattggtcctctccctcatcacaggcttgttgtaggaaatggaaaggccagagattttttttgcaggaaaaaagtacagctagtgctagtagtaatactgccaacatgtagtactcgttgctagagatttttctttaaagatactctcttccccagcatgctaaaccattcaactgacagtacaactcaccgccccaatttaatcttttgattgctccatttgggggtttcagaggcgacatgcaacagtgaaaaccctgtagaggatctgaccagggaaaagagtgtgcattgcaatgcaaaggctgcagctgttgttggatgggggcaagagattagattgattcatctcaaccaggcacatgattctactgttgagcacactgatgaaaaactgtagctgcttttgtcctctccctacccacactttccaatccaacccttatacaaacacaaccacacacacaccccaatggcaccaatgatcaaatcaagcaaagcaccactgctgctgcaaagaacaccagatagatcaaactctctctctctctggtgttgctgttagttggtagtttggtactacttggtactctgggaagaagaaagagattattatagcagaaaagcagcaccatggcatagctccaggcagcaaaaccaggtctgaaattatccctatcttttctttgcaagaaccagaatctttttatggcatgg

SEQ ID NO: 62714 - DNA, 1379 bp, Oryza sativa
atagtaggatgataccgtaagcattttaacatgtaacatatccagttttctgcatacgcacgactggtgggtgttacctggtggcacacttctttttagaagggagcttaacccatcctcttgagtcttgacagttactattatattgttatataataatgcatagtaatcatatatggtagcttgtgtattttcatgatgtagttttccacttgacgcgtttttaccaagtcctacacaaatctttcatggtgacagtgtttgcgattttgcattgcagatgcaaggcagcagacagatatttactttggccaatctccttttggccaagtgagaagcaatgcaatttcttcatgtgacaacctgggaggcttcaaatttacagaagcaaaactcccctggatgaagccaatgaaaactataggccttgaggatctgaatttctctaccctgcagatgccaggcaatgttgtgtcgcatacggtgcatcatcatgattttgatgggctcataccattcaagggaaacaccccgaaggtcctcaaccaaggtacattaacatctctcaattcatcactgaactttaaagaaaagacatgcagctgttgcagcatcttcaattttaagtttttaaccatgtgtttttatttaatgatctaaatgggactacctattttagcaattcaatttcttatcagtaaataggtccgactgatttgaccttttgtttgattgttatctgtactgttcacctctctgctattcgacaacgccgagacagcattttattctccataattccttttcatacggctacaatcttctgaaaagtctttgttgctaaacagtcagcattcctgacttggagtttggattaaacaagctacttagtcataagaacacatcattttgctccctttttttcagtaactactgattactcattttatccatttgcatcagcttgctttatggacaagctagaaccacaaattgtttctcaaaaaaacaaaaacaaaaacagagaggctagatccaccaattatctgttacaagctttttggacttcctgccttggtatgttgatctttcaatctgaactgctccattttttctctgggtggagcctgggagcctttcaccatcccaaaaagcaagaaatgtgtttcacgcgagagatcgacaagaaacgactaggtcccatttactaggtttatggccccatcactgcccctgataatgacattcaccagaacttttagctggtagtccagtacccacatctgtgcctggtactaacctgggaccaacaaatacttattggatatgccagcttagtgttgcaacttgcaaggagtgtgagtcatctcaatagatac

SEQ ID NO: 62715 - DNA, 957 bp, Oryza sativa
aaaaaatcaacaagatagattaatatgtgataaatcatttcataaacatgtaagattaaatttaacttctacaagttaaaaaaaaccaaattggatttataatatacattaactagctatagtttaatttgtcttttttatttgtaaaaattgaattttaatttgcatgtttgtagagtgatctatcacatattaatatatgtagttgattattttttcaatttcttacataactactaggataacatgcagatgagaatttaggatccactcctgttcatttgctctgcctacgactattcgttatttctttctgaacgttttgttcctgagctaacaatcacataggccatgtttggataatgggtttggaatatgatttcttacccctcaaaggataagtttcaatcatagccatccattcttctcactccatttcatcttatccctccatcatttctatttcccaatcccacctctcctaacccattatccaaacacacccatatattatcaaactctgttcaccaatcgaggtagtacaagcaacaggttagctggagtgtagtactaatacagatgcgctaggccgcggcgctgtagggcgagaggtgggcgtaggcatccccaacctcggtccggtagtgcttccccatgccgaggtgggtcatgaggaggcagacgaaggtgatgagctcgccgccgtccttgagccgctccgcgtgctggtaccctccgcagtgcaccgccgcgtagcccagcatctccacccacacctcgcacaccaccctccacctcctccccgggtcggccatgctctgcctcagctccctcgccaggaagcacccatcccacagcaccgacttgcacttgtcccccttcaccaccgccgcgtgcagcggcgtgtccacgtccaggagcaccctgtgcgcgttgtcctcgcccaccgcccgccgc

SEQ ID NO: 62716 - DNA, 986 bp, Oryza sativa
cttttcctgttaaataccttgacattccaatgcattttaggaaactgggtaataaggattggaaagttattgaacaaagaattgagaaaaaacttagtagttggaaaggtaaacacatgtctgttggaggtagactggttttgatcaattctgtcctttcaagtttagctatgtttatgatatactttctttgagataccgaaaggggttcttcaaaagattgattattatagatcacgtttcttttggcaaggggatgatcataagaaaatgtataggctagctagatgggatattatttgtcaacccaaagatcaaggtggtttgggggttcataatttagagattcaaaataaatgtcagttgagtaagtggttatataagttaattaataagaatggtgtttggcaagatttattgaagagaaagtatctttataataagtctataacccaagttgataggaaacaaggtgactcccattttttgtcaggactcatgaaagtgaaaaacactttcttaagtatgggttcctggattgtgaataatggggaagaaacaagattttgggaagataaatggctaggtaatatggcctttagagataagtattcatctttatatgctattgtcagaaggaggaatgcttctattgctagtgttatggcctctattccgcttaatgttttctttaggagagctttagttggtcagaatctaacactttggcatgagttgtgtgcttctattgttcatttccagttaaataattcttctgattattttagatgaaattatcatcaaaatggtcagttttcggttaaatcaatgtacttagctttaattaataatggttacattgatagaaataagtttatttggaagctttaagatgttgctaaagattaagttctttatgtggtacttgcttaagggagttgttttaaccaaggataacctagcaagacgaaattggaatggcagct

SEQ ID NO: 62717 - DNA, 865 bp, Oryza sativa
aagatggaacacctcttcccctaagccctccgacgtggccaacttctaaaaactaagacgccaccacaagaggatgagaatctagagcgtgcttgcaccaattgctcgggtggtttcggcgaggggatgcctagacaacgtctccaaggagataagcgacggaacaccgccgccgccatccaccaaggtctcaaaagggcagagaatgacctttcgcccggcaaccacccttgaggggtgagacggcacgacaacgccctcaggagggggaatgacactcgagcaccatcgttgtcggtccgagcaaggacgagctgggttttcacccgccgtccaccacctgccaatctaccacagatacaccaatgctccaccaccatctagacctccgccggtgcgtgggcacactgcaccgacgccctcccccggccagtccccacatgccaccacctcaccgggctccacctccaccgacatcacctcccgctgcgcagccatcacacactggccgtcctcgacgccgccggccacgcctacacgcgttccaccgttgccggtcgcaactccttcaccgtgtcggttgtcggctacgtctcccagcctcgccggccatccacagccaccggcgcccgtgcatgccgccacatccgccacgggtggcgccgcccatgccggcctccctgcagccgccggcaccacccacaccaacctcccgctgcaatggcgacgcccaccgacgcctccacggtgccctgactgttgccgccggtgccatcctcgcgcagccgctagctccgtcgcgctgtccacgccctctttccgtgccgtgtcgttcacagctcttcaccatgccgcgccgcgccgt

SEQ ID NO: 62718 - DNA, 845 bp, Oryza sativa
catcaatgcaaaggatgaggcaacggtgcacaaatgctaggatgcaagctgcaaaagagaagaatgctttctgcagaatgcttgcattgccctcatcattcttagctgatgaatagtgctgaaggtcgatacaggtgcctggattcctaaactgaattattgctagcaatttcagcaagttatcataagatgctttgaatgtgccaaaccttgtctctatagccttctgttttgccctatatgcctttgcatagctgatggtgtgcttgtatttttttttcttttatgtgcataatgattgacattggttcaaagtttaggttcttcataacatggccatacacctcagctgctatggatgctgatgtaatattacggtagtacttctccactccttataagtggcacacatgcttcgtaacaatcgagaattgccagcaatccttccatttacccttgtatgcgtgaacctgccatggacagtccacctccgtcacacacctaacctcatacatagttttgcaagacttccctaccctaaactctccctgcaaagaaataacaaaatgtttcaccgcctccttcaaatcctccaatctagcataccgagcaccttgcacgacctcattctccttatactcccatggcatgtgatggccatctgaaataatcaggcaagaaaaatccttgttgcaaaccatgggaatatcctcgtcagacgatgcatctccaacatccttctcgttttccgcatcctctcttttcatcagattcataatactaccaatcctcttgtcacacctcgattttcgttcgggattaaaaatcattaaataatatatttt

SEQ ID NO: 62719 - DNA, 1741 bp, Oryza sativa
tcaagttgcttaagcaaataaaataaagacaggctccgacacagttacaccacacaccggcataaccatgccccacacaactccaacaagaagacaaacgagaaagaacacacgcgcaagcctactaactgctcgtctaccgctgcgacgggccaggacggaaggtgagcaacagcgcatcctccatgctaccaacgccggaggcttccccctcctggggaaccacgggcgcaggctcggcacgaggggtctccacgaagcaagtccacgccagggactgacgaacaagctcgggcctggaggtgctcttgcgggcggtgatcttctggctgcggcagacgcggcgacacttggggcgacagacctctccctgggtgatcttgagctgatgcagctgcgcctccactgcgtctaggtccttcttcagctgcagattctcctgacgcagctccaggatcttcatgttgttctcgaccatcccacgacgcaccatctgatggaagtcgatacgagccgcatcgtacgcctccaccatgcgcgccaggtgcatgatggtagcgtcatcctccgagctagcatcccggaaggtggcgaagtcgcgggctcctccgcgacgagggtggtagcggtagggcgagtgctgcaactcgtccgggtagccctggtgaagagtgccgatggcgaggagagcggcgctctggcaagcggcggggaaagaatctccacccgcggtgactgccaacgaagtccgctcgggagagccagtgaggatcactgcagtaacctcccaagcagcatggggctctgcatcgtcaccctcctgctccgggagcggcctgccctggtagtccactccatgcggataccccaggacaacgcacatgccccgcagctccaagacgaaaccagtcatgtccagaccacgacggctgacgctgccggccatctacaaacaaaaacaaaaagaaaagcaacattttaaaggtcatattttggcgataaatgaagcagcaggacagagagagactagaggattttcacaaataagaagggatttttattttgaaaatattgctaaggcttgggatctaaggctcgtcctagggtcaagggggctctgataccaacttgtcacgaccggaaataacccaacgggtgttccttacgtgcgtgcattaatccttgtcccaggaggcaaggtacaccaaaagttgatacaattcagagtttaacaagcggaagcgtaaatagttaatttattacatgggcagcaaaggcccagcacacacaaagacaaacgagaaacagcggaagactagggcgatgaccacaggcgcttgacggcaggcacgagctagacaccaaagccttcatcttccaggggctcctcttctgggtttgggaaaaattgagcaagactaagtacaaccaccgtactcaacaagatacacccacaagtgcagaataaatgcaagggagtacaaaggagttatactataaagggttagggttgcagtaaatagcatttaaagatatttagttgctcaaaactatttagtaaacacgattctagaactatacaatattatttatcaaggccgtgaacccacacgaacctgccttaacccaaggcctacgatgattcataccgaactggcaacccgaccctgggtcccagctcgtccccaagccaacacaggccaaccattaacaccttttagttgttaagcaggttttaaga

SEQ ID NO: 62720 - DNA, 6497 bp, Oryza sativa
tattgtgtgcctcggctgattcctggacgagggttcacacacatgtaagcgtttggaattttggatagaaattccgggcgtgacaccattccatagtgtccaggtgatatgaacatcccaaagtctagagttgtaaaatcacctaatgttacctaattaaacagcgaagcatctacctaaaatcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataactccatataacaagtagaaacaaagcacaaaaatgggttcttgacttcttaaggaaaaattagagacttgaacggtccaattccgagttcaaatggccaagttatggccatttgaaggttatatgctctttaaatgaatatttgcgaatttcttcatttaaattttaatttaaaatggatttattgcgtcagccgaggggagagggcgcgcggaccgggtccacgggagtggggcccacgcggcagcctcacggtccacggtggaccgggcgcacccggctcacaccggccggcgccgtgggtcccatgcgtcagccgcacccgagggcgcgggcggctgacggccgggccccacatggcaaccgcgggacgcgcccgaaggcggccacgccggcacaacacaccgcaggcggcgcacccgcgccccgatggtcgccgccggcgaccaccggcgcggcggagcggcgcccgagagaggggagggaagggggaagcgaatcggcggtccacggctcaccccgggtcgacggcgacgacgggaacggcgaccggagcggaggaaggcggcggcgcggcacgggtcgacgggaacggcggcgttccggcggtcggcgaccgaaacggagaggtgaacgaggtcggcgaggttgcggcgaacccgaagaaggcgacgccgaaacgggagaaggtccggggcgacgacggcggcggaccggagctcggcggcgacggcggagagagagagcgacggcgcgagctcgattccggcggggagagagagcgacgagtggcggaaacggcggagggaggcacggggagcgtttatatagggttgggagtgagagagggcggtcggatgagggggaaacggccgctcatttcttctttattcattgtacagtatgcaattccacgaagctgatagaactggagcaaaggttggatacgtcgatccaacaagaatatgcaaaacacaacacaccgtagagctgagagaagactgcgagcaattggttggcaagaccccggaagaaaaggaagaatatgtgaagacattgcacaagaggaagaagctagaagtagcaacatacttggcaatagcaatgttggcgcacgccgacaaagatgtcttaatggtcccctaccagttcacgtaagctctctcttctttttgtttaattaatttatcttcttcggaattttctgtctccaataagcctatcttatatgtagagaccactacatattattccttgtatatccgaaagaccaattgatcatatcattggaccccgcacactatgacaaggagacatttatggaattcctcactattttgaatttgtaagtgataaacatttcattactataaattgtttaggtcgatcaccagtcttctaactactaataaaacaattgtttccttcaaacagagcacacaagtactaccgcaaaagaggtggaccagtacatattccatcccagaagaagttatccgtcaggactggctggccggtactatcaaatttataccaatacaactaattatcgaacagtacatatatactaaatatatctactgagatcggtccccataattatatcgcagtgctacaaacaaccaccaggaaccaacttgtgtggttattacgtgtgcgagatgctcagagtaaatggaaggtacaaaacaaccagtaaccgagcaggtcatcgaactcttctctacaaagaaacccatctcgcacacacttctcactgagtaccattttattttcctttctgtgtgcagatccccgaaatcccatatattgcacaacgattcaacgacactactatcttgaacgtggccgctgacctctgccgattcatccttcgtgatgtctgcaacgcaagaggtctcttctacgacaaccagagtgaactcacaatggacgacaaatttaaacctctcagagagtgggagaaagaacatatgcaataacatgtacactacttatacatatgcaataacatgatgaaaaaactgtgccacttgctattatatattcgtatgtaaattacgattgaattaatggttatgtattacatgtttgttactgcggcacttgtcttatcttatatgcttactactccgaaatacgataataaatccctcaataatttaatattaattacgagacacatctcaccaaaatgctagaataaatattattttagctattcggaaattgaatttcgcatgcggtctacttaagacgcccgcatgcgaaaatagatcttcgcatgcgatcttcttaggtcaaccgcatgggaaaatatatcttcgcatacggctgcgacatgcgggccggccaaccgcatgtgaagatcgattccgcccgtatgcaaaaacgctttctgtagtagtgaacgttgaaggcgggaggagcggcgcgggcgggggaggcggcagcccccccgatggacgcggtgggcgtgccgagccggccgacaacgacgtgaccacacgggagttgggaggcatctgcgtcaagcattctcctgctggttgccgaggcaatcggcaagagacgacagatgaggactgactggactgcgactagcaagcggtagcaacaggcagtgcatgtgtgtactaacatcaagcggcaagccaacaagcaaagggctgactgacagagcaatgctgcagataggcacgcatcgtctcctcgccggacggtggggcggccgcggatggtccaggtacgacgaccctccccacccattcgcacggacggagcgcggccgcggaggagggggacgcgaggggcgggagcctcgctggccctcgagcgccccccgccgccggcgctccagctcccgtccctgcagacatgcgaaggggagagaagagatgtcggatataatcttgacttaattagttgctgcacattatgtgtatgtgcagatgtacgtggtcactgagtcagtcacgtagttagccattacttgatgattgcacgcagatgagctagtgattagttactgcatgtgcgtgtattagtgggagttagttgggttgttagtcgtgtgagctgcttacatatccatgcagtgcatgctgaagttagtgcctagagaataggtcgtgcatgagtggagttggtagctcttttgtgtacataagtactagataaatgaatgaaaatatgtggcatggttgccgagaaagcaagatgtagtttatgtgtccacctctgttcttcctccctacttgtaatattcttgtgtgcgtgtgtctaccaaagagaatttacgtgtttgtgattaacacctagagagtgagaggagatattcctaacaagagagaggagggagagagagagggaggaggatgaagaggagagaggataatatgtgggccccacatgtcagtgggttcacaaatttgctttgaatgataaataggtcccacacatattttttaattctaatgatacctaagcgccacatcaacgccacgtggacagaagatcgagtcaatactgccacataggtgccacgttagtaaaaccgccctccaaaaccgccgagggagtcaaattgcaccggttttaagagttgggggtcgagatatccggttttgtggtttagggtcacagattagatttcgatcacttttgagagtcacgaagtgaacttattccacatcggaatcagttgggcctaccagacaaaaatgggcctccatatcacacctaaagagaggggttgctcaatatataatccaacgcttggtattagctggtctgagctgatccaacgacgccaattaactgatgacgtggatgaataagagggcagcaaattagtattaactgcagtaagtgtggattaatcgtatagatatataggatttttgctatgctgactgcagttctcacgacgaccacggttgttgtcatcattgtgaggatgaggccacgattgttacgatgatgtcagcaaccgttgtcctcattactcctttggttctcgcgcttttccctccatccattgaggtgttgacataagtctatcagcttcatcgtttggcctaaacagtcaaagaataaaccaaaatttaaatttttaaacttaattttgaaattgattttgaaatgcttttaacgtaatttttgttaatgttggcttttaagtcgctacgaataaatctacagaagttttacttataaattaattttaattttctaataagccattttggataaaatgggcaattgatgggagcctacatcattattggggggaggagaattgcgtgttctccatcatcgaggcatagattgatcttgattgtggttctgacttcattattttggccttctgcaccgtcttggttccttgcgggagattggtgatttgctgaatgtcatccctctctttgttgattgttcacagttttaaatgtagtatcgaggttggctgtcatagacttcatatgttccaaccaagctgttgcatctggattggtcgttgcattgttggggatttggtccagcaatccatgtacataggtcaaatgctcggccggtgttagagcagggtttgttggaggagtatgttgtgagaagctaacgtattcaccttcctcatgggatgctcttgctccagcactggttgccgcttccccttgattaggatcattaaccttgtgttccgagttggccccctcatcttttcgcttatgcttatacttatcagccaaaatttaaattttcaaccttaaatttggagttgattttaggattttattcattgtagtttagttttcagcatttgagcctttgcttttatatcgtcaagaacacgtatataaaagttttatgcacaaattatttttcatttgtaattatgttgttttgctttttcctccaatatgcctaatgatggggttgtaaaatagccccatattgcatattcaggcatataaactatcacaaatgaaaattttatcaattagaaagttgtttatctcattgagctatataactttgatatacgtcatgtctctatctgagatcatttaaaaaattcaaaaaaaaattccaaaatagatctcatcatttgtaacgcttatttgaacatgtaaacaatctcaaataaaaatattgaggtctacaactttgatatagggcctatctccattcaagtctgtctgaaaaatttaaaatttatttttcaaaatagatcccatcacttagtgcatattcagacatctaaacgatctcaaataaaaatattatcaattataaaattaactctacaacttttacataaagtctgtctattcgactacatacacatttttttaatacacatttttttatcaaattttataaaaaaaggttgtgatttaaatatattccctcatgtgtgagggttcgtaactgccactcatcatagatcatagatatgtgtgatgtgtcgtagttacgagctattacgatgacgggtcataaatatctttgatgggtcataagcagggcttcccttactgccgtaaccactcttaccgtgggggtacggtaatggttaccggcggtagggtttgatgaattttaaccaaattcaaaatttccaaaacaaatcgaaaaaaacatggatgtagttcttgatttgtagtggcggatggtaaagaaatttgatgaaaaagagtaatataaaataacatttgatggtaaaaccgagagtacattagaaaatggtaaaaaaataatgcaatggacctttaagttgcactgtttatccagcaaattaaggcccaatagtggagaaaatatatatagggtggctgggtgctacatatggacatcattatgatttgaaatgtgaggttgttgaattgacgttgttgacttattatgctatgaattgttgaattgcttcgaagtccataacatagtaaaggacatgctgaatttttgtattt

SEQ ID NO: 62721 - DNA, 2934 bp, Oryza sativa
acgtggtggtgatggtccacgacgagacggcgggcacggcggagctggtggtgctcgacgccgggaagatggaggtggcggcgacgtagcagctcgccgagcagagacttgattaattagttttaggactccctccgttttaggatgtttttgacctttgtcaatatcaaactgctttaatttgactaagtttacagataaatatagtaatatttataatactaaattagtttcaccaaattaataattgaatatattttcatattgaatttgtcttgagttgaaaatgttgctacttttttctacaaacctggtcaaacttaaaacagtttaactttgactaaagtcaaaacgtcttataacctgaaacggagaaagtatttcttattagggggtgtttagatggggttaaaattttttagtccatgtcacatcggatgtttagacattaatttagagtattaaacatatactaataaaaaaaactaatttcataaatgagaactaatccaggaggcgaattttttaagcctaattaatccataattagcaaatctttactgtagcatcacataggctaatcatgtattaattaggctcaaaagatttgtctcgcgaattagtccaaggttatgaaatgtattttataattaatctatgtttaatactctaaatttgcgtccaaacatccggtgtgacagggactaaatttttgtccctagttcccaaacacccccttagtttgttgctaccaggtttaaaatttcagttcgaaatatctgaaattaatttcagtaatttcggaaatccctgcgaactcacaccggcaagcaaatatcttgtacggaatttttggtttttcatatttttatgtaagaatttggttaaaatttattcacatttagtcaaatttattaaatttttaaataatttcgttaaaaaaataaattcccaaaatatttgaaattccggttactactgaaatatcagaaattttggttttcaccaaaattataaacgttggtagctacaagcttctcggatattttgattttttttctatttcaaactaaatatattatcaagttttggaagacaaaacaaatatattatcaaactatatctcatattggatttaatggaacaaaatatttaatgctacgcataatgctattttttttaaaaaatagtaagtttgacttgaaaataaaaatcaaaaggttgtacgaaacaggacgcaccatatgtaggggataaatactctcttcgatcagtaatatatgacactttgaatgtcatagattttttttatgagggcaagtatatctatatatttttgcatgtattaattaacattttgaatctatatatcttcagatcaccaagcgtgtgtgataaacaagcacccgtgtgttgctcggcaaataggtagcctttctcaaactcaaactcaggatgatatttgaactgggctttataatcctttttttttaaaaaaaaaacagttgctcacaaatagataaccttcctcacgccgcctttgttgctgacaaggttatgatatgctcgtgttcatcctcgatatgatttacatgaagaggtcgatcgaggtgtcatatctagaagacatggagatctcatcaacgaaaaatatatgtgtgcaagcactaattgccacaaatatgtcgcatgaatattattagttacatcatcagtttgatggatcatttacatgaattgacatgaacaaacacaatgtacatttgcgctgtgtcaatgctccctccaatcaaagatgtcgcaacaaaacgcatctggacaaaatttcgaggcatcaagtatcaacgccttatgatacaaaattaatgtatggatgcatttgatttagagtgttaccaaattttggtaatgtttttaagagttaaaacttttgaaaattatggtaggatggtattgactaaagtatgtttattaaaatttattgacttaccaaactgtggcaagtttaaaagtgacaacaaaccaaacatgtcttgaatgaatttgtatatgatttagggctcctttaaaacacgggattcgaaaaatataagggtaggctatcacatgttgaatcctacaaggaaaaaaattcacaagaattaacgaaacaccttgattagtaacccaatagaaaaaacagacgaactctagacacaagaaagagaaactatgaggtaagacttcatgttagggggtgtttagatcccactccaaaattttacaccccgtcacatcgaacatttaaacacctatataaaaattaattatagacttaaaaaaataactaattgcacagtttgcgactaatttgcgagacgaatcttttaagcctaattgcgctatgatttgacaatgtggtgctacaatacacatttactaatgacggattaattaggtttaataaattcgtctcgcggtttacaggcgaattctgtaatttgttttgttattagattacatttaatacttcaaatatgtatccgtatatctgatgtgacatgccaaaactttacacccctggatctaaacacagccttaggatttctccaaaaatcccatcaaatggcccattccatagaaattctaaagagacttttcagagttattcttttcttcaaaacagtcacataagaattatttcccctaagaattcaatccttgaaaagtcctccatttcccctttgttccgaaggagtccttagaagacggtgtctatgtccaagactttacataattgcgaccatatagaatatatctcacggtatacgtgaggactgacgtgccatggttctatcatggtacacttgcacagcccccttggaacgatcttatgatcttcggagacaacaatgcctgaaagttgtggagattttagctgcaaatgttaccatc

SEQ ID NO: 62722 - DNA, 4113 bp, Oryza sativa
actaaagaatggtatagaaggtacaacaatgaccaatacaataaacctgaagttttggttagaatcattgcagcaatggacaactgaactattcgtgtacctctccacttctccatatacacaaaggaatggtcgtacatgtgagatgatttacttgctgcaggaccagggcaaggatgcacatcaaaatgatgtatagacacactctttacacaataaaagaaaataaatacaccaaaagggaaaaaaataaaagataataaagcacactctctccaggcaatccattctcctgatccttacatggatgttcaaaattctcttctttgaacagggagaaatggcattcgttgtgtaattgcctcgttgacacctatgagcaaccaagacatttacttactggacctaagaattccaggaagctggatgtcggctgaggtgttgtttcctctgcccttaaaggtagatgtctgaggaatgccctgactacacctgacacaccgtcttcagattccatggccttggcaagctccacggctttttctttcacctgaaattacatgacacaccgacaaagtcattgatcaggtacgaaacagacccatcatacaatgtacaccaccatgccatagaccatcttatccacgctatggaaaaaatactacttttcatcgtatcaaatatttcgatttatgttaattgacacttacataaaaagtacataaaagtaaaatctatatatatctatatcggctggtttacacagcagataatggttatgataacttggtacagtttgtattgaaacaaacagtggaaattgacgactttgtgcaatgcaaaaaataccctgctactgcctattgccaaccattccagcacaaggtaatgttcaattctaaatggtattatcatatcttcagattatttgattattttaaaaaggaaccccaaacctagaatgggtaggatgcggggaatcattatctcctgtgtgaatcaagtccagaaactatttctttcaatgaaatgaactagcaactaggtattccagtatttcatttgagggaagaaaccaggaaagcaaggaaagtgagttatcccaacagaagagaaaaaaactagctagaactttttggcaaagacggtcttaaatactgtggagcaagtaagggtctaatactagagagtaaaagaatagcatttaagtagcacaagtggtgcaatgaattaataaactactccctccgtcccaaattttagggtgcccctttttaagaaaaatcaaacttggtagcttttgactaataatcatactaactatatcaatataagtattatatatgctatatcactagattcatattttgaagtactttcatgtgatgctaatttcatatttgttgggaacatagaatgcaataaaataaataaatagtggtcaaagtatattattgaagaccatgtaaaaaaatatagaccttatagtttgggacagagggagtactactataaatcaacacctgaaaagagagaatttaaataaccattctagggccaaaaaacggatattgccagttctggttttcatcctgaaacaggtgatttgcagcacaaaagctggtccattaatttggaaggcaaaaagtgatataatatataatcttaaaaaacaggtgatataatgcctattcaggtcaaactgcaaatacaagcagatctaaataaatagaaaaccagccaagcaaatagagaccaaacaggataaggctccagagaacactggttttccaaaccctagcgagttcaagacagacagtgcaggagcaactctgttgtcacaaagtaggagcagtatatatgcaatgttggttgtttcggtgaagcaaatgttcgttttttactagacattttgcacatcaacagtccctgatgcgcatgttccattgctacctttttcaactatatatttacaaaaaattgaaacataaatatatgaaagtatttttcattataaatttattaataccattttcacatatcaaatccaaatattttttagcatattaaaatttaagatctcaagacgtaatctacttgagaacggaggtagtagattccctgttaactatttacatttgttggacggttaaacatgtttgaatggaagatatcatgttatgtatgaaagaggaagcattagaaccaagttaaaatgcaccagctagtcagcatatctacgaggggtgaaatctatatattcgcaatcctattgacaacatatatacatccgatccatattcttgttgtctttatacatcttaccaacaaaaataacagcaacattaagaacatatttgaattgtgttgcaaagtagatgttacctttggctccatcatgaagtttatagcatcaaccaatttttgcaagctgaattgatcaactggtataggtagaggccctacccctctagcatgcactcggtctccccagaatggttggtcaccaaagaaaggtacaatagttgtagggcactacaaatcacacaaaggctaggttaggagaactgaatcattttcaagaattagcccaaaaagtagcacaccacctgccagaccctattttttgcaactgtgttaacaggaatttctgaaagttaggtggaattggaactgctgttagagttcataaattcattcaatccagaagtgtaaccccaatttttattagttaagccaggtttttcttttgagagagagaaaggagggagatgggctaagaagggagagagggaataccgctgctttgaggccagcagctgttgttccagcaccgccatgatgtacctacagaagtaaaaaaaaaaaaaaacaaagagtgagctagcctctccctgaacgcacatgcaaacttaacatcataagttctttcaatcaaattagataaatttctaagtaccgttttagtccgtaacaggtacttatgccatgaaagctactcataatcaataactgaaaatttaaattttggtttataatttcactaatcagtactaaaaactattaagaagtaataactactaatctctgaaagttaaacttaaagatatctacttcatgccaagcatgacaagcaaaatgcttaccactgctttacactgcaggaagagccagtcatgggggcagttatcaagtagatatacaaaatcttttggctctgccactgccacaatgttttggagttgtcaggatggaggtaaattacacgtgcacagaaaaaaaaatggcaatgagaaacaaggtcacatcttaagaggtgaacttacatgttccaagcccaccccaacctttgttgatgatacctctctgtccagttatttcaagtgctttgacaatgacttcagtcatctttgctggatcttgaactggctagtatacgaacaaatgaaaggagtgaattttcaaaacacaacaatcatagtatcctaaaattcattaagaaaaaaactgaaccatggaatcactatttgcaagcagctactatgcatgccgcacagatcaacaccaccaaggcaccaacaactcattatcataagcaaaactaacaaggaagttcatccttgtttcctaagtgtacacaactgtttgtacaacattgacctctcccccaaggtcaaatattggaattgcagttgcagaatggccaaaaagatcacagcataacaaaatgtcctgtgtggctatgcttgaagttacttttttcataaatttattctatacaaattgagcatagcattttatgtaacaagcttctctggtgcatcaaagttatggtttccataacaatttgatctcctgacatccatataccattttctagagtaagacataaactattgtgaataacataactattgtttgccatgagatgctatgctaagcttcataagtgacataacagtgtactattagatgtaaatatgcaatggtaaaaaagtgaaaacactgtaaagtgttgtttcatgcagtaaaataaatattccctccatccctaaatatttgacgccgttgactttttaaaacatatttgaccgttcgtcttattcaaaaaat

SEQ ID NO: 62723 - DNA, 1363 bp, Oryza sativa
aattgcagttgcagaatggccaaaaagatcacagcataacaaaatgtcctgtgtggctatgcttgaagttacttttttcagaaatttattctatacaaattgagcatagcattttatgtaacaagcttctctggtgcatcaaagttatggtttccataacaatttgatctcctgacgtccatataccattttctagagtaagacataaactaatgtgaataacataactattgtttgccatgagatgctatgctaagcttcataagtgacataacagtgtactactagatgtaaatatgcaatggtaaaaagtgaaaacactgtaaagtgttgtttcatgcagtaaaataaatatgagttccactaatccacaagctgcattaaccaccgatgtcatttggacaactacagaaatgataacacatgcacacagtcctatctaattagacaagcagttcaaagtttaactatatagtacaagtaaaggtcaacaaattgtgccatcatacatagaagagtagaaacataatacgtcaaatgatgcctagatcagaacaggggaaacaaaaactgaaaacctctaataatacaaatcgagatcaaagtgatcttacaagactaccaaacccaacgtatatgggcttgtcaccagcttcaagccattttataagtggttcaggaggcacataattggaagcaagatcaagaaagcaaaatccaacaacatcaatcttagggccccaatctgcaacagaatagactatgtaattcacagtagaattacagacaattaacaacaaaaattgctcagttaacaccaaaattgagcaggaaacttcaaggttttttccttaacagttaacgcactaatatatccatatcttacaactcatactattgaaaggatatgatagttccttatacacatcagtgattactgaaaaagcataaaatagcttaacaagcattttcctaatgatatattttagaaagaattggatatttgccaccagagtttgcatcagtcatcggtctgccatcggaaatgagcttattgctacagtgccattggtttttcggtggttttgatatatttgctactcctacagcattagaaaacaactaactcctttaggccagcagcctctaaccatcaaaagaaccccggggataggtacatgacccaaaaaaagaatgctctccacacctttcttcatttctcctctctactctctcccatattttttcctctcacatcaatcggctgcactcattgccaaccatgcatggcactccttgtcagctgaggatcccctccatgggtcgtggagctatctccatcagccatctccacctttgaaag

SEQ ID NO: 62724 - DNA, 9681 bp, Oryza sativa
aaccccccccccccccccaaacaataaaaggaagtactaaaggaccctatcctatttcctgtgttaacatgaagtttggatgtccacatacacaaaatgtccatatctgacgttaaatttcattggaattactctctctgtcccaaaatataagcatttttagcatggtgacaagtcaaacattttcaactttgactattaatagcaaaaaaaaagatcaatcatgtcaaatttatgttactagatttattattaaacaaactatcataatatgtaactctttttatttaaaacatcttccttttatagatattgctggtcaaagtagcatctcggagaccgtgtcagagttcaaaagttcttatattttgggacggagggagtagcaaattttcatgctcattaccaattagaaaaatgtggtatcaaactgaaaggctaccaatttcagttggcattactaatattgacttggttcacagtgttatcacagcaaatactcaagcaagctcttttcaatacaacaactgaatgctataagaaagtcaaatgaaaagaaaccataggaccagattaaggtccacaagttttaaaaactatacaatcgaaggatgacaaggttaagcatgacgtgaaaagggataacatataaatttcagataaagctaatactcatcaggaacctttcggttttggaacaaggtgaggactccagatgtaaccatgaggaatgtcattcccagaaccctgtgcaccacttaggtatgttaccggacgcaacttcagcttcttcttcctaaattcatttatcatatctcggataccaagccaaatcatagagtcaacaatttgataagaaagctgcaagtgtaaaccatttgaagattagataacaaatcagatcagaagaaaatgagtgatttgagaatgaatctttcaacaagtgcttgatgtgagttagggagatgatctctaactttgacatgtggtgcatggttgtttttagggaatgcagcaaaattgcaacctatttaattacaagaattactataaattggatcaaggtcccttgcaacctaaagagcactcccaagaacaccagccacactgaatgaagccagaaactaactctctgcatacagtaactcacttgagtttaccacccaaatcagtctaacaacaaacgagcacaagcaggcaggccaaaattgtcagagttgggatcctatcccagtagtatgcacaacaatgcaaacaaagtaagcacaacaaaacctattgtctgattgccatttacaaaataacagttcaagccatttcaaatatctctactattataaaaattgaagatgtttccaccggaattttggtacgtatccaattcgacatgagtctaaaataactattgtagacccccccccccccggcccagcccaacccaaggtcccaagcctttttttctcttttttttttcttctttgccttttcttctctcctgatcatcctgatttctccctctccttccaatctctgttttctgataaactttagctcaatattttagaaaactgcaacattagtgcacaattttatcagaaaactgcaactccatccccatttgtgtccaataggttggcccaatctgtaaaggccctattgcatgttgctaacagaatgtcggttctctaataaaacctacactttttgcagttccttgaaatgcccagctaaagttgaagatagttttgacagaatagttgcactttctgaaatttactctggcattaacccatgtaataatgaatagttcagatacaatccgtgggcaagaacatgttaaggacatagcctattattacacatatgcacaagcgtgcacatgcctatggccagcagactagccatctgcgcaccaaacaaattacagccaggtgttctgcatcttaatctatctgttggcacattgttcagttggataaggtctttgcttaattatgggttagtcacctacttaagaaggcagccagatatagtaatcgaacgcaagaaagaacaaataaaatctaatctcatctaagtgttcgtcatatataatgttctctcatcacaagcagctgacactgccagctatcctccctgcagtgtctgccgcatttaatagtataaggatcattatgtattgattaaaagagaatgtaagctcccggcaaccttttttgtagtatttctttcagttcatcaattagcatactgactaagaaatgggaaatcgaagatcaatccttgcctgccattttctaacatatgattaacgctatgcttagttgcttactccaaaaagaagtattcctgaggcctatgccataaaaccaactgcagttttcaataagcctaagtgtcacaaaatatgatagttaatcaattagacgcggttgatgaaaaatgggaaatgtctaaagcccttagaatgctgcttctattcttccatgtcccaaatcagaaatacccctctaaatcaactataaggttcaaggattaaagatctactgaccttgaaaatattgaacttaaactataaatgcgaaaatgtataacagcaaacagcagagtgttttctttcttatgttcttagaatatatttccatagatactcatatctctttttgttctttcatgaggcttagaaagggcattcccagacaaatcattcaagtatgtgttgtttatcctttctgtgaaatttacaatgatccagaatggcctacaccacagtattagtttgtagtatgtgccaatgctgtgggtttggttcaaattaagagatggttatgggctcaaacctataattaagctacccaccaaaaaaggcatagagtaagctaaccaccacaatataagcactaatgattctgttttttctactgttaatgaagcaaaaccacatatctagcctaatggcaattgcatttaaactgtctaagtttgctgccaaaaacaaaatcaggtttagctaacacagctgggttatgccggtagggttaatttaatcattgagcaactataacaaatgtgtctaagagaagaagtttaaaatatttcctgaataaatatgtaagatgcaaactcactcgatatccagccgcttgtttcacacgagaaagaggatgggggaattcactagttggcctgaacaagcagcacaagttagatctccaaatgagaatattcctcagcaaatgtgctcttcaaagaggaagcagaacaatagtgactcacgtccatggcatggtaaagaatatatgaataggtacttttagtgcctctgccacatgagtatgtcctgaataatcgttaaggtcagcagcaaagaaacatttataaattttcatagaagtgaattgcaattggctactggaccataaaatacaaaacatgcaaaaaaattcacactagagcaccttgtaaacacatcattgcctaatcatttgagctggaaatgactatgattggttccaaagtgataaacacagaaaaatcctgaaaagagatgcctccagaaagattggcgaaacagaaagagcttttaaagatgtcaacttcccaagtatattactaggtcagtctgcctattaattgcacaccaaagaaaagcaccaccatcataaggcatgaatcaagaaatgattgttctgaaatggatgcctcaaatcagaaaaataaaccaaattgaagcagtaagaaagaattgtacatgagcaaacttataaaaatttaagatcttttcgttttaaaaaatatatgatcttgactggaccataaaatatgatgacgctgatcccgttggatcctaacgtgcataggatcttttcaattctgacgaccatgcaaattagtaacttataacatataaccttcacagtaacaattttcacagtgcaatactaagactccaagcatgtcaggacaaaaaaaaaatcctgccttggatcctgatcctcacaaccttgtatatgagtatgtcagaaattggtgttttttagagtagtaggtacttagttgagcatataataaacaaacttggagttacacttgtaaggtagagagaaagtaaagcaaagcgcaagaaatcaatccaaagctggtaagatatactgaccatatgctggagggttagcaatgatagcatccactttgaaaggaataccagtgtcaggatcaggctccttgcacgcaggtagcaaagagaatataatttctttcatctgtttcctctgaataggaatttctgaaggaccagaaggcaagaatcctttattcttcaccatgtctgctcaaatatgaatataccaaatatattaatcatcgtgacgtagaaactgaaaaaaaatcaactatgtgaatacaaggatttattttcatacattcagcaagtatttttggatcaccgccaagagggaaaaactccagaccagccgttagaacgaactccttaaagtttgcatgggttgccaatctcacacggtgtccataatcctaaaaaaaacaggtaatggataatcctagtcatacagaaaccatgtatttagaaacattaagcttgagaagcaaaatagttcacctgatgagagataaaataatgtgaaattaacaaacaatggtagcttttgatctaacctgtaagcgtttgcctatagcaatgaatggctgaacatcacctcttgtgcccacaataagaataacaatatccataggaggcctcacagatatgtctgctccatccaatggttcctcaacagtaacatcactatagccatcatatgctacaccatcagttgtacttgtttccagagaacttggcacatcaaccaccacagttccatcatctttcactgtagctatccgatttagcatttcgagctacaataaaatgtaaaatatcacaaaaaactgttgaacaacatcaagcatccagatacaaaagagtacatctggcactgagttcctgactattcgaagctaccatgcagtgtatcacaatacacaattgttgtgaaaaaaaggctgaattggctgcataataatctgaataatcaactatttttcaatcagttggaatgtttctcaagtttaatcgtaaaatagactttactccctaattacagtgaactaatctctgatctcatgtagtagtgtttgctttggagatgaagcagtgaagcacaaaatacaacatgtcaagcttagcaagtgctgtttttaagtggttataacatgtcataattttcatgttttaattgactttagttataaataaataaattagtagagcataactatcaaaattctgattaatcagcagtatcacacataatcgtttaacagatatagctatcttagccctcacctctgcaacaggctcctagccctttttcacaatgctgcattatactaaaatgtatcaaattcagatatagctatcttgtccgcgctcagaagataaggctaacagttcacgtgactgttcaaaatggcttctcttatatgaacatatacatgctccaaatttcaaaggtcaaatgcatgaagaaaaggaagctacaagggtaaatagatgaaacagggtgcattgcaaatgaaggaaaggcaagacataggcaacaggactatgttatccgcaccttcttttttagggaaattttatcatcaaataactgtttagtaggatcatcagctggattgttttgtcgacgcctctctgttcttgatctttccagattagatggaccagcagtttcattggttatttcaacattattaatcccacctggcatagtgcttgatctggggaggcccctgtcatctacaaaaacataatgatggtttgaaaaatatggatgacaacattccttttattttacactatcataacttactgaacaaagtgagattaaaatgtatcaacaaaagatatatttgcactatgatttgaggtttgctgcagtaaattatcctttaaaaaatgatacaactataaacaccactgcataatcctattgaacacaactcacaagccacatggtacaactaagcctagcagtgttaccctgagtagtgagtagagcatactttcacactgtgcaatggacctacaatattgtgtaataaccagagctgaagagcacaacctgcttgacagtgtaaacaaaattacaataagtttagttcattggggtttcgatgtaatctaaccctccaaaacggcttcgttttgtgaagagatttgagaaaaccattattcagaaaggtaaaatctaggagaaggcaggccatcacccactagtcgtggagtcaacgcctaaaattagcactcaacacagcaccaaacccccacaccaaaccctcacacgcagcattcccagcaaccagcgtgacacagacagtgaagcagccatcagagtgtccaccaacaaggcgaaggtgcgctcgcaactagcagccatccacatgagcggagatggcagaagccgccgcagatttgggggggcgaagctgaactagggaaggcaaagcaaccgccaccaatcccaacaccctaggttgcctctcgcagcaaagctacacgaacgaagacgaaaggagagaggcaggcggggtgtggggggtacggatggatggatcaccagcgggggaagacgacgaggccgcggccgcggcggaggcggaggcggtggcggtggcggggttgtcgccgccgttggcgctggctcctcctcctccttcctccacgcccttggcctcctcggcggcggaggccatttgtagccgctctctctcacacacgcggatgtaggcgggcgcggtggaactccggcgccgcccccgccgccgccgccgtggagcaccgacgccgaggcaaaaagcgaagatgcgtctctgaaatcgaatgcctttgctttgctgtgttgctacgtgcgtgctctgctgtgatctcttctccttcttttttcttttcttttctttttcatttttttagagtaattttttctttgggtcaccttttattaccggttgtcgaggagtgatcctctccagcgggagatcatgagatccccttttgtgagttcggccgagggaaaaggctcgcttttcgagattgcgtatccgccctgaatgctgctaatcgcgtatgggcgataagattatacaggttcgggccgctatcgagcgtaataccctactcctgtgtgtgagattatggtcgagtgttacaagggttccaaaactccggagagcactctcgctcttctttccctagagttcaggcctactgagtggcgttccccttcccggtggacaaggtcctccttttatagttcaaggggataccacatgcaccgcttctacctactctttctacgggagggggacccactctaccttgaccggaccgcgattcgtgccttcgcccggaagctaaaaagcggtccgcccttcagtgtcacccggtgccgccccccacctgacacgggggacagccctgtcactcactcttaaatgggcggagacttgtggctgccctccttacggggagagaactccggatgatgctccgatgtgacaggacatacctacctccactccgccggatacagaggcgacgtgggggcacggccgcctgtccagtcagatgtgaccgacgacaggccggtcacagactggtcagacccgactgacgtgcatcagtcgggcggcaccgcatgtctgcccttaccgcattaaatgcggtgaggggcagttggggcgccgcgcgcattgatagcggcttggcttgggtctcctccccgctcgctccccccgccacatggcagttgggcgagggcctcagggcgagtcagcgcgggggcccgaggggcgtgatgtggcaccccgaggccccctggctgcccctgcgtctcccgaggcgcggggggagggccaaactgtagagtcacgtggctggatgggaaggtaacttcccctcactttgcatacccccgggcccatatctccgacagtagcccccggcaccacgtcggacattggtcccctgagggcagtctgacgtggcgcctcacgacttaccgtgccgaggttgtgggcccgacgaggactccagacggttgccggcggcaaccaggatggcacattagccaaaatggcgatttgaccgccactgaccacgctgatgatgggggcacttagggcgcgaaaatcgggggtttggtcagaccatgcccagaatcgctatttacgccgcctcgactcccccgcctgtcaagcatgcgatgggaccaatggcgggcccgcctaaccgtgcctgtgagcatcgcacgccccacgccgagtgtgccgctgacaagcgcactaaacgcgggacgcgggctccgcggggcaacgtgatgagtgggcgcgagatttgaggaggcaaccgcaggcgcaggaatcgagggggcaaccgtaggggtgtgaaacgaggaggcgagtgcgggcgaggggtggataaaaggaaggggaggcggagagttcgtcccctttctctcgccaactgcatactcgcatactcgctcctaaagccctagcgctcctctcgctccaccctgctccatacaccaagctcctcgccgttttcccgccggccatcatggcccaagacgctggtgacgccgtccttccggcattgcgcatcacggcggagaggcaccttagcctcatccgcaagatcatgccggaggatgccgccgtgagggtgggggagtcgcggctgcggccgcggtaccccgacgatccgtgcacctcctgtccttcgccatggtggggttgatcccaccattttccaggttcttccatgaggttttggatttctacgaaattcacgccttccacctcgcgcccaacgtcgtgatgactctggccatcttagcgcacttgtgcgagatgttcatcggggtgcggccgacgatgcggcagttcctgtccttcttcgtcccatggctgctgcaaggcgcggtggtggggggatgctgcttccagccccggccgggcacggcggggcaatacattgagagtcacctatgcaagaagtgggaggattggaagaaggattggttctacaccgcgctgccggaccatccacgacttcggctccccgccggccctcccgaacgatccgccacgtggttggtagtttcggaactaggcgaggagtacgacgcagtgcgggatcgcctcaggggcctgcgaagccagggcctaacgggggcgatggtgttcggtgactacttccgtcgtcgcatcgcgcctctccaggagcggtctcgcggcgcgtgggagtacactaggtacaacgatcccatgcgcacccatgtgggtgagcactgggactgggcgaggaggacgcgaagacggtgatccggcgggtgctgggcctggacactgtcgagcaaacgctgactccggacgggatcctccccttatgcagcttccgcgaccgggagagtatcctggctgtgatgtcggccgtcggcgccggcaggggtcggtcccgtcggggcggcgccggtggcggcgccgtcggcgcgggtagcagcagcgcgtccgcaggcggcagccgaaccggcaactccggcggggacggcgacttca

SEQ ID NO: 62725 - DNA, 4067 bp, Oryza sativa
acgggggcaactgttcccctctgcatctggggcgccctcgaggctggccgcgcggaaggggggctgagagcagcccccagtcccgcggggggtccagcagcactctgtcatctcgggggcggaccgtgactttttcttccctgactcccgcgagcatagagccactcctgtaggtgctcgccgccgccgactccatcgtctgggaggggctcaatgcccaagttcaagccctggcggacgagcgggcggccctagaggcggagtgggcgcagctcgcggcggaccgcgcacgggttgacgaggggcgccgcgccgtggacgacatggtggaggtggggcacaaaatgcgccaagcccaaccggcggagatccaggcgcgtgaagagacgctggactcggtcatgcgggagacggaggaggagcggcaggcggcgctcatcgcctcgagcgtcttggatgaggcgctgggcgacatccgtttgcagtacgagacccacgccgaggatctggcgaagagagtcgaagacacccgcggagtcctcgacgctgctgccgcccaagagcggcgggcgtcggaggtcgacgcctcgctgcgggctcagtcggcggcgctcgaggccgagcgcaaggtcttagacgagcgtgcccgctccgcgcaagagttcgaggccacgatccatcgacgaattgaggtccttgaccgtaaccagcgcgagcaggacgagcgcagctggaaacaggcgcagcaagcccgggagcttgaggagcacgctcgggcactggaggagcatacccgggcactagaagagcgggcgcgcatgctagaccagtgcgagaccactttggccgcccacgagagaacggcggccgaggcagagtcctcccttcgcctccgtgaggaggccgcagccgagcgcaaccggaccacccttgccgtagaggcttcggtggcccatcgcgcggaggagctgcggcttcgagaggaggcatgccaggaacgggacgccacgcttgccgtacgcgaggccgaggagaaccgccgtggggtggcggcgcgctggctgggtgagcaactcgcgaagcgcgaggaggccgttaccgggcacgaggcccggcatctagaaagtgcccgcgctgagcgcgaggcaatggcaacgaggtcttccgagctggaggcccaggagaaggagctagaggtaggcgggcaactcgctggcgcggagttggtgagccagctcaccgcggctcaaagcactctcgccgacctggggcgcctggtgcaggaccaagtcggggagatcacagcccttcgcctcaccaacgagattggacctggccaactctccgacgccgtcgaccggctggggcgcgcggggcgccgaataggcatctccgtgcgccaggacaggaaactcccgcccacacagccggcagtcgtgctccggctggatgggatggcggcggatttggagaggctagaggaggaggtcggcgaaaccgtgaagtcgtcgtcagctttggcgcaggctatggtggagctggtcctcgcaagtcatcaagctcgtgacaacgacttcctcccgtggcgcgcgctcgaggacttccccccggggacctaggcgagggctcgggagcaagtctgggaggcggccgacgtaatcgtctccagcttcgacgggtcggcccctcggttcaacctcgcgcttgcttcagacgaggagagcgggagcgaggacggtggtggcgatgatggcggcgaggactgggacgaggtggtcagcggcgccggactcaggggcccgggcactccgtgactatccccgcttttcttctttcatcgtggtgatgtactcgcggtgaacgcttcaaactttatgccatcgtgccatcctgtttgcaaataaagcttaccctcgcacctttacgtttttgcttccgcctttcaatgtctgcggcaaggagagaaggaaaaaccaaagcgaacgtattcaattaactttcttatgattaagttgtcgttcttaccccctttatacccccctcgggctcgttctggtgaaaagggaaactcacgctcggtccgtggtacctaggtggcgaggggcaatgccgtcgccccgagaaagctgcccagcgggtctggccaaaccggggctacgcgaccgggggtcggggatggccgtgtgaaggcccttccgagcccccagggttcgccgcagcccggggcgcggcccgcgtttaggctccctttcggcggttttcaggccgcccaatgccacttagggtccggagtaagcgcgaatcgtcctttaaacccggacaagccataggaaggagtaagaaagggtacacaacggcttccacttgagcagaaaaatttattgctggggaaggaacaagatacaacatatttaacagtggtagccccaggccaagcccgcacaagccgaaggatgtgcgggggttggcccgagcaccatgaaagcgaaagacgcgcgaccctatggatagaaacggcggaggttttcgatattctaggggttaggcaaccccgtgccgtcctcgtggttagtcgaacggagcccggccggggaacgccaacactttttatggcccttcccacattggtgagagcttgctcagtcccaagcgcgactgcacgcgacataggacgaggtcgccgacttgtagtgatcgggccaggacgtggcgctggtggtagcgccgctcgcagggttgcacgccttctgcattcttctaaatagtcgagatcgtcacggcgaagatcatcctggttggcctcatcgtacagcacgacgcgaggcgaacctagggagagctcggaaggtaggactgcttcggcaccatagaccaggaaaaagggcgtttccccggtggggcgacttggagtggtccgattcgcccacagcacggcaggcagttcctccagccatgaatccctgtgcttctttaggacgttgtacgtcttggtcttgaggcctttgaggattttggtgttggctcgctcgacttggccgttgctcttggggtcaccgaaaagctcattggtgaactaggtgccgttatccgtaatgatacggttgggcaccccgaaccgggatgaaatgcccctgatgaacttcagggcggaatgcttgtcgatcttgacgaccgggtaagcctcgggccatttggtgaacttgtcgatggcgacgtacaggtgctaatacccgccttgggccgctttgaagggtcctaggatgtctagccccaagaccgcgaaaggccaagagagcgggatgacctgcaaggcttgggccagctgatgggtttgcttggcgtggaactggcacgccttgcaccgccagacccattctggggcatcttgcaacgcggtcggccagtaaaaaccttgtcggaaggctttaccgaccaatgtgcgtgaggccgaataggccccacactcaccctgatgagcgtcggcgatgagctcaacaccttgctcccgagaaatacacttcaagagtatcccgttggcggcacgccggtagagggtcccttctacgagcacgtattgcttagagatacgcgtgagcttctcaggttttgcgcgaccctcaggaagagtattattgtcggatgcccattccggccaccgccctcaatcctgctaggagtccttcgtattccgccatattgttcatggctcggaaatcgagttgaacgacgtactttaggacatccccgcttggcgaagtcagcgtgactccgacccccgcgccctgaaggtggagggagccgtcgaagtgcataacccagtacccggcgcgaatgtcggcgtttgggtctcctccgtctccggggaggaagggaacattagacggaacagggtcgtccaccggggtccactccgcgatgaagtcagctagaacctggtttttgatcgcgtgccgcggtttggagtgcaggtcgaactcagcgagctcaatggcccactttacgacccgaccggtcccctcccggttgtgaaagatttggccgagagggtaagatgtcacgacggaaat

SEQ ID NO: 62726 - DNA, 3186 bp, Oryza sativa
ctggtcccttatcatagatgggctcacaacgcgggtcgccctagtcgcgctcaactacaagggcggcactcaccgtgtgggaggtcgcgaccaagtagagcagcaacggtttctctggccccggggccaccaagatggggggagaagtgaggtaagctttcaactgattgagagcttgcaccgtccacacaaacggctcggggcatttgaggagcttgaataggggcaacgccctctctcccagcctcgatatgaatcgacttagggcggccatgcatctcgtgacgcactgcacatccctaagtttgctggggggcgcatcctctctatcacgcgtattttctcgggattagcttctatgcctcgggaggagacaagaaaaccgaggagtttgcccgccggcacaccgaacacgcacttttcggggttcagtttcatgcacgtggacctaagactgtcgaaagtcttggccaaatcctgcaacaatgtgtcctggtggcgtgtctttaccaccaagtcatcgacatacgcctctatattgcgccctatttgattactcaaagtaatgcgagtcatgcgctgaaaagtaggacctatgttcttgaggccaaaaggcatagttgtataacagaaggtgcctacaggagtaatgaaagtagttttttccttatcttccctagccatgcggatctggtgatacccggagtaggcatctaagaaagacaaaaggtcgcaccccgcagtggagtcgactatctgatctatgcgcggtaaagggaagggatccttagggcatgccttgttgaggtctctgtagtcaatgcacatctggagcttgctgttggccttcgggacgaccaccgggttcgccagccactccgggtggatgacttctcggatgaagccggcctccaggagccgcgtcacctcctcgcggatgaaggcttgccgctccggggcttggcgccgtaccttctgccggatgggtcacgcacccggccgcacggtgaggcggtgctcgatcacctccctggggatcccgggcatatccgacggcttccacgcgaagacgtcggagttcgcccgcaggaaggagatgaacgtgctttcctatttggcgtccaaggtgccaccaatcttggcggtcttggacggatcatcgccaaggagaatctccttgacgggcacctcatcggccgaggcgaggcgcttcttggaagcgcgggacgcagaggcctccggggcctgcggcttcgtggccgccgccaggttatcagtgcgctgctccgcgcaggcgagggcgaccttgacatcgccacagacggtgatggggccgttgggacctggcatcttcatctggtggtaggtgtagtgggtggtggccatgaacttcaccaacgcgggcctgccctggaccgcgttgtagggcaggttgaggtccgccacatcgaagtcgatccgctcggtgcggaagttggtggagtcgccaaaggtcaccgtgagctcaacatgacccaggggccacgtgtgacccggggtcatgccgatgatcggcaatgacggctggagcttcatccccggggacttgagcgcatcaaaggcagccgaggagatgatgctcaggctgccccccccctccgtcgaccaggacacgcttcatcttgacgttgtggatggtgggggagaccacgagggccaacttccctccctgagcgagcactgtcagatggtcgctctggtcgaaggtgagtttcatctctgaccagcgcgccttccgtgccgcctcgtgagttgggacggcagccagaagctcacacctcatggccttgaaaccgcggcgggaggtgtgagcgcaagcccccctatcaagagtggtgacggttccctaaggtatttggaattccagatcctcactgttgtcgctgtcatctggggggccttcttcttggcctcccctcgccggtcattggcaggggtcgcgggggctttgccctcccgtcgactctgccgcttctcctcatcggttttccggaaccgctcagccaagttcttgaccgagcggcagtcggcgaggctgtgccgataagtgttgtgcaccgagcaccacttgtctgccgaccgaccctcgccagagggagcggtggagcttggcttgtcgccggtggctttctccttgcgcggggcccgtgagggcccatcggccgcaaggacgtggccctcgtcgtcggagcgggccggcttccttttgcccctcctatctcgccgcttagagtggggaacagattcgggggcagccgcagccgccgcgccggtgctgggggagttccagacccacgcctcctccttccgaaccaccttgtccgccagctcgaagagctcggcggtggtcttgggctccttggaggcgatcttctctagcatgcggttgtgccgcacgccgttccgaaacgcataaacgactgcgtgggccggaatgcacgaaatagtgttgcggacctggcaaaaacgatgtatatacgagcggagggactcatcagccttccgctgcacagcatgcaggtccgcctcctctcctaggcaggggtacgtgccttggaacttcataatgaactgctggcacaggtccttccaggagtggatggagtcggtgtcacgtcctgataaattcatcccgaaataaaaatcattctctaaaaggaataatagaattaattaaaattcgaaaagaaattggcaaaccctaaaatacgtacaagaaaaattcaaatgtggcccggagaatttttgttaaattctccttggcctaaaaggagccctcaaattttagtggaattttcagagcacaaataataattgaaaagaaataaacaaagttgaaaaggtttataaaaagaaaaatcctaaaagaagttctttccccccctctcctttttccttcttgggccggctcggcccagtccctccctctctctctctcttcccccgcggcccatcggcctccctcgcgcgcgcgcgccgctgacaggtgggcccgcccgccactctcgctgacgggtgggacccacctgtcatctccctcctcgcgccgcagccgccgcccgcccgtgccctagcgccgccgtcgccgccaaatccgccgcatcccgccgtccccgcgcgcattgaagtggggggaattactccccg

SEQ ID NO: 62727 - DNA, 1206 bp, Oryza sativa
ggccccacttcccgtggacccggtccgcgcgccgctccctcggctgacgcaataaatgggatttttaattaaaaattaaatgaagaaattcgcaaatatccatttaaagagcatataaacttcaaatggccatatcttggccatttgaactcggaattggaccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagtcgaagccgtcgtttgggaaagcgagcaaggcaagtcacatcatccttgagcatattgaatcccagtttataaaattaatttgatttaaattaatgcattatcgctttatttaaattcccgcgttatcactgttttatttagccatgcctatttacctttgttaggaccatactattattgttattgttattattaccttgttcaccctagaataaacaaaaccccaactagtggacactctatttatggttccactagtatgaatttaggtagatgcttcgccgattaataggacaacattaggtggttttataattttagactttgggaatattcatatcacctggacactatgaattgttggtttatggtggaattggacatacacctctcttcctctttcaaaacccctaaaacctattttcggtggggtttgggtgcatgccagttgtgggaagtagcaccccggccactataaggattaagctcgggcctctgttgcaaagcactaccgtacttccacatgtctagtgggtaaggcttagtttgtggctcaatctagtcataaacaaaagtacacggattggagatggatgaagtcgggggtcgatggacattctccagggcaaatgaaggctacacgagctgcggcccggtagtcgagatgtcatatggcagagggttggtgccctgctgctagggggctcagtcctgcctgcctgtcccgggtgtcccggccgtaggaggattgggtcggtactcttgattatggctaggatgggttgggaactatgtcacgtcttccgtccgtataccgtggtggtatgtggcacgtggttgcacgtgaggaagatgtgtcttgtgggtaaagatgtacacctctgatcagag

SEQ ID NO: 62728 - DNA, 1273 bp, Oryza sativa
ccttgggttaagcaggttcgtgagggttcacggccttgattaataatactgtgtagctctaggatcgtctttataaaatggctttggggcaactaagtgacttttaaatgccgtttactgcaaaacttaacccctatattattattcccttgtacctcccttgcattaattatgcatccgccggtgtggcttgctgagtactgtggttgtactcattcttgctcaatcttttcccccttcagtaagagaagctttggagaagatgtcttaggtggagtcctggcttataccccagttgagcgcctgtgaagatggagccgtaggcccgctagtccgctgctgtttatttttgattgtcaggccttatgtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacagtcggggggctgggtcatgagccagccgcgcgcctgacccttgagagccatggggaaataattcgccatgacctggtcgtgccccccccatccccccgccgccacgatgatcatggtatagatctggaggaactcggagtgattgatgttgccatcatacttctccgtgaggttggggcgaaacttcgggggccaccggacattccggagactcgcaacgaaggccctacaaccagtccctccaaggtgaacgtggggggcgggccgcctcgcgaggaggaacgtggcactctagacgaggaggcgccttctcccatgcgggcagcgcggcgctcatcccggcgtcgctcgatgttgattcgagcgtcctgttccccgtagaggccgtcgtgatgtcttcgacttcccgaggcccccggcgacgttggggccgtggatcgcctcgaggccgtggccgaccgatgggccctcctccttgctgacgaggagagggtggtgggggtacgcgatgtaccagcagcggtgggccggccggccgcggccaactgccgctgggcagtggtgactaggttggccacgtcgtctaaccatcgctggacgggggtctctggccctgagttcacggggggatgccgtagaagggcacccgccgcgtgaagcgcgcctcggggcgagccgccgtcgccataagtgaggcggtgtcgcacccgacgcgacgtggcttccccccgcccgtaggcggggagtgggccgagccacccgac

SEQ ID NO: 62729 - DNA, 3054 bp, Oryza sativa
  unsure (1)..(3054): unsure at all n locations
atagagatacactccctctgattacaaatatatagcgttttggtgactgtatcgctatttaaaatgttacttatttacatgtagagatagcacttgctattttcattaaatgataggttttgtagtactcactattcccactaaatgatacttatttacgatggccaagcaatacaccagggactgcaaatactacaccaataagcccaaacaaagatgactcaagacctaagagcaattactataaggctttaagtgcttcctctagaagtgttacatgggattaggtgatggtggagtagagaagtgagaagggagagaggacgagccacctctcatacaacgggcaatatctatgcaatctccaagaaaagtgtaaagagaaagtgtaatagtgtgaaagtgaaccaacaatataaaattatgggttaattggatccatgccactgtaattttgtcatattagataattccactactattcacgaaatctgctacgtgccattacaactttgtaaaattagatccatgccaccgccgtcacatttttcatccatcgccgtcacacttcagtgtgggattgggacccacatgtcagctccatcctcttcctccatcccctctctccttccttccccatctctcttcggcgagcatggccgacgaataccagcagcatgtggccggcaacagcagtagcagcagcagcagtagccggccgatggcggcagcgagggtcacgaacgccgtcgcgtcctccgtgcaccccacgttctgcacccacctgtgccgcaatgccgcacggggcactccatgcggaaggcccgtgtctccgttcgagctcgctccgatgcacccatggtgtgtgtgctcgatcatgttccatatgcagctagtgttcttcttcttcttcgcatggatgtttgtgttgagatgtcgatatggtgatgacgcagactnncagcgattgggtgtccatatgngcaggaagctattgggctacgaagcatgtgcgcaacgggaaaccccttgcccgcgtgcgtattaccggtgcaccgtggccgtcggctgcccggcggcggtggccaagtcgtcatccgccaatgccgcgaccacggagatgctcgagctcttgcgggatttcagtgactactcgagcttcaactcggatatctcaagtgagctcgagcggcttgcggcggcggtgacgcctagatctgacgcgccgcaggtggctgctgtggatctgaacggcggcagcagcagcagtagcaggctgacgacgacgacgccaccaccactgctgcaacttggatgccggcaagccctccccttcatagtccccaccggtagatgcgcttctctcgccgccgtcgtcgaggaaatcagcggccggcgtgcttctccgccatggatgtcggcagctggtgatgcgggtgagagagaggaaggggaaagagaggggagggaggtgggtcccatgcgcagttggattctaacatggatttttaacggaaaatgcgatggaatggcatggttccaatttcgccaaattccagtggcacgtagccgatatcgcgaatagtagtggcatttttccgaattgacatatttgcagtggcatggatccaattaacccttattataagggtatgtgtagtgaagagtagataacacggctaaaattagatgtagtatccacctctacataaaacttgctctaaaggctttttttcccttctaaagctataggttactactacattaatggactgaaagctagatttgagttgcttttcttggcttattatgtgaagtggagttaggaaactactcttgaccttgtgggttttaagctattggcttataaaccacaaaagtcaaaataccaacttaactactccctcaatgccagaaagttagctgttttaaggattaatgtacaaattaacaccaagtaaaaatgataccctcatattactcttatttgttagtcgcagtgataccctcatatgagaatcacgtcaccgaagtctctacttgcgtgaagcattcctcctctcacaccgatattgaccgtctcaggctaagtatcacaaccccgttccatgattatgacgttattaccctcattgataaaatcatcaatccgttattctggtgttaataatatatttaacccatatccatcaaaccaacatgtctcaaatgattataaaacatagagatgcgattaaaattagggggagcattaccatatttctcccaaggttcataatatcattcaagtgtcccatacagatggtggcacgatggctactttgattaacaaaagtactaacctcctgccaaattctgctagaactaagatgagtaggatcaccatatatatacaaaagattaaacatcgtgccactagggatatgaaacacctacagctactatataattggcacaactactcatcgcagtgaggtccacttcattattccacaaaagccacaaaccaccagaagcatggacaacaggaactatatagctattatctacatgaaaagcatcagtgagatcagaggaagtgaaagaatcattttttgtttcagaaataaatattacctgagcgagagtggagctgatcaaactacggaggtactgcatcttcctcctgccgaggtgtcctcccatacctcggcagttccagctcaagaaagtcatggtgcctgtggcaccttgtgggctggcgccaactgcccttgagaagtgagccgacctttctccaatcccaagtaatccccatgtgcaagaagctgatcttgaggctgagtttgcaaaagttttcctcgaggaacgctagccacatcatgcccagaaacagaacaacatcccccgatcgtagcaggagaaccataattcctagcagcttgagccccagccaaataagccatacctaaagtcaggtgcgacttgactctgtggagaaactgagacttgcttccttctgattgagctcgatcatccacttcttgataaaagagcttgtcatttcttccatag

SEQ ID NO: 62730 - DNA, 1660 bp, Oryza sativa
tttttaaacctgcctgcttatttaagggggaggtgagtgcattagatgctctctcacaagttaacggaccaatacacggcaactaatcggcgcttgagtacacgagttgagtccagccgcagaagatccacccgcccgaccaggtttcgtttcgatttttcttttctgggtccttcattctcttctgggcggcaccatgtcgagcggcggcggcgcggcggcggcggtggacccggaggcggcgacggagctggtgcggaagggcgccacgctcctcctcctcgacgtgccccagcgcaccctcctcggcgtcgacacccaggttggtttccctaaaccctaaaccccaccttttctcctcgctaggctaattcttgcgtgctgctgcttttgattcgattcggttcaggtgttctccgtcgggcccaagttcaaggggatcaagatggtgcctccggggccgcatttcctctactactgctcccccaacaggttgcattgcgtcatcccatttctctatttcttagatttatcacaccgtcagtcaacttgtgcagagttgtttagccagcaagtgctgagtgatatgcatgtaaggttgatttttttttaaaaaaattattaaaagaaccttgctagtgtactagtgtagcatcatcaattggatcggatagctcgattctaccttccattttgacaagacaatcttagcgaagcgtaattaactacctagtgcttctttgggtcacaacagtttgtgtactgatcagtgttttcaagtcgtccgattagtcgcgactaatcatgattagttatccttatcgctaccctgacctcgatcatgaactttgaagcgattagtttgaccagaaaacttatcgtccgactaatcacgactagtcatgagagtcgatcaaattagtcgtggatgactagtctgttagggctaaaaatatgtgttggactttacacttcagtggcaggccttttgcccagcccaagaaggcctgtacccctcatctaaccctaaccagccatctagatctagtcacgagagagaggggagaaaagatgaaggacttattgcaactaggacaggtaaatgatttaactttaagaccttatgtcaagtgtgaactgtcaactgtgaaaatctgattatccttagtttgtactatactatactagtatactatggtaattaatacttataaacatctgtacattatcctgcatatccctagcctatagtcaccgactaatctatgactagttgcgactaatcgcgattagtcgactagtcggtgcccttacgactagtcccgactagacgacttgaaatcactggtaccgatcttgattaacatttgtaaaccggtcttgatatatatcagtagcagcacgtttgattacttgatctggagttatggcattcagaaaaccatgttaagatgatgaaaccacttgtgcctgttttacgcattctgttccatttcgcctgcatggtctgtgtctttcagttatggccaaaacaacttacatgagaagccacatattgattattcttccacaatctgtgatcctttcaggcacgcaaatgagttcgcacctactgtcggattctttcttactactcacccatctgaggtactctttcatg

SEQ ID NO: 62731 - DNA, 3206 bp, Oryza sativa
  unsure (1)..(3206): unsure at all n locations
actgttcatatatgggcacgttttactgaatttatcagggcaaagatggtctgaaatgataatgactaatcaaccatttccttgtcattttgtgctgcttcagtttattagggcaatttactatcaactcaagcatggctttcagcacacacaggataatagaagtggtgaggaaatggggaattctctgttcttagatgaagcatggttttcaagagacatatttctctatcgtctttctaaggtacttattaccatcttttgttgataaccctacaaaatcttcttggttacaagatatatgcttactgtttaaggtaaatatttcctaaaactagttgtatgactaagaagaaacattatataatttttaattgtgtcaaatacgaaaaatcaagtaatggtaatattgatctctagatcagattgtacatcttgaaacaaccacaacaagtcaccactgtccaacactggctactgatcgagtcatttttcgtattttagttagctcctaccagatatgtcccaacagttagtaaaacctcatctctcctctatcactgctcttttcatttgaaactgtatttcacccttatattgattactccataattgcatttaaatgggtccttaagcaattgcaatgaatgcactgcttggacctgaagtaaaacgattttagcttcactgtgtatagttagcagacatatcctggattcaattagttacatgtttactgtttttaattgttgtgaagacagtaagcagcagcgcagtgtgcctattcaatgctaacttaagtttgatcgtccatttgggactcgtaatgcagaggaccctaacattcgtacatttttaaactcgaggactattaaacacctataataatagtaaactcatcaaggtagaggtgaatttgcatatctggaaaatgtgtgaatatattgttcagttcatttgacttcatgatttattttggaatcattatatttaatcatgaccaagcatgatttcttatcgcatatttgaattatggagtaagaaacagtttgcttagaagcacagctagaagctgaatagcttgttctgctattgtcaggatttctttgcggtgatacttgaagctacagttgttgatggtgaccttctgtcatgggtgggcattcctataccttctctctcacatttacacataccacataagcaattctgtagcccatgcttgaattaccacatttagactgagtttagaacttcatactttctctgaaaataccctagctggactagtattttggttacttcaaattcctggtttaatatccacaaaaccacaaattatggacctttgaccagttattttgagggagttatattttcgtgcacttgaatgattggtctgtggttgccgtttatatgaacagaggagagtaatatcagagaaaaatgtttttttattttattcataactagagtacgttgcagacaaagtatgctgcaaattcaatccattgagcagccagcctcattatttctgtagaaaatttatttcagctttattattgtgtaatgttggaataatatcaaaagatgtttctaatgtttacctccatatattcagactcgaaaactaaaatcacttctggagaccacatttggatgggatcttgacaacaatacggtgaatctaattgatgaagatgatgaggtaaatttggatcacgattcatgatcgagtgatagcatttctttgctgcactcagagtgaaaacattcttttcatctgaatgcagtttgctcctgtggtcgtggaaatggatgggtcatagactcaggtggacttttgaagccatattcaggtttgttgacaatttgcagtttcacccttctgttcagtcatccctatatcaaatttcttggtttcctaggtttactggaatctcattgtagctagacttctgctcgtagtactagcataaaaaaaatgcactgaaatgtttactatatgtatttctaggacatctgatccgactaacactggacttgcttaacagctggctacttgatcagtgatggagatgcatacaagattacaagtagggctttcttggcagtatgtatcctggtttcctaaattcctgtttgtaaatatacgaagaataatttctctttgcactaagcggtctatcttgtactagtacgctatttaccgagccttttatcttctgcagcgaacggcagttttctctatggtttgttctagtacttccagtaaagttcttatcctgttacacgagttctttagataacagctagaaatatccgtaaaataccagcgcttccagggtaagatagtaggggtaactttacagtggaaaccactgtttatatgaaatccagtcaccacatcatttaaattctcagataattgaaatcacagtgtagacagccatctaaacaatactaggtgatttctactccattctaccaatgagattgatggtacctttatcaaaggagcatatatgtaatatatacatccactggtttaggcactctttgcccttaactgtaattattgaccgccatgctagaaatacaggttttagttttacgtgtaatgtccgtgtacagctctagttggtgtacatcccaggaattagaacttttaattgaaaaggataaaactaaacagattttacatctatcatgaacatcagtatcacccagcctacaaaacaaaattaagacctatgcccaattcagaaattaatataatcatgcatactaatgttttgctaataggcacaaagaaatttggatcttttggcggcggttccacgtggctacgagcctagctacttgcttgtagctttgtatagtacataatacacgttgaaaaagagatggagatggaatggtaagataaacttaagtgggttaagcggtgtgagatggaatctaacagcatgtgacgtcctaattaaccttgggatgcgtgtatagttaatccgtctggagagaggccagtgttttaacctttaaactcgcttcaaaagcagcagcagctgaccgggatggatggtgtgcagtgtggctggtgattatacagcatggtcactnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62732 - DNA, 2276 bp, Oryza sativa
ggcgacggcagctcggtggcgcgaaacgagggtttcggcccgaggaagacgacgactgacgggtgggccccacctgtcagcgacagcgcgctcgcgcgggcggctgcggactgggccggactgggctgaggagagagaagggattttgggccgactttcggcccaaagccaaaagagactttttaaaacctttttcaatttaaattatttcttaaatgcaattccatttattaaaaatactgtaattagctcaaataaatcccagaaaaatctaggaattatagaattaagcaaagtatttaatgaaattttatctggcccaattttatattggaatttattaattaaaattagattttcttttcaagactgattaaattatttctaaaaattccatttaaacaacaatttatataattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccacgggactttgcaaaaacggataactcgattcctggttcttctctcacttgtttccaggatacggattggtttctcaacataagtcaaatcctcttggacttctatctgctcaatattagcttcttcggtaggtacccttaaacactttttcaattgcgacacatggaacacattatgtactcctgccaaagattgaggtaactccaactgataagcaacctctcctcttctactgacaatcttataaggtcccacaaaacgcggtgccaattttcctttggtatgaaaacgatgaactcctcgaagaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcggcacttccgaccatacagtgcttcgtaaggagccatctgtaaactagcttgataactgttgttgtatgaaaattctgcataaggtagattcttatcccaacttccaccgaaatctagagcacaagctctcaacatgtcttccaaaatttgattcaccctttcggtttgtccgtctgtctgcggatgataagcagtactaaagttcagcttagaacccatctcttcctaaagtttcttccaaaaatttgaagtaaactgactgcctcgatcagacactatcttcttagggacgccatgcaaacacacaatccttgccatatacaattccgctaagcgacttccggaataagttgtctttaccggaatgaaatgagccactttggtaagtctgtcaactattacccaaatagagtcatggcctgatgacgttctgggtaaaccagtaataaaatccataccaatttcttcccatttccattcaggaatcttcaaaggttgcaacaaaccggcgggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcgtgagcttctttcagaattgcatcctttaaatctttgttgtcggggacacagattctctcacccaaccataccgttccgtgctcatcctccaagaaaccaatagcttttcctcttctcatattcttcttgatctcttgaatatcaggatcattattttgggcttctctaacttgatcaattagagtgggcttcgcttctaaagctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagtt

SEQ ID NO: 62733 - DNA, 712 bp, Oryza sativa
ttacagaagcacggtagcttcttcatcaaaatgtgtcctgagcagtttaatcaacctattacatgtctcacttcaaaaaagaaatggaacctctagccatctgggtacaagcgaagctctatttttgcagaatgcagatgcaagcagccaccaaaaaaatgctcaatgacactattttgtgcactctgatttttctgttttgatagaaattagttagcatgtttaaataaagagtagcactattgagtaggcagtacaccatcgatgaagcaaaacatgtacattctatccatcaatttgtgaagatgcagtaaaagtgctgcttaatattaacagaaagttgagataaattagtacttacagcttcactacagctcaaaagaagactaactaatgctttccattgcataaaagcctccagtgactgccccatctaaataactcaaaaatgttaagagaattatgatttattgaatgtctttaaagaagttggtttttttcagtagtaccataaatgctatgaaagcaaactgcagctctcccaagagtaaatcctcttggccttggtaattcttggccaaaacactctccagcaagcatgtctgagaagtataatagcttcatcagcaaataataatacaatttttcgatttggtgcatttacatgaggcatgtgtgaaaggaatcaattcaagcaatccaccattagtag

SEQ ID NO: 62734 - DNA, 1584 bp, Oryza sativa
aaatgtctagtaaaaaacgaacattgcttcaccgaaacaaccaacattgcatatatactgctcctactttgtgacaacagagttgctcctgcactgtctgtcttgaactcgctagggtttggaaaaccagtgttctctggagccttatcctgtttggtctctatttgcttggctggttttctctttatttggatctgcttgtatttgcagtttgaccagaataggcattatatcacctgttttctaagattatatattatatcactttttgccttccaaattaatggaccagcttttgtgctggaaatcacctgtttcaggatgaaaaccagaactggcaatatccgttttttggccccagaatggttatttaaattctctcttttcaggtgttgatttatagtagtagtttattaattcattacaccacttgcgctacttaaatgctattcttttactctccagtattagacccttactcactccacagtatttaagaccctctttgccaaaaagttctagctaatttttttctcttctgttgggtgactcacttcccttgctttcctggtttcttccctcaaatgaaatactggaatacctagttgctagttcatttcattgaaagaaatcgtttctggacttgatacttgattcacacaggagataatgattccccgcatcctacccattctaggtttgggtttcctttttaaaataataaaataatctgtagatatgataataccatttggaattgaacattaccttgtgctggaatggttggcaataggcagtagtagggtatttttttccattgcacaatgtcgtcaatttccactgttgtcccagatagccgctgccactactgtttcaatacaatctgtaccaagttatcatagccattatctgctgtgtaaaccagccgatatagatatatatatatattttacttttatgtactttttatgtaagtgtcaattaacataaatcgaaatatttgatacgatgttgaaaagtactaattttcccatagcgtggataaggataaggggatactatggtctatggcatggtggtgtacattgtatgacgggtctgcttcgtacctgatcaatgactttgtcgggtgtcatatgtaattttaggtgaaagacaatgccgtggagcttgccaaggccatggaatctgaagatggtgtgtcaggtgcagtcagggcattcctcagacatctaccttcaagagcagaggaaacagcacctcagcagacatccagcttcctggaattcttaggtcctgtaagtaaatgtcttggttgctcataggtgacagtgaggcaattacacaaagaatgccatttctccctgttgaaagaagagaattttgaacatccctgcaaggatcaggagaacggatttcctggagagtgtgctttattatcttttatttttttcctttttgtgtattttttctcttttattgtgtaaaaggtgcttgtctatacatcattttgatgtgcatcgttgccctgctggtcctgcaacaagtaaagaatctcacatgtacgaccagtcctttctgtgt

SEQ ID NO: 62735 - DNA, 4300 bp, Oryza sativa
acaaaggggaaatggaggaattatcaaagattgaattcttaggggaaataattcttatgtgattgttttgaataaaagaatgactctgaaaagcatcttcagaattcctacggaatgggccatttgatggaattttttttttgaggaaaactaacatgaagtcttacctcgtggtttctcttacaaaaacgccacacttaggtttttagcctttggattagaatacaagagctgatagtggtcgagtgcatgagtacaccaagataggtgtgtgcataggataagttgcctagatctcaccccaaaattttaaactctgtcatatcgaacgtttaaacacatgcgtggagtattaaatataggctaaagaaatagctaatagcacatattgcgactaatttgcgagacggatcttttaagcctaattgctccatgatttgacaatatggtgttacaataaacatgtgctaatgacagattaattatgcttataataaattcgtctcgtggtttactaacggatactgtaattagttcttttattagtgcctgaacaccccatgcgacaccctatataatacctgatgtgacacgccaaaactttacacccctgtatctaaacacctcctagtatgcaaacttcatcacataataagtggcaacctattcacattttttctgtttcaaccacttttgatttaaattaattccttcccattttatcattcatcatttaaattacatgccatcccactctcaatcccatccgggcatttaggtaattcgtttgtcctactaatttggtttttaattaaattctacaactgcacttaatataagatggagagtactcttgtacttttttttcctgtctagatttacatagtagtgtaagttacatttagttatagactgctatattctaggatgagagagtatataaaaaataagcaaaataaactaaatttatacaaagtcacatcgaagtttgcctctcagccgctaccaaaattaaaaattgtgaagcagaattttagtttctttattggctaagaataaaacgaccaccgcgccgcgcggatggccggccagccgacctcaccacctggtgtcgccgccggcgacaagcatcgccttcccgctgctcgctgcggccaacaggtggccggtcttgcctatgatttatcgacaggcagcattgctagctaactagctggctacctagaaaacgtagctgcttataagctattttatctgtttgttattagggaattggtttttagctggagcagtccggaggcaggcaccatcctcagcgttccactaagttgacatcagataatcatgttatgtattttccacggtcaagattttcttttcactacaagtgaaacataatccaccacacggacgcttgctaagagcatgcctagcagctcatctatcatgttctccattgaaaaaatggcatatggagggaaaaaagcgactctagcatatatgctatccaggcctccaaaaatggtgcatacgctatcccacagagagaaacaccaaatttatatttggcgtttctctctcctcacgccatattgcaaccgactcctccagatcaagctcccgcccccattcggatcaactacccctgcccctacgcctgcagcacctccaattgcgacaacttcggcggccctgtgcgacccgcgctatcacctgcgccgctcacgccctcccctaggaggctctagcggcccacagtctgtgaccagtgcacctctcgtgctgagccgctgacccaactccgatggccctgcaccacccgtgcccatctgcgtcgctagctcccactgtcgcccctctactcggttgtcctagtccacccttcccctcttcctcttctctggatcgagcacccgggatgaacctgtcatagagaaaagatgaagagaaatatacttttaccagttaggagttgaaagatattaataaaatataaaaaggtgtggtttattgaagatgtaatatgaatgatttgttggagtgaaaagagatatagagatggatttttttatgaccattcaaatggtaatatggtagatcaggtttggatgagctaggacatgctctaacatgttagaggtagcgggagttctaaaggttgccaaagacgaactgcgcgctaattacaagtcaggaacttttccaaaatgtaactacaagttccccgtcaaatgccaaaaaaaaagctgatttctatactcttacctactattggttcacaaatggaagagttttatcccttcaataccccttacctaccaaccaacccaccaatactactttcatattaatgagatatgccaattttccctatatcaaatccctattacttatgtacggttttattcgagaataagtagaggcaacgcgacgagcaagggacaagacgagcaggtcgccaacggcatacggtgcagatcggcaaatggcgtagcttgggtagttgggcgagtagtttgtcaatttacttgtcaaatgaaaaagaaatactgcatgctctcaaaatatagcaagtgttaagctataaatctgaacacatatttgtccatattcataaccaaaagttggttatatgcatggtagaaaacaggaccaaatctaacaaagggcaatcagttaagaatctattacctccatccttcataaaatatagctacagctagaaatagccatattttgataactataaagtgaggtataatagaaggggataaatctcataagcaggcctcttgatcactaacaatagaaagataatgacatggcggatagctcggccgagacaatttaatgattgactacacagaagccatcatttgttgaacttaaaatcccacatccctaatcaaactgctacgtactatatgtatgtattgccaaatgccaatcagcaggcttgtgcaaccagcaagaatctacgagatctcatggagtatcaaaacttcagttaaaatatatgatgccccgctagcaagtcctaaagcaaatctagtttagtgactgatggacctacctttcaaagtattgctgcgtgggaaacaatcaggtaacctattctatgttgtatcgttgcgaacaccaaagcaaaaaatctgctgttctcccgttccaactgcagcacttatttcttttcagggttgatgagcaatagggtaaagaaaaaactaatccatggtagctgtttccggaccaaaagtattctccagatggattcacttctgtggaggtgacggagatggaggcggaggtggcgtcggcgttggttgggacttgcatgccttgcaatcaatttgtggtgatggtgtcgtgttgtctggaattgttaccctaattgtttggtgtttcccatcgtcagtaggaacatcaaggatagcatccattaatagtatttcccagtcactgcgttgcaggaatgaaaaccaagactcatctgcaagaataagaatgacatgggattagaaataggctcctacaacatggatcaagacttgtagagactcaaaaaatatcaaaatcagttgtctaacaaaaatttcttcagttaaccggtacttcagttctgtatcaacatgatttttcaaagatagcatgccaaagggaaaaatggaaacaagatttcattggaggaaaaatctggaagtgatgaatttaagaactaacaggtcccagatgaacgcaatatcagtagcaacacgatagaatgtgctctgggcctcaatatgaagaaaaccatcaactgagcaatcaaaaacaccaatgggaccaaaagttacaaactactccctccatcccataatacaagggattttgagtttttgtttgccctgtttgaccactcgtcttattcaaaaaaattttagaattattttttttgacttactttattacccaaagtactttaagcacaacattttattttttatatttgtacaaattttttgaataatagttacaatagttattttaggctcacatcgaattggatacgggcgacgtaccaaaattccggcggaaacatcttcaatttttataatagtagagatatttgaaatggcttgaactgttattttgtaaatggcaatcagacaataggttttgttgtgcttactttgtttgcattgttgtgcatctctgggatagggtcccaactctgacaattttggcctgcctgcttgtgctcgtttgttgttagactgatttgggtggtaaactcaagtgagttactgtatgcagagagtta

SEQ ID NO: 62736 - DNA, 1284 bp, Oryza sativa
aacttcgttgtacccaggttgcgagcaggggcacaaaagttggatgccactctagagttgttgcaatggaaggcaaaaaatggggttagtgacaaggcatttggcgatttattgaaactcgtcaagaacattcttccgggggaaacaaattgcccgagacaacgtacgaggctaagaagatagtctgcccgttaggattggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggagaagtttaacctacgagcgctgctgttcgtaaccatcaacgattggcctgcacttagcaacctatccggacagtccaacaaggggtacaaggcttgcactcactgtatggatgaaacaaaaagtacgtatcttaagcactgtaggaaagttgtatacatgggtcatcgtcgattccttgcagcaaaccacccggtacggaagaaaggcaagcacttcgaacgtaaggccgaccaccgtacgaagcctaaacatcacagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttg

SEQ ID NO: 62737 - DNA, 1414 bp, Oryza sativa
acggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaagacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaattatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatattggaatttttattaattataagtcatatatttgcttattacgatttatccacttaatttattacagacaaaaataatttttcgaagtaattgtcattaatctttgtactttaaataatgttaatgcattaacttctattttataaacacatatgtaagcgaaaatcatatgcagtgctataatctttagtcccggttcttaaccctaaccgggtttaaaaagtaatttcgaaatagcgggaaaagatatttactcccgg

SEQ ID NO: 62738 - DNA, 5944 bp, Oryza sativa
atcgaacgaagacaagcgagaacgagggaacgaacgtgaacgagaacaagcgaacgaacatgaacgagaacgagcgaacgaacgaggacgaacgttaacgtgaaatgcaatatatatatatatatatatatgttacttcgcatttatcctaatacatctttttgtatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataaaattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgatttttaatataagattactttatttgtaattagacttagtatgtaattattgactacggaattggtgcgacaagtagcaattgactattgtagtcttaaaacataaatgtctcgtgacttagcagatgtttgttgtatcaacagatggctgaccgcgatgaggaacagatattgtacgatataatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgtggagatcatgagagctttgtcccagattcggagaaagagatgctgtggaccacaatgctcgagacattcacccttcctgcgggtacagaggacaagtgaaaaggtggactctgaagaaaatggcagaacagtttcagagcttcaaagggagatctgtaccagagagtatatactgaaggggcatacaccgaacttcgacacattcccaaagctaagggatcactgggacgagttcgttgcatataagacaggtgaacaagggcaggcgatgatggaaagaaacaaagaaaattccgccaagaagaagtaccatcaccacttggggtcaggaggctatagcgtcgcgatgccgaagtgggaagacaccgcaggctagcttgattgagaggggtatcgaaccggcaacagccaattggccggaacgatcgaagttctggtagtatgctcacgggggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcatacctagagttccgggtatcgagctacgaactcaacatgcaagaagaggtggcaaggaaggttgatgaacgcatgtccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctatcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggtggtacatcatcctccctggacgacaagcggcgtctcgtgcaccatctcctccggctccgccatctcctcctcaggatcctgcaccgtctcctcctcatgctccgccagcaccgtctccacctcaggctccagcaccgactcctcctcaggatcctgcaccgactcctcctcgggctcctacacctactcctccgcaagctcctcttccggcaccttcaaagtcaagggcccccccagctccatcgcctgcccacacaagggcaacgaagaaggcgaaagttgacgccgccaagaacaaggacccggggtatgattgcacgcaagaggagcttgacgtttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccattggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatataaaataaaatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccgtacaacacagagttagttcaattttactgtcttcctacataccaaatttcattcccgtacgaacttcctaagtgtttcatatgtaatgcatcccacgcacattgcagattccactgggtgcttttactcttcgacctgtcggcctgcaccgtcaacgtatatgactcaatggataaaaaagagtctacgtttgacaaggttttcgaacttatagacaggtaccgtcataagttcctctgttaattaagaaaatcttgttatgttaattgctactacgaatcatagctttaaactccatgttgggcttggtatcggttccgtcatttggtccgcggcaaatggagagaaagacttaggcggaagttcaaatttcctgtgagtacacatgctctacatttatatttctccgattcaaattaatacatacaactgtatagtatattaattagatctcacgccgttaatttgtcatttatttgtagtgcgcaaagcaaaagcagggaactaacttgtgcggctactacgtgtgtgagtattgccactgccttgcagaccaaatcatcaccacaagagagctcgatgtacgtacaaataaattcaaaatttcattacgtaacgatttcttgtttaattactaatcaatttcatacattcatatagtttattcgcatgagggataacctgatcacacacaagaaatttatcgcagcggttcaagaacaactcatgggattcatcaacgaagaaatccttgatcccaagggtgaattctactacgacggaaacacaattcaccggtccttatcttctgagctagcagcgactactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatatacatatatatatgtatgcatatatatgtattgaaacatatatatgcatggtttatatatatatatatatataaaccatgcagcaacagggccatgcaaaaaaaaaaaaaaggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtggtggtgcctcgccgttgcgtcgcttcatctcttcatcctgcgtaactcatgcatccgaacagcaatacactttttcccaactttcaccaggtacgtagatgtagcgtcggataattaatatccttaattaattcgcactcttctacgtgattactatttgattccatcgatctctacgagtcggattcatcctcattgcatgtgtgcctgcaatcgccatgcctgtgccgcagtgcctccaaaatccatatcccagacatgcatccggcggttgtaggatcggaggttcactgcaaggagaggagtctgccgtcatccggcggcggctggagtcttgcacttcgctagataccacagagtgagcgaggtcattcgtacgcatggcaactaatctctctagcaagcagaacctcaggtgcgcttactattttcgctatcatgtgatgtgtgtgttgtgtgttatgtccgctagatttaaatgagtccttaggtggatgctgaaagttttggcgcatcttcatttgctatggatttaatctttcgattgattttgccttttttttctagattaattttatacttaacgtttctcggtaaattcaattttgcatctattctttactaggaccgttattctgcattagctatgggctatggctgtttttttagataatggattataataaacccggcctctacaccttgtgagggtctatacagcctaagctatggctgtttttagttcacgtattgctactaacagcgtgccattaaaattttgctgtcctattttctgaattagaaatgttacttggtgttggatatgattctgatcataatcattagtcaatatatttcctatctaattgtgcatgataagaat

SEQ ID NO: 62739 - DNA, 1579 bp, Oryza sativa
gtctgacttggattgcatcacttcacttttgccagacagcacaatgcaacgattacatatacattttatgaataaatgttatatggatattccccatttaactaacttgatgacttaatctaatgtatcaccatgcaaatacagctccaaattctcttcatatcttagtactttctctcttggttactgttacgttttacaaatatactgatctttatattaacctagagaaatttgacttcgattccccttcaattccagcggcaacgcgcggggtatcatccagttaccataaaaattgcaaccgccgagagaaccggggatgaagagacccccggtcacccccacgacgtaatgaaggcaataatcaccgggatcccgatcccagcgatccatcttcttcatcatcatgttcatcaagtagacatccacggagatgttctcgagatgatgatcgtcgattagatttctaacctggaggtggctacagagctttcaagccttatctatgggaagtccgatggcccacaaacttccggacccgttgagaagtatgacggtaacaccgatcctgaggagttacttcatgtctattcaaccgtcctctacggagctggcatagatgatagcacgttgggaaattacttgccgactgtgctgaaaggttatgcccgctcatggcttatacaccttctcaagtcgtctattggatcatggagcgatctctgaaagcaattcgtcataaatttccaaggtatgtacaaaagacatgaggtcaaggacgatctacatgctacgagacaaaaaaaggtgaacctctcagggattttatacggtgattcaatgaataccgtaatactatccctgacatcacagacacttctgtcatcagggcattcaaatctagagtcggagatcgttatatcatacaagagagctggcaacaaagagaataaatctgttatgaatctattcgagatcgttgacagatgtgctgacgctgacgaagctctccgacgaaacgatggcaatgagaaagtgtccgatgacaaggtgccagcaaagaaggaagaacctggaactagcaagaagacgaagcagtccttcaagaggaacaaaaagaacaaggctgaggccgaagttctcgtcattgaccaagagcccccaacagcagtgctgatttgaaattcaaggtgaagcttcaggaaaaaagtggtgcccaataaacaagacatgttctcactctttggctggctactctgtttttcagaaggcgatggcaaaatagatggcgctcacacgagaccaacgagtatgtttgttgagagggaggatagccatccatagtccgaggacgatgctaactttctagacccctttcaccacgttgctcatatcttcagtggttgcactccttactcttcgaaaagagaatgcaaaaaggtgaaacgtgaagtctgtttgatatcctaggggccaaatgtcaaactacggtggtcagatcaaaagattaaattcagatgatgatcaccccaccatgaagactactcctgtatgatatcctatagtggttgagccc

SEQ ID NO: 62740 - DNA, 2240 bp, Oryza sativa
tcttggaaggacagccttagccaagttcatggtagcatcccaatatgcacatcaacttataaagatacttgtcagtgttatggataaggcataccccacgatcttgggttgggctcggtctaatatactaaatcttatacggaatcatgcctcatatacggaaggtgttttggataaggagggaggagcaaagttcaagttggaaactacaaggactactcggatcgtatccatatttgtctacttggttctaattggacaaggggacatctgtgggtataaatacaagacccttgtcatgcccagaaattcccgaatagaattctaagcagaatgtacattaaaatccctgtcttacagatccacgtcttacaaacattataaaagtcttacatgaatgcaacggaaaattaaagataacaggagctaagccttgacttggattgtcgccggaacaccaccccacaggcatcctcgatggcacggacgaagcccactcctcagagaaaccaccatcggacgcacacacgaactttgagggttgggagatagagcaagactgagtactatccactgtactcaacaagtcataccagaacggaggatatgatgcaatatataaccaaaggaaggctaaaggggatcatttgcataaagctagcatttataaacagtagttgaaaatagtaaaacagttgtagtaattaatcaatattaaccatccactgtccaacactacaccacgttgcaacaggcccaaccaaccacctgaactattcaattccattagactaagctaggctgagactaatcacggtgaatcaggttgaccgcccataagacacagaggtgaatctgatcagaggtgtacaactgtacccacaagacacagccccatgacacgtttccgtgcgccgacatgccaccacgacataccggaaagaggccatgacaggacccttcgcataaccccctctagccaagcacaccacacctcaggtttcacccttgtccccagcgggcaacgggcagtcccctctcgtgcctaggtgaatccggaagcgacagaagccgtcgcagggcccaccccgctccatcatgcccacccttgcctgggagcgtcggctagaggaaagctacactacaagcccagccgttgcccacgttggcttgtggtaagtacgataagttcttccagggcgtcccgcgaaccagcaaaaccatgcacccacaacccaccattggtatattttaattagccaacaccatagtggtagtacatgtccaacattaagctaaaccaatgtctaacatttaatgtgaatcccccattgtatgcgagttcaactaagcatggctaagcaatccctaactcaacatctaatcatgttatatccccaagctaacaaaggaacaaggtaacaaatagtatggctgagacagtaggtaatcatctcatggtagcattgtaaaataatgcagtatttaaaggaaaacaatagggcatttgcaatatacgatcaacatgtccaagtgacaagcatgacttgccttgctccgctgttgaagggacctcggctacaacttcgaagtacaccggagcgtcgggagagccggattctacacgacatacaaggcaaacaatgcagacaggctataaggctactgaaacagagaacaaaaccatttttaacggattctttgtatttttcttgatttactgagccttgaatgggcttaaacggagctcggatgaattttctatgaattttagaagattcactgtgtttttactataaacagaaaaatccttaattgatttattgtgcaattattaaaccctggagggagagacgggtggtgccgacatgcgggccccacatggcagtggctttgggcgccagctcatggtgcatcgggtccacggcccggggaaaggaggtgcaccacgtggcacacacgtggcgccgatgtggcaccgacgcagcagccacgcaggtgaccacgctggcggcggaacgggcagccccgatccactcggggtgaatcggacggcggagggggcggcacgcagtcggcgcgcacgggcctggctcaagccggcccggcggccatggtgcgcggcggcgcggctcgacgcagcggcggcgcaaggcggcgaccgaccggcggcggagatcggcggcgacgcgggcggcgctagcggcggctgagtggctaggcgacggcgcggcggctaa

SEQ ID NO: 62741 - DNA, 924 bp, Oryza sativa
tgttagtacctagcagatttcagtcgatggagattagttttgttagctaacagtgcttacttcagagctaccacctatacctagttttgttagttttgtaagcaaaggggtcagccgatggtcgatggagtagcgaaggggctgccggcggcggcagcggcaccgggagggggcttcttcttattctcatcaaggtcacgaggaccttgatgggcattggcggcccccattcagtccaatggcacgacgataagcaggccaccgctcgctgctgcaattccctcgcccgccaaccgccgccaccgctccagtgcccgccgccaccactctgttgtcgccacggctcaaggggaagagagagagagagagagggggggttaaagagcgaggctgacatatgggatatgtgggtcccacaatactttttttgaatgaaaaataggttccacatatattttttaattctaataccacctaagcgccacgtatgatgaaaaccaagtcaacaccgccacgtagatggcacatcagtgaaactgcgttccaaaaccgtcgagggagtcaaattgcacctgttttgataattgagtgatcgagatatccggtattgtggttcagagatacgaatcagattcggtcactagctatgggagtccaagtgaacttatttccctacaaatctaggtccagtttgttcctgcaatgtgggccaatgcaatctgggctcagtaaatcgaacctgcaaatctacggggctttttctcaaaacaaaacgagcacgcaataatgatgggttacaaacttatagttccgcacgcactgtgcaggaggcgatcggggagggtctcgttcgggatagggagatcgtgcacgtttctccatcgtacggcaagaaatttgagtgtaactaaaaaaaaaattcac

SEQ ID NO: 62742 - DNA, 785 bp, Oryza sativa
tttcaaatggtccattagcaacatataaaagcagatttcctggttttcagttagcagccaaacagaatgcctagcaattgaaggatcaagacattcatcaaaggaaacaaagcaatggaggaccaatcaatagtccgtatgtctacactgataaccattacaaaagttactagaaaaatataaagtgatataatagattaaagacaattctatcaatcagatatgtcacctcctcttctggtagttttattaatctctcctcctgtgcatgccacttccgaacaatcacctggaaatagcatacagaaaatggtactgtaaacatgcaagttactgccatcatcagaatccccccccccccaaaaaaaaaaaatcaaactttgacttccttcaaaattttaagtacagttgagaatattaatcgtcattcactgtgacaacaatcacaacattcattttcatctcttgcttcagtacatcttacaagtgagttcttctttgttggcttttcttctgttcattctatagaccaaattagattttttttcttttagccaggcatacatatctatatatatacaatacatgcaagtttatccattatttgaaaatgagtggttagatccacgcattcatgtaactacacttcagcaaatcatatcaacagtatcttatttgctaagatgaaaataaaaaagagaataacatacggtagtaatgcaactgtagtaaaaataaatacaatactactttatttagcaggacagggttctacatttgaattc

SEQ ID NO: 62743 - DNA, 3878 bp, Oryza sativa
tctcctaaagcaagcaccgattaggggggaggttttcaactcgaaatttttgcttgaactctatacgaaaggtgaagaactctctatcctccttcatttggctccatttttgttatatttcgttggtggaaagtggagtttttttaatattttgacaaggtttgttctaactaatttttgcaaaatctagcttcaaaatatatgttttgatgggcaaattttgcatgtaatcaattgtacatactagttacatgtattgttgtatttttttttggagacaaatgcatttaaacttttgtatgaaatacctgcggtctatttttttatttgtaacttttttgcctttatataattagatggatcagtcgtcatggatgtatgagatgtggagaacgcagccgatatttattaaggaagcatctaatttattgatcaggctaaggcgcatgctttgagggagaatatgacaaagatcttttgtccgtgccgtcattgcaagaatcagaaattgttggtagatcctggtgaaatattgggtcacataatggagtacggattcaccgccaactacaaggtttgaacctatcacagggaattcgccaatccgaaagatgacgatgaagagttatgtttcgagatgaatgaggcagagaattttataatcgaagacatgtcgcgtgaaagaatggttgtcgatgtttccaccgatagtgatgatttcgatggtagttttgatttagaggatatgctacgccatgttaaaccagaggtgctagcgggcaggtcacgaggattggagaattggcaggcattagagaaggcatcgaaggatcttctttacgatgaaccgaagggatgtgataaggatttcacagtcttgcgttcagtgcttgaacttctaagattgaaggctaaacatggatggtcggacacaagttttaatgatctgatgagtttgttgcgtgtgttgcttcctaagcctaactttgtaccatcgaacacgtatcaagcgaagaaactcatatgtcctttatctcttggtgtagaaaagattcatgcttgtaagaatcactgcatattataccgtaaagaatatgcggaattggaatgttgcccaacgtgtggcacaagtcggtataaaatggggaatgggcccgtagattcagagtgtaccgatccagattctgataagggtaagcgcgggaagattccttcaatggtgatgtggtacctaccaattaaggaccgcctgaagcgtctgtactcaaacccgactgatgctgagttgatgagatggcatcaagagagccagaaaatagatggtatgattcgacatcccgccgacgctcgccagtggaagacatttgatgcaaaacacccagaatttgctaaggatcctaggaatgtaaggtttgcattgagcactgatggaatgaacccgtttggtgacataagcagctcgcacagcacatggccagtccttctcacaatgtataatcttccaacatgaatatgtcagaaacgaaagtacattctactcactatcctcatacaaggtccaaaccaacctggaatcgacatagatgttttccttgagcctttgatggaggacatggaggagctttggaaagaggggttacgactatgggatgagtttaagcgggagcacttcaatctacgtgcgatcatattcgttaccatcaatgacctacctgcaaacttttcattatctgggcagattaaagggaagactggatgtctgatatgtctggagaaaacttcatacagatacctgacgtcgtctttgaagacagtgtacatgcgacatcgacggttcctaccacaaagacataggtaccgtaagatggctagattgttcgataatacagtggagaatgacactgccccagtagcaagaggtggtacatacgtgtatgagataacaaagaagattaatgttgtatatggaaagggaaagaagaagacagtaaagaggaagaaagctgatggtgacaacggtactgcgtcgcctttcaagaagcactcaattttcttcaaatatttagattacaggaaggacctagagattcgacatgcaattgatgttatgcacctcgagaagaacgtgtttgatagcaccgttggcacattgctggacatcccgagtaaaacgaaggatggattgaagtcacgtaacaaccttgtatatttgtccatacggcatgaccttcacccagtagtgctgccaaatgggaagaccgagattcctcctgcttgttactcgttgacacttgaagagaaaaaagccttcagtaaatgtttacaaggggttagagtgcctactggtttcacatcgaacatcaggaagctagtatcaatgaaggatttgaccatttcgggatacaatgcgcatgactgtcataggttgctaacggtgttcctaccaattgctataagggcagtcaaaccagtccacacaaaggtggttataacaaagttgtgctactttttcaatcgaatttcgcagaaggtatttgatcctttggaattaggtccgcttcagacatttgccatcgagactgtatgacagcttgagatgtatttcccaccatcatttttagatatgatggagcatttgatcgttcacatcgtccctcagattattgaacttggtccattatacttacatcagatgtgggcctatgagcgttacatgtcgatcctcaaaggctatgtacgcaatcgcgctcatccggaaggatcattgatagaggaatacacaactgaagaggcagtcgagtgttgtatggactacataaaggatgctaatgccattggcattcctgttcatcgacatgaaggtagattgtctggaaggggtactgttggtaggaagcagttcttcaataatgattacaaaaaggtgtccgcggcacacaacagcgttcttcaacagctcgctatcgttgagccattcattgagcgacacctagaagaaatcaaagcctgcttcccagggcggtccaatgattggatatcaagagagcacaagcgtcgctttcctccgtggttgaaagatctaaacctgccagttggtgattctgtggaggaacttactttacaaagactggcatgtgggccttcaagtattgtcaattcatggcaaggttacgacatcaatggatttaccttgagtacgactacgaaggacatgaaaagcactgcacaaaacagtaggatccgtgtcgaagcgattgacacgagtggagaaaagaggtcgtattatgggaccattcaagaaataagggaactggactatggcctaaacatccagatccctgtgctccgttgtgaatgggttaaagacacaataggggtttccgttgatgactacgggctaacgatagtcgatcacagtaaaacaggccacaaggatgatccatgggttttagcagagcgtgtggctcaagtgttttatgtgaaggacccttcagatgaaagaaaaactattgtcatatccggaaagcaacagatcgtcggcatcgacaacatcgaagaccccaatgattacaaccagttcgacgatgtaccattgtttactgatcttcctatgcgaattaagaaggttgagagaacaatcgatgaagcaaatatgtcgtacgttcgagcagatggtgttgccaaggttattaagtcatagttatttcgtaacctttagttctcattgtgttccaaatgtacgtgcatgaatttaggtcccccttatgttgtaatcattagcatgtaacatttgattacgagttttgagcaattttcatgagttttcttagtgccaaaaacattggaatggataattgtggcgaaatattgggaaataa

SEQ ID NO: 62744 - DNA, 9834 bp, Oryza sativa
tcgccgccgcacggacctctcccccctcgccgttgtagccgtcgccgcagcacggacctctcccccctcgccgtcgccgtcaccaccgcacggacctctcccccctcgccgttgccgtcgccgccgccaggacctctcccccctcgccgtcgccgtcgccgccgcacggacctctcccccctcgccgttgccgtcgccgccgccaggtcgtccccgccgccaagtcgtccccgctaccgccggctcctccccgaagtcgccccgcccctcaccgtcgccgacgccgctgccaggacttctaccccctcgccgttgccgtcgctcggtaacatttacttttaaaaaaagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgttaaattgggatttatgtataattgggacttttgttaaattggcacctatgttaaattgggacttatgtttaaattgaaacttatgttaaattgagatttatgtatatttgggacttttgttaaattggcacctatgttaaattgtgacttatgtttaaattgagacttatgttatattgggatttatgtataattgggacttttgttaaattggcacctatgtcaaatggagatttctgtttaattgtgactgatgctaaattgggacctatgttaaattgtgacttatgtttaaattgggacttatgttaaattgagaattatgttaaattgggacttatgtgaaattaagttattgggacttatgtgaaaataagttaaattgtgacctatgttaaattgagatttatgtataattaggacttatgtttaattgagatttatgtataattgggacttatgttaaattgggacttatgtcaaattgagacttatgtgaaattgcgttaaattggtacttacgtaaaattgggacttatgtcaaattcttttacgtcaagttggaacatgtcgaacgaaaaggttccatcgaatgcaccaatagcgcctcaagaaggtaacgctcctcaaaattccggtagcaataagcagccagacgcttctagtgaagaaacgtggcgcacaccaagtgacccgtttccaatggaaataacacaagtcgccccccgcgatgatgatccggactacatacctatcgaacaggccgtaagtgttgaaaatcgttagccatgtattattccctaactatgatgtgacatgaacctaatggtgtatagagttacctattctttgcagatggtagtccgacgccgctcgaaacgtaaagccgagaggaacaggacagagcaagaagttgagatggacaccgctacgtctgcacctgaacgtacggagacatctacaagtgcaggcgggagtgggaaaaaaagatgtggtgagagaagcaagaataaattacccaaggaaacttacaacgtgattgctctcgatcaggatgggaagcccgtcgagccaccgatagtgcggtccaagttcagcaacgcatgtggcactctagtcaggacacgttgtcccattaatgtcaagttgtgggaaacagtggacgacaacatcaagacacttctctggaatgagttgcagaagtattttgtgttccctcctggatcagaggtcagggggagagattacgcacttaaaaagatgggagatcgatggcgacagtggaagtccgatctaaatcgggattatgttcagaagaatctcccaccgtttacggattatggacatatatcgcaggctgactgggacacgtttgttgcggatcatacaacagctgaagcattggctttgaggaaaaaaatgtcatacgctggtcacgtcgatcaatggcgggagatcgagcaaagatttgccgcggccggtaagcccctgctggtagaccccatggttgaacgtagcaagaactgggtttgggcgcgtagcacaggtcaagtctcggatgagggagacatactattcgagactccagacatagaagaagtgactactaatttgcagcagatagtcgagaaagaaagatcaggacagttcgtcccacggtggggagcgagatcagcttactgcggcgttggggacggctgaacactctggacgtgtaaggggtttgtcctcaaagacaagttggaaggtcgggtttccacaagacgcaccaagttataagaagagagacaaatacaaagaacaactatcggacaagatctatgcgcaagtgaaggaacacttctactcgttggcagctgaaaacccgacagcctttccaaggttattccctgatagccaacaacccacacaatccgcacagcaaacaactaatgtacccagcagtgtaggctcagtgcagacaactaccttccctgtggatagtataactggaccacctccgtgcagtctcatcgtaccaatcggtcgcgctggaaagactaaggaggttgcaatgggttttgcaatacccggacgtcaattccacaacacggcaatccctgaggattacgcaaggatacaggtcgccaaggtccatagcaaccacgtttccttggaactagacatacctacacttgaggggattgaacttctcggtgatgcagtgaatcagtttatcttgtggcaccgcagagacataatcctgagcgcggcctttcctgcagcaggatcttcaaccccatcctcatcacaggcaatgactgctgccgctcctgcaccaccgtcgccttgtcacgaccggaaataacccaacgggcgttccttacgtgcgtgcattaatccttgtcccaggaggcaaggtacaccaaaagttgatacaattcagagtttaacaagcggaagcgtaaatagttaatttattacatgggcagcgaaggcccagcacacacaaagacaaatgagaaacagcggaagactagggcgacgaccacaggcgcttgacggcaggcacgagctagacaccaaagccttcatcttccaggggctcctcttctgggtttgggaaaaattgagcaagactgagtacaaccaccgtattcaacaagacacacccacaagtacagaataaatgcaagggagtacaaaggagttatactataaagggttagggttgcagtaaacagcatttaaagatatttagttgctcaaaactatttagtaaacacgattctagaactatacaatattatttatcaaagccgtgaacccacacgaacctgccttaacccaaggcctacgatgattcagaccgaactggcaacccgaccctgggtcccagctcgtcccaagccaacccaggccaaccattccaccttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacccccgggacaggcaggcaggactgagcccctagcagcaggacaccggccctgtgccatgacatctcgactaccgggccacagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagaaggagcggtgtgaagccaattccacaataaccaaaccatttgtcacaccctgaaaattcaaaatatatatactttgcttaattctataattcctagatttttctgggatttatttgagctaagaaagtatttttaataaatggaattgcatttaagaaataatttaaattgaaaaaggttttaaaaagtctcttttggctttgggccgaaagtcggcccaaaatcccttctctctcctcagcccagtccggcccagtccgcagccgcccgcgcgagcgcgctgtcgctgacaggtggggcccacccgtcagtcgtcgtcttcctcgggccgaaaccctagtttcgcgccgccgagctgccgtcgccgccgctttccaaatccggccgttcctttccttctccggccgatttgttagaggggaaacaatctccgggatctcctctaccttttctcctttggaatctttggttaaatcgctttggaaagcgtcggagacgagttcgtttcggatcggttttccctctctccaagccgaaggtttccttcgccgttgccgtcgccgtgggccttcgccgccgcctccgagcccctttaaaaggacccccggtgtctcctctacccgtcgcagccctcgccttcgcctctcgtcgccggaagagctgtagcgccgtgtgccctagctttgccgtcgccgccgccgctccagccgtgcgccgccgtcgtttcagccgtcgccgtcgctcgggaagaccgccgtcgtgcttgccaagtcgccgccgtcctcgtccgccccttcgctgccgtcggagaccgccggagcatcgtcgccgtcgtcaacccgaaggtagccgccgcttccttctcgtcgccgtcgtcgtccgttccttttccgccgccgttttggtcaccggtgtgttcgccgcgttgtcctctacgtgctggtgccctccgttggtgccgtggtgccgccgttcgccggcgagtgtccgccgcccgagccgttttcttcgccgagccgccgccgtcgtcggtgatgtcatcgttgacgtcatcgggatcctctcccgtgagccggtcatggaccgatcgatcttggccgtccgatttggatcggatcaatctcggccgtccgttcgcgtgaaccgccgcccatgcgcccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaattctctaattttttctaaaattgagatctacacattaaaaatatccacatgtactgttcatgcttgtttatgtgctgttttggtgattttgcttctttttgcttagattccgtcgtttccggagagtccgttttcgcggaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatacaattgcttagccctgcttagaaacattagtacacttatgggataactaatgactcactattatttcatgatggcttattgatagttcacgatggtcaatcgtgattagttaattaattaatgtgccaactaaaacctgataatggtgggttgtgggcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcattgtaaaagatgcttaaactggtaataatttgattagctcctggtttggaatggtacattcctggtttggagatagaactgtgcagccggggtggttgttcagaatggttgggcctatacaacagggtatgttgtatagcgttggattaatattgtttaattacttaactgttttatcaaattctcaaatgtttgctaaatgctgcttttgcaaatacaaccatattatgccatcctttgttatcctgtgcacttgcatatttgctgcgtggcttgttgagtatgtcatatactcaccttgcaatcattcatcagaagaagagttctacaatgaggctgatggtgtggaggattaggtgtagccttggtcaagctgcctgtggagtggagccgtctgcgccgtttatttaatttccgctgcttagaactttattgattgagaagaactatctacctctgtaatgacattttattcgcttattaattagagtattatttgtactctattatcaatttgttattgtgtgcctcggctgattcctggacgagggttcacacacatgtaagcgtttggaattttggatagaaattccgggcgtgacaagttggtatcagagcccctttgaccctaggttataccaaatggttacccaaagaagccctctgaaaaatattggaaaagtagaactgttctcctccctttctcttttaattaaccaaactaatggcacatgcacttcataattttttttttaatggttttcattaaaaatttattccagtgttattagtactgtacatctattactgtactaatggctcatttatcagcaaaagttttacaatactgttttatttaatcttgctgcaataaaataaatttagtatgttgattttataatttcctttcatctcttttgaaaccagttattcaaaattacaaaatttgtgacctcgtttccaaatgttttaatttatttcgcaaagcttggtttactttatttacttccctttttactttgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgtacgatgtcctttgtcattggatttgggactgcccctttttatacccagattcctcatgatcgtcatgaagagaagtgccgagtcaaagtcaccttgaacagcaatagtgaagatattccctcagtgatgttcgaagctggaggaagaaactacatccatgcatgtcaggaggtggcaaggatcgccataggagagctccgtgatcgctacagtgatcaattggccgacactgagtatcgttaccatcctcgccaaccccagggaagtgaccgtggcagttatcttgagactgaaggaattgagaattatgttaccacaagacatttggttgagatgttgtgggctatggatgaaagtcgtgcggagactgtgttagcagctcaagatcgtgaagaccggaatcatggtaagatttgcaagttagaagacaaggtggatcgtttggagaaggaattagccgcattgaagggagaagcaccgccgcagaaggccaggattcgtcttaccgcaaggaagagagctctatttgtccctcgctatcaactggcgccaaaggttcgtgtggtggagaaagaagttgccccagctcaagcggatcctccggtcatcatcttaagtagtgatgaagaagaagaatctaagcgcaacaattccaagattgagtgggtagcaacccaagatgatgaagacgagccttcaatcgacctccgatgcttggaagaactagagtgacttgttaagtcgttgtcatagatcgttgtgttagtttgcttgcttaaagtttgcttgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagttttccccgttttctcttcttgtgccctgtccatgccagatggtgaacactcgtagcaatgggaatggtcccaacaaccccaataacaacaatggagagaatcccactcttgctcaagttcttgctcaacaaacacagcttatgaacatgatgatgcagcaatttcagaatcagcaaaaccaagggaataatcatgcacctccccagaacaagttagcagaatttcttcgtgtgaggccgcctgttttctctagtaccactaatcctgttgaagctagtgattggctgcatgccatagagaagaagttggatttacttcagtgcactgatcaggagaaggtatcttatgcatcacatcagttgcatggccctgcctctgaatggtgggatcacttccgccttaacaggactactgctgaacctatcacttggcttgaattcaccgctgctttccgaaagacgcatataccatcgggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtataatcgcatggagcagaagaaacgtcggattgctcaattcaagacacaacagggaaataatcagaagccgcgtcttactttaggaccccagtctatgccacagggaggttcttcgtctgttgttcgtccgcaacgtcagttcttcaacaacaatgctggcaacaacatccgtaataaagctccacgtcctgttgcagctccagtacagcaacaacctgccaagagggagcaaggcagcaagcccgtggtgtgtttcaactgtggagacccaggacattatgctgacaagtgtccgaagccccgtcgcgtgaaggttgtccctgcccagagtaactctgctgtaccagtatccaaggctcgtgtaaatcatgtcgctgctgcagaagctcaagatgctccagatgtaattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctcggtcagaatagaaattaaaggagtaccatttctggccagatcttatcttgttagaatccaaagacctatgatgtcatcctagggatgg

SEQ ID NO: 62745 - DNA, 3171 bp, Oryza sativa
ttttagggtcgttttgggacgcgacaaacctaccccccttaaacggaatctcgaccccgagattcggaagaactggcgaagagatcgggatgggctgccttcagctcgtcttcacgctcccaagtagcttcttcctcggcgtggttgctccattggaccttgcaaaaacggattacccggttcctggtcctgcgctccatggtgtccaggattttcactggcctctccacgtaggtcaagtcttcgcgaacttcaatttgctctgagtcggcctgctcggatggcactcgaagacatttcttgagttgtgacacatggaacacatcgtgcccgttgcccaaggaggcgggcagctccaactggtaagcgacttcttcgcgccgagcaatgatacggaaaggacccacgaaccgaggtgcgagcttcccttttgtctgaaacctgtgcacactcgcaatggcgtgacccgaaggtacacaaaatcgtccactgcgaattccaggttacggcgacggttatctgcataacttttctgccgggactgtgccacctttagattatcccgaatggttctgaccttcgcttcagcttctctcaggatatcagtcccgaacacttgactttccccaacttggtcccacaatagcggtgtccggcatttgcgcccatacaacgcttcataaggtgccatttgtatactggcttggtagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatctggtacccagctcttcttggagcttcttccaaaagtgagaggtgaattggcttcccctatcagatacgattttcttgggaacgccatggagactcacgatcctagcgaagtagagctcggctagtttgttccctccataggtggtcttcacaggaataaatcgagctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcatgagcttcctgaagtatcagctgtttatgttctctgacatccggaacgcatacccgatttccgttccatagggttccatgttcatcctctgtgaaacccgcagctttaccctgttccatattttgaggagtccacgcatgtccgggtcgttcttatgagcctcgcggatttgatcgagcaaggtgggcttggcttccaacgcagccaagaatccacgactcactacgctcagattcagggcttccatctgttggttaagttcgggtggaaagccacggacgttaagagtgttgcaatggctctttcgacttagagcgtcagcgaccacgttggccttaccaggatgatagtgaattcccacatcgtaatccttgatgagttctaaccatctcctttgccgaagattcaggtccgactgagtgaagatgtatttcaaactcttatgatcagtatatatttcacagcgattcccaatgagataatgccgccagatttttagagcatgaaccaccgcggctaactccaaatcatgggtagggtagttgccttcatgaggccgtagctggcgggaggcataggccaccacatgaccgtcctgcatgagcacgcaccccaatccttggcgcgaagcgtcacaatacaccatgaagtccttgcgagtatccggcaagattaacactggcgaggaaaccagcttttctttgagagtttggaacgccttctcgcattgcgggctccacacaaatttctcttctttcttcaacaactgtgtcatgggtcgagcgattttggagaagttctcgataaacctccggtagtatcctgccaaacctaagaaactgcgaatttgagtgactgtcttgggttgcttccaatcagtgacggcggtcactgttttggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtataccagtaatgtcatcaatgaaaaccacaacaaacttatccaagtattccatgaacactttgtgtcattaagttcatgaagaaggcaggagcattggttaacaccgaatgacatcaccgtgaattcatacagtccgtatcgcgtggtgaatgcggtcttaggaatatcttcttcacgaatacgtaattggtgatatccggaacgaagatcaatcttggagaatacagtggcacctttaagctgatcgaacagatcatcgatccggggaagagggtacttgttttttatggtgacttcattgagagctctgtagtcaacgcacatcctcttcgtcttgtctttcttctccacaaaaatcacaggagcaccccagggggaagtactcggacgtatataccccttttctttcaactcttccaactgtttcttaacttcagccagttcatttgctgccatacggtagggtcgcttgtatagaggagtggttcctggagcaagatctatccggaactcaatctctcgcttgggcggcataccgggtagttcttccggaaacacgtctccgaactctctgacgatggggatttctgacagtcctatctgatgaagttctgaactactgacagaggttgggggtgcaaagaaaacaaccggctgttctggccctgggtacagagtgacagtgcgtctcgcgcaatccactactccttggaattgagccaaccaatttatcccaaggatcacatccaagctcttggtgtctagcagaatcagatccgagggaaaaggaatccc

SEQ ID NO: 62746 - DNA, 878 bp, Oryza sativa
gtctggagttgtcagcacgtttctcggcgtgtcacgtggttcacacgaccccgtaatgacatccttaccaccgttgttggagcggggaggcgcttggccttgctgacgcctcagctttgggcatttatccgcaaagtgcccgggctcgaagcagttgaagcacagacgctgcggaccttgagcgtccctgcggctttgaccaggctgcacagttggcataggaggacggggcgcacgagtcccttgttgactctgctgctgctgcggctgtgggacgcgcaccacgaattgaggtcgaggcgcggagcgtggttgctgctgctgttgttcctgctgcgaggaggatccccctggatagggattggtgtagcggaccctttggttagcaccctgttggttgcggaaattcgccaagcggcgcttgtgtgactccagttccttgtgcttgtcttccaagcggatgctcttgtccaccagacgttggaaatccggatagtccccggagactagacggacggacagctcaggatccattcccgccaagaacttctcctgcttttcctcatcttcccgtacatcctccggggcgtaccgggccaggttgttgaactcatgcaaatactccatcacagagcggttgccttgcttcaactctcggaattcccttttcttaagggccacgactccggcgggcacatgggttctccggaaagcagcggtgaagcgggcccaagtaataggctgcccctctggctgcgtagcctggaaatggtcccaccatagagatgcgggcccctgcagctggtgggcggcgaagatgactttctcctcatcgctgcactgcacagtgtctagctttttccccacggcatgcaacc

SEQ ID NO: 62747 - DNA, 952 bp, Oryza sativa
tgttcacttatattctggaacctgatgtagtacttgttttctacaactttgttaactctatgaaatattcaaaaccaaaggttttatgaagtaattctttttttcggctggaataagaaaggacagataccaatactttaatttgttaactttatataagccgaatggtaatcttttttctgcgcaacttttgccaaagctgaatgagaatctcgtctttgtaaaaggcttttttttgggcttgataaagggtgccaacttaggcagcacaacgtcaatcaaaagaaaaggaaaaagggaaaagagtggaggctgtggagctagcgaagaactggagctgtggagatgcactgatgcactggtcgttctttgttgtctgtgcaaagttgaaaaaactcaccggtaggccctccaagtttgattttaccataataccatttttttcttgcgcgaggaaatatcagtttgcctttgaccaaatgaattagtggatccgaagatgttgacatgaactctctctctctctctctcaagtggttaaccatgcatgcaaccatttttttaaatcttttataatttaactgaaaaatcgttcagtaaccaattgttaaaacaaacaatctagccattcactgaaggtaacatggtaagctattgactgtaaatatttatgtaatgtcgaaaataacttgccatgtgacatagcaaaaatataattttcaaaatacaaaaaaaaaatcacatgcgacccaatcaaatactcctatcagtgataattgaccccgcaagccatctagggtcaattctagtacaattccacgtagatttcctcccaccctaagaaaagttgtcactttgttctttaaaaagaccaactcgcgtgactttcttctttctgcgctgtaaagataatagaatgaaacattccggcttttgctcaagagagctacag

SEQ ID NO: 62748 - DNA, 1760 bp, Oryza sativa
  unsure (1)..(1760): unsure at all n locations
acacacttaggtaaaagaataatagtaccaaagttaagcgagaataaatgtaaagtaccattatgaaactccttaaaaaggtttattaaatcaaattttataacatcttagaaaacttgataaaattcagcaggaaacccatcaagacctggtgctttgttatgttccatctggaaaatagcctccttaatctcctcttcagtaaattccttgtgttagagcctcattctccaaaagagaaacttgaggaatgtcagtaaatttactctcatcaaactgaagaggagaatcatctggaggaccaaaaagacccttataataagtggtaatatgcgatttcaaattttcatcaccatttattaattggtcaccatcttgtagttcaaaaattctagttttcctatgttttccatttgcaaccaagtgaaaatactttgtattagaatcaccctctagaatatccttagatttggccctcagataccatttgatttcctcctctctcataattgaagataatctattcctataaaaccatctaatatccaattcctcctgactcaaaagaatatcctctttgtctcccatgtttcttttgatttctggaagtgcgtcattgcatgtacaagggcaaagtttcatgggtactggctccatcagtccgccgctgcttccactcaaaagctctgttgggcgacacgggcagcgaccgccgcttgcacctctaccccccacctctctccctcccgcctcaccgccgccggagccagacaccgaaaacgtacggcagcatgaatggcggcggcgagggcattaacgctctcctgcgcgggatctaggagctagcggttgctaagaggacaacggtgacgattgccactgctggcagcgtcgggcagtcgcggagaagttcaaagccaccggcgagagctcagaagcgcagtgggaggatccggcgaggaggaaaggcaacggcaggcggatccggtgaagagggcgatggggcggtggctcgcacgtcgtcagcagcctggcgctgccggcggcatagggttgtccaaggggagacatcttcgaccctcgtgactgcctacgcgcaacccctctttgccgccggtgaagctggacctgttcattcgcctccttggccgatttgtctagatccacttactccttggccagatctactcggttggggctgggaggtcggtggcagcggcgccctgacctgcccatgggggcggtgtgtgatggtgtcttcaagccgctagcgtccgtgccgccgccgcgtgagctatctgactagtgtcctggctggctttaccccctgctctgggttgaaaaccccttttggtttccacagcgtacgatggcgtcttctttcttgttgtcgtccttcttcttgaaggcatcatatttggaaatcccctgccataaccctcgggtggcttcttctcctcgtcattgttgtgccctctacctgtttgtcccctggcatccatcgtgtcctgcctacacctatcctcgacgcctttggtccaccttgccttgtcttttcatctaaccagtgttagtgttcctcctagtttccttggtttgagtcattttggttgttgtttcttgccttgcttcgaccaccttcaccttgatccaccataaaccacgagtatgcagtttcccctttcctcctcagatttcttccattttgnnnnnnnnnnnnnnnnnnnnnnnnnnnnnnnnnnnnnnnnnnnnnnnnnnnn

SEQ ID NO: 62749 - DNA, 1784 bp, Oryza sativa
tcgcttcaagcattttgcctgctgggtagtgggcggcactggtcagagagctgaaagctgatggagatatgccgcggaaacgcgagacagcaaaatgttgagttgggctaagccttcggaatttgcgagaacttctgaactccggttttttgggctctagttggactatcgcctactgggcctgtgggccatggcaaggcaattctataccgatgcaatattccatttgcacattatccggacctttctcttcctggaacaagtataccgaaggtccctcaacttgccatcgagttacaaaatagtcccctaaccgcaaaaccgcgcatcccccaacttacaaaaccagtgcaaactaggtccctcagcggttttgaccccagttttggctgacatggcggctgagtcagcgtgggacccacgtgggccctggtactccttgagtttttttttttttgacgaagtgagtaggagtatgtctgattgatgttggcggatcggggatctgcagaggatgttagggccttgggcactgctcttctaatcgtctttgcctggcagatactgctcgtacagtagccccacacagaggacttgggcgagtaattggtttgttttggaccgtgttgctctcttgctttattttccttttgattttttgcctttaagcttcccactatgtttttctccctctgaaagcttcacggttactgttcttttacactcttttttaaaagcttcgaaagctttataattgagagaacgatctaatgaatccgaaccagttgaattgaaaaacagaaaaaactactaaacggtgttccgtggcgacggaatagtactactaccttatctccttctcttcccctccactcgctcgctctctctctctctctgtctcttcccctccactcgctctctctctctctctgactacccaccatgagcacgaaggcgacgatgacaatggcgacgacgacgacgacggtggcgacagcgacgacgacaacggtgccatcaccaccagcccccgcggacgacctggacgacagccggcggggctcccgaccgccacaggcgacggccgccgtcgagaagcctccccctcaagctcctcaagccgctcctcctcttcgttgttcttgccgctagcttcctcgccgctactgccctcctcctcggcggcgctggcgcctcctacggccggggagcggtggacgcggccatcggggcgagtgctttggcacaacatgagcgatgaggagctgctctaggcggcgtcaatggagccacgggtttggcggtttggagcgaggcacgtcaatgaacgacggaatggcacaaggtaggcaccagatctgtcacttcctcttcctcttcctccgtcgccgccccgctgctcgacctccccgacccgcgactcctcctccttctctctcttggggtatcacactgatacccaggtaccaaggcctgatacctaggtaccagctcgatacctagggtaccaggtggcctgatacctaggtaccagctcgatacccagggtatcaggtatcagtcgataccagggtaccaggtaccagccgataccaatgtactaggtaccacctcggtaccttacccaaggtaccatgaggatatggcggtgaggtagctgctactctgggtgctcaggagcgacgacgccggcgaggtatggcgcgtgaggtagcttctactctaggtgctcaagggcggcgatgacgccggcgaggtaaggtagccgctgctccggcaacaat

SEQ ID NO: 62750 - DNA, 1076 bp, Oryza sativa
  unsure (1)..(1076): unsure at all n locations
tatgtaattttagtacttacatatgtaattttgagacttacattgtaaatacactaaaattacatatgtaattagggacttacaatgtaaatacatgtcgactattttttttgatggaaaatatggcgccataaatatagcatctcctctcttgcttctgatcaccattatttttcaggtctcgaatacccagacttcgagagatggcaacaactaccgtcaccacaccaattctctgcaacctcagcgccaagccacgcgacaccctgcgcctgccgacgacgcgttcgccgaacgacggcacgaggcgaacgacgctccacctgagctcgtcaagagcccgcggcgacttgatccgcgccgccgccgccgtctacacggtgaagctcatcgggccggaggggcaggagagcgtgatcaaggtgccggaggacacctacatcctggacgcggccgaggaagccggcgtcgacctgccctactcgtgccgcgccggcgcgtgctccacctgcgccggcaaggtcgtcgagggcggcgtcgaccagtcggaccagtcgttcctcgacgacgcccaggtcggcgccggctacgtgctcacctgcgtcgcgtacccgaccgccaacagcgtcatccagacgcacaaggaggcagacctgtattagttagctagctgcgttgcacttgatgatttgatccatcactttcgatgcaatcttgacactgtggtttgcacatgcacttgccgttgaaactagccagaatttatcgtcatcttccacttggattgagttaagtgtacgttcttgtctctgcattgttctcaatggatatctcggaatctgtcaagcctgtcgtgaagtcgatggccggggatgctgcattatcagcaatcggtttcagttctcgccgccgttctcgcggcgtccatgagaaagaatcaaaaagggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62751 - DNA, 1180 bp, Oryza sativa
caaccactaggaaaatggagccaacatggtaaaacacaatcatgacaggcacaatccaaaatagagagaaaaaacgtggttcaccagaaattactattacctccgttgttccgccctaaaatataacaacatttagctatgtgtttaaatttatagctaaaaatacttatattttaggacggagggagcagtaagcagccgatcaaacatagtactagtagaaagcatactctttctcggtgttttgaaatttgaactggtactcgagaaaagcaaacctgaaccgtgtgcctcatgcctcatgcctgcactgggctatcgataaatgggccgtaagacaagtctatgggccactgtttaggcccatatcttcgttggagaaagcccacaagcggcaggagttggggaaacctgagccgtaaaccctctctcctcctccggtctccttcctccccttcacctccgcggcgcgccgtcggtcgccgctcgccgccgccttctggttcttctccggtctatttccccgcgggattcgtcgcggacactccggttggttggtgtatctgtatgtgattcgtcccacgctgctccccgtcgcctcccctaagacgaatcgaagctgacattttctggtgtttttttttccatgattgttggctgcaagaagtcggttcgagttgccaaaatctgattgttctccggaggtgaaggtttactaggcaatcatggatggtacgcacgcgctggctctgttgcccattcccatttcgttaagctttgtttattttgtgtcagttggggaagtaaatcttaacaaaacttggtcatcctctcttgcccaaaccgcctaaaaagtttggaggatcaaattgtgttttagcacataggttgtgcagttggttgttaatgcaagcttagtggcgattgtagttgcctgggcttgagttaattttgaagttcgtaatggcaactgtgaggaaataactctcttttttttctctcgatcataaaaaactgatgacttttgctgatcatgcaagaaccagacctatgctatcagcaattcagcattaataaaccactgtggcacagtcaggaactaactctctagtcagtatcatgcaggataaccagcatgccagagaacctgatcttactttccaagttcgtgcatttcaag

SEQ ID NO: 62752 - DNA, 2049 bp, Oryza sativa
ttattttagttacaacttttagaaatcgaatttgaacttgcatatttctaaagtgatatattacatattaatctatcttgtaattttttatgaaattttttcataatcatttagttgacatacaagaaacgagtggatgtccatccgagatattagaatccatcacagtggagtaactaatggttgtgcatccctcggttacttaattgttgtgctacaggggatggaatgtttgtagtcgttaattccacaatcgttgcatcaacattttttttagactaagggcattaagcccccatttccattactagaaatgacagattacaaaagcaagtcttacaaactgaaacaataataataaaaaaaaggaggccaacacactggctgttttttccagactagaactgtccagaagacatagaagaacacatccccatcctcaaacttgcataagagcaagtttagggcctgtttggcacagctccagctccagctctgtcgacggaggatactcgtagaccagatatagagggtattggggtacactggtacgaggatctacgtagtacgacatcaaggaaacggaaaacatggattatactggttcagtccccttgataggtaatagccctaatgcagttgatatgagattatatagtggaaaccacagattacaaagggaatagcagaactcgatgataccgacgagaccatagtcaagttgattcgactagatcacccggcgatttggctcctgtaggttccggcttcgtaaggctgtggtggttgtcttggctatgagatttgatgccttaggtcctaccagggggtcccttttataccgcaggtcagttggtctccaagtagaactcggagacatcggatcctacacaatacaatgacgacccagttctattcgagtaggactccttccgtctgtggactccgtgatggatttccttaacgtgtacataaagcgtccgtatacgtgcaggtataccatatcaatacacgacatatatccaagggtagagggtataccttatccgtaaccctgacaagctccacccctcctggagctggagctcagcaaacagtttcagctccaccaaaactgggagtgaagttgggtggagctctctcacaaaatgaactaaagttgtggagctgggtttagacagctccacaattccactcagacccaactcctggagttaaattgaggagttggagctgtaccaaataagcccttaatagtatatcccactactagcaccaaatcatctatagccaatgtaatagccaattcatacaatagttatttactatactattaatacctggtcccacctgtcatacacacattacgtcttggagtccgtgctgcagctggctactgatctgtagcccgctgctcttctctctcttcatttatctctttaaaatatgtttatagctggcttatagcctgctattgtacctgctctaacaagacttcagggactaacaaggaccgaaaacccaacagcaaaagatcagcactgcagcctccccaccggcctccatccaaatctggagttgtacacttcacttgcaatttgtcttatgagcttggccccaagagcagccttctttgatctgcctccagcttctacaaaagagcccatgattccatccagtggcaaaccaagaaaactacatcagtgggatcattaggcaaatttttatcaaagcagactttattcctggtcttctaaacagtccagattacagcagcaataccaatgacaatcagatttttggttttatttgagaaagcagaaagccaagtcccaaaaagatgttggcaatctttagccgttttgaggtcaaaagcacactatatatgatgttccaaattaatctgacaagagagcaacaatcgttgcatcaacatgtttccgttttgtcccaagtgaaatgcagctgtgatgaatggcaccgtctgacgctaaatatgtgaggtacaataactgcatgcctctccgaagtccaagtgaacaagtgacc

SEQ ID NO: 62753 - DNA, 1169 bp, Oryza sativa
acaagagatgagggaggttaaatggacttattcctataaagtataccgccatttcgatgtctggtccctgaaggccctggacggctgcacgcgccgatgctgctgcccaatagccgctcgcccgtggcccagtggcccgtcttgctgctgcagtgtcagaccagcccacattttcctcccccatacaatgggcccaaccacccccgcccacagggtggctttgccttgctctcacgcactcacgctggcctccccgtagccgtcaccgtcgcatgcgtcctttgcctgcctgcctcgtgcctgccacctccgctggacactgtggcagttagcgaggtagctagtgagccacggttcaagaccgaaccctctgcatcgctgtgcaactgtgcatgccgtctctctctctgtctctcactctaatccgaaacacaaccacccgtgagtccgtcaccgctcctgctcccagtagtccagtactctcgctccactctcctcgccgagtcgccgtcgccgcctcggccagcttcggattgggttccagcaccggggcggataatctgctgctgctgctgctgctgcaaggtcagtctcgcgcgcgctcccttccccgggttgatcaccgcgtgcggcgccttggtgacgtgaaagcgatcccgcgcagcattacgtagttttaattaattctcttgtgtacttcacgctagcttcttgcgggtagtctcgatttctgtttccgtttctgcttccgttcttttctccttttggacgaatgcgctgcttcctgtggtgagagcaaaaggctctggttgcatgacttgcatccaaatctgagtaatttagacaatgtatgcagatcttctagcagcctggaccctagagggggatactatatacagtgcagttgtttgtctgtgagactgtgaaactgttttttgaagggagttatctgtgtaaatgtataatcatttcattctgaactggtcatgacatctgttgaacatcgcaaatgtggagtaagaccagttgggtgaacttgtaagtttagtaaccaactgaagcctatagattaggtagcctcatgtatgctcttctccatatgattcatacgggtggccctcgtagctccagcttcgttcttctgtaggtgtccaaatccgaaaaaagaa

SEQ ID NO: 62754 - DNA, 1210 bp, Oryza sativa
gagggccaccgccggccgccgcgcgcctctggttctccccgccagtcgccggaatacacctctatattaggagcagatattccgccaccgccgccgctccctaccgccgccgacgctgctccagccaaggttcagagaaaaggccgagggagagagagagagataagggagagagaggggaaggaggaagaagggaaggagagtttgcactgacatgtgggtcccactacgctgagtcagcttgtcaaccgggtcaacaacgccacgtcggacgaaaccgccagctaaaccaccgagggagatgatttgctctggttttcagagaaggaggaggcgttatacccagttttccatttgaggggtgttattcacgcaagcgcaagagatgagggaggcaaaatggacttattcctactttatacaaggaaaaaaactatacaacatttattttttaatatcggctagttcgattggtttagtcactaattcagtttgcttcgagcatttatccgctgagaaatatctcacaattgtttgggtgacgatctctgggtcaaagtcaagagtacatattaccttttttttttttgcttggaacgacatttaataatatagtttttaacaaaatatatttcttcttctttgcaggttatctttttatcatgcattgactttggtctcgggctatcatccataagcctagtttgtaggggtttactactgcgactaatttgtatttaaagtaggtggccagagagtttttctacctcgtacacggatggcgatctagtcttcgaatagagatccttgatcaagttataatttagttttcttccgtgggtatctgtatgtaggcagtgtgaactatcacgatacaaaagtcgagtgtccttagaaccagtggtgtggatgatgaaagaaaatataggtattgccatgaacttaatataaacataagcgataaaactctaagcaaacggcaaggttcaacgtgatcccatagtaggccgggcagtaatagaacgtgacgcctattcactaatacatgtgatatgcttaggcatcgggttgccatcaatgccaatacacccatccgttgtatgcctcttacattcagtaatagaaatccctagccaagttagcaccaagcatatacatgggcattagatttactagctagtttaagcaagtctcgatccatacaggttac

SEQ ID NO: 62755 - DNA, 1260 bp, Oryza sativa
catatactactcctcactgcgcagctaaactctagcggtagcagcaaccagtgcgtaggcgtagctagctatagctactcgcgcgctgcgcgccgaatcttctttgagcacgcacggatgacgcatgttctctctgatgtgacgcccccgtgtcagggccgatcgatcgatggatcgtgtcggcaagacgccaaaaggacacgttcttttttttcaactttgctgtacatgcacggcgtagatatggctggagtctggagagcaacccggtcgtgtcaaagccgcactcgatcggcagagccaggagtcggatcgacccggccgcttgtgctcatgcctacccataggtgacatcgctgctactgtagtagtagcagtagcagcgcctaggtcgttcaattgttcaaagttgcacgagctgatcaggaagtatggtaggagtacgtacacagtgatcagtagtactccgtagtagcttagcctgctgcctgccatcgtgacatgatgcacctgagagaaaaaaaggggccaaaatgattggatacgcctttcgctttggtaggggagggaattaattgccggcgacacgtctggtgggtcgcgtcgctcgcacagccggaccgccgatgatggcgcggttgaatataccgctccccgctcgcgcgttgccgacgacgcgcaacgtgcgtgcaaggccggtgtgagacccgatcgcgaccgatctgccgccgctactgatgatgcccgctgctgctgccctgctgcctaattaacatatgcttctcctcccgcgatcgatcgatcgatcgacgccaggacggcgacgacgaaagctggggacaaaacggagcccgggggaaacatccgaacatggcagcacacgtgcatgggcagaggcgaagcgaacggtgcgccgcgcgatcgatcgccatcggacggcccggaccgtgtgcggggaaagtagaggaccgaggttagctggcgatcgagcggcgactgctacctgctccgtttgcagccggccgcagtgcaggacgacgcagcggcagccttcggtttcgcaggatgcatcgccaaagcggggagaaaaaaggcaaaggttttgcagctgcagatcgaacagatggaatgatgatggagagacgaccaaaaactcggaattaagatggccaggagaaaaaggcattgcgactcatgcatatgcatgttcactgtccaggcaggcaggtcaccaatctgatctgatctctgatccgagtc

SEQ ID NO: 62756 - DNA, 804 bp, Oryza sativa
acccagggcagttctcgcttaggtacctggcaggctgaccggcacgatcaggtcctcggcgccgtgccacaggtgcaccttccctttgccgccggcgaacgggtcctcgagctccagcgggctccagctccacttcccgaatccgaccgtcatgtcgcggtgcaggcagctgtactccccctgctgccttatctgcggctgcgacgacgacgacaacgacaacgacaacgacacgcaaaccgatgagcaaacgctagttacaactaaatatgcaacgcaagtgatgaagcgatccggtgatccttaccatgtaggttcggaaggcgaatttgggcatgatgagcttgtcttcctcagagaggagggccgggttgtaggcgatgacgctggaggcagggaagagcttctgggagttccaccagtaggtgagccacggcaggtggtgggagacccagaccgcccacttgtcctgcgggagctgctggttccaggcgtgccacgacacgttcgacggcaagccggaccaccagtagttgcccacggggccaagaatggccaccccggcgagcctgcatgaataaacacattggtcagaattcagaaacaagcagtcctgcactcctgccatagattttccggagatgaaaatggtgatcgactctacctgtgtgagatgtgcttgaggcagctccacatgatctctccgcccatggagaagcccatgaggtagaacttggggcccagctgcaggttgtccgcgagctcctcgacgtccagggctatgctcttctctgtacttgccgg

SEQ ID NO: 62757 - DNA, 4621 bp, Oryza sativa
  unsure (1)..(4621): unsure at all n locations
ctgtactagacattccaagagtatgtccttgcgcctgttttcttgtggtaatacgtaaggccatatattttgatgagatcaaacgaaaatggccatttagactgcataaagaaaggcgacgtaaataatttatatatactatactgaatttcagattgagattcctagatggttattgtatagtgcttaacctaatgctctgtgtaacacttataattgcctgcatctgctctggggatttagtggcatatgagagaactacgtggttcctgcctgatagactacaggcaggatcttcctaggcctcacaatccacacgcggttgtctgttccgatgagttgtacttgttcttgtgcttgacagacctatgagtctatgagtatcaccaggaataaggccaaacacttgtaagagtaccttgtaaccataattcagcaccatacaaaatgaatcattggattttctgaattttctaatgatttatccacacgatttcatcagttttgcttgtatgtgctttcatatttctattataggcgcatgattcttgctagtggacttgagggcatggaaggatttcgccaaagatggagcttacatggacagcttggagacacaaggtattaaactttgtattggtcatgcgttgtgatcatctatgtcatagttgaaactcgaaagagctcacttgtaatttgtaaatgtggaatttgaatattaagaagctagtgggcctatggtgattaaccatgtttttaactattcgtatgcatttgaataatttattaattcaaatccagatggtggattaaaattgcaatatatacatataaaaaacaaggcttgtcattttttttccttccgtgcagttgagattaaatttacatctgaagtatcattaatgcattatgtttttggtgatgtggaggatctgcttcagatgaaatgaagctgttacaaccctagtctcccatgtgtaggcatgggtgtccttttatgtggttgtctgtgctgagccttgtgaagggttgtttttcaagcactgtgccatccttcatcctttttatttctgggatgtcttccagtcatgatttccccattataagcataaagtactgaacaaattatatacaaaggaattgcattcaaaatttctggtcactccagttgaacttttgaattatttgagttcagaaatgaacttaattcttcatattgcatgccaagctgttttttctctgttattccattttgcatgccaagttgttttttctctgttattctattttgcatgccaatttgtgtttttgctgttccattttacattgtttttttttgcaggaaaaggttggaagcgctgaacagtggaatcgtaaaaagagggagccaaagttctccagtgcaagagacaactcctgcagtcaggaagaggtggttcctttggtaggttagttttcgttttctgatttgcaaaccagtgtagcatatggtatattattggccatgggcatgcactcgttcctttccacagtatgctgtctccaaaccaacaatcgcacctgctaaccagtacaatttgcatttatacataggctccacccccaacttccaactttccatcacatcacatcacatccaaaactttcctacacacataaactcctaacttttttttttccaaactaccaactttccccaaactttcaacttttttcagtaactaaacacagtcatagctgcgagtctaatgtgagatccaggaagtcaaaaccgtggagccattgctcctaatacactcatacatcttgctgtgccttgtgaacttaccatagccaaccaaatgatctgtaatttttccactattgcctggattgttttcgttgtcagtagagtaattactaattagctggtacactcaatccagtacggtattgttgaagtacattgatccagatatccggaatagcctattagatttcttggagcaacatcctgaagcaagatagcaacttgagatctagtgtgttttcatggacaataacacgtgcgtcccaggtcatgctttacgcctcacgatgaagattacaccgtactcgtgtcttcatcagttattccactcaaaaccgcattcctgaagattcgttgaacctttgtggccatgctcacttgggttaggacatattctcggcgtttaagtctagtgtggaaagattgttcaggtacccccccccccccaacccaacccccccccaaaaaaaaaaatggatgtgagtattggaagaatgggagtattggatttacgtttttgcgttagaatcaagatggacaagcagataaacactttatttttcgttagggaggaaaggaaaatataaataactatggaacaggctgataagggtgagttagggagaaaaggaaaatataaataactttggaacaggctgataagggtggatcctgcggttgccataacgtagagaagattgtactcgaaaccaagatcaagaacaagcaaccgcattccgttggccgggatgtcaagcgtggaatcgtttcatgtggagctcgccgcgcgagtgagagagaagttgacttccccagacttgattggcgaaaaagccatgcttaattccaacgacacacgcttggtcagagctcaatatgccaccaatagaccccgcctataaaaaagcgcgcgagcctgttccatcgtatcacaaccactaacgtgcgttcacccccctaacaactatctcacccccctaacaactatctcaccggctcgatcaatctctcaccggagatggtgcccgtccggccgtccgcggcggcgctgctgctcccgccaccgctttcctcgtcgtcgcggtgggcgcccagccgctgagcccggacagccccatcctgagggaccccaacgtgatccccatctacatgacccccggctcgtcgcccaccgtggcgagctgctacaaccagaacaacacggcgtcgggccccgactgcacggtcgagccgcgcgcgtgcccgcgcggctgccgcgacatgtgctacgttcactgccccacctgcaagctcgtctgccgtaagaaaacgcatcaaaaagttcaaaacagaatgcatatcatgcatggtaatagtaggtaggcgcgttacgtttggggtggtttttgatgatcggttttgcatgtcgggttttggactgtgactggtgcatgcagtgtgtgagctgaccggcacggagtgctacgacccgggttcgtcggcggcgacggcaacaagttcctgttccacgggcgcaaggacgccgacttctgcctgctctccgacgccaacctgcacatcaacgcgcacttcatcggcaagcgcaacgcggcggcggcacgggacttcacctgggtgcaggccctcggcatccgcttcggcggccaccgcctctacctcggcgtcaggaggaccgtcaggtgggacgccgccgtcgaccgcctcgtgatcaccttcgacggcgcgcccgtcgagctggacgccgtccccgccgccagctggagcccagcctccgttccggcgctctcggtcttccgcaccggcccggccaacggcgtggtggtgcgcctcgacggccggttccgcatcgtcgccaacgcggtgcccgtcacggaggaggactcgaggatccacggctacggcctcaccgccgacgacagcctcgcccacctcaatgtggcgttcaagttctactccatcagcgccgacgtgcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtcgaacttgctaatatggtagtgatcatttcggggttcacttataacaatatcaaatcacttaggccctctttgtttaggtttagggttattggtttagacttttaagtcagcttattggcttagggatggcgccgcctggctgggactgacactctcgaccacgggccgggcgcagggaggcggcggcgagcactacatggtttgaagtggggattgggcagtggtttgatgctgcttaattgaaggagccatggcggctgccctctcccgccggccgctgccgctccactcctgccacgcagtagaggggcagtaggccaagttggccccgcgcgagtgttgccgctgctccaccacctcgcctcccccaaatccctgcccgtcgcctcctgcctgatgagccgaagcttagt

SEQ ID NO: 62758 - DNA, 757 bp, Oryza sativa
ccgcgtcgagcgcgaccttcacccggacggagctccggcagggggaacaccttggcgctgctcgtgtacagcgcgacgagacggtagatctgctcgtgcccgtccatgtgcttgatcatgtcgacgaacttctcccgctgcaccgcttgatgatctcagcctgcaacgcgagcgtctcagtgaagaagcaggtaatcaccatggttgttgatcgagagttcgagctcatgaggcgtacaccccgggtggttgtggtggtgtgggtgatgccgcggctgcggccgaggcggaggcgggtggccggagttgccgaggaaggcgaagcgaatgagggtctcgccggacttgagcaggctgcagaagttgtcggcgacggtggggattgtctttggcctagcatccgacggcggcgcaggcaactgacatgtgggcccaataatatgtttttattgttttactcactgacatgtgggtcccatttacatttgtttttattttagtgctacgtaagcgccacgtcgatgccacatggaagtcaacccgccacgtaagtgccacgtaggacaaaaccgcctccgaaaccgccgagggaggtgatttgctctggttttcagagaagaatgaggcgttatacccggttttccggttgagggatgttattcacataagcacaagagatgagggaggttaaatggacttattcctataaagtataccgccatttcgatgtctggtccctgaaggccctggacggctg

SEQ ID NO: 62759 - DNA, 800 bp, Oryza sativa
gagggaagggtggggggtgaggaaggcggcggcgagggtgagggtggcggcggaggagaactggcggcgggcgtgggtggtggcgctgtggttcgccgccatggcgtcgctgttcgtgtggaagttcgtgcagtaccggcgcacgccggcgttccgggtgatggggtactgcctcccgacggcgaagggcgccgccgagacgctcaagctcaacatggcgctcgtcctcctccccgtctgccgcaacacgctgacgtggctccgctcctcctgggcccgcttcttcgtccccttcgacgacaacatcaccttccacaaggtaaattcaattaaatcccctcccgcctaaataacactctccgtctccttttaaatacagtcgtatgtcccattttaaatacagtcagaatttgtatatttaaattttaactatctatcttatatttaaaaaaaatattaaataggttaaaaataagatatttaaattttaatcgtctatctaatttaaaaagtttattaaatattttaaaaataggtcaaaaaaatttcaagtaagatataccgtcaatatgttcagattcgttatactccctctgttttttaatagatgacgcaattaagtttctgcttttttttttcaaaaatagatcaatatgattttttaaagcaactttcgtataaaaactttttacaaaaaaacgcaccatttaatattttgaaaagcgtgcgcccagaaaacgagtaagaggggttgggaacatgggatggccaacactccctaaagggagggggagtggggc

SEQ ID NO: 62760 - DNA, 4540 bp, Oryza sativa
  unsure (1)..(4540): unsure at all n locations
attacctcattccaaaatataacaagttttaattatatatctgaataagtgtagttgtttgatagccatctataacacggtctttacctactttttttggttttatcactaacatgtctacaaaacacttaaatggccgttgcttaaaacagagtcatcatcctgtgttcaataatcaactttataggtctaattttgaactaaaaacttgtttataatcccaagtacctgcttacaaaaactaataaatcgccgtgcaacttttttaaaaaaatatagttaaaacaaaatgaatggctcaatgcgtgcacttccattcggagacctatatataaacacacgcacacacttatcagttctcacccaagcctaccctcctcaaagaccaaatcctcctctcgaacaaccgccggagccaaccaccgccgccgcgccaccgcgcgccggagaatatggagctcctcgacatggtgcccgcggacgccatcgcgctccgcctctactccctcccggcggcggcggcggccgtccgctcgctctgggcgtggctcgtcaccgccctcgccgccgcggtcggactgtggcgcatccgcgccgccgccggtgtccgtagcgccctcgtggacgacgacgactacaagcagcgcaaggcgaagcagccgcgcggtgctctgcggcctgccggcgtcggcgaggcacggccggctcgcgccggggcggcggagtcggaggcgacgacgccgacctccccgagcgagccgagcacgccttccaaggtccggttcacggcgtactacggcggcgagggggacggcgccgacgagggagtcgtggacagcgtcaggagatgcgtggacaacgacggcgacggcgagggggagacgccgacggcgccggtgaggcggacggcgtcggggaggaggaggtggtcgacgacgacgacgacgacgacggcgccattcatggcgacgccgtgggaggagagggagatggccgtgaggaggaggggagacctggggtggtaccgccacctcgacatggcggcgctcgacggaagcgtcgtccggctgtgggacggcgaggtcacggcggcgtcgccggggcggcgcggccggagggcattatcggaattgcacctctcattgtagagacatggctcagtgtgtatattgtggtgtaggactattggatggttattaccatggttggtgtatatgacaattttgcccctgggcttgtcataccctagcagtatggctgaggggtaatggcccctcgtatgaggacataaatggaaatttggcaaatgccactggttatcctttgcttctgaattccaattccaaatttttacactctgccacttaatcctcattccttttctttctctgaatgtttatctgataactgaagctatccttcttaatgcattcatggtttagcttcttttcttaattatttatcaccaattagttattccctattgatgatcatttttaatgaagtctgctgatagagaatggttagactatgcatgtagatgaacttgccaaatgatataatctgcttatagattcagataagactgtactctactctaagaggaaaaaaattatttggatcaattaacataagcatcatggttgtttggtaaggacaccagttgacacggcatgatttgcagataatattatacaattatggtgatgtgtggaccaagccggcttattagttccgcaattaaagttgctaaacaaattggctgccttttcccaactgatcaactctgaatgaatttagtgaaccaccttggaagatggtagtggcaggcaatgctccatgcttttctctgatcatctctagaataataaaacattttaaagagcgaaataacaatgtagcaccagacagaagtacagtccaagacacgcatattattgtgttcgagagaaatgtggctatgattttttgaggttaattgtccttatttggtgttaagctatgtaagcacttcttttctacaagaaaaagacaagtagataaaaatcagtgataattgcattagtactagaaacactaactttatgcctatattccaaattagatatgaaatccgacaggtattaattccattttgctgatatcccggcacaatctatagcaggtatcaccttgattttgccataccctctcaaggctcaagcctcaattactcataattttggtggtggaggacaaaacaacaacatgggttgctttccattggatataaaagtttcgataataaagtaaatgatttagtaatagtggtctgaactattctagcatggattcataattaactgataacgacgggcttggaacctgggctataatttaaattgatgttctccgattgatagtgatatatgttacaacgagtaataccacgagaatatgcttcacatatacttggaagtttaactcaacaaaatgattgttcagactcgggtttaggtttattctagtgaagatgcaaagcatctttcagattcagtgtacattgcaggaggcaaattgaacttggattcactgaacaaatgtggcatatctaccacttctattgactgtccaagaaaactttgatcctgaaaattgttcggacttggaagttgggacccaaaacctttttaagttgcaaagctaaagttagcaacaatgatagatatacatcggtcagaatactgccaggataatccgcaaaagttagcaacattaatgataaatatactattagaatttggagcagttgaacgtcaggtgaggattatttttttctgaaagaagtcatcagacgaggataataacttttctcaagtatatgggtgcaaacaaactaaagccatatacaacatcatactgccatttcttcaggcaacaaactaaagctatgcattggcttcagaagaagaagaagatcaaaggagaggcagagttcagttgccgagttgctttcgtctctcgtatcatatcattccagtggacaaatcgatcggcaaactgccggtatggcgcccggacgacgtcggtgtctcgtagcagatgtgtggtcaccggctcaaaaaaaaaaaaaaattgtgtgtagtgcactgttcttcaaaaatctgaatagcaacaagccaaacacgcctcgtagtttttgagagacaaacttccattattcgccgcatcgttgcctactccagatagcaacttctaatgggcatgtttggtcaggggaaatttggagagaattatattccaacattttactatttactgtggatttcctatgttggaaagaaatatcggaggagatttttttcaaaaatttcccaaataggagaaatttgcattcattggtatagatggccaaaaggcccgcccggcacggcccggcccaggcacggccaagcacggcccaccagccatcgggccagcacggcccgatcgtcacttcgtgccgggccgtgccagcccatgggctgcgcctcccgcccaggcacgannancagccgtcgggccgtgccgggccggcctgaaggcgcgggtggcctattgtgtctttttctaaataagtctatttttccgtccctcctttttgggctgacatatatatatatatatatatatatatatatatatatatatatatatatagtgaaaataagtctatttttcatccctcctctttgggctgacatatatatagctaaataagtctattttacatccctattctttcgaccgtggcatacaatatatctatttttactccccaatgtttatgtctagggcctggcttgcggcccatcgtgccgtgccgacccggcccaacgtgccggtggagaggcctaggcacggcccggtggtcgggacgggcaggcacgggcccgacccctgacgggccgtgccgtgcttgggccaggccaaaacgccgtgccgtgggccgggccatcgggcctcgggccttttggccatctatattcattggcgactcgtgttgtttttattaaaacaaagatgagcttatgtccttaaaagtcttctcttttcttttactatctaaaaattgccacaagtttttgagcgaaaaactttcaaatgtaataatattgttctaccataactatactacaactaaaatatagcttgtatataagtattttttaaaaatatgcaacttcttatgcataaatcatagaagttataatgtacaattatgactactacgttgtaactcattgtaactacgtaatatagttattgtaactcacaataactaaaatgtgtctagtgtagcacaaatcttggcgcatcatcgtacggtcgaaaattcgaaaaccagggaaggaaaaaaattgtaatttttctagcaaatccgtctttttttttcttttccgtatcaggaagcccaacccagtttgggcttagacgtcatatctccggacgaggccgcgaaagcgaacaggcgtgcagcccaagagagctcggaacatgtagacccaatgaaccggaggta

SEQ ID NO: 62761 - DNA, 2973 bp, Oryza sativa
taacaaatagcttagaacatgtggtctaggcacacagtagaagaaatatttttgagaaaacatatttttagaggcatggagcaaataatctgcagaaataatcctgtgaattagttgaaaagaatggggcctagcttaaaatggataacgagttacactggtcaagcccacagagttaatacttaatacaacttacttagcttctgactcgctgctcctatcactggatgtagcatttgtgttcgaacagaagaaagtcttcccctgaaaagcatttcctttgtcattaccatttagagaatatgtaaaagtcagaaaaccgcatgtttcatgctttagttgtacaaaattccgggtttacaggcgagtggcacttaaccccatgttttaagctgcaagagatccagttaggaaagcttaaacggcataaaagacacacaaatttgcgaccagcctagtagtgactacacaacctaactagtgtttctacagtaaggtaagggcacatgtagaccaattttcagagcaccaaggaaatgaattctcaccaacacaaaccctaatagatgttatagagatcaagagctgtaacagaactaaccaaatggttcacatgagaggtaacagcttctgcttcgtgcctccttgaagcgagtgaattttgacctgataagtaacagtgcataataattcaagcagtgaaaacagagagaaggcgaccaaatcaaacttccaaaaatgcaaattctcttttcaatcaaacacctcgaagaaatctacagaataagtaactcatgcccagatcccaaactccaattaattccatggcaaacacacaaggcagcagcccagtctcttgtcttcccaaagctagcgagcaagtgagagctaggcggaaaccaccataactctttatctccaatacgtatacagccaaaccctacgccatcctttgcatcccgatgatctcgagctcaaatcgctgtagcatgcgcggcagattttccggagattcacgatgagggagggagaggagagagacggagcaagcggagcccgaaccatgccattctagaccgtgcggcgcacgaggcggcgacgccaaccacaccgacaacaacaacgacgaggacgacgacgacgacgacaagcggaaccgccgcggtggggaggaaggggggatctcacctggcgcagtggcgcggcgcagggcatggagccccaggcgggagaccctcgccagcatcccgacacccgcccggagcaaccggtgcaagcggcggcggcgacggcgacggcggcggcggcggcggatttggtggtgccgtgtgggggaatcgccgcggcgccggcgaggcgaagtcgcgaggcggaggagacgaggtgcggcttttgctcggctctcgcctcgaggagaagggaatcgtgaagctgggccggatgaatgtacttgggccggaggtacggctgcacaggacatatattgggccaggccgtgatttcagaaggctcgagggggagcaagttaaagtgtttaacgggcctaaatgggccaaattctggcccaccgacgggaaattggccgagaggttaggcctgccaaacaaggccgaggaaagggggctgctagctggcgcgggagccccactccccctccctttagggagtgtttgcaatcccatgttcccaacccctcttactcgttttctgcgcgcacgcttttcaaactactaaatggtgcgtttttttgtaaaaagtttctatacgaaagttgctttaaaaaatcatattgatctatttttgaaaaaaaaaagcaaatacttaattaatcacgcgctaatggaccgctctgttgcgaggagtttagttcccaacttcccatctccgaacacagcctgagtcttctcttaactaactaaattacttaatataattaacactaataatagtaattaagaaagattctgaagatttttttactaacagattgaaaattttttaagttagatttgaaaactttcaatttaagttttaaattttaaaaacttcaactcaaatttgaaaacttttaacttgacatttgaaaactttaaactcagatttgaaaactttcgacttgagatttggaaactttcaactcagattcgaaaactttcaactcgagaatcgagattcgaaaactttcaagtccagatttgaaaattttggaaactttcaatttgagatttgaaaactttcaactcgagattcgaaaactttcaaatcaagatttgaaaaatttgaaaattttcaaaatcgagatttgaaactttcaactcgagatttgaaaactttcaagttcagatttgaaaattttcaactcaaaaattaaaaactttcaaactcaaaacatgctaaagattaaaaaatcaaaaaaagtggaaaaaaaggaaagaaaacgaaaaaaaggaaaaaaaaagtggagagacacgcgcacgccggcgcagcggcgttgggccttctggacccgaaacgcgcgcgcgtattagtttttccgcgaggaaaggtcagcaaagattcggttactttttggagttttaacaaggattcataaccctctaaagaaagtcatatgtttacatacctcctgtgtgagtggcgacgaaaatgaaccagcgaaccaagcaacagattttttttttagataaagaagcaacagatatactgacagacaagcctgcaatcgatctgaaactgaaatgcgacatttgtgagattgattaaaacaaaaaaccaaaaattggagaatggagacgcggggaatcgaaccccgtgcctctcgcatgcgaagcgagcgctctaccatatgagctacgtccccatcgtgtcatctgttcttgtacaaattatcaaggcaacatctgtagccaccctcgaaggcacgttaacgcccagaaaaaaaaaagagctcggatgatgagcgtacaacgtgct

SEQ ID NO: 62762 - DNA, 853 bp, Oryza sativa
attttagactgaaatcagctctaagcgcaaaatgtgtgttggagatgaagtacatcaacaaagcattgcacatattttcttgacacttcgctctttctttttaaggaattgcttattattcattgttaacaaattttagacaggttatgcaagaagctgctaggttcacatttgtaccttttggacttcgaaatgcactagcgtactgtcaccacacaatgcagtgcagaactaactttagtaaaattaagagttttgagctccatctgaactccttttcaagagaaaagctctgtcccaagcaaaggcatggtagagtaatcattgcagcttaccatcaaaccaggtgcattctccatacaatgacaatggattatgtgggctcggtgaaggtggtggtctacatgttcagtacaaagcaaggcattggtatgcaaggtacaaaggaaggcatggggtcaaagacatgagcatgttctacacatacacattttgtcttacaaaatcaatctgcaaggctttgatcataaccaggacaattagcgccaccattagatgattctatatttcaccatctaaacttgttaaatctatcttagtcacgcacaagcaataaatgagggagaagctattaaataacctttagccagacccttttttttgctatgtagttacaacttacaaccaagaagggcttattttcttctccattctcaaaattataaccttgcagctgtgtcgtcaccaatcacacgcatttaatgctgagagatgattgtacctcccaattcataaagctaatttaaaaaaaaatagtttcctgtcatctactgttatcagaaatatatattca

SEQ ID NO: 62763 - DNA, 1119 bp, Oryza sativa
ttttagataaactttggaggcaaataagtacgaggtttcacctcatattttcttctgagttcttgtgttttcatacgtgccaatcaaatgattatatttaatttgtaacttttatgtgtcttaaaattgtagaacccaatgagcataatattttattactatgtatttttttcaattaatgtatttttaacaattaatgcatttcgaagctgctcttatcatgtacatggacgcagactcgaattgttcatgagccgagctaagccgttaaggcgcggatcgaggcatggaaaaaccaaaaagacaaaaaaaaaaaaaggaaagtgacaagccaaaattacacatgcctcccaaatatctcgccgaaatgctctctccacccccaagactcctctataaatccactcccctctacctccttccaacaaggaaggaaaaaagagaagcaaccagacactgcacacatcatcatcttctcccccgagaccgggtaagccatccccttctctctctagatcttctctctctcatcaagaacaacaagagtgaattaatgaacagcaagaacaacaacaaaaaaaacgcagaggagaggatgcatgcatgatcaatcaaattaagcttcaaggtagctagctagcttgctagctctaagctaaatacacatttaattaatttgctacgtataaaaaacgttgcaggtgatcttgggttagcttagctagctaaattaagctgcgtgcagcatggggctcctcgaccagctctgggacgacacggtggccgggccgcggccggactccggcctcggcaagctccgcaagtacgcctccttctccccttcctcctcctcctcgacgatggcggcgtcgccgtcgcccatctcggcggcggcggcggcggccgacgcgccggccgtgacgcgcagcatcaccatcctccgcccgccggcgctgtccgtgacgtcgccgcgcggcagcgagtcgggcccctccacgccgtcgtcgccggccagcgtcccggactcccccttcggctcaggtggtgaccaggccaccataatctcttcttgaatcttgatctttttgcacacgcatatatcgtaatctcgatcttaat

SEQ ID NO: 62764 - DNA, 1006 bp, Oryza sativa
cttgtacgtacacaacctgtagtgtacgtacacgatgcgatcgatgatgaactgatagtatatgtatatggcgcagctggtgtattatattacatgcgctagctggagggagagtgtgctaatgttgtactagtactacgactgatctgtttgcttctcctctgctttctttgtctccagaaaagagggagaggagagaagtttttcccctgtttttgtggaatatgtaaaagatggctgcagtgcatgcagcagtgtaaaagtgtgaaaagaagtgggcaataatgcatggccaaataatgttatgaacctatacttaagactgtttattagtagtaagtagatggtatctgtcaattatcatggtggttgataattgacaatacttgattgttttttcacagcagtcgtgttcctgatgtcaagacgatggggaagtttatcagaaaattgaatgttaccgtgctctttggactgttaaaggtcaagaggatgaggctgatgtatcatgaatgacagaaagtatgaaccatgctgccatgccatctcactaaattcacaattacgtgctttacacccccaaggccctaaaatatactcatatatatttttttgtcaataacttaagcgtccacttggaatttgagtcctgtgtgaaatacaaaacgaggctctaaaataagaaatccatgttgttgtaacagggggtcatcgccatccttcctattcaatcgtaatacttaagtatggaaagttcttcctgtgctagaaagttcctctcgaactggaaacatgctctcaagtcggaaattaaagttcctctcgagttgggaagttcttctcaagtaggaaagttcttctcgagctggaaaaatgttttcgagtaaagagaacgtgaccaagatggtttgtcacttgtaacttgttttgctcaggaactgaggcagattcgcttcgggagtcgacggtggagaagaataagcaagtcccaaagaacacaggaggc

SEQ ID NO: 62765 - DNA, 1374 bp, Oryza sativa
tcctccttatcctcctcctcctcctcctcctacgtccgcaacggcctccctcccccgtcctcctcgccccccgagccggactcgggctacgccgccgcgtgcggggatgccgcgggggactggatcctcttcaccagcccgacgcccttcaaccggtgcgtgctcctgcggtgcccctccgtgtcgttcgaggacgggggcgtgctgctcgacggcgtcaacgagcgcctcctcaccgaggagcggcactacgtcaacctgagccgcggaagcatccccgcggcgcgcggcggggatggcggcgccggcgacatattctaccagagggtttgcattcccgcggaggacggcggggtgatcgcgctcgattggccggacaatttggatttgggcaaggagcatgggcttgattccacggtgtttatagtgcccggcacgcctgaggggagcatggagaggggaatcaaggtgtttgtgttggacgcattgaagaatggctacttccccattgtgatgaaccccagaggctgcggcgggtcacccctcacaacacctaggtgaaatttatgccccttatttatttaccattccaaagctttggacaacatctttgctgcaaacgtgcaatagtgcttagctagtgatgactactactccctccgtccctgaatatactccctccgtcccagaatataagaagttttagggttggacacgttattaagaaagtaggtagaagtgaatagtgaagtgttgtgattggataagtagtggaggtaggtagaaaaagtgaatggtggagggttgtgattggttgggaagagaatattaatggagaagttgttatattttgggacaaattctgagacctaaaaattgtaatattttgggatggagggagtagcttttactagtattagtatttgtaagaaacagtttctgtgagcaaaattagaagcttcttgtagcctctgcataattcactttaaattttatagtgttttccatgtttgctaaacctatgtactattgctgaatttggtaaatgggaattccagtccgtctcatacacaactctgttatccatgctgaactcaggctagaagattacaggaccttggtggtagctagtactgatgtgtaacatcagtaaaaatgtttagaataactagcgttattattggataacaaaacaactttacttaagaatcgcagaagcagtgattggtaagtgtggattgtactggaaattaacataattttagttagtgtagtggacgatagttttagtgatcatttcaaggaaaaagtacatctttgcaagatcaatcataaagttgacttagaagtttgatatgggtaggattgttgtct

SEQ ID NO: 62766 - DNA, 2267 bp, Oryza sativa
  unsure (1)..(2267): unsure at all n locations
tgcatgatcaagaggtggcactcgtcgagcaggatctcccgcacgccgtcggggtgctcggcgtcggcggggtcgacgtcggcgcgcagctcgcacggcggcggacgcgtcggcggggaggaatgggggcgcagcgtcgtggcgagcggcggcggagggggaggaggaggaggagggcgcggcgggtcggtgtcgttccacggcgcggacggcgtgcccccggggctccacccggtgtacgtcggcaagtcgcgccgccgctacctcatcgccgccgacctcgtcggccacccgatgttccagaacctcgtcgaccgctccggcggcggcggcgtggggggcggcggcggcggcggcaccgtcgtcggctgcgaggtcgtgctgttcgagcacctcctctggatgctggagaacgccgacccgcagccggagtcgctcgacgagctcgtcgagtactacgcgtgctgaccgcgcctagctacctgcgatcgagaagacggcggcggcggcgatggccggcgtcgccgagctcgccggagtcgtcggaggcttctagaagggggtaatttggtaattcggtttgttctttttttttttggttctttctttgaggttaggggtagagttgtaatatacgccgagctacgagggcgagtagcgaaatgtttggagatttagttaaccttggggtgtttgtggtaagctggagattagcagtgtaattaccgtccacccaaggtaaatgctcttttggagcagttaattaattctctaatgctggatgtaataatagcttgcttcttttttgttcttcttcttcttcttttcctgcttaatcttaataagattttagggatcaatgtatccatgtactctccaccattgtataaacttcatgatcatctcttctgagattcctcttaaattcacttgaaattcttggtttggtatttggaggtgttattcacttaattgatccatgctaaaaaaaatgcatgtcacttaattatattaactagcatggaggcccgcgcagattgcgcgntagcatcattatattttctctcatataatagcatatatgttttctcattatattattaaaatatattacaatgacaacataattttaaattttgcaataactttacgaaactactaatgtgtaatattcatattgtattttatatacgtgttagttattaattatttttactatcaaattttagttatctataaattatatatattcctttatggactctagactcgtcttttatttttttttaattctaaatttttattatttctaattgtatttctatgtggactctaaactcatctttcaatattctttaatttttaatttcaaatttcagttacttctaaattgtattcctatattgactttaaactcttcttcccatgtttttcttaatttcgaattttagttatttgtaaattgtatttttatacggactctaaactctacttttaattttatcacatttattccgaattttagttagtttcaaattcatgtatggactctatactctacttctaatattccttattttttaattccaaatttcctttttttcttcattgtatttctatatggactctatactttacttctaatattccttattttttaattccgaatttcagttattttctaattgtatttctatatggactctagtcttctcttttaatattccttattttttaattccgaattacagctatttcctaattgtatttctatatggactctagtatcctcttttaatattccttattttttaattccgaatttcagctattttctaattgtatttctatatgaactctatactctacttctaatattccttatttttaattccgactttcagttatttcctaattgtatttctatatggactctagtctcctcttctaatattccttattttttaattccgaatttcaactatttctaaattgtatttctatatggactctagtctcctcttctaatgttccttaatttttaattccaaatttcagctatttctaaatgtatttctatatggactctgctttttctttttctccgattaacgtgagaatttctaggccatgagagcgaacgtggaggctcctttttctattcctttaattatataatagattccacccatttgatttgtcttacaaagacaacacacagcttgattcctaagcaatgctatatgtatatactataaagcaacttt

SEQ ID NO: 62767 - DNA, 2114 bp, Oryza sativa
aattcctgcagccccctgaagtgttttggaccacttaatcacccatgttagtatagtaaatagtatacatgatatgccttagaataaattaggttgaaccaagaacccatgtatgctctgaaaattatactaagtaagcacctttttttttaaaaaaaaaaggtatggttactagtattatctttctcagatagatgttgtcctagaatgcgtatagtcaaacctccaaaccttaaatgattaattgatgcaaaaaataagtgtttgatatgagaaattttatttgtcgattttttgtgaaaaacactttcatatatctatgcttttaatatttttttttttgtaaatatatagttaaaagaagtaccgatgagactagtgtatattagacactgtgttgatgtccaaaatgataggtaaaaaggaaggtagtacagattggttgggatgaattaagctaaagtttacttctaaatttcatcggaataatccatcatttatattattaagatgactcaagaacaagacaccatgtttgtttgttgtggatagcaacttctgcattaattggagaaaaagataaataattacactgttagattctagtggttcagattgtcaaagaaaaaggtaggtttgatcgatttagttatatataatatttatgaaaaaaatactccaaccattttacattataagttgttttgactttttttaagtcaatgttctaaagtttgatcaagtttggagcaaaatataataaaatttttaacaaaacaaatatattatcaaaatctattcaatgttttacatttaatgagactaatttgattttgtagatgttgctaattatttttttttacaaacttagtcaaacataaaaaatttgacaaaaaaaagttaaagcgacttataatataaaactgagggatcagtagaagcaaaagttgtgtacaaatgtatttatgaaattgaaaacaagagttgtatatcacaatttacttttaatatttactataaaaaaatctaggtctgcacaaaatcgagcaggaaaccggctaattcagtgttttttgggccaagaatagttcacaatttcggactttctttatgttgtgagttacagatacggtagatgacacattgatctttactctgttactctgttcgcaaggggtgttcccaacatttccctctcgttttccgtacgcacgcttttcaaactactaaacggtgtgttttttataaaaagtttatatatgaaagttgtttaaaaaaatcatatttatccatttttgaaaaaaaatagctaatacttaattaatcacgtgctaatggactacttcgttttccgtgtgcactgtgtatgttcccatcctcccctagcaaacacagcctaacagagcatagcagagcgagagacaattcgtaagacagaactgcatggcaacagtccaagtagaacctgaccccgacaagcaaacaagaagccctatttgtggcttgcaccctaaactgaacatttagtgcaatagcaatgcaagctatggggcccatacccatagcctaaagtcacagctcaaagatactccccccacagtgcaagcacccatatatgtgtggatagagacactgatgaagagtaccaagcccacagtgggcgttacccaacaatgcgcgaggtcacgggaggggcaaagaaattttcctcacctacccctcctggagcgagggtcgaccctatccattcggcgattccagcaattcctctcgtctctccgcctcgtcctcctctcgccgcgcttcctcccactccgccgcacacgccgtcacctcctcccactccggcacacacaccgtcgccctccccttgttgccgaccagatcgattcgtccactccatctcatatcgtctgtccgcccgcccgcctctcgctgcacatctttccctcgctcgtcgtcgcgtcgtcccattccgctgctcctttgatccgaccgaaccatggacgaccgccccaagttcacgcagatcgagctccgtagtgggcttgtgctgctcccgccgggctataccccgtccagagtggctaggggtggcgggaagaagaaaaggg

SEQ ID NO: 62768 - DNA, 1252 bp, Oryza sativa
aagtcgaggaggggctacactacacagtatctgtactctgggaaggtttcctttttcttttcttgaatgcacaattactattttttttctcatataaattactattccatccgtaccataatataagagattttgaccatttgcctttcaataaaaaaaaatccttaaactaaaaggtttctcatcttttctctttcttttttttttcttttacctttaaatagtgctcttattaaccagttggcatcattgtatcgtatgtgatctagtgtctctgtctattcctctctttttttttattgagacgacggccatattgctcagtgcgtacaaactatcgacaaaaccatccacttttacattagactagagcttggcgcgtcgcctgcccgtaatgatgttgaaaaaacacatgataattagggttactgaaaaaaaagaagaaagcagatggttatagataaccaaactacagtactaattacaggccaacaaatcatgcacacttcataaaagcgattattcaaccgatgctacagccaagaaaaattttcatatctgtaagatctatgtttacatattttgatcaaccatagcgattcaaatactaatcaactggtagacaatccctgttacatgaaccgcaattaccgcatacctcacggtgtttccttggatcagcatttgcaccttgagaaaagcatgtcaaaatcaaattccctggcaagcacccaatgcggaaacctaaccaggcgggggaacaaaaaccaaggtctcgatcaattacttgagcagtcatctatggtcaccatgatggaaccagtatggttatgtccatgaacaacaccggtgttctaaaaacttacagttccataccatatccatgacctaccattgaaagaatattataaagctgatctgacagatataatcacatcgatctcaaatcaacaattcccaccttagggtcagcatttccctgaacttgtacataatcacagcgtaggaaagatgaggaataaaaaacctcaaacctaatcgcatatctttcggaatacaaaaatatctattccattatactcttgcatatctttttgcagggcaagtaatggcataacaaaaaaaaaaaacacggtggtagcacgaacattgccatggctaaggaaccgcaatagccctctctgcaactgatatcttcattaatctgaaagtagtaaagcatagtagtggactattggcatcatggttcttg

SEQ ID NO: 62769 - DNA, 766 bp, Oryza sativa
agaaaaaggaggcttattttacagcttgcagcagattcagactgtgatcagtatgtaatagacgttgcgcaatgacctgcaggctaggaaatcaatcgccgattcactatagctgtccatgaaataaatacctgcatgtgaaaatcaatatgaacaatttttttggagacggtgtacgtatatatctagcaacttctatgatgcgtcagggagaggagagagatattgaggcttgcattcaagtgtttttatggaggacactttctgcccggatctaacggcaaagacatcataattcagcaaaatttcgcccatacaaatgcataaatttgacaatctgtcccatttccagaatccagacgtgaacctgaaagagccacaatgcgatagtgtgccaagctaaagcaatcctagtgtatattgtaggcatcactcacttatggcatgacatttaataggtagtattatactacaatattgttattagctggagaaatttcaacagttgatttataaattttactacaattagattttttactagtaataatcgagatgataatacaaataagggaaaattagaaccataccattataattttgcaaaatttgaaatatgtcatcatgacccacatgtcattgactcatgtgggtcctacatgtcattgatataccgatgatatatctcaaactttgcaaaattataatggcatggttccaattttaccaaataaataaatatgattcattggattggaaaagatga

SEQ ID NO: 62770 - DNA, 762 bp, Oryza sativa
ttgcgaagtggacacccagtcacccacccatgtccccgtgttagaaacttctggtaactaaacacactcaaatcgaagaattacaagtttcttgaggatgacatgtagaactatgaacaaaacaatattattgttttatttgtaaatggtgaaaaatgtaaagataatagtaacaaataattttttttgttgcagatgattgcgacggcgatcgtggtggggatcacgctgcacgcggggaaccatctggcgtgcgatttcccgaggctgatcgcgtcggggccggaggagtaccggctggtggcggacgcgttcgggccggagaagccgacctacgtggggctcctctcgggcgtggagggcatcacgggggtcgccatggtggtgctcatgaccgtctccttcacgctggccacccacccgttccgcaagggcgagaagggtggcagcggcggtggcgcagccgccaccgtcctccccacggtagcgcggctcccctcgccgttcaaccgcctcgcggggttcaacgccttctggtactcccaccacctcctcggcatcgtctacgctcttcttatcgcccatgggtacttcctcttcctcgtccgtcgctggtatttgaaaacggtatgtgccatcacaaacatccttaaaaatatccaattattttatattttttccttttttttgcttgaatccgttacggattttttgggttttttttttaaaacggtgagggtgacggttttctgtttggtccgg

SEQ ID NO: 62771 - DNA, 4410 bp, Oryza sativa
  unsure (1)..(4410): unsure at all n locations
aaattcccgcagcaatgcgcggggttttacctagtataaacaaaacttataactggttaagtctctctcacggtaaaacatgtctattcgaaatcaaatcctaaacttgatagctaaacttgataggagagcgtttgtatttatggttaattaaatttccagtagagtatatgtgtgcacgtttatagaatgattgtctatgcgttatgtaagcgtcttatgcgcggttgtacggtgggttgtacatattgttttttttctaaaaaaaactaagacaggattagagaggtactaatcgtgccaccgacctccttattccttcttagttaagtaggtatctactctctccgtctcataaaaaagaatttagaaccggatatgacatattatagtataataaatatggacatatgtatgtctagattcatagtattaggatgtgtcacatccaatactagcttgtttttttatgggatggagggagtataatctatcaagatcgacatattcacatggctcgctaatttcatctcttttggcgattaattctgttggccccattgggtcactcgtagcatctatatttctatatgcctatatatatatatatatatatatatatatatatatatatatatatatatattgtgtgtgttacatgtcgagttctcaagtgtacacatttccagactccagtactgtagtagttgccatatactatctccgtcctaaaatatagctatttctagcacagtacttancctaaaatgaagctatttttctacctaccttctcctctcaaccaatcacaaccattctttttcatctaccttctcttttcaaccaatcacacacctttttcaattattctcacctattttcttaatacccatgccaacctcaaaaatacttacattttagaacggaggaagtactacgtaggagcagtagctatagctcgtcggtcatgtgcttgcacgttgcagcagccacctttccaagcgatgccaatgtccttatctgaagatctagcataacacgccggccacgtatgtgtcctccgtttctagtttatgatgaataagaaacggtttaattttgtgtgatgatgctttgttaacggctgtttggttcatcaagtaatgtaaagtttgggacatgctttagctaaatagtacttatcattctcccttttaatttacatctgggtgcatgcatgctcagctccccaggtcattagttatttgagggtggtttattaagaattgtttcagggatcagagcataactcagtggtcatcagtccatgctttgggggtttctgtccttgtcacgtcgggccaaaaataaaataaactcaagactcaaatcatacaggaattaaaatgaagaattttttaatctacgacctttagatggattcatgtacatagtacacctctagcatacgtacttcttccgttccaaaatataaaaattttgggtgaatgagagaaaattgtaaatgtcttagaaattgaacataagaccttagagataattaaaaccacacacttcttaccactgcactatcaagtgcattttagaaaatcacaagtaagtatatggcaattttacgcagatgcaccggcttaattctgacttggtgatccatcatgttctaacctggcatccgatcaaacacaatcatgcaagcatgttcctgtgcaggccatacataaattaaagtccgtacttacctgaaaaattaattaatttccagcgcacacagcctgcctcaggccctcagttagctattccactgcagaaaaggagtgtgaattaagcacaactccagagtccagacttggcgattgcgccaagctcatcactaaaatccggaattgatatgatatattcctgcttcgcttgcaaggcaacgtacgtacaaaatatatttatactttttttttctgaatcttctttaatttgaagtctagctatctaagctaagctagctaaagcttagcccggatggatcaaacacaatgcattcttgagcgacacgccgcgctagtctcgtccaatcaaaacattatcaaatcccattttaaaaaccgggagaaaattaatggaatctctccggctgatgcatatgcagctagcttgccatgttacccctccatggccgcgttgcgagtacgaactgattatataatcgcatgcccactctcgcatgccgtcctctcgatccattcatcattcgctcgctctcgctctcgctgatctctccatcttcttctccagctcagttcagtgacaagatcgatcctaaatgggcgacgatggcggcggcgtgaaggtggcggcggcggcggcgacgacggcgacggggatgaagcagatcacgcggctgagggagctgctgcagaaatggcaggcgatggcgctgggggcgaataagggtgatgttgccaccgccggagacgaggaagacgaggaggtggtggaggtggctccggcggcggcggcggcggcggcgataccgccgttcgtgatgaggcggctgcagaggacggtgacggtggactccgacgacgagagctgccagagcccggagccgccggcggacgtgccgagggggtactgcccggtgtacgtggggccggagcagcggcggttcgtgatcccgacgaggtacctcggccacccggtgttccggctgctgctggagaaggcggaggaggagttcggcttctgccaccagggcgcgctcgccatcccctgcgagaccgaggccttcaagtacatcctccagtgcgtcgagcgccacgacaacggcctcgccgccggcgacgtcgtcgacggcgtcgtcgacgtcaacgaccgtgcgccgccgcgcgactagtagcagtttcttcgattgctttattaattaattacttaattaattaattagctcgcgatcgagacggagctagccgtcagaaatgattaatcgtaatccatgggggttgtaaacttgtaatggaactgcattttgttgtacgctgttgtaacacagtattcctagatgaaaaattaaaatgacatgtaatatttgattgttacgatctagccaatgcaatatctgtcgagctcttcgcgtgttactccatcggtctcaaaatataaaattgagtacgttgtactagattagatatatccaattacaaatttggataaaccatgtccaaattcataataagtatgtatgtttaatttgatacgtattttctttgtttcaaaatataaaggattttggatagatgtcaggatggagggagaactagattgctatatttattttgagacggagatattaccaatgaattacaatgggccgtgttttgtgagttaagctgaatctgaaaataaactaatctcttccgtacttttgaatcattcatgtgacgcgcgcgatgatctgtgcgtcaagtttgtccagttggacgtacggcatgcatggagcgctccccgctgttgccagcgttttcaattttatttttgttttcaattttaatacttgtgtgattttatccgaaaactaatcagaaagacagaacgatacaggcaaaaatcgctcgcataattgagtgttattactttgtctattacttaattaactagtacgtacgtaccatcaatcattttatcacacaaaacataaagttaattttagcttagctctgccgatctcatgctatgtcgaagccagcagcatcatcgagccaagatgtcaaagactatttatttatcactagccaataatcctaaaaaaataggcacgatattaaagactatttatttatcattaggaaggaagcccgcgcatatgcgcgggcaattcacttattgtttataaaaaaaatactaaaagatatctcaccatattcactataagaatcattacctagaataaaaaaaaaatatttattccgtaaaatagaccataaactttaatatactatatgataatgtctattatattcaaacaaaaatcactttattatcaccatccttcacaaacatacgagttaatatgtgttttgtttttttcttttattatgcatctaatcacttatgcattttcatgggtaatatacgaaagaataatttatattatcaaaattgtttatgctagttattaacattattaagatgatattggcataattataaagagttataatgtggttccacgtgctattttcgatcgtacgcatgtatgtacgtacgtatgtacgcacgcacatatgtatgtttttcatggtgaatatatagtagtctctcggatctatataatttctcttggcttttttttacaaatattttcctcttgtaggagataatgtttgtatgtgtattcacaggatgggctgcaggaattca

SEQ ID NO: 62772 - DNA, 1298 bp, Oryza sativa
cctccggccgatctagggttagggttttgggaggaagagggagagggaggaaggggaggtgagaggaagcacggccactgcaaggccaccgccgccacccgccctctccgtccctcagtccctccagccggatctgagagggaggggaaccgccgccgccctcgctcgtcctctatctggctagatctgggagggaggggaactgccgccaccaccctcccccctcccctcttcggccggatctaggagggaggggaactgccgccgccggccccgctgtcaccgtggccgtccccgcgcctcgccgtcgccggatcccgccacccctgccgccgaacacccacagccgctgagggagagagggagaggagagctgagggctactgagggaaatgagaggtgagggagaattgaggagataagacttaggaaaaaaattagcgatgtggcgcctatttatatgccacatcaatttttgcaggcggaccatataaaagctccgcctgcaaaaataaagagtatttttgcaggcgcaccgcttaagttgtccgcctgcgaaaatagatttttgcaggcagacaaccatctcaccccacggttgttattttcgcaagtggtcatttagctttcagaggcctgcccacctggaaaaaaaagctatcatcgggaaaaaaaatggttttttagcagtgtgaagggaatgtcggttttcggtaacagcttatttaatttggtggggagtggttgatacatgtcttggctttaggagagtggtaatcatcgatttgtagtatgagatgtccaacactttaactttgatatctaaagtaaccaatgttttacattcgacgatttaattgaaggcaacaatatttggttattttgcgtaaaaaaacaatatttggtcataatatggcgcaacaaaaataatctaaacttatactccctctgtccaagtttgatcgtcatatttcaaaaaattatattttcaattttgatcgtcacatttgcagtcagcagccgttccatctcgtccgatgcgctggccgttcctattcgcgtgcgaaattaatcaggttgcgcgcggacgcctcgggagcagtctaaaaaagcttgttgcatgcatgcaaaattaatggcaatcacagctggctacatatcattggttccgtcgtgcatgcatgggccattatgattagaaagatgtaagtgcaataatgagtagattagaaagatgataagtgcgttttctgtccttggtctgtgtgtcaagccaaaatatgacgatcaaacttgaa

SEQ ID NO: 62773 - DNA, 740 bp, Oryza sativa
atgtaaatttccaggatgttcatgtagttagctcccaaccaaagtggaatttggtttttgttcgtatacttcaacaatgtgaatttttttcctgcagtaaccttggtttttgttcctgcagtaattgaatttccaggatgtgaattttcaggatgttaatgtagttagctcccaaccaaagtggaatttgctttttgttctatacttcaacaatgtcacatgtcttagtttaatttggttttggctaatttagtcttgaaaacaaaatgcactgtagtaggaatcacttgagaaattcatttatttcataaatacacatgatgaaattatttttttaaagttctgttattggttgccctgtcgatctattgagttcacaaggatcttcgcttggtgagtataaattttgaattctatcctcttcgtctgtttctcttctcttgctcgatttgctttgctgttggtgcctctttgtgactgtactgtatctgctacttttttttgttaatcttgtcatggatctcggaaaggttacctgatttcgcatagattttgtggcttaagaagtaacaatcattgttaaagtaagtgagatttgaaataattatttcctaataagtgagatattagataatatgctggtaaattatttcatatattattactcctaataagtgataatgttaaatttttctcactcttcgcattagctacgtacaagcattataacaaacatctca

SEQ ID NO: 62774 - DNA, 4499 bp, Oryza sativa
  unsure (1)..(4499): unsure at all n locations
tgtgacatttccaatcactatttgatcaattacacaacaaattgcttcaataacgaacaaattgatgtgaccaatgtggtgaatgggttgtcaattgattttttacatggatttctcatgctactcgggttcaggacaagaaaaccacctgtaacataacagagttaccattgctttttcaggggcccgcacaagccgacctgagggattcaatagctcaagtgaagtccgacattgttgttaaggtactcttatcttgtactgtattttcagttttgattcataggatacttttttgcaatactttggtatgcaagtcgccctgttaactgaaagctctgaaccatggtttgaagtctcgattgaactcctaatattcgttctcctttatatatggctacaacctattatccattattattttgaaaaataactcgagttatacaatttgtcgatttggacatcataattcataagccattatattttgtgctcctcacttatgcaattttgcattgttctgttagtccaacattctattatgccctttcctttcacattggtctccggaaaggctagtcatttgatgaagcatgtgctgctggttttactgaagagagtggaaccttgggagatatttgggagactgtttcgggcagtgacctcgtgttgctgttgatatcaaacactgcataggttaacttaggctctagctgcatgattttagttgccacttgatgttgttacctttaccaatgcttgtttaaattgtgctgaatttcatggtcctgtttattaaattgaatctccaatgccacatgccatctgctgtcacacaatcactccttttatcccttgtagatgcagcaaagcccacactcaaaagagagatagttggtgatggatcaggagctctgagcttggcggtggagcgtgatgctttgctccaggaggactccatcgtttttgcgctcatcaagcagcagcctacactcccgctgccgaagctaccggtggccggtcccttgcggaaatggtaattctatcatttaccggtttcttcttctgttgaattgtagatagatccatttgatttgatcctgatcaagttctatttttgaactgttgtagttctttcacatgacaacttgtggttaatcaaagctctggacatctacagaagaacaaggaatatggtctgtatntcatcatgtacctttattttgtttttattattacctagagttacatgcattttttttccttctgtacgaaggcattgggagaactaaatgatctctagaacataagacaaaaagcctatctgatttctataatctttgtcagtttaaaactcagtaggaacttccaattcccagttctaacagaggcaattatctttaccttatcctgtaactgtttacttttcaccgctgatacttttctatctattgtcaacttgaaagactaggctgatccataatatttcctatattattaattagtaaccttgagctgttctcatagataatggaggagaatgggttattgttgtgaacatctttgtggctgtttgaaattatcatgtatcttttccttctttctcgctaaccttatctcttctcctcctctccacacatgaaccagccacggcagtgaaaccaacgggcgaacgcgttgaccaccgaagtcgccaccatgcgatttccaccaagatcaccataagccggtcttcgcccaataacgttgccataaaaccccaggtaagttcctattgcttgccttgatccctcaccatatcttttgctttcgatcattgatccctgtccacactcttctgggcttgggatttgatgctgtatgtatgtgatgatttgaatgaggggatacgactaggaaagtaccgtgtgagggatttatatgatattagtgtcgtttgacttgattagattcaatctggctttttttaggcaaattttgctacaggacatcacaattgtgtggttttagcttaggggcaccatgaaagtgaagttttgggggaagacatcccataaccacaaaatttcccataataatttatctacagtatcaactcctttctcagtaaccacaaaagaagcttaccaaaaatatacaatgcaggcaacaccaggaatacatttgatgatgtgtgctccttagcacagaatgctcagctatcatctcacatgaaacatatcacagatattgcccagactatacatccttcaaccaggctttacattgtcgctatgaactccacattcatgaaacaagacagagttgtcagttccactccaagctattactctcttctagctgcattggttatttttccatgtccttacagctatataaaacaactcacatataatgtcttttatagtactttggtaaggaatttacaggtagatatataaagccgctgatgcaaaacaagaaagccatcggtatttgtcagtgatatgggcccgggggtacccacactaaagggaaaaaagtcatttcccccagccacgtggtcacgcggcccgaaacccctggcgggggaggtcggatgcgtgggcagtagatagccaagaggtggccgtgtccgccgagggggttcggggtaaccagttgcacccgttgggcccggggggtgcgttaccccgaggccctcgctcggccgccacgtggcgaccgagcgggcggaggtaagggcgctgccaggcgcatttatgggcggcgtcccaaccaacccccgtcgcttttaatgcgacggggcaggtcgtgcgctgcccagtgatcgacgtgcgtcaatcactttgaccaggtcgtgactggctgccagcggataggacaggcgtcagcgcacccacgacctgcctattcaggcggcgtgggggcaggtatgccctgtcccatcaatggtaggggatcgacgattcgaccggtgcatcccgcgtgcatgagcctccaaagtctccaagaatttataagggaatgatgggggatgtcccccgtgttaggcgaaggatggtgttgggccctacatgaggttgcgcggccgccttactttttgcctaaggcatgagtggaggccccaccaggttcgcgcgggcccctccttgaaaaagggacgggtagaggtggtgcatgtggtatccccttgaactataaaaggagaaccttgccgcccgagcaaggggacgactttcggaagcttgacccttaggaaagagttagccaaccctctccctagggtttgagaactcttgtaacctgataagcataaatcctcacaggagtagggtattacgcttctaaacggcttgaacctggataatcctgagtctccctcttgatcatcatccaccacgctagcgcgatccatagaggagacacgctcttgatcatcgcgtcctactcccccggtcgaactcacaaaggggatctcacgtccctccgctagagagaattactcctctacagtattcaggtccagacactatagggtgtttcaaccaacatgctcctatatatgtcaacagatggtcgttgcaacctaaagaaatgatggaaggactttgcagcaaacattggcatacacctacacacaatttgcagtcccccgagaacagtacttgtgagctgttatattctataaaggcccttcaaaaatacgtgaaaggagaggggtgtttttgaaaaaacgccgcgcactacccccaagccccgaaccctagccgctgcctccgctcacaccatctctctctcgtcttccctctccctctcgcaccgctgccggcgctggcgcctccgcctcctccgtgcgtcgtcgccgagcgcagccgtatccggctccaccaccgccgtcgccatacacctccgcgccgtcgcggcgaaggtcgcctcgcgccgaccgccgcctcgcgccgaccgccggcgtccggatccggcctccatgtggtcgggggacgcagatctgaccgcccccgtgcgccgggcaacgtctccgcctccgctactgccgtcgccatcgccgagcgccgccacttccgccttctccgtcgccgagcgccgccgcttccgccttcgtctcgctccaccgctgcagcgccgtcgtccgctgctgtcgcaatcgctcagcggtgctgctgcggccttcgccaccatcaccgactaccacttcttcctcgtcctctagctgtcctggtaaatcgaagctcctcccggatctacaaggctctggagcggaggtagctgcaggcgaagcagggtgtcgcagcgacgcgactgttaagctgcgtggcagtgtgctcatgcagctgttgtcctaacgagcgcgcgtggtggcacaaaagcaacaacggcagccgaagtagtgcagttcctcggtggcggcgctatagcaatccggagcagcagaggtgtgcgttctacgtttcctctcttttcattgttgttgttggctggggttgacgttggcatcgatt

SEQ ID NO: 62775 - DNA, 1144 bp, Oryza sativa
tcatttgtttttcacaggaacttggcaaacaacaaccttgaaggacaaatccctgataatataagctcatgcataaatctcattagcttgtaagtttcatttgttctctctgaagttctatatcctctccgatggcagggctcttaactttagctttgtaacagcaatgcttatggcaataaattaaatgggactgttccacgttcattgcacaaacttgagagtataacttatttgtaagtgttattggttttaggtgattttccttcaagcctgccataaatttagttctgttcatagtgcctaatgatttgtgtttccatccgtagcttctacgaatctgtcatcaaactatcttagtggagccattcccattgaactagcaaaaatgaaaaacttggacacatcgtaagtaccagaagttaatttgcattctgcaattgcttttaagcaagcgattctcatgatatggcgtgttagctgatatatttgaaggggcttatcctgtaacatggttggtggttcaattccctcagcaattgggagcttagagcatcttctgtgactgtaggttctatagtatagtacttttctataaaaaaaataaaataaaatacttgtattatgtcatgacaacatcctcttattcctatagaaattttagcaataataatttggttggatacatctctgctgagtttggaaacttgaggagtatcatggagatgtaagtaccttctcacctacgcgttctctgctctgttcctttgggaataatgcagattcctcttcctttgttttagtgattttttacttgcaagaaatgaatagtcaatcattttaattgccccagtggatcatctaatcgatagtaaaaaataattccaaatcaatgtggacgtaaagaagccttaagatttcatatgaacaaaaaaaactcccaaaccattcatatatgtcgttcctaacagcaatgccgtttgtaacaccaactttagtgcaaaaaattatctctaaattgactggagggattatgtgaatatgaaattgcatggacatttttgtaaccacaaagatatatgccgaccaaagttcatccatctaactgggatttgggaggcattgtagatttcagcagtagaca

SEQ ID NO: 62776 - DNA, 921 bp, Oryza sativa
aattcctgcagcccgataattttctttcaattttttgatttgcaggtgagggcgacttcactcatgctactcaggaccaggatcatggtgctccaagctctcaacgaactaccattgcaccgggagtccgacaacagcaacaattcagtgacatacaacaggatagctctagctcattcagtgcctctagctttgaaagtggctatccaacgtatgtgtacaaccgtccccaagcttctgattatcctgctactacatgggtgtatgaatggcaagagccttagtggtatgctcaattgtacgctcagtggcaaacaacatcatcatggacaggtcaaagttgggaggaatacaaggcggggttgctacattcacatggcttgatgctcatgtccacagaggagtacaatatggcatataatcagtggaatgcgtagctatgcatgtccttgtttatttcctttcattcgaactagaattgtaatcgtggacattatactgtggactctattgttattgtggactatattgttattctggactgtattgttattctggacctacatgtggacatcgttatgctttgaaatgtgagattgatgattgttattgttgttataatgttatgaattattgtattgatttgaactccacaatatagagtaggtcatgccgaatttttctgttgtataaccacatcttaattaactaaaatactcacattttagtttttttctattatttttttcatttttcttatttcagttccaacatatcgcggttaccgtcctcttaccgcggttaccgtaccaaaccgtgcggttaccgtgtccataccgtggattttgaattcaaaaatttggaaacgaaatttgtgcggtttttcgtggtaaccgcacggttaccgcggtaaccaccata

SEQ ID NO: 62777 - DNA, 2484 bp, Oryza sativa
ccagatctgatggcacgaactcaaggccgcctgatctgatggcggtgagctcgtggctgccgatggttaggcggttggtggagcaaccattgtcctcccaccaaccggcttcaccctttccgccgccatcgacaccttgtcgctgtgttggacgaggggctccgcctcttcacgcgcagccagccgctgcgtccgatagaatcctcctcacgcgccgcgaaccatcgatggaccagctgaaggaaccgggtgggccaagcggtggagctcgcagccatacgtgtcgtgccgcacggtaagtgctatatcttctcaagcaccaagcgcttcgaatttgtagttgcagagagcattctgacctgcttctattgtcaggcgtcaggtagagttttgggtcaatgcgattgcattggagcttgaattgattggtgttttatttatgaactgtgacagacatctctgcaagagctcaccaggcttgggataaagcacgtggagaacctggtgattccgagtgtcagaaatgatgtaaggcctgctaagcttaaaaatgtatttgtagctttgtttagttatttggaaattgcaatggtgcaacagagcgtgatgatttgatggggattctggaatcaagcattgcaaaattgcaaatgcagaagaatagtagtgccataatttgttcagaagcatagtcccccattttccttcttgtgatcacgcaggcagcattttttttcactgttgtcggttcaaccggattcctacccattcgtgcaggccagcttagtagggtttttccttgctacctcctctttgtgctactctggattgataaaaataatcttttttcccttacaagataagtgcattaggcttcggtcacaggttcctgcaaaataatttttctgttgatattaataaacatcctgtgatatataattttagcttttcaaaattctctatctcaggattggggctttttggttccttacttgattggaagcatctcattgatagtattagctatcggaagcatttcaccagggtatgtgtttgttgtctctgctaataagcctgtgaaagttgggaagagccggcatcaaacaatccagatgtctgacatattctaagattctttaaatggatattcaagcagcaaaacttatcagcttaattaatttaatgttatgtcactcaacatagactacttatggcatgacaaataacactatctgttttatgaatgctcaatgaaaatatgttgcaactttatcaaggatatattgtaattttccattccatcatcacagtcttctgcaagcagcaattggcgcatttttaactgtttttcctgactatcaagacagagttgctaggcatgaagctgctcattttttgggtatgtctccagttctgcaataggagtatgtctgaaaataggttttttactgactatagtttattgaatattgaagtgccttaacaaccaatcgtgacaacagttctggagcagttttagtataatggttaatgatgatattgtcattgtaaagaattatgctgaactagccatctaggtaaaggtaaataacattgatcggaagaatcacttgaaatatctgaagctaacttgagtagaactaaagagcaatacaaaaatattttttgaagctaagctaatggttagatgagctggatatgaactaaggctgtcaattggatcactccattagatgcaagacaatcatactgacctttcagattaattaagttgtatattctcagatttttcaggcccatagacagttgacagccagtcagccactgaaaaagtacactattactagcttagtttttcttttcctacttctacttgacagattaagtcttgttttttactatatgcttttaacatctatttttggaataatagttagctgccttaggatgtaagccactagtagttttccttaggatgtaagccactcctagtttcttaggatgtaagccactagcctataccttatggtgtaagccactagcctatatatatgtttccaaccagccatggttgatagagtggagaatagaaattaaaactagccccaaacctgtgttccttttgctaacactacttggtcagtgtactacttaacatttttatataaataatatcgtggttgtgattgggcatctactggaaaagaactggtaggtcaatgaatccattacggtgcttgtgttgcagggatagttctctcgtgttgcactccaggtgtttgtagttttgccttacggaagagtagtttcagttctgctccatggcttgcagtggttgattactaggggttgatcactagaggtgtgattcatgcttgtcagtactggtaagaaaattcacatattcctgtcatcctgtgtttagtgaggacttcttcttcatctattacttccactgatcagtcttcaattttgggcaagctt

SEQ ID NO: 62778 - DNA, 871 bp, Oryza sativa
ctgcagcccacattgcccgagacgacatacgaagcaaagcaggttctgtgtccactggggttagaggtccgtagaattcacgcttgtcccaacgactgcatattgtaccacaagcaatatgcggacttggatgcttgtcctgtttgcaaggcttctcgatacaagcgaaagaaaagtgctgacgaaggaaataagtcaaagaggggtggtccagcaaaggttgtgtggtatctacctatcattgatcgtttcaagagaatctttgccaacccgaacaaagcgaagttagtacgttggcacgccatggaaagaaggaatgatggtatgcttagacacccagcggattcgattgaatggaggaatatagatcaaaaacacaaagactttgctgccgaccctagaaacatgaggatatgtctttgtacggatggcatgaatcctttcggtgacatgagtagtactcacagcactttgccagttcttattgcgaactataacctgccgccatagttatgctttaaacagaaatatattatgttgtgcttgttaatccaaggtctaaggcaacccggcaatgatatcgatgtattcctggagcctgttatcgacgatctggagattctttggaaagaaggtgtggaaacttgggatgcatatggtcaggagaacttcaagctaagagttctattgttctgcaccattaatgactaccctgcactcggtaatctttccggacaaactataaaaggaaagaaggcatgctccgattgcaaggaacatacacgaagccggtggctgaagaaatcacgaaagatggtatacatgggtcaccggaggtggctcccgctacgttacacatttagaagaaaga

SEQ ID NO: 62779 - DNA, 1043 bp, Oryza sativa
aagtaaattaagatctgtgatgtgaatgttttgggatgttactttgatttgggatttggggatatgcatctcactcgatttgggagaaaatatagggattaaactctggctaaagaaacaataaaaaaaaaagagaaaatgagacctattgacagtgccattgccctctctttagtcctagttggtgttactaaccgggagtaaagatatcttctctttagtcctggttggtgttatttcaaccgggactaaagatgccatctttagtcccggttggaaaaccggaactagagggggttaccaaccggtagtataaacggtttctccacaagtggtaacatcaaattcgtttcataaaatccaccgtgaaatgtcttgatggtaaaattcattattgtaaatgttagtttatttcctataagatcggtcgtagttagaggagtttgatttataaacaaaacttaaatataatttattactacagtaatactagtgcaacaatacgtttgatcagatcatcagatggagtacttatttcatctctgtactataacttcttcatgtctccatatgcatggcatacacttcctttttctccatgggcgacgggcacgaaccacaccaaccaactctctctctctctctctctctctctctatatatatatatatatatatatatatatatatatatatatatatatatatatatatcaagtgtggtatcacaagtgtggtatcagagccagtcatcatagagaaatcaaattcagaagctaatattggaaagataattactaccaaagataatctgaatataaggtgtagattaaatcacattgaagaccatagttggcactctaacaatagtcaattaaatttaattgttgatctgatatataatttttatataaattgggataaaaagcaggaagatttagagcgaaggattgaagatttgtttaaagaacgaaagcaatctgaagaacaatatttgcttgtcagtaataaattaaattcagtgctaaaagagctagaggaata

SEQ ID NO: 62780 - DNA, 1173 bp, Oryza sativa
  unsure (1)..(1173): unsure at all n locations
tggttataatagacgaattgtaatggcatttttctgaatagctaaatttacagtggcatggatcaaattaaccctatttaaaaatgaagtatcaagtaacaaaggttatttatgctgtgagtttgcgatcctttttgtgcggtacattatgcagagagaggaaggcctctccaaaaactggacgagcatttgatatcgacacatggggtagccttttaggattcattcatgtcgatctcananaatatggcttcaggtcatgacatgcaatggctagggctattgatttgcatcttgatttgttcccaggatatctgatttgactggagccaatcttagcaaatcctgagcttgaccggttctttgaggcttggtcggcttaggactagacaactggtaccttacactgacctttattgaactgggagctattaatgaataactcacaactgttttaagcatctgtttttttgtgtgtggaaaagattgcaatttcttgccttattcttgccatgttctagagaaccagaaaaccaaaacaatggttacagtctccggtgagcaaaatcaatctgctccaaatcaagccgggagtacgagctgcttggctcaacacgtgtagctgtacacagaactatccaattctctgagctgtaccgtaagaacgtgaagaaaatacaaacatgatattcagcacgtgttgtgttacacatacaatgtatagacaggcttgcatgtgtgttgcaagaaaaatatacggccaatctcggccttggtggtgccatacctgagacaggatatgtttccttggaccatgggttaaatgcattgtatagcaggtgctgtgacaagagtccaaggggaaacactcgggcccaagctccccaatcctgatcagatatctttggtacggcctgtgggtgagcatgcatgaccaactcaactcagcccaaatgcatgactctttagtaaattttggactccaatgtctccttgccagttgccacagcgatcctgtatgattgcatcagcaagctgaagtacaacatttctgatgcatgtgccagagttaactgactaaataagtaataactgatgaaagccaaggtgtgtgtagaaaaaaaataactgatgaaaggaatggtctagattttatactacctccatcccaca

SEQ ID NO: 62781 - DNA, 809 bp, Oryza sativa
  unsure (1)..(809): unsure at all n locations
nnnnnnnnnnnnnnnnnnnnnnnnnnnnnnnnnnnnnnnnnnnnnnnnnnnnnnnnnnnnnnnnnatgtagaaattaatttgaaaaccggttcctctgcgtcatgaggtatttctactctttccggtgcattcacagcaggtatatgagatttcatgatcccctttgggttagtgaaggcttctggcagattatttgcaattctttgcaaatcaattatggtctgaacttcctggtcagattccttagtacgtggatctaaatgtaggagatttttagtttcccactcaatttcgcggcattcgaccttctgtaggtactttcctccccctaatgccgggaaatgatcttcattaaatatacaatcagcgtatcgacccatatgtaggtctcctgtcaatggttctaaaaatttaatgatagacggagattcaaatcctacatagattcccaattttctatgaggatccccattgacgtacgcttaggtggcggtatagggacgtatgcagcacatccaaatttgcgcagatgggaaatatttggtgcatatccacgtgtaagctgcataggggatacagcatttatgcagtaggtctgatttgaaataacgccgctgcatgcaaaacagcgtgtccccaacatgtagttggtaggtgcgataagcttaatcctcttaattaatgattcggcgagaccattctaagtgtggacgtgtggtacagaatgtttcactttaattcccaaagccatgcaatattcattaaataccttagaggtaaactccccggcattgtccattctaatgga

SEQ ID NO: 62782 - DNA, 3463 bp, Oryza sativa
gaatatgacttctagatggatactatacgtatgtaatattgttgtttgctactaatgagtcaagttggggatagtttggtctcggaatatggtttctttgtttgttccatgtgtaggtgacatgagatgccgggagagtatttgcggtgatggaccgagagtcggcttggggataagacgatgtccgtggtggtcagagatcatgcgggatactaaggctagagttcaatgcacatggttggtgaagtttccatatggcatacgatggaggtattgtgtgcgtatgggatgcggagttgaatttgaaaggagtccaaatttggtagaattggttatgtaaagtttgtttcttgtacgagaaggtttcctatggggattaggacttctagtatgagtttggttcgtggctttaggttgcctacctcgggtataaatagagagggagcgtgaggcttctcggtattgcttttcagagcaattgagttgatagtttacttatggtttcgagtttactcgagatttttgtaaggagtgctgttggtgcactttgtaaacacagagataatcaataaagtcatcatcaactttaagagttcttcgatttgtattttctcgagtgcggcggtctaaccagcaactcactggcggtcagatcggcggcaaggcggcggtcggtagcacgcaggcggtcagaccagcagcagcgacaggcagcggcaggcgatttcggcggttcgaccaatcgatctacatcggtcagaccgacgttcttctggcggttagaccggtgcatacacttcggtcagaccgcgattagtcgaatttgagggtaacttttatttccgctaaaagttttggtttttgggtataccaaccattcactccccccctctggttggcttagtttttgtattcgatcctacagatggaagtggtccttcaggtcccttccaaatgtattctaatgaccgcgctaggtttatggctttggagagtagccttgctgttgcgagaagtcaatattgtccatctcgcacgggccttccactagtacagaatcgatttttccgtgcggtcaaaattgatctttccgtgcggaggtagcgcctgtctacagctaggtgtctgtgaaaatcaactttatcgcatgcaggcggcccaaccgtacggggtaatctattatcccatgcggtcgagtcaagtggactgcacgagataatctaccaaaaaacatctttcatgagtcgaattgtactacatttaacatatgaaaaaaagatacaacttaaacgaatattatattactattcatggtctagtggttccaataacattaaattaataacttaaaaattatttagaattactagatttgtaaacctaatatattcgtcgaattccattgaaaaagtttgaaataaacggagggaactaaacaaaaatttaattaaagatttacggagaatttaaacatgcatataatatttttaatcattaataaaaaattttccatttccaaaaatgaaaattttcttagcttttatctgatgacaaattaaattaatggaggcaaacctaaaaaggaatcggactactaaatactttgaaaatcatgtgatacaaataatatatattatctcaaaagttataaaaaaacataaaaagtgcctacactattccatttataaaagtgcaaatttcttcgcattgcacccgtaaaaactgacaaaaatagaagcaaatgaaagacgagaacaagcattacaccttttatatgaatcaaaatcaaagatttaaggtcgaaaacctcccctcttaatgtttgtaagtctaggagagagaaaacgtcggaataaatagggcatggttgggctggggtgtatatagaccaacatcatcacgtgcggttggattaaacagcccgcacgggaagatgcattatcctgtgcgggcatcttaacccaaccgcgctggataatcgcattatctcgtgcggttcggttaagacgcccacacgggataatgcatcttaccgtgcgggtgctggccctgcgtcggtcctccggtttccaggaaaatgttttgtgtagtagtgttcttttcttttattggacagtgatgggacaagaggccaacccaaaatataaggaaacacctctgatgttggcatggcattgttaggaaatcgcatggtctagaaactcatgcaaatggcacttcatcctcgcaaaattctcgtagacatggtgaaccgaaagtatctgttgctagtgttaccaatgttacactggtttaaaattaccgataaatatgctaatatctcgctctttcagaagtaccagacattctcctaccaatataataattaacatacacttcagagagtgcacagataataggatggactcaattcaggaggttgtatttctgcaaacagatattaagctccttttcaatatattgaaaaacacaagcttcagatgcatcaactgtaacatgagtatgtgtagctagcctctccagtgcccaagaaccagttcaatgattgtaagctgccgctgcaaaatgtgacagaccaaatgcatcgtacgtatcatcgttcatcatccctagacactgcttctctagagaaatcgatttcctagattcgtcccaagcctaatttggctgctgttttctttgagtcatagtggccaatcgccagtaagaatatataggcagcattgcatgcatgaggagcttatcacttgaattatatatttcgtatatacgtgaaccgagaatggaacctacaagctcccttctgtatcttctgacgctagctagggtcttcagtttataaatagaacaattttaccatcttacactcgggcctgtttagttggtgaaatgaaaatttttgggtgtcacttcgaacgtttgaccggatgtcgaaagtggttttcggacacaaatgaaaaaactaatttcataactcgcctggaaaccgcgacacgaatcttttgagcctaattacactgctggagaatcgctttttagtcctggttgggaacccccctatagtcctggtttcctaaccgggactacgaatccgggactaaaaatatctacttttagtcccggttgaaataaccggggctaaaaatagatctttagtcccggttcgtaataccaatcgggactaaagatactaaatctttagtcccagttggtattaccaactggtacaaaagtttttttcttttttttcttttcttgcgccaaatatcacagatttgtgttcacacatcactcatcacatatcgttcacacatctcaacatcccaaatcatccacagcaacaacccaatatctcaaacatcccaaatcatccaaaacaacaaatcacagatcaaatcaacaaacaattattcacattattcacacaacgaaaagaaaaaaaaagaaaaaacagaaaaaaaaa

SEQ ID NO: 62783 - DNA, 7013 bp, Oryza sativa
aaatttgtgtataaaatatggtacctcgaggtaccaaatgatggatggtaaaattgctcggatccacaataattttggtccgaatttatcgaaaattctggttccccctcaaatactctggctctctgaaatttgaaatgctgctcttggtagcttcatgttagacagctagcctacatggaaatgttagaacaaaggggcagataaaccagaaacagatatatcaccagttcttgatccattgaaatttgtgttttgacagtgtgatctctatatgtttaaattactttcttattaggatcacatgtatatatttactctcatatatatatatatatatatatatatatatatatatatatatatatatatatatatatatatatatgatggtttaggctccttttcaatctcagaattagctgggttgaattgaactggtcgttgatgaaattcagtcgcaatatggttgagattagtaggaagaagcatacgaggtcgctctggccagccgtagagagatgatcgaagtgaacagccgttgcaaagacggtgaatgctaatgagcggcacaccaaagctcgaatctccgaaatgatgcgcaataataagtcagatgcataatcccgacgcatcccaatccatacgcatgatcaccttgtaaaatcaaaggtgttttttattattattctgtgatgaacaattggcattggagattattggttttgttatttggaatttattcatgaagtggttttggagatgattggatttacaggtgaatcacaggttcattattttatgtgaccggtcagaccgggctctggtagccagtcagaccggcgatatgcgaacggtcagaccggctagcccgcggtctgaccgaccaacactatgtcggtttcggtttcgggtagtttatttggatatccgagtttatttcatgattatgacttctagatggatactatacgtatgtaatactattgtttactgctaatgagtcaagttggagatagcttggtctcggaatatggtttctttgtttgttccatgtgtaggtgactcgatgtctcgggagagtatttgcggtgatagaccgggaatcggcttggggatacggcgacgtccgtggtggtcagagatcatgcgggatacttaggctagagttaatgcacgtggttgatggagattccatatggcatacgatggaggtattgtgtgtgtatgggatgcggagtcgaatttggaaggagtccaaatttggtatgattggttatgtagagtttcattcttgtactagagggtttcctaaggtgtttaggactcttagtatgagtttggttcgtggctttaggctgcctacctcatgtataaatagaggggaagcgtcaggcttcccgggatcgcttttgagaacaattgagttgagttttgagttagggtttcgagtttagtcaaaatttttgtaaggagtgctgttggtgcactttgtaaacacaaagagaatcaataaagtcgtcatctactttaagagtttttcgatttgtgttaccaggtttcggcggtctaaccggcgatctaccggcggtcagaccggcggtaagcggcggtcagaccagcgggagcatggcggtcagaccggcggcggcgacagcgagcagtagctgatctcggcggtcggaccagagatataatctcggtcagaccgacggcaaccaggcggtcagaccagtaggacaacttcggtcagaccgcgatccgtcgaattcgagggtaacttttctttccgctaatagttttcggtttttgggtataccaaccattcacccccctctggttggcttagttcttgtgattcgatcctacacacctcacattgagtaattcaacttctttgtggctgtgacgtatgggtaaaacaatgaacctgttactggcatagagaatcatgtgatgatttattttatagagtaactacaagtattttgcacaatttatcataaaactacaggcttgtttcataaaaatacagatttttatcacaaaactacaggtactttgtataatctatcccaaaactacagatttaagaacttgtttcacaaaactatagatttagtgtattcgtttatcacagaactacacatttagtgtcttcatttatcacgatttagtgtcaccattatcacaaaactacatgctaaaatatgtagttttgtgataatgaagacattacacttgtagtttgtgataaatgaagatactaaatctatagttttgtgaaatattgtgcaaagtatatgtagttttgtgataaacggagacactgaatctgtagttttgtgaaacaagttcttaaatatgtagttttgtaatagatcatgcaaagtatatacagttttatgaaatttactctattttatatgatgaactattgccaaaggtgagtgtttgtgaaaatacggtgaataatgtttttatatggtgaatagtgtggttggcactggatcaccggttagaccggtcaggagggtgctggtcagatcagaggtatgtagccagtctgaccatgcggtccacccgatcagactgggttgacttagggtttgagtcagtgtcaagttgttttcgtggattttctagattactttatctatatgacttctagatggtttttatatgtatgtgacattgttgtgtgctgatgtgagttaagttggtgcgaacttgtactcagatatagaatatttttttgttgttcatgtggaagtgttgcttgaggccatgggagtattactagtgatggatcggaactagatttggaagaagttgagatgtagacagtcaagcagatcacatgggatacccaggctagagaacaattcacatggatgcatggaaaggtttccttatggtatacatgtggtgttgtgtgtgtatggaaaaaataatcaaatttgaatcaagaagattggagtttagagttgtatgtcgatgttgtttccctgctttggtaggttccctatatgattagaagtcctagttctagttggatttggggctaggggtagccatgttttgggtaggggtgggcagaaaaagaccaaaccaaaatgaccgagaccgaaaccgaacttactgagaccgaaaaattcggtcacaaattcggtcagcactttctacttaaccgaatttaggtcgggcgattcggttttaggcctcggttaaccgaattgaccgaaaaaaccgaaatatagaattggcccattaggcccaatacctccttagcaaaaccaaccttatccacccacaaccttatccaaccaaccaccagcaccatcctcccatccaccgagcccttcccatccccatcccctcctccccgtgctattgacaccgacagcgatgccgcctccagcgtcggcgccgcctccacctttgccctccgccgcctccgcctccggctctagcgccctccaagctccaacgcctctgccttcctcctccagcgtcgtcgccattgcctccgtctccactctctagcggctgtgaaaaaaaatcggtcagaccgagaccgagaccaaaaaaacgagaccgaatttgttggtcctaagattttttgaatgaaatccggtcttgagtttctaaagaccgaactaaccgaaaaaccgaagaccgagaccgaatttttcagtctgaccgaatgcccacccctagttttgggtacaaaaagaaaatggattgaggcttgaagtatatcgacgttttgttgtgaaaaaatatggtttgtttttgcttcaattctaattcgtgagttgagagaggattgcattggatgcacttggtaaacacatcttgattaatgtggatcggccaatgcagttgacacataatctgattgtgacacatccatgcaaggttaaagctatgcttaactctgaatattgttattttcaaaagacaaggttactagttgtcttttataattgtaggttaaaacatatcgatgcgcctaaagagagatatttgacttggattatttactcaaccaataccaccactatacaaaggcgaagtaactgtgcactaaccttgctatcatatgaacgtaaaccatcatttggactagtgccacaatctcgaggaccgactatgctaagccatgttgtgactccatctccaagggattgtgccaagcaaggatggagtgcgcaacatcattcaataaaagtacgacaaaaggttgactcttttctcgctgaatttaactttaatattaacgagaattatgtactacctaaatcatctactttgcttttacttagattcacacgtgcacaagacttgcagggcattgatgatgagctagaagatcaaattgatgatgggttatgtgaatacgacgaccatttacgccatgctgatttcgaattcggagtccacgtctcctaacatttgctccaattttcaaattatgtgagacccatctagtcaacttcttccttgcatattatatatggatggaaagataatcaagtctagtttcaactccaacaaacggcccatcattttgatttttcaataaggagtaatggacaaatcattgaagactgcgtgagtattcttgggaattcacttattaagacctttgagctagtctatgtccaataaactctcaagaattttcattcccaactaggagggttattcctaatataaatattccctttgttttaccatttgaaagacttttgacaataagaatatgaacccctttgtttagttgtgtgctaacaaatttagagagatccctaccccttttctcttgtgatttccttgtgggattacagaagtagtgttcgacgctccccaattgcaattggcgcttctacttccttcgagatttctcttgtttgattgtaggttgtgttggttggtaacttagagtgtggttgggctaaccctcagtacaggttgccgtaatggagatgacggtttaggttgcactactattttggttgcttgcatctagttatcttggactctttgaggctagttatcggctttgctaggcactcagtaattgttgtagaatcaacctaaaaagcacaattcaaacttgtgtgccatctgtcccgcatcctcctctatttggtgctgtgcttcgatgatcctatcatctatcctctctcccaatttcttgcaatctcaaggaggatagaatgtgagcacaggcttgcagaggagcacgtacgaaataggcccttggctacttcgaacttgagttggagagaaactgaattcctagataccttccaatcctatttgactctctcttttcttgagtcatatatagtggccaagtagcaacaagattatacagcttgcatagacaaagagctcgtacattgttctagtcttacttacccttttggttctttcttatgagaaaaggaggaatggatctatcagtcactgatatgatagtctctccgtcgcacactataataatttttacaagaaacggaggaatatacctataagtcactgatatgaaatactcactctgtcccacaatataataatttttaggctgttttgcaaagcttaagcttaatgaaaaagattccctttcggtcatctcagtcatcaaattttgaattttgaattgcttaaattcccctcccacgcacccactttgcttaaaatgtatgaattttgcattagtatcaattctcataactcgataaattttgaatcctagaaatatttatattttattaagaagcgagtatatggctatgctatagttgggacctgtctgttcgtagttgagtttatgtagtgatcatttgcaattcagtaattgttgtagcatcaacctaaaaagcacaattcaaacttgtgtgccatctgttccgcatcatcctctatttggtgctgctttgatgatcctatcatctatcctctctcccaatttcttgcaatctcaaggaagatacaatgtgagcacaggcttgcagaggagcacgtaatgaaataggcccttggctacttcgaacttgagttggagagaaatcgaattcctagataccttccaatcctatttgactctctcttttctggagtcatatatagtggccaagtagcaacaagactatacagctttcatagacggagagcccgtacattgttctagtcttactttcccttttggttctttcttataagaaaaggaggaatggatctatcagtcagtactgatatgatatagtatctctgtcgcacactataatattttttataagaaatggaggaataaacctataagtcactgatatgatatactctatctgtctcacaatataataattttcaggttgttttgcaaagtttaagcttaatgaaaaagattccctttcggtcatctcagtcatcaaattttgaattttgaattgcttaaattcccctcccacgcacccactttgcttaaaatgtacgaatttcgcattactatcggttctccataaattgacaaattttgaattctagaaatatttatattttaataagaagcgagtatatggctatgctatagttgggacctgtcttttcgtagttgagtttatttagtgatcatgtgcaaattaagctccggacctgctgcgcatcaatatcacattatagtcacaaggacaaatatgtaagtacctaggtatatacatagatgtagaatgaaaaggcgctctacactactacaaaaacctcgtagggaccggcttatagtgtcgaagcaatatttcggcaatactaaaggggtggctatcaagcaggaaaagtggatgggttaggagacaaaagttttatacaggttcagaccttctcgataagaagtaataccctactcctgtccggggaataattcgctgagtgtattattcatcgtatgatccgggagaaaaattatgccccaagagacaccgaacctctccatatggggagaagcccgt

SEQ ID NO: 62784 - DNA, 1359 bp, Oryza sativa
  unsure (1)..(1359): unsure at all n locations
caatatcacattataatcacaaggacaaatatgtaagtacctacgtatatacatagatgtagaatgaaaaggcgctctacactactacaaaaacctcgtagggaccggcttatagtgtcgaagcaatatttcggcaatactaaaggggtggctatcaagcaggaaaagtggatgggttaggagacaaaagttttatacaggttcagaccttctcgataagaagtaataccctactcctgtccggggaataattcgctgagtgtattattcatcgtatgatccgggagaaaaattatgccccaagagacaccgaacctctccatatggggagaagcccgtattacaagatacaatccatgttcctaacggaatagacaagtaaagataaattacagtcgtatccgactaggaccatcaggtgtttccgtggtacacaagttaacataacaacccaattgagtcctgtactaaatatattctatctgtatatggtacccctatacccggtcgaataaacatgccgtgtgggtatggggtatccataatctccacatataggtgcacctattgacctttttccacctcccatgggataaaaaatagaaaaccaacacctttaaacaaatataagtattggttctaaagaaaaccggtaccaatactaatggtaccggtttttaaaaaagaacgaacacctataatatattataggtggctattaattaaaaactagcacctatgttatgtgttatattataggtacctgagaatttaccgagcaggcatgagctgagctggcaggctccatcacgaggaacgaggagataaggccctcggatcaatccagatccatcgactccatcgatctcttttctctctgtcgctcttctctctctctctcgctctccattgatcctgttgggaggaggcggcggtgacaccctcccctcttctagattcgggcaggaggggaggcggcagggcccggcgtaggaggaggcaatgccaacgcggcgacggcgagcccgcggagaaggtgatgtgtactagggttcctaatctttcgaaaggttctgataaacaacgatttaggcggagtcgcgacacaaatcgatccagcttcttgaacgcgcacgctcttgagccccgcaatcgcagcaccacgtctcctctggttatcacccatgtcaaaacgcggataacctcaccgagaaggctaatccctatttgacagtcgaagaacacaaacaagaacgagatagaaaacaaccaaaattgcggatgaatgattaannnnnnnnnnnnnnnnnnnnnnnnnnnnnnnnnnnnnnnnnnnnnnnnnnnnnnnnnnnnnnnnnn

SEQ ID NO: 62785 - DNA, 1683 bp, Oryza sativa
cccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgctgatactcgcactaggtgcgcgaatatcgagacgcaactagatggttgcaaagggacatggtatcacaattaacaaagaaaggatcaaatgcaacaaattaggtaggtctaccaatctgccttgcagacgggacaacagattaagtgcgatcctatcaatgcataatatttttcaagcaacataattaaatttcaaatataggctcaagatgttcaaaggtggcttgccttgctcgagatctggagctcgatcctcgaaatcctcgcactgcgggtcttcgggctccgaaactacacgtgaaacgggacaactcaacaaacggcgaaaataaagccctattaatgacctcgaagcgtgccattagatagatctcaagatttgaggaattttggaagttgaacggagtcaaacggacttacggttgggaagatattgaatttctaagattattggatttttggtctaaaggaaaaggatttaattaaatcctttttggaaaataaaagaaaagaaaagaaaagagggagggaatatagacttttctcgggcggctagggcgcggcacgagagaaagggcggctcggccgggcttaacgggccggccggcccaagaaggcggcccagagcggcccaagacgcgcgcgcgtgggagggaggagagagagagagccggtggaccgggcttaccacgcgcggtcccgggtggcacccgcttgtcagcggctcggctcaccgtgcggagggagcacgcggcgcggcgctagggtggggggaggatgcggtgcacgcgcgtggttcgcggtggacgcagatgcggcgggcccacgcgcagcctcacggctcgcggtggaacgcgcgcacggggaggggctgaccggggtcggctcgacccggtcttggctgagctggcgccgacgtggcgcctacgtagctgccacgcgggccggcgggaggtagacgacgacgccggccggaacggacggtggacgacggcggcgagcggcggagcgaaccacggcgatacaggcaaaagcgagcacaccgggtggttgcacgtgacgaggggagacgagccaacggctcggattcgccggaggaagcttgacggcggcgaatcgcggcggcggcaaccggcggcgggagaaggggaaaacggcgacgaggtcacgaggggccaattcccggcggcgagagcatctacgcggctacgggaatccgatgctagcgtcggattgggcggaactacgccgagcgaggccggggacgagcgggtgctacggagctcgagcggcgacggcggcgagcacacggcgagtgacgacaacggtcggggcggcgccggctagctacggggaggctactcgtgctactaccgaaaactaagggggagagatggagcgaggaggaagaacggagggaggcactaccgagatgaggaggggcgctgggacg

SEQ ID NO: 62786 - DNA, 1251 bp, Oryza sativa
gcaggggagatgggccgagagaaattcggcccatcgaccccgggggaggcaaattagacttttgcggaggaatttgatttggagggatttggatttggaattgaactcgacgatagatcggggattgagatcttgagatggcacggacactagacaacaagcgaagaaacaaatttcgcaattagggtttttaagagataattttcccgctaggcgccacgacggaacgggcgctacagaccaacccccctaacaagaatctcgaccccgagattcagcacctaagggagcagctccgggaactcggcgcggagaagatcttctcgctcccaggttgttttcactggcacgaaatgagccaatttcgtgagtcgatccacgattacccaaatggagtcgtacccgctaggggttcttggcaaaccggtgatgaaatccattccgatttcttcccatttccactcgggaattggtaggggctgtagcagaccagctggcctctggtgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaattccttcttggccggtacacagatacgtggaccgcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacgttggctttaccggggtggtaatgaattccaagatcgtaatccttgattagttccaaccatcttctctgcctcatatttaactccgtctgtgtgaagatgtacttaagacttttgtgatcggtgtatacttcacatctgttcccgattaaatagtgcctccagatcttaagagcatgaaccacggctgccaattcgagatcatgggtgggataattgacttcatgaggcctgagctgcctggatgcataggccacaacctttcgttcttgcattagg

SEQ ID NO: 62787 - DNA, 3471 bp, Oryza sativa
cgactatcaaaaccatgtgctcataacccaccataatcaagttttagttggcaaatttattatttaagcaaacatgactgaccatcgtgagctcctattaattagatgacaataagtgatagtgaagcataagttatccccttaatgagctaatgtttctaagcatgactaagcatcatgatagctttagctaaaatcatataatgttctagctaatcatattattaacctatttacaaaggacaagtaatcaatgtcaaaggggcataacaaagcatataggtcaaccctccggtgacactcgaaaataattcaacagttgaatagaaacaatagctttaaacaagttcaacatgctgaaaggggtgttttagaatctgtgactttccttgctgttcttcataggcttccaaaccttcttcatcataaacggtctcttcggaacgtcggaagctaaagcaaatgaacaaaatcaacaaaacagtaccaagcataaacaatacatatggatatttttaacaaatagatcttgattttatatgaatttagagactgaaccacctaaatccatgttacggtgaattagttatgaattttctaagtttaataggatttaatccattaacagacaatgtttaagatttatgaagaattatttttaaaaaggaaaagggaattattgtgtcatcatggatcgggtccacattagaccgggtgcacagaagcggtccacgaacagctcagattagatcggcttgccacgcaagcagacgatgaggtgaactggttgggcgacgtggcgctgacatcatcgatgacatcatcgcctgcggcgactactcgggaccctgttggtcaccggcaatctagggcacggcgttgaaaacggaaggcgccgacatgacaagcgtgacggggaacccaccggtgtgcggcgcgacggcaaatggcgacagacagcgacggcgacaaggttggagcgacggcttggctcggatcatcggtggcggcggcgttccagcggtagtcaatggcgtcgggccggtgtatggggtgcgtctcctccttgcaatcccaaagaaggcaacgggaagcggaggcggcggcgcggtgacggcggcgctagggtttgcagtggcggcggcgctaggagcgacggcgacggacggggcttgggaggatcggtagagtgcgattagggctacctatttataggcacagagggagagattgagcccaacacgatcgcggtggcgccgggaaaacctagggttcggtttggagagataaggttgaatccgagctcgattccacgtcggattcaaagggataagagccgattcttggggtaaacgggagaggaggataaggggaagatttcccctcaccgaatcggactcggggcaaaaggtgacggcagatttaagagaaaatcgacggtgagattagacggtgccatgtggcagccaaggagcgtttgtaggaataccacatgacagcttaaaagcgtttatagaaagtttaatgaattttagtatatagtagatagtgtgctaaagttagtgtagagacgatatattatacacattaacccttagcttatatggataaaatataaaaattgaacatgtttttgccggtattttggtacgttgtccatgtatgagtcgatttttaagttcgtttgtttttttaaaatacatattcgtatttgagtcggtttttaagtttgttcgcttttggtgcttttggtaatacagaaggaatcgtataagaaatctcacagtgaatttcatcttaactaaactatataacaataataagattaaaataaacttcacccgttgtaaagtacgggtattttttctagtatggataaaattaaaggtggtaattacctcttctataaaatttgctccaagtcctctagtaagccggccgggctgcaggactgtagttagccttgatatgccataattgtgttttacgaattgttacaagctttggctgtttgcgtgaatatgtttctttcaacgggttcacgttccaatcttatctaataaaccgatttcagggttagaactctagttcttgattgggacaggtggcaccaatcttagaacaccgatcgaattcttggctggagaagcgcaccacgtatcccacccctccagcagcggtacgatagcatatcgacggtgaaaaagacgtcttgcggacttaaatgtatattgaaacttttaagaggtcttttttacaaaatgcgtgatctcatctagaacagcccggaagtagaccaaaatatcctctgagaaaaaaaagaatctaataaaaaaatcaacaagcggttagccccatcacgtggcctaattccatatatagttttgtcactacgcatagccatttgattaaaaatctggcaaaaaaaaaaaaactgcccccattgcaagctttgagtctttgttcgaattgaagataaatctggaattaatacaaatgaaaagatccgaaaatgtggtgcggattgtaaagaaaataaggataaaaataaaaaagccaatcctgcccacgagccgctgccatctcccctcccacaagacgctatcgtcaaccaccggattcgtccgtcactcaccgtgagatggtgctgtcctgctggccgtcaaatccgaggaagtcgacgcggagcttcgctgcaggaggtgaaggtggagaatattagagagaaatgagcagctcaacatctgcctgcatgcctgtgggcagcggggagaaaagaagcaaaggaaaggaagaagaaaggtagaagaatgacagcgtcttctctctgtccgcccgtgaggccgtgacgacagaaaaaaaaagaggaaattaggaagagcggtgaaaaatgcatcaggaggactgagtagaggtggccaaacgggccgggccaaaacgggcggcccgaggcacggcggaacctgtagccggcacggcccggcacggcctgctacagtaacgggccgtgccggcacagcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccaccttcgcaagtacgcatcgcatccctccgcgccatttcggtttctgggccaaccgtgccccgtccacgggccatttttcattcacgggcccgtactgacacggcgggccacacgcatgccgtgccggcacgggcacggcccggccattcacgggccgtgcttgggccggcggctcggcacgtgggtcgggacggcacggcccgtttcatgagccatgcctaacgggccgtgccgaaacgggccgtgccggaccc

SEQ ID NO: 62788 - DNA, 1803 bp, Oryza sativa
  unsure (1)..(1803): unsure at all n locations
nnnnnnnnnnnnnnnnnnnnnnnnnnnnnnnnnnntactatacgttctaggttacctgccagaatgcatacctggacataatattatgtatggatcgactggtacacttcaatggacagattgattgtgacactgagaccatcaccttgctggatctggaggaaagacaattacgctgtaaccaaagactcactccgatagtcggtctatttataactgtggacaaaccacctcattggagtcggtgcccatagaatgagactgtgaccacgtgtttactgaagatttaacgagtgattatacacagatccgacacgattgagccactcatataactggcaccattatacacgcaccaacgcaaaaagaccttacctaatgggacttaatgtgttagtggaacctcaaagacacatcgatgaattggagggttattggtatgtgcaaccctagctcatccccttggggagccccagtgcttctggttaagaaaaaggatggctctgagagaatggtaatcgactatagagccctaaatgaagtaactataaagaacaagtacccgttgccacggattgacgatttgttcgatcaacttaaaggagcaagagttttctcaaaaattgacttgagatcaggttaccaccaattgaaaatcagatctgaagatatcccgaagaccgctttctcaacgcgttatggtctatatgagttcacagaaatgtccttcggactcaccaatgctccagcgttcttcatgaacttaatgaacaaaatctttatggaatacctggaccagtttgtcgtggtgttcatcgatgacatcctgatatactccaagaatgaggaagaacatgctgaacacctgaggctaataatggaaaagctcagggatcatcaactattcgctaaattctcgaaatgcgaattctggttagaccgagtagcattccttggacacgtgatctcctccaacggtgtcgaggtagatcccagcaaggttgaagctgtacttgcttggaacccgcccaagaatgtgtcagagattcgcagcttccttggcttagttggatattatcgaagattcattgaagaattctctaagctagccagacctatgaccgagctgttaaagaaggaaaagaaatttcaatggtctgcagcctgtgaagacagctttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagctcaggcctcatgaagtcaattatcccacccatgatctcgaattggcagccgtggttcatgctcttaagatctggaggcactatttaatcgggaacagatgtgaagtatacaccgatcacaaaagtcttaagtacatcttcacacagacggagttaaatatgaggcagagaagatggttggaactaatcaaggattacgatcttggaattcattaccaccccggtaaagccaacgtggtcgctgatgcgctaagtcgcaaggcctattgcaatgtagctcaaatacggcctgaccaagatcgcctgtgcagagaattggagaagttgaggctgaccgtggtacagtcaggtgtccctgccagcttgacagtacagcctaccctagagtcgcaaatccgggaagctcagaaagacgacgaagggataaaagagttannnnnnnnnnnnnnnnnnnnnnnnnnnnnnnnnnnnnn

SEQ ID NO: 62789 - DNA, 4851 bp, Oryza sativa
ctgtctggtactatacaggaattgggatgttttcgttgattgaacaccgaaatcttatctacaataaaacacggcttcgcattcttaataatatttatctcactactaaaaatccccatgttccctaccgtttaatattttcctactagtgtgtgtggagacaaggaaaataaaaatacccatatcgtaccattctaggaacatagggaaattttttgtttcatacagttttacagtattaagagggaacaaacaactgaaacgttcaccatgctggccggtcatgtttccctgcgatatgattaaaaacaaggtgattccccgcgctttaatgcgagaattactaagtaattattaatttttttgacagcaagttaggagtaaaaagaaaaaaataataatgaaacatcagggtttatcaatcaaataataccatgcttcaatgtgaaacatattgataagtatatgttaaatattgtaaaagtgatagatagatttgttaaaatatcgtgcaaatgatacgaggggtgatgattcaaggtttcaaacatgctgaacatgctgctacccagtcaagtgaaatgtccatgcatgtttggttttcaccttaatattgctatgttgtaggaagcaaacttatttagcaaactgtaagtttttattatactatgcaacaggtaggaaataataagaatacctggtgatcagagatcttgacaggcaccaggaagaagtcattgtccacctccatagcatcctttcccccagccaccacctctttccgcatcttggacaggcggggatcgtctttgtccctaatcttcgtctgcagcacaccatccttgaatagcttcacacaaagtagcgaaagagagagataatgccagaatagattgctagtgttgcccagcagaaaaaggaaagtctgtaaattcattctcacctaagatgaacaacagaggtctgcccccaattctgtgtgtctgcaaaaatcaaccaagaaacaatgaggataatgagcagcacaaccgaattagccaaggaggaagatttcctcttgttggctaaacgaaagaaaaaaaagggcaccaattaacctgcagcagtagagtgggcgagcttccaagagagaggaaccgatgatagcagcacgagcaacagaagcaaaggtgctgctgcccttgtccgtggccgccgtcgtcgtcactaccgccgccctcgaccgctgccaccgccctcatccgtgtccgccgccgccaccgtcgagtacagccgcctcgtcctcgtccactgccgccctcgaccgctgccgcctccctcttccgcgtccgccgcagccgccctcgttcgcgtccaattccgccgcgctcgtccccgaccgccgccaccgtcgctgtcaccatcgacagagtctgtcaccgccgtagtcgctgttgctgggggaggcgatacggtacaggaggcgatgcggtggggagcgaagggaccgagggcatgctccaaaacgcaatgaggaccactgagatgtaatccaacggtcgataattaaatgatgacgtggcttcaccaaatctcagctttgggtcttaactttatgaaagaagggattatatgggactaactctaaagaatttagctccagaaaaatttgcctgtcctcattttctttaaaaaaaattgcctgtccctgctagttttatagtttccctccagtccatacatctctgtcccacctcgtccacatagaaaagccctagccgcctccaccaaaatatttcccttcttcggtgaaatcagcggccatgctctagtgtcatgccattatctaaggtcattcttgcttcccgcaactctcctgcatcgaatccctaaactttccacccaaaaaacacgctttgtggccctaaatcctctattcgtcatcccccattacctttccatccattaaatgcgcatgaccaccttttaaaaaactgacaccttttaaaaactgagcagtgagcttatgagcggataaggggaggagagtgcgcggtgacaagcggataagaccgagagtctctctctctctctctcggcctcccctccgccagattcggtgggaggagaggcatcgatgatggtggtggcaggctccggatctcacgggcggtgggctccagatctcacgggcaagggcgttcatgggcgacggcggcctctccgtccgtctcccctcccctggcctgccttggcctctcctctccatccggccagcaacggtggccaacggtgtcctgctaacttccggctccaatgagcacccatgtcgacttgaatcctctttctctctccatccatctcttcagccttcggtgagcaccaccatttctctttgccttaaccctatcttcatttctagatctagagcaagcttttctccggtggatgcagccaacagcgactttttatgatgcttgattctatgatgtgaacttatcgatgaacatttgatcgtgtgatccatgaacttgttgattgtctgatgtgtacttttatatatatatatttggatttatttttggtgactttgaagcactagcttagctcaaattgagctaagctggagtttttttttttttgcaaatcgtatacctctaatagacttcgtggtgtcagttgggaaatccggcacctatgaaagtttcccaaccaacaccaatagccttttttataatagtgatatagggtatgttcagcagtcagtcacatgctaccacaaccactttggttgaacctttttaaggtttggtggttaaaatttttgctaaggtataggagctgtttggatggggggattgatttttagcctctgtcacatcggatgtttggacactaattataagtattaaacgtaaactaatgacaaaacccattccataaccttggactaattcgcgaaatgaatctattaagcctaattaatccatgattagcctatgtgatgctacagtaaacatgtgctaattatagattaattaggcttaaaaactttgtctcgcgaattagctctcatttatacaattagttttgtaagtagtctatgtttaatacttcatattaatgtccaaacatccgatgtgacagagactatacaaagttagtaactgaattcaaacactaccttagtaacgggatccaaacaccaccttagtaagcttaagagagaatcgtgtcatatttttcttaatcacttacacccgagccctagttttttagaagtactaatcttgctacaactgtctaaatagttgatcaaatttatctaatctatgataagttatggcgcaactaaacggggcttataatatcttccgttatatttgaagaaaacacgacccagttagctcagtactaatacttatgtgcaaacagtacgttacacagtacaatgtcggtcttttgtagtactacctccgtttcaatataaatataaatatagttgtggttttccatatctaacgtttgaccatcattcttatttaaaaattttatgattttttttaaaaatagttacacataaaatattattcatgttttatcatataataataataaaaatactaattatatttttttaaataaggcagatagttaaatgttggacatgaaaactcacacttgtactgatgtagatagtaattagggtgtgtttagttcacgctaaaattagaagtttgattgaaattataacgatgtgatggaaaggttggaagtttgtgtgtaggaaagttttgatgtgatggaaaagttagaaatttgaagaaaaagttaggaagtaaaccagaacttaatttttttgtctatgaaaaagagggagagggaggtacgtacgagctagaaactgcagagtgtgaatgcattcccaatcaatcagtcactgtaatctcaaacaccatggacagatatgatatggagtagataggagtgaaaagggtcggaaacgatcggaattgatatcatctctttaaaaacggtgctcgatcagccaataattgaccatatttatcatttaaactactcagtatcgatattaatacgatgcagaaaaaattatgaaaaaaatttaaaatagcaaaaaaacgatacggtcggaaacggtaccctttatacggaaacgacactcggttgatcgggaatttccgtgaccatcttcacccctatgagtagatatgtgatcaatcctgcagtctgcgctgcgttgtttggttacatgttttccgaactactgaacggtaatattttttctaaaaacctttatatataaaagtcgctttaaaaaccatacaaatctatttattttaaatttaaaataaataatactcaactaattatatattaatagctcatctcgttttacatatcttcccaatttacttcttttctcttctctcgaactcccagctagctcaaaagcaaaccccagaaaaatccaccggctgccacaagcagccaccgtcagaccatcacatatacacatcgccattagcagtcgagctgtcgaggtcagggagccggctaatttagcccatgcatgatagctccaattcctccatcctataaaataatttcgtatcttttacctctaccattcttttcaaaatgacatcacttctttcactttatttatatctaatccataaattaattagttttattttgttgatatttcttatccacttagaacaagttttatagtaaagatgatgatcacctctaatttatcttcatattacttgccttagatatacacccgtgctaatataccataataatatattttactatattacggggattattaacggggat

SEQ ID NO: 62790 - DNA, 1882 bp, Oryza sativa
  unsure (1)..(1882): unsure at all n locations
ggaattcgctgtgcgtttgggttgatttcattagttcaacgatgattccgttggagggcaatttggggttttctgcaggcttgttcggcgcgagggcacgggacctatatgaatattcagtatgagcttctgctagctgcctccacgcgctccaaggaactgatgaatctccattctccaaataatcctccggctgcttgcccatgcaaacggcataggatataggatattgatagtcatagctagggatcacatgcaggggtatccttttttaaaaaaaatttaactttattaactttagaagcatagtaactatgttaccctgatacggagatacggatacggatacgcgttacggggatacgaggatacgtcacttttaaaaaaacaccgatacggggatacgtctatatatacttattaattaaaaaaattactaaatccctgtaaaaaaacaataacactttcttgtagctaaagagattagcctgaaataatgaactttctgattggattatattatctccaccaaagcccagataacagaggaccaagaataatgtataaattagtgtaagactgtaagcagtgccaaaataaaaccaagtgaatgtttttccctggcgggtggccaagcaagctcttaatgaacctccagccgacttaggccctaggaccgatagatgcagtactttgaacttgcaaatccaaaacccatcagacatatgaaccaagatgcattagttcttagaaaaaaataaggggggaagaacgtacacaaacaagatccatcaacggttctttcagtgggaacgaaggacccatattgctcagtgcggtggctctgtgcccggcgatgtcggccatcggcggcgctgcgcccgggcagtgaaggtggtacacgtctggcacggcggtggtccgttcgacttatggccgccgcggctctccttttgccgtcgttggcggcagcggctttgcggaggcggcgcagccgcgcgcccacgcgtagatgcggcgattgacagtactccctccgtttcagattgtaagactttctagcatttctcatattcatttaaaagttaatgaatctagatacatatatatgcctagattcattaacatctatatgaatgtcggtaatgctagaaagtcttacattgtgaaacggaggaagtattgttagggttgggacttgggactatccaggatgcgcagagccgtatccaagaagtatccgaattatctttatttatttgaaaatcagaaaaattgaggatacgtatggatatgtatcggagcgtatccgatggagtatccgatacggatacgctgactgttccccgtatcagtgcttcgtagcatagtacatcaaccaatgatacattctccataagaggagagaattccaaagcttctttaggcttttagggtgctccaccctggaccggtgttatggggcgccatggaggattntgttcgacatggaacgagcgcccgtgccaagttaggctcctcacgtccatccatactgagcgacgtagaaccttgtttgctcgagtctacgcgcggccaaaaaaacgaaaggagcctgcgctgtgggcttcggttcttcgccacaccgtgacctcgcgccgcatccagtgaagaaattcccgattcgcccagaaaaaccccatcccgcccagcgatttcccctcccaccacatccattttcctcccaccatcgagtcaagaaaaggcaagaaaatcgaagaaccgaagataagagcatgacaagcaagtatagataggagtaggatccctctgggtcttaaaacaccacaggaacaaacatcacaagaactgaatataagaacataacaagcaaagataaaaa

SEQ ID NO: 62791 - DNA, 888 bp, Oryza sativa
  unsure (1)..(888): unsure at all n locations
nnnnnnnnnnnnnnnnnnnnnnnnnnnnnnnnnnnnnnnnnnnnnnnnnnnnnnnnnnnnatagtgaattccatagctcactgtcccttttagatagcgcattactctttccagagcatgccaatgatcgtcgcccggatttgaaacaaatcagctcaacttactcatagcaaatgagatgtcaagtctcgttgcactagttaagtacatcaatgaaccaatgtttgggagtatattaatagatcccttgctattcttcggtttttccttaatagcacactgggatcataaggagtaggagctggcttgcagtcactataatcaaagcgactcaagaccttgtctacatagtgagactgcacaagtgtaatcccaccatcatctcctctcaatagcttaatgttaataataacatcagccactcccaaatccttcatttcaaagcttttggacagaaagtccttgacctcctcaatcacattgaggctagtcccaaagattaatatgtcatcgacatataaacacaagatcactccctctcccccaccatagcgatagtacacacatttgtcagtttcgttcacaacaaagccaacagatgtaagtgttttgtcaaacttctcatgccactgcttaggtgcttgtttaaggccatacaaggacttcagcagcctacacaccattccctcttgaccttctagtacatacccatctggttgatccatatagatcttctcctccaactctccattgaggaaagctgtcttaacatccatctgatggacgagaagaccgtgagaggctgccagagcgagtagtactcaaatcgtggttaagcgagcaaccggtgnnnnnnnnnnnnnnnnnnnnnnnnnnnnnnnnnnnnnn

SEQ ID NO: 62792 - DNA, 949 bp, Oryza sativa
ggcgagggtgggggccaacgagggggagaaggcgaggtgggtgacgttgaactcgttggcgggggtgagctcggaggcgcggaaggagcgccagtaggaggcctccggggagaggcgggagggcttgcggccggaggggaggagggcggggttcggcgccgccgggaagaagggcttggaggtgtcggcggccatggcggcggcgggggcggcggcggcgagtgaaaccctagtttgtgggggagaagtgggggagagggggtttatgggttttggactttgttgcagatgggccgtggagtggaggaacgagttctataggagaaatggcgatggatggacaggggaattttacaatttggcacctgtttctccctcttacagtatgccaccgagaagtttgaaaatttttggaaactactcgcaggagatgaagttctttttctatattgataccagaaaatatacccgtgaattgcaatgagggaaggctattttaatcttattattgttatatgatttaattaaggtgaaatttgctgtgttaaattcgcttggatatattttttttatagaaaattatgagctgcaattaagagtatgatcgtctctaaattagcttatgagtttttttaaagagatttgttataagattcattctgtatttcaaaagcgaatgaacttttaaaaccgactcctatacggatgacgtatcaaagtaccggctaaaacatctttaatttttatcatagtagagataaatagtatggggaaaaagagaaaaaaagtacaaaatggaatagtcaaaagatacaatcagatctatttctctctacttgcctattttccttctgtttcataggcttatacgcaatcatttgcgtatgaaaaaaacatttggggcattgggagcatgaaacatttctggaatatgagaaaaaaagtgcaa

SEQ ID NO: 62793 - DNA, 739 bp, Oryza sativa
tgtggggttgtgtcttgtgggtacagtggtacacctctgatcagagtttaaactattcgaatagccgtacccgcggttatgggtgagttgagcaatgtttttcgtgattagtctcacactactcataatggtaataatgtggtaattaatttgactcctggtttggaatggataattcctggtttggaggtttaatttgttcaactggggttggttgttcaaatgtggttgggcctatgcaacatgggtgtgttgtatggtgtttatttaatattgattaattattacaactgttttactattctcttaaatattcgttaaatgctgtttctgcaaatgagctatattatgccatcctttgttatcctgtgcacttgcatatttgctgtgtgacttgttgagtatgtcatatgctcattcttgcaatattcattcatcagaagaggagtatctcagtgaaggtgatgatctggaggattaggcttgttctggttaggatgcctgtggagtggagtcgccatagctgttccgtagtttgttatagttttattttccgctgcgtagaatgttattctttgagaggaactatctacctctgtaataatttattatttgcgaatattaaatagttatttatttgtactctattatcaatttgttattgtgtgcctcagttgattctggacgagggtttaacacacatgtaagcgttcggaattttggatagattttccgggcg

SEQ ID NO: 62794 - DNA, 899 bp, Oryza sativa
  unsure (1)..(899): unsure at all n locations
nnnnnnnnnnnnnnnnnnnnnnnnnnnnnnnnnnnnnnnnnnnnnnnnnnnnnnnnnnnnnntgtccagcctcatcgtgagaaacccaagtcccgagaggaactcgagcgccaccagttggaagcaggaggcatcccacttgatccagaggaacgggtgtgcgcgttcccccagtgtacgtcgtgcggtgcttgccagcgattctcattggcactgtgccaggaagaaccaccggtgctgtgccgtggtgcctgggtccaaccgggtgcatctcccgttggctcccagtccgcctcgtacatctgcacaggtatcgatgaggatgactcctcatgctcttgccttggtctgttgcgtgtcttcctgtaagatgtacctgcacaagattcttctatggtctgtaggggaatggttagttcctgacagttgtacaaatgataccccgcattgggtaatgggatttcatttgtacaaccggggaaaaagtatatcaatgagccatcgtctccatgcttaagtatatgcccttgtactaagtatgtttcatcctcatagggacggacagtggatatatactcgatctgatcggtggtaataactccaaggccattcgctatacgggtgatcaaagaagtacactcaacaggggcagtatacttaatactttctaactgtcacgtcctgataaattcatcccgaaataaaaattattttctaaaaggaataatagaattaattaaaattcgaaaagaaattggcaaacactaaaatacgtataagaaaaattcaaatgtggcccggagattttttgttaaattccccttggtctaaaaggagcccccaaattttagtggaattctcagagcccaaataataattattaagaaataaacaaagtt

SEQ ID NO: 62795 - DNA, 753 bp, Oryza sativa
aagaaatgcccattcactggaactgtttctatcagaggtagaattattgctggaacatgccacagtgccaagatgaataggacaatcatcgtacgcagaaactacctccattttgtgaagaaatatcagcggtaagtaaagcaatggaggactatgaacttacatttcttatctgtgatggcatcttatttagaaggtgaacttgttcatcttgtagatatgaaaagaggcactccaacattccagctcacatttctccatgcttccgtgttaaggaaggtgaccatgtcatcattggccagtgcaggtaatgttctctagctgatgctgtacttagtacatgttttctgttttgttctgcatacctgaatattgggattacatgacttgaaagttccactgaattatctgttttctttaaaatgttcttgaaaattaagaaactaatttatattttcatctgctctgtcattcctcttgtattacattgttgatgccataactcagaaccaagcatcatattgttttggatgaggctgttctattgtcttaaccaggttaaggtcctgtttggcacagctccagctccagctccacccctcctggagcttgagctcagccaaatagtttcagctccaccaaaactgggagtggagttgggtggagctctctcacagaatatactagagttgtggagctgggtttaggtagctccacaactccactccagactcaactcctggagcaatattt

SEQ ID NO: 62796 - DNA, 858 bp, Oryza sativa
  unsure (1)..(858): unsure at all n locations
atcggtggtcagatgtatggactatggtggtggcatgcctgagtgggagaggccagcgaggattggtctgaagaggcggtgacttctcacctagacttgttgtctccgtcgactagatccgatacgggacgacggtctagaacgaggaaggctggcgagggtgtgcttagtgggtaggcgggggcgaggttggcgattgggcggctcagacagtcatagtggagatggcggtgtgcttgagggggcggcatctgatatggaggcagcccatgaggaggttgctgagggcctataaaggggtgttgatgtggtgactatgtgctggtggtggtcgacttggtgcaaggtagctatgatgatggggggagaagcctctaggtgaaagcctagctcgtatttctatgagctggcaacgatgacgttttgggcatcacaatccctcgtgggggtgttgttgagatgtctctttccctccctagcaaagcactttggatgaaaaccttgcccaagttctcttgggtgggagacggcaatgctctcagtgtcaaagccttacaggaggtgtcatctttggaggcccaactctgcagttccttccttggggtatctgttcgcctaggacaacactcttcaaagttacatggcggtggacatgtgcgatggatgagcgaatctttcttctatgtcgccctctctctctacactcttaggctatggtgatgactgggagccttgttttgtatggggtgggcgatgggtagtgcttttgtggcccttgctctcctggcgacgagcggtcannnnnnnnnnnnnnnnnnnnnnnnnnnnnnnnnnnnnnnnnnnnnnnnnnnnnnnnnt

SEQ ID NO: 62797 - DNA, 4084 bp, Oryza sativa
aacgaagatggtgacacgatcacagtattcgctgaggaagccgactatgcattgctggggaacccatctttactcccggtttgcaaaccgggacctcgaatccgggacgatttttttattttttcatgttttttgctgcttgcatattgatttccataaatcgagttgctctctacatccgcaaatcaaagattcacagataacatcacaaagcacaaataacatcacaggtccacatcacaaattctcaaaaaaaatacatcacaaattataaaaaaaatacatcacaaatgcatcatagattcacatcacagatcaaatacatcacaatttttttaaaaaaacatcacagattcgtatcacagatcaaatacataacaaattctaaaaaaaagaattcctggtgctgccgcctgccgcccgctgcctgctgcgtgccgacgtagagggaggagtggacgaggaggagggcccccggcggctcggcgagccgtgggctgctgcctgccgcctcccatccgccagaggggagggtgctaccacccgctgcgtcccgcccaccaccgcctgtcgccactcggctgagggctgacggagtggaggaggaggaggaggggatcgaagaaaagggaaaagggaaggagaggataaggaagatagagagagagagagagagagagagaagaggatgagaagataaggtgcgcggttgcgatgccgaggagataaggaaaagagagagagagagagagagatgccaatgacgtgggagagatatttatcaccaaccggaactaaagtttgttgggggcttgatagctattgaacaggaactaaagatcaaaaagtacctataggcttttgaatcgggactggtgtgatttttgcatgacccaacaaagatcacttctccagtagtgatggaaccatggaggatgagacgtcaccgggcttgccaaaattgggtgacaacttaaaaggaaggagcacaatggtgttgcaaataccgtgtgaacgaggtaggataccagcatgaaccttacaaaattgtcgaattgaactagaagagaagacctccaagacagttgcgcagtggtgttgccaataccgtgtgagcaaggtaggataccaccatgaactttgcacaattgttgaagtgaactagaagagaaagccaccaagacacttgtggtgcacagggtgatgtaaaggtggtgcacaggattaggaagaattaggaaatgagctctcgcaccatgggggggattttgacagttgagtttgtgcagatctatcaaagatgccaaaccaagcctgccagccagtgaacctgcgaactcattctcaaaatactctagaataagcagaaagataattatccaccactgggatttatgcaggttgagagtgatttactgaaatacgccatcataaagaaaccaaatatcaatgtttttaatacaaatattaatgccagattcataaacatggaaatgcatgatggctcaatcagaaaactgattaatctctaaggtgtgttcttgttaatcgtctgatattagtacatattactaacggtttgatttcaagctaaaccttggtctccagaatggttatcaaagaaccttcagagataaggggtcgagcattagctgttttgtacatacaagtgtgcagtaattctgctatatatattcttttgaacaatatgaagtttgtttgacgtcaaggaatgtatgaagtgaacaatatgaatttcgtttgaacagtgcgtattcagatggatcataatttccgtggactaataaggaattctgtaatagaaaaattgaaggttcaactatgatttctttgtttactagcaagagaactggtacttctgctatttgttaccagattttggaaaccaaaatatctgtcatgtaggatatgtgtaggatccaaatttgatataatcgatcaaaacgcacacagtactccaattttgctaatgtaggatccaagtttgagctgatcaatcaaattccttggaaatcaaagagcatgtggtgttcccgtctttatttaaataagtgctgtcaggagccagattatgaaatgaatgtcataagaatggacgcatcatatagacagtgaatggccattatatgtaccaatgccctcatctcttgccacacggtgaacacacattccgaaaaacacacatcaagaattttaaatgaaaatttgaagcatatgaaattcccagcagaagaaggtagcagtcatgctctagccgtttgataccccaaatttgtgtgagcagttagcactgagaatcaccaggaaatatatactcagaagaatcttgttaggtggtgatctgaactataccatcagttagggatgaatcgaggttactacaaaaagaagtgttggactcaagctgccatatctgacccaaggttattcagctctgatggttgtttgtatgccaactgtcatagcgcattggctcatcccaattcgttgaggacatgatttgaaagcttaacaacatttgggatcttcaaaacttcaagatggcaatcgcccagtgatggaaatattaagctcttgtggtcgagccattaaaattatgcacaagtgctagcagacaaattcaaactaatagcctgatttctgagattgcattcaaagtaaattaaaacacacgagtagtcggagagtcggtacaagcatatctacgtgttttggtggcacttatttttctgattttgtagatttatatcagcatgtgaaccaagaaattatctaactcaaattcacacatggaggtgtgcaattcaagtgccaaatttcttagttgtttaacagagaatagcattcgtgaatcatgataggctgaagccttgaagggatggaacacatggagcaacgcaagaaacaaaactcaagtattaatttcacttctgtaaataactcgttagttccacagtaattaatctgccaaatctctccagtttcttgattcatatgcattaaatcagatattttttttaactttgatctgtaaatcctctatgtcagtaactttgatattgtagtttttcaaacacttcacaaacgcggagaactcgatcaaatttgtcctcaatttgatgcaatcattcatggattgggatgcgtcaggaatatgctcccatcatttcagggatgcaactgacagtgtactgctgactaatattccattcccagggaagcaccacatctagtactagcttgcatcactataatcgccaaccataggtagcttgttgatgtttcaactgatcttaaccagatcactataattgctgtagtggaaggactaatgcaattcatctctttatatttgaactgaacgtccaatgcaattcatctcagtcgattcagagatccaaacagagcctaaagtatcaaatgtttgatcgtaataagcaagtagtataaatagatacagatcacaccgtatgtaaaacacaccaaaaaataaaaaaaccaagggagcatgttctacaattccatgtaggccagctgtccaattccaacgtgaagctataaagaacacaggggtttttaattcctgagagccaaagcattttggtgtctaaaaagttcaagaatgttgctccaagaaagtttaagaacacattccaacatgatcagtaactaaagcacgaaacttgaccagtctatgtataataccataccaaacgatgatccattgtcttttaacgtttcaaagcaccctctccgtttcagattataaatcatttgactttggtcaaagtattttcaagtttaactaagtttgtaggcaaatatattaatatttacaatactaaattaatttcattaaatatatttttataatatatttgtcttgtgatgaaaatataaattcttttttctataaatttgatcaaacttcaaagtcaaaacgacttataatctaaaatggagggagtacttgattatggtttttctttgtcaagatttcaaataaccgtttgacaggttgcacatttcactatagacttgtcaatctcaaatacatgatgtt

SEQ ID NO: 62798 - DNA, 10794 bp, Oryza sativa
aatccgggactaaaggtgggtatctttagtatctaggactaaaatccatatttagtcccggttggtagatggatagggccacgtcacgattgttttttacttattattattatttttttgcttgtacctattccccacccaaacccacccaaaccattcacaaattatacacaataaaatcatccacaaatcatacacattcacaatccacaaatcatacacatccacaatccacaaatcaatcacaaaatcatccccaaatcaacaaaaaaaatctccaacaaaatatacaaatcattcagtacaaaatatacaaataaaaaaaattcactcgctgccgcccggccgtgcaccgccttgcgcccggctgccgccgccaaggagagttcccaaatgacttcataattaaggagccactcggtctacgatggcgtggtataatatatttctttccaaaccgaataatacaacatgttaaagactatacaatttcatattatatcataccaatctctaaagggtaacaataataatatggtgtatttataagaaaaagactatttacaccttagatgaaacacccaaaggttaaaataattaagaagctcacgagaggagaaataattatcatcaactacagttaggtggagccaggcaattaattgtataacatttaggatacatgatacctttggacccaacttctatctatctattatatactaaaagtacattaaacttcctataaacgctctcgagtcgccaagtggcgcttctacaaacactcctggaccgccatgtggaccgccatgtggcactatctaatctcaccgtcgattttcacttaaattgatggacccgttaatttagaacattagattagatctattattaaaaaggtgatagtttttcctaaaaaatatgcaactggtggctgggaaaaggaaataaaactaaatgtccgtacgtaagtataattgaaaaaaaaacaaataaagcttcccactgttaggcggaagaaaaaaaaacatctactaacgataaaagatgataaagcaaaaaaaaaaagatgactcatccatcctctcctcaccaattcaattatctcctcttcttttttttaactaacataatataactattgttttatttataattaaataaataaatcaagataacattagctatattttactataaaaagttaaaatacattatttgatggtagaccctatcgtttgaatggcaactaaataacaacgaaaaattaatcgaacataatatgtattatgcgatactaaatcactatacctaacaaaaatcaattaaaacgctctagagcgctcataaatcaccatataatatgtcctaaaattataagaaaaaaaagcaaaatttgatacaggacacccaaaaaatgtgtaattggctgggagacaccgtaaaaacgtgacatggctaatggaaactataaaaattatgtaattggctataggacaccggaggcaatattttatatttccgagtcaaaacaggtgagaaactttttgaaatggtgagattgcccctaacacagagcgtcgccgccgcctcgcccaccgtgagcggcggcggttgtggcctaccccaccgcaatccgccgcagcggcgccatccgctacttccgatgggtggatccggctgcagaaatgtcctgcgggttgacggagcgccctcggcgacggcgtgtcttgagccgctggagcttgtctctcctctccatcttcgtccgtcacctgccatctctcttcggacgacgagcttgtcgccggtcagatattacgtattgctttgtgatttgctcgattccgttggtttccagctttcactcctgtggatcatcccagctgattttattaagttcgattcagagtctgttggtttaatttttagctgattttgaatcaaactctttttttttcatataattgcgtgtgtgtggatagagggtaccgcttggtcggatagacggacaaaaaaatattgtgactattggaaagttactattttttataagtagttaagatatggataaatgtgaatttgtccatatttatatctaaattttttgacacagggagtaaccaacagcctttttcccacgaatagaaaaaaaaagaacataacgaacactgactacaaatcaccgagcgacacgtggctggacatacgaggtgctagattaaatttgatcaattaaattgacgtatccaatattttatctattagatctattttttaaaaataaaatcttaagttatcatgtctcacgtcctataaaaaacggataaatgaccttggaaattcttagaaaaaatgaaacaccctgtcatcggctctcacttaaatcatttagaaaaattagaaaaataaaatctccaccccctcctcactctcacatctacacaaccctgtcaccccctccctattgttttatttattaaattaaaagagaaacaaaaaatatgtttgatattattttagaaacaaagtacaaacacgagcgcttacaacgtgcgcgcactcacctatgtgaacacacacatgcacatacccccatgagtacttctgatagactaggatgacatattttgagatggacgaagtcactacgtacgtctcgctttcgacgggtacgtcacctactactgaaagaatttgtaattctaggacatgaacacgagtgggaaaattccatcacaaccaacgtttacttcgtagtaatgttggatattaaaacaaccataatttttaaactacatttctggaatactcctatgccctttaaaccggtggaatcattatttctaacagttagagctatcttatataagaaaaacaaatgtgtatacatggtacatcacatttaaaatattattgtgcaattatatttcgctttcacattagcttgcgtggtacttctgacccactctacattaaattatcatagatggatcggctctcaaatcacatcaatcatattaggctatataaacccatatatttagtggagcttcatgtcccacccaattaatcctcgaagaaaccatgataatatatatgcaattaaaaaaagaaaaataccttagttttactttgcacttactcttcgttgacatgttttctagggaaaataagtctaccttcttttcaaatgatgaagaagattataaataattgtttattgatattacttaaatatgatataatataaagctaataggttagaaaattataaaagaaattaatgttgatgaaaagaatttacggagaaatcgtggtagatgttcaccggttaatattttcatcttataagcgtctcaatcttagcatacgacccatgcccgcgctaagcgcgggctatcttcctagtttgataaaaaaggccttacatattttacaggaacatcgatccatccatgaggctagctaccaaagctgttgctaaagagatttaggacagatacatatgtgtagtatgggactgggaggcattgtggaaatttcgcatgcctatcaagtgtggttttgcacgaaagatggtggtgtgtcaccgtgcccaggcattcgtcgcactgacagcccacatcatcctgccactcagcagcatttgcaggctatccaatatttgacagcactatgcaatatatgaaatgcatgtcgctagcctcgatggtagtgtttgcattagtaatatgagtgtagagagaaaaatcaagttgaattgattatccctatcatttttctcaattgttcttttcaagaagacacaattagtaagtgaactgtatgtgttcagcaatactaacgcggtaggctcagttcaacagactacgtacatatgcttctcatatatcacaatgaacaagctaatttttcaaatcaagatcacaatgaaaaagatttaaaaagtctaaagggaaaaaaaactatattgtacatatataatctgatataacccatctctaacggataaagatcatgcaacacaacatatgctaattgaaccttccttggactgggatgcgtcaggattatgcatatgtcttatgttttcgcatcatttcagagataactgacaattgtgtttcccacgataagggtgttgcttgtctggttcatcaatgtaacattggtcaaggaagtttgtttctacttcagatttgaatcaaggtcgcgtgcaattcatgccagcaaattcagatattcaaaacggagcctacatatacgtgatcaaaataacaatgtaattgaaatagatatgattgagatcacaccatacgtaaaaacatgaaaatcaagggatgatttgtgatatatatgtgtttcagatgagctgtctaacaatagcaagtacactatagctgtccaacatgaagctcaagctaccaagaacaggattttaaatttttcagagctgaagtgaccaagcttgagaattttggtccaaagttattttaaaccctgcaagaacaatgtcaacgagatatcgtgaagcataaaagttggctagtcatgtcagttacaatgcaatgatcaactttcatatacaattaacgtttcaaagtacttaatcaaggttcttagtagcaagcttaatagtgatacaggacaaaccatctgcggatctgccagattgcagactgcatccttttattctgtcatatatagatatcaattaacccacttgtgtgagtcatcgcaatttgattgattgaaaattacaatcactctgcaaagtagattgatgtctaacacagaatatataagtcattaattgccacaaattgcactgagagtttgtaacttaattgcaagggttgatataatctttgcattagtttttatatcttcatgtgatatacagcagttcttcaacttgcacatgttcactgaatccgctatcgagatcaactatctgaactgaagaccctatatatcatcaccatatatatcaacgagttttgtaggttcaattcacttcacatatgaaatatgtaactaaatggttaggctagataatgtacaagcacctcatgtatgcatgctgcctattcttgctggcttttggcgactctatgagtctcaaagaaaacaggagccatatacgcttgggaggaatctgggaaaagtcgatgtcactggtaggagtgatcaggaatacgaacggatgatcagttgaatttggtatttctctcgtttcttataggcatgatcttacaaccactaaattgtttcttgtgtgtttgctgggaggctagcttaaacagtagatgcatttgaacttctgaagcttgccatgcccaatttgttgacaagtagcttaatatatatgcagaattggatcgcaaggcctctaccgtaatctatttgctctatacaaccttcttaaggtggccactctcttacatgtgtccattctctgaaatctatggtatattggtacaataatggctagtgctagcttatgaaaaagaggttttatcagaactaaaaaccagttaacattgataatacttgcagaaaatatctccaagtttttttttctaatttccaaatagtctagctttgtctagcatgaggctttggaactctctcctagggtgtgttacactacaaaggttggtacagctgcattttaaagagaggtcgcattcagtaaagatcagaatatcgaagagcatgacacggcgggagcatgtacagtattgttggaaatatggtgtatattttaatccaaaatgttaagacaataattatggcatgaacaatgtggggtgatctagtgacaacatttagcataaccagaagcatgcttacagtaccataagcatcatgaacataccaagaacgcaatgcgaccaacagaacaaacagaggtatgaacgacagtaggagagagacataccccgagaatggccctccgctggattgtaaggcagaactgcctctgtcgatgttgaagttcgcaaaagctctggctcccagagctccatctccagagacggcggcagcggcggctccggctccaggtgcagacatggtggacgacgagacaacgacgaacagagcagtcgtgtagagcagtcgtgcgggaagcactccccaataacttggtcacccgcctacccggtgcagatctcaggcgaaggtgtggttccggaggccctgctccttccgatctctcgtgcgcacaagcgattgcgatcagaaacgaggaagcgaaatagaggcagcacagggactagcggcctccttatataggaggagagatatctgccagtttagcggcctccttatataggaggagagatatccgcgaatcgttctgatcggactagcggcctccttatataggagggcggaggactagccgcctccttatatagtaggagagatatctgccagtttagcggcctccttatataggaggagagatatctgcgaatcgttccgatcggactagcggcctccttatatagcaggagagatatctgccagtttagcggcctccttatataggaggagagatatctgcgaatcgttctgatcggactagcggcttccttatataggaggagagatatccgccagttgccgcacgcgcgtcgtgggatcgtgcatgcgccgttacggaggcaatcgtggtagcaaaaggacagagactgacgtgacgcacgccccgccccggcccggccaggcacacgcgcgtggctttccgattcccacctcaaccggtcaacagagagcctccaataactccctatttaagttgaggtactcctcgcttaattcctgaggtgatattgttatccttaacacttattatgggcatttgagatttaatagaataaattgggcctagcccaatctatctatctattatatactaaaagtccattaaacttccttcaaacgctctcaagccgccacatggcctcctacaaacactcctatgtcgccacgtggcattttataatctcaccgtcgattttcttttaaattggtggagccgttaattttaagcgttagatctcccttagagaaaaatcatccccactatttttgagaaaaattaccgtatttgctttaactaatagatagaaaaaaaaaggagaataccataataggacaagaggccagccagtgaggatcgggcagggtacatacgttcttttattttctggtgtcatacgttctatttttttttcctggtggcatacatacgttactacgttagttttttttagcctttttttttagcaaacaatattttttgctttacacattcggcaaacagtactattactacgcatacgatacgtacacgtacgggagtttagggggaagtgttaatagatataaaatcacatgttaccgatttaagtgaaaaccgatggtttgatttttttttctcataatttttaatatttattttaatttagagatatgacatgtagtgacctatgagcatttatacgagcgccacgtggcggcttaaaagcgttcatggaaagttcaatggatttatatatactaaaagccaattaaactttctatagacgctctcaggttgccacatggcctcatataaacactcctacatcgtcacgtggcattctataataacaccgtcaattttcttttaaattggtggacccgttcattttaaccattagatctccatctcaaaggaaataaatctggtatccccacaactaacaccttacatacatgaggtaaaaaaaagcagtacgtactctttccaccctccgaatctcccctcctctcctattttctagctaacttatcctattttataattaacactcaatatataaaaaaataattcaaacatctaaataaccctcaagttacaattttattctcattttttgttaattgttctgttatttataattaaatataaaattcaaaatccatattgctcatattttgttatctaaatattagatcatgcaaccattctaactacaaatgtctaggcctaatggtacgcccataaacacttctaagtcatttgccacatgacactctattaaattaaaaaaaaatctataagtgtgacaaatgaaaacaaaacatctaaccattagtttccacttgaatcaatggatccactatcttatatggttagatctatctttaaaaggaaatcccaaaagtcccaaccgtttgtcccgttcctctctccctaccattcattatctgttctttttatctccatggcaactaaatccaaaattatctttacgagaaaaaaaacacccacaaatggactccgcctaacaagtctagccagcttttcctttgtcatgtgcttctcttctctttctcctcaagctagtacttataaaaacaacctaaattagactttaaaataatcgtaaatttttaaatcttatattcaatttatgacatttctaaactattgtaagtttcaattaaatcaataatttaatacattgtggacccgtctatccaacttgaagcctccaataaataaaataaaatactaaaatttctaattaaaaattaaaatatcccaccttaagtttttaatagcagtcaacccattatttataccatgctaaatagctaattgccttcctcccaactccttctgtttcagattataagtcattttaaattttgtctatgtcaaattacttgaattagtttataaaaacatagtaacattttcaacacaaaacaattatattataaaaaacatattcaattttgaattcaataaaaataatttggtgttgtaaatattgatatatttttcgtcaacaatagaagtagttaatttctcttaacatttaaataggggctatttacttatacttagatgcgcttttatgaataaatgatctttttagagataaatagacgttcctaagatcatcataacatctaaattatacatattatatctgatgtcactaatagattagagtaaaagcttttaattatatcttttttcttgtcataacatgtaccctgtctaggatctatttgtcatagacaatagattgaaaacaatcaatggatacttttatcccatgccaagttgtatggccttaacccacttatatttccataccaaattgcagagatcaaaacatttaagggatgcttgatggaatggaaatctagaaaaaaaatagaaaaataacatgataaaaataattgaagactgaacttttttttcttctaaatttaactttttttgaatttgaaacccattctaaatagcaatgttcaaatattttaggagtactgatacaatgaaaataactaaaattttaaataaaatataatagaaaattggactttttggcattatgttggaaacaaaatctaacataatttcagttcgaagtatacaaccctaaactacaacttgggagcaataaagtctcatttttaatatattttctgatttagaaaaacttttactgctaaaccatagttttatactgcaatactatataattacaattaaatcattatttcaacatattcagctcatttaattagatcatgtaatcgtattagccatatttttaatagaaaatatcttcaattgatatatcctaaaattcaaaaaaacatatatagtgcaaaaaaaaagatatgctaaatattaaaaaaataaatgcattatgtacaaatgcattatgtagaagtgatatatagtttcatatatatatatttcttataaaaccaaatttgcacagttttaagtaattttagtttagaatttatacaccagcgatggttactagcattcagagaaacaccacacaaattattgaaaaattaaacatgtttacaatagagtaatcataaaaattcctaataaaatttctaacacagttaaataagatgcccgcgcatatgcgcgggctaccttcctagttattctaacaagtatatgtattatatataaccactgatgctagtttttctcagtagcatgcatatttatatttcgttggaaactctcatatagtcaactgtaagcaatcaagactgtcaaaaacctgcatacagcaaaattgcagcttcagtcatttgctcatatctaccataattggatgtcagcaggattgagatgcatcggcaaattagccctcgcgtcatcggtagaaagtgctacattggagcacttgtggatagcaccattgaaccaggcaatctatattctcttctctttatgcagttcatggaaactgctaagacgatgagtccgtgatcaactcctatttaggaataacccgtaccagtgacggttttattcagttaggcaggaatatatctgtgaaccagcagtgatatgatgagccggtttcaattggcttttgtgtgatagcataaactttgtccagaaaatgccgcaactaggttttgtatgcagctagagatttgatcaggtgtatgtttaggtgaattacaccattgtgaatttgggtgaataacaccattgtgaataaactaaatacagatatacttggtgatgtttttaatacaaatcgatcttattgccaatttcatgaacatgaacatgaacattcacactgcttcgttattaaaaaccttttgaaatcgattaatctttaatatagtctatgccaattaatggctagatatcagcacaaatcattcacggtttataattcactactacatagacgatttctctgtacgagcatccctatagtttgc

SEQ ID NO: 62799 - DNA, 5477 bp, Oryza sativa
ttaaagacctgcgtgcaaatacaattttcgctggtgaacctcttaacacacccgtatgcaaaaaatgagtctattttgacatgcggatctcttaagtgaccacaagcaaaaatagatattcgcatgcatgccccacgctttttcccgcaccatttttttaactcccctctttctctccaccacaccttattctctctcttctcttcccactcctcctagctaactcctcctctccctctcccctcttccaatctcttcttcttccctccccccttctcttctccagtgggtgccagcggccagctagcggatctgccatccccgccctcaagagcaatgagtccgtcaaccctgccctcaggagcggcggcagcgggagcgggcagatcagtcgcccaagacctcgagagcggtggcggtgggagcgggtggatccgccaccccgccctcagcaggaatgatggcgcagatccgccgccgctgctttcgggaatgacggcggcgggcgcagcggcccgacgacgacggcaccggcggtgacgactacaacgacgatgaaggtagcgactagggtttcgagcgattttgtttctttgggatttttaatttttttcgctgaaactattttcacgtgcggtcgtcataggtgaaagaaagcgagaaatcctatttttgcatgtggttatgctaccgcatggaaaaaaatgacgattttgcacacacctaagtgcatggaaaaatatgttttggccgtttggaaaaatcgttgtgtaggtttgcaagtcttgaatggtttctcacagacctgttagagtcttagagattagttaattagacttgacacttggttgtccggtggaagtgtggactattttgcctatttactatcagaacatacaaaggattaaacaataatacgatgttgtttcaacagtgtatatttaagatggattagaattttcgcagactataaattggaatccttatgaattttcttggggaaatgggattgattaaccttgatttatatgtgtactagcaagaggagaacaagtacttctcctactatactccctccgtacatagtccgtacaaaatacttctagtatttgaaatttgttcacaaatataatgattttattgtactactttccaacacaactacctatcgtttaatgaatggcaccatattcttttcccttcatccttaatgtctcaatagaatttaaaagttattgtatttgtggacagaggagtacatgtctagctaggatcaaaaatttcgatgtaatcaatcaaaacacacacagtgtttcccattttgccaccgacatactcaaatttcatttgaaatccaagaccatgtgggtgtaaggtattagttttgcaaatcatgagagttccaaaactagtttcccaaaactatatggtccttgattcatattcattaaattcaagattttcttagttgtggtcttttatatttgccatgaatctgttgtataaaatggacaggtgaaccctctatcctatatgtcaataaagagtgcgtctccggtgctttttacttagagtagaaatcaatctaaaccgctaattcgtttttatccaagggattagatttatttatactaccaccttattaagagtagtagaaacgtgggagggcaaattcgtccattgaaaaataaacattgatggataaatttgtaaatacgaattggaaactttgggatgagatcgatggtggtggcgctacaggagggggcagaggcggctaccgcggtcgctgctatcggcgacggcggctaatctgcgtgtggacactcatcgccaacatgtccatctaggcgagtgtttgtaattcttcatagacagaggagaatgaccagatgcaaggcccaacgattgtttgtcccgtatttcctctgacttcaattgtacagagaaaattttgaaggttgtaaaatttgtgttgatgtctttgtaatttaatcttcataatccgtaaagagatggatacttgaaaagaatatctacttaaagagaattcgatagatattggatggatggttactggcgaaggtcagttgccgaatcgagttggcaccgccgccggtgtaggtgcgtagagatacagcgagagaaaacgatataagcggcgacactaacaacagattcaactattaacggaaaaataaatatcaaaattacccctaattaactatacaggtagcaaaatactaatatacccttagaaatcaacggctcagatcattctacttgtagtagaatactaccagtagaaagcactggagcgtgactcgtcaataaaatgtccatttttcttccaacacttcttcacaaccgcgaagttctcaaatttgtcctcagtttgaagcaatcatatgcacgactgggatgcgtcaggaatttgcatctttcttttgctttccagtcatctcagggtgcaagcgattttgttctgctcaccagcatttcaacatttgagagaattgcacatccacctaacactacgcaggaaacgctcatctctgacagcaccgaagaactcgtcatggatgacctcacctttgaccggtccatccacagcctgtgagaggtgaagtctccagccgcgggccatcacaagttataatcactctatatcacagggcatggatttttcattttcctgttgatctcaacgaggtcacgcagtgctgtagtggaagctgcgctctagctctttcattcattttcaccaatggaaactcacccttttagattcgaattgaatgtccaatgtaattcgtcctcaagcgattaagagatccaagcagagtataaagcatcatatataatcttaataaccaagcaatccaaacagacagagatcgcactgtaggtaaaaacactaaaaattaagggagcatttgtaatatttgttgcagatttatatactacattaattctttctcacacttgcaagtatgctagctgtccaattcgaaattatcaagaacagagttttaaattttagagtgccaactctctctctctctcagcgcaaaagcatttcaggggcactgaaatttcagtattgaattgtgaactgtgcacgaacactgttaggccttattcggtttagagagggattgaaaagtattagaggggattaagaataattccccaccaaataggtgtggaataaatctcctctaatcccttcctcacaagggttaatcgaacatgacgttaaggctgatttgtggagagcctgaaactaggcatttacatgctcgtcgtttgcattagaaaaaaaagacaataatcagttgcaaacataatgaccgtatcaaagtagttgagtgtattcagggagcatgtgcagagctccaaagcgatgcaaacatatgaaaatacaataatacatttagagatcttcttcaatacttaaaattaattaggaccattgatctgcaataatctaacggacagaaagagaaggtgcctggaaaaaggtattaaaagggtgagtcaggtatggaaggtgggagggtaaaatggtaattgtttttcattaaattttttcggtaaagggcaaaagcgtatttttacaaattcagaacttttgagagaagcaacaaacgtttcagcatgaggaagaaaaaaaatgagaggaagaattagaacgctcgcgtgcgagaggaacctacataacctgctggtcgtcgctgccgtaaaaggctgccgcttgccgaggccgcacacgcccgccgctcgctgctgccgtacgcgcctacgaaagcagcagctggacaccgtcgccgccgacgcacgcgcccgtagcgcccgccggtcacagctgacgtacgcagcagaacatcgctgtcaccgccgctgcacgagcccgtcgcgccagccagtcgccgccgtcgcacgcgctggcttggttgattagggttaatcttgaatcaacggtgcgatggcttggttgattgggtgacgggtgggatttgagcaattactaagctacccttgttaataaaaaattgtgttcctaaattaccctttgaagattaatggtggataacaattcgttaaggaggtactggggtaccttccaagcaccgtaaaagatctcatatatttaccatcacaaagtcaggtagaccctagcatagcatatgagcctcagtaaggtgctagtatttactagtagtaaaaattaatctgaaccgttgatctcatctcatatctattaatactattaccccaagtaagcggtagtagaaatatgaaggggcattattatagaaaaaggtgtgaaggggcataatcattatatagcagtaactaaacatttttttctccttttttttttgctttttcaatgaaatatgagcgatgccagctcaatggatattataggtcgatttagccaaggaaaaagaacataaatgatagttactcctaatcatggtattaatagattactaatttagccctaaaaataatggtagtataattaaactgttagagaacactggagcatcgtatcagtgagcaggttcactcctcttttctcataagaaacaaccaaaaggttaagactaggacactatacaagctcctcatctacgcaatctgccttttaaagcaaaggagtgtcaaataggattgggaggaatctaggaattcaatatctctccttctcaaatccacagtagctaattgcctatttggttacctgcgcactcgtcagcaacgaagctgggatccccatggcatgtgctgatcacattgccttacactgggaggcaagaaatgaaagagaggatagataataggatcatcgaagcatcataaaatagacgtggcattacttttgaacctcatctcttgaaagaaaagtaatcgaacactggaaagagtcatgtggtgagttatacatctcttgttgatgacttttcagttgaaatcatttagtattcgaaaatattgtttgaagttgtcatattttcaaattcaaattcaaactattcaaacaaagacatatagaaaaattaccaaaataaaagttatagatcttgataagttatacaactttgtttttgataatttttccatttgaaatcatttactacccgaaaaaattatttgaatttcttatattttaaaatttaaattttatatagtccgattaaactcggatggagaaatgaccaaaataaaattggtagatctcaatgagttctacatttttttatatgagtttatttagtaccataaaattcaattcgaagtttaatttttttcaagaagtctgatttgcctcctctttgggttgggctggcttatgggtcttatgtataagtcggatatccgatggaaaataccagataatatccgacggatatcacctagaccatatcgtttttatatccaaaaaaaaatatttgaattcgtttccg

SEQ ID NO: 62800 - DNA, 4761 bp, Oryza sativa
tacttttgaacctcatctcttgaaagaaaagtaatcgaacactggaaagagtcatgtggtgagttatacatctcttgttgatgacttttcagttgaaatcatttagtattcgaaaatattgtttgaagttgtcatattttcaaattcaaattcaaactattcaaacaaagacatatagaaaaattaccaaaataaaagttatagatcttgataagttatacaactttgtttttgataatttttccatttgaaatcatttactacccgaaaaaattatttgaatttcttatattttaaaatttaaattttatatagtccgattaaactcggatggagaaatgaccaaaataaaattggtagatctcaatgagttctacatttttttatatgagtttatttagtaccataaaattcaattcgaagtttaatttttttcaagaagtctgatttgcctcctctttgggttgggctggcttatgggtcttatgtataagtcggatatccgatggaaaataccagataatatccgacggatatcacctagaccatatcgtttttatatccaaaaaaaaatatttgaattcgtttccgaattcgaaaattttcggatatatccgaccaaaactatccgaatccgaaaaatggtccggtcggatggaaattatccgaatcactttccaaccctactgctgagcgttccctgaattcccaaatttctgatcgatcgtgagcctgttgataggttatctacagttcgtttgcatctcttataaacaacttatttctgctgcttcttgctgttaattctacgatcattgagtttttggtagttttttcttaggatcgaatagcaagaactaagccaaccggggagggggggaatagttgtagtacctaaaacgtgaaacttttagcggaattaaaagttaccctcgaattcgatgtagatcggtgtgaccagagttgatccacctgtctgatcgacgttgatttccaggtcaaaccaccctgcgatcgtctctgcctcctgtcgccgctgccggtctgaccaccttgtccccaccggtttgaccgatgcgatgccatcggtctgaccaccaaacccgaacaaacacaaatagaagatcactcaatgtagattggaactttaatatttctctctgtgtttacaaagtgcaacaacagcatgaaattctcgactaaactcgaaaccctaacttttctctcaactcaactctctcaaaaacattaccgggaggacacaccctccctctctatatatacccgagataggcagcctaaagctacgaaccaaccttgtacaaaaatcctaatcccctaggaaaccttcccgtacaaaaaacaaactttacaaacttcaattgtactaaatttggactccttccaaattcgactccacatcccatacgtacacaatatctccatcgtatgccatttggaatcttcaccaagttatgacaccgcatgatatcctgatcgtcattgatctttagcctaagcataccgcatgatatcttgatcgttcagacatcatcttctcccatgttgactcccgatccatcaccggcaacactctcccgagacatcaagaccacctacacatgcatcaactaagaaaccatatccgagcacaagttctcaacaacttgacttattcttagcaaacaacaatattatatacgcatagtatccatctagaagtcataaacatgaataatccacagatatattgagaaacaacccaaaaccaaaaccaacacagagtcggacggtcaaatcgcaagctggccagtctgaccgcttgatacacgctggtctaaccggcaaccactgcccgatctgaccggttctacttagttagcaatccctgttcatcacctgcaaatcaattatctccaaaaccacttcgacaataatctccaaatatcaaaactaataatctcagatgccaattattcatcacagaataagaatcaaaccaactttattttacacttttacttggaagttcttgtgttactgctgctgctgattcaattcgatttactcagtttagaaatcaattacgtcataagtgctacccacctatataaatatagctcttggatttgttttagatatgtacagatttccctagaaaatcaagagtaaaaggattcattttcccaaatctattcagtttcttgattcgtatgaattaaaacagagatttctttgctttggtcttcaatatgtgccatgaatctgctctatatattggcccggtgaaccctctatcggagtaacatgtccattgttttaccaatacttcacaaccgcaaagaactcgaattcctcaatgtgaggtgatcatgcatggactgggatgcgtcgggattatgcatctgacttacttttgtaaatagtttcagggatgcaagtgttggaatgctgcacatgagcattccacatcttgcaacagctgctcgctttgatcatcgctcggtgattggccagagcaagatcgttcttcttccaactaatctcaaccagattgcaatttcttccatggaaggtgggctgtttgacaccttcccagctaattctgagatttagaaggtgccaaaaccatcatatatgtgatcttaataagaaagtaatttaaacagatagagatcacaacgtcaaaaacacgaaattcaagggagaactggtggtatctgttgctggtttatctgctccttttgttgtaacacttccaagttggctagttgtccaacatgaagctatcaagagcaggattttaaatttcagagcgccaaagtatttcagtccaaaattattgtgggccctgcaagaacacaatcaaggatgattaatgaagaacaaaacttggccagtctatgtaactacattgcaacataatgatcaattttcttatgtagttaacattcaaaagtatgtacttgatcaaggctcttattatcaagcttgtaaataacggtgacatagagccaaccatctgccagatttataggcttgatgctttagttctgtgttagatgtcaatctacttgctgactggtggcaggtttgaatcaatacaatgcgttgtcactgtgacttgtaaggactgatcgataaatctttgcatgttttatatccatgttaagattagttgtaaatttgttcttgcacttatcatgtgatgttgatctttagcagctatctggaacttgcacatgctcactgaaggagatcaactactaccgataggatatacatatcaactatataaactgaagacaattcagtacttctcatatatacgaaatatgtaaacaaaatggtaagctcctcatgcatgcactgcctatatattcttactggtaatcagataggcttgggaggaatctaggaaatcaatgcctctggaaacattaagagatgctgagtgatgatctgctgcgtattgtttggctcgttctgcagtgacagcttacaacaaccattgaactggttcttgcacacttgcagggctagcaggagcttaatatctgtttgcagaaaacagcctcctgaatggggtccgtcctcttacatgtgcctagactctagtggagtacttctgaaagagagtggtcaaaacatatttatcggaagcttaaaaaccagtgtaagatttctaacactttgaaacacagacctattggttgatcttggtgctacgagaattaattgtgcgaggatgaagtccaccgtgcacccgcccaatacattcacatgagtttccaaattaaccatgcactttcctaacaataattccatgccatgatcagcggcgtttccacatattttggaccggccacgtgtcccaccaatgtcctataaaagaatagaaggcccatgtgaggtagtgaacaatattgacttctcgcacactagaatacgttgggaagggacccgatggaccgcttccaaacctacaggataaggccatttccaaccaatgacactagacactagtacacactattctttccatgcaaacaccactattccataattcaatttaatgctacttatctcacatgatgtcttggatgttgtgtagaaatcatgtctcatgcaagacatggtttccttctccttttctcatttattcacttgtcacatcatttttcatcctacgtggcagcttaactaatgctatggacaccatcctagtcattgggttggtaatgccctaattaaatccttcaagggagatgatgaggaattaacctaggaagttaatgtgtctggggccagctctgtcacatatcgtctgtctaatttagcaacggcaacttaattataagcactgaattagcttttatacgattgcaaagctagctgaccgtgtacgctatttaaagttcatatacaaactcgtgatattgtctggcgccaccgcacaaagctctatgccatcgtgcgattgagatggcgcggctcatcgggggcaacggcgattgcgtagggacagttgagatcgagatcatgagtcgcggatgttcggcccgccgccatcgctcgcttgcgacaggaggggaaaagagacatttcgcgtaaaccttaattttctcaaacatgtcataaacgtcaaataaggggaatggagggagtacaaacctaatatagccatgtcgcactagttgattgagattcttattatcatgctagtaaatatatgggtggtatatagggccaaccatttgt

SEQ ID NO: 62801 - DNA, 1325 bp, Oryza sativa
acagtttgggatgtgttggctgccactgccacttattatagatgacttaattttgtaagcggtaactatcactactacacaaaacctttttggtgccggttgcaaacccacataggtgccgaatttggcaagcggcacccagtttccagcacctatgagtattgttaatggtgtcggttcaagaaccgacacctttgaggtgtatggatcacaaaaaaaaaaggatggcttggctcgactcaattcgagcggatgcctcaaagccaaaagaaatcgaaaaatataaaataaaatgaggcaagttatcagataatcacaaattcattcacagaaacattcatagatacattcacatcaaacatttacaaatacattcacagatgcattcacaaatacattcacaagaggagatcagtgaatacattcataggaggagatcagcgacggcgagatcaacgagaaaggagagggcgagggagaggggagaggagtattgacctttgggctggcccacccgccgagaggcaccctggctgccgacctggctgggcaaatgctgccgagcgccataccaagcaccccgaacccggcccagggcggccgaagtgggggcgcacacggcagtgacaggcgggctatcatagtatttgctaagttgacgggctggagataagcggactcgaaccgctaacacggccacaaggtaaaaccaccgcctcttaggcctacccaacgggggccctagggcggacgaacccgctagccagcagcggtagctatgcgcccactgtgaacgccagcgccgacgccgacaccgccttgaatgagctcgaaagccggcggttctcctcgttgaccaccttttgatgcggacatcactacctcggatacacacaacaatcctccaacggtcattcaaggaccgataacaagagctcgtgcgcgacaattaaatttagaggtgagttcgttcctatgttcttctttgtatgaattcgagaatagattgctacctaatgattatattatgattaggaacaatggaggggacaaggagacacttggagaaggacttatagccatggaggatcatcgaggacgtccaagtcaaggtggaggcccaaaccaagtcgacgtcgggtgtaattcggagtccaggaccagtctgcactaaaacgggcacccaagtcgcatacgtgctcagattggggcgttctttatatggatggaaagctaagaagataacttttccaatggttttggtcccacgtacaaattctttctaagtcaatggaaattgaccgaacaagttgacgtctagaatc

SEQ ID NO: 62802 - DNA, 858 bp, Oryza sativa
gggactaaatatcattgcacttttaaaccgggactaaaaatgctttttagtcccagttttttaagcaatcgggactattgttgtttttggcaaccgaccaaagatggtttctctagtagtgttaatctgtcattagcacattcaggttactacagcacttatggttaatcatggcctaattaggctcaaaatattcatctcgcgatttacatataaactatacaattagtttttatttttatttatatttaatgctccatatttgtgtctaaagattcgatgtgatgtttttgggaaaagttttttgggaactaaacaggccctcggtacctcaaagttacacaaattttttgtaccacgaggtattttctagtgtaaaatttggtagcttgagttacttcgtatcttgaggaactaaaatttgtgtataaaatatggtacctcgaggtaccaaatgatggatggtaaaattgctcggatccacaataattttggtccgaatttatcgaaaattctggttccccctcaaatactctggctctctgaaatttgaaatgctgctcttggtagcttcatgttagacagctagcctacatggaaatgttagaacaaaggggcagataaaccagaaacagatatatcaccagttcttgatccattgaaatttgtgttttgacagtgtgatctctatatgtttaaattactttcttattaggatcacatgtatatatttactctcatatatatatatatatatatatatatatatatatatatatatatatatatatatatatatatatatgaggggttaggctccttttcaatctcagaattagctgggttgaattgaactgg

SEQ ID NO: 62803 - DNA, 703 bp, Oryza sativa
tttaggtgtaaaaaagttgaagaatctgcagtagtataagagatttttatgcgctgatttttattaaaagtataaggaatccgaatatatattgaggaggcatatgtaagatgcagcttggcgtacatgccgtgctgtcaacggtgaagacatatagtggtgggtgtgttttttcttctctttcgcaactcgctccctttttcacgcgcacgtttaccgaactactaaaagatatgcctttttttaagataaataaaaataataaatatagaaaagttgttttaaaaaagtttattaacctatttttagagtttttttataatactttattaatcgtgcactaatccatcgtttcgattctcatgctgaaagggaagtttccccaccctcaccttataacacagcgaagttggcatgctcgttgaaaaacaatatgttaatttgaagctattcctccctctacctatgtttgcaaaggtagcttttaaatttggtacagcttttttcaagctaattttggattttaactctttttaataataattttaggtcatcttcttttacttttcttcataacaatataaaagttgagtaacaaaaaacaatgaagaaagcccgaaaatctaaaatcacaaattgtagcatcacagtggactacgccctccatctaaaaatatataagtatttttttacggaaattaag

SEQ ID NO: 62804 - DNA, 1930 bp, Oryza sativa
gggctgcgccggtctgaccgcgcgatacacgccggtctgaccggcaaccactgcacggtctgaccggaccacatatccagcagtacctatagatcacctgtgaaatccaatcatctccaaaaccacttcgcaaataaattccaaatatcaaaaccaataatctctccaatgccaattgttcatcacagaataataaccaaaaacacctttgattttacaccatctctacaggacaacctttgaagggagatgacgatcgccggtgattagcatatggcggaagctgtgctccagctgtttgatccagtacaagaaagatataagagagcaattcatttcccctttagattagaattgaaggtctaatgtaattcaccacaacaaattcatagatacatacagagcataaaacatcatatataatcttagaaagcaagtaatttttaaatagatagagatcccaccatatgtaaaaacacaaaaaatcaagtgagcattggttttttttttttgcgaagggtattatttgttgttgatttgtctgctacattgatttatcctaatactttcaagtaggctagctgtccaacgagaagttatcaagaacagagtttcaaattttagagtgcccactctcagaaaacaaaaaagagagccaaagcatttcaggtggaactgatatagtgggaatttcggtcgaaaattgtgaaccgtggaagaacactgtcaaggatgatttgtatggtgaatggtcaaacaattatcttaactgaagaccctaacacaccatcatttcggtgacttgtaggtcattcctgttttctgataggaaataatcagatggttagacaagataaatgtagagaagctactcatcacctcatgtgtactccccgtttcacaatgtatgtcatttagcatttcccacattcatattaatgctaatgaatctagacatatatacatatttatgttcattagcatcaatataaatgtggaaaatgctattgtgaaacgaaggaagtatgtaagaagcacattctttgttggaacttcgccggtatgactcgagtaaaagagagtcagataggattgggaggaatctaggaattcaaattctcaataaaccatgattgtggtagttctgctattcatgtttgtgtggtagctaagtctctttttacttacttggtccaatatagcctatagctagaacccccatggcatgcgctcacgttgtgtcgtacgagttgagcatgatcatcaaagtttcacagaagtgatatttgttgccatgatttgttctgtagaagtcaagctgattcagtttgagttactcagtttagaaatcaattactgtgtctgtgctacccatatatgaacatataaagccattgggttggttgcaaatatctgttgttgggctacttttcttggctcttatgcattatactcgaagattttcttttctttggtctttattttgtgccatgaatcagctgcttatattggccaggtaaaccctctatgccattaacatgtcaattgtttttccaagtaattcacaaccgcgtagagaactcgaactcctcctcaatatgagttaggaatatacatcgttatgtggatgcaaatgatggtgtgctacttatcatgagcattccaatttccaagtttccaacatttgggacagctgttccttggctcatcattctctcgcaggccagagcgtgattgttcatcttcctactcatctcaactccatcacaatgctgtagatgaaggtctgctctttgatctacacaataggaattagaatgcaattcatttcctctttagatttgaattgtaggttgttagcatttggggatactctgttatgtactctgtttctgtaccctgtttctcacgtgactagttcagctcatgt

SEQ ID NO: 62805 - DNA, 1682 bp, Oryza sativa
tggtcaccaagttgggcttacagtgtcagcaagtggaaggaactcaggtgacaattgctgatgggggcaaattattatgcaacagaattgttcctgcagttgagtggtggtgccagggtcaaacctttgtaacagacttcaaagtattgacactgagtggctatgatatgattcttggtatggaatggctggaaacctttagtcctatgtgggtggattggaggaggaagaagttaaggttcacatatcacaaccagagactgacttttattggggtcaaagatcaaataaattctggcaagttgattatagcaaaacagatgcaagggctctacaaggatggcgctattgcccagattgtgcagttgtgccaggctgaggttccagcacatgcagggcagacatacccagctgagattgatcaagtgattgctgaattcaaagaaaggtttgatgagccatagggtttaccaccccataacagtttgatcacaatatccctctactacccaatgcaaagccagtgaccaagaaaccatatagatattctccacaacagaagaatgagattgagaaacaagtgactcaaatgctccaacaaggtataatccaatcaaatgtcagtccttttgcatcaccagttttgttagttaaaaagaaagatggcacatggagattttgtattgactatagggggttgaatgagatcactgtgaaaacaaatatccaatgccagtagtggaggaattgttagatgagttggctgatgcccaatggtttacaaaactggatttaaggtcaggttatcagataaggctaagactgcatttagaacccatcaggggcactatgagttcaaggtgatgccatttggccttacaatgctccagccaccttccaaggacttatgaatactatatttttgcagtgataagaaagtttgtgttggtctttgtagatgatatactgatctatagtaagtctcttgaggagcatgttgatcatctgagaacagtcctttccgttgctgcaacaacatggtctctttgtaaaagctagtaagtgctcctttgcccaacaacatttgtactacttaggtcacgtcattggaattcatggggtatcaactgatccaaagaaggttatggctgtacaacattggcccattcccaagaatctgaaacagttgaggggatttcttggcctcgcaggctactatcggaaattcattaaggggtatggtattcttactaaaccgttgacagagctattgaaaaaagacgtcaaacacaaatgggagcaacaggagcagacagcttttgatgcagtaaaaatggcattgactcaatcaccagttctagctttaccagacttttctaagcaatttgtggtggaaaccgatgccagtgacaaaggaattggcgcagtgctgatgcagcaggggcatccaattgctttcattagcaaggcattgggtgttaaatcccaaatgctttccacttatgaaaaggaattcatggcaattttgttggctgttaacaagtggaggtcttacctgcaacatgctgaatttgtcatacaaactgatcacaagagtttgacccatttgaatgagcagcagctgggtacaagtatgcaacagaaggcttttgtgaagctcatgggacttcagtatgtgatta

SEQ ID NO: 62806 - DNA, 5770 bp, Oryza sativa
ctatagggcgaattcgagctcggtacccatttggttgggacatcatcctgaagcacagcaatctgttcttttagctctgcataacagtggagtggggggacattcaggcattactgctacatatcaccgaattaagggtttgtttgcctggcctgggttgaggaaggcggttcagacctatgtgtcccaatgtgaaatttgccagcaagctaaggttgagcattgcaagactcctggattgctccaacccttaccagtacctctgcaagcttggcacacggttacaatggattttgtggaaggattacctaaatctggagggtatgacacaattatgttagtggtggacaagttttccaaatttgctaagttcatacctttaactcatcctttcactgcatacacagtagccttggctttcattcaacatgtttatgatgtgtttggcatgccccaagtgattatctctgacagggataggatattcactagcgctttatggcaagaattgtttcggttggctgatgtgaagttaaacatgagctcttcttatcatccccaaaccaatggtcaaacggagcgactcaaccaatgtttggaagcatttcttcggtgtactgttcatgctataccaagcaaatggtctggatggctatcacaagctcagcattggtacaacactttgtttcacagtgtgttgggcaaatccccttatgaagtactatttgcaaggaagccaactcattttggcttagtggacactggtagtatcactgtgcctgatgttcagatttggttacaagagcgtgcacagatgaatgaggtgttgcatcagcagctcactcgagctcagcaaaggatgaaacaccaggttgacaagaggagatcagaacgtcaatttgcagtgggagactctgtctatctcaagttacagccatttgctcaaatgtctgtggcacggtgttcatgtcagaagttaagtttccgctattttggtccttttactattctggaacaaattgggaaagtggcatatcgtttggttttacctgcttctagtcatattcatcctgtagttcatgtgtcactcttgaaagtggctgtcaaacctgatgttgaggtcagtccagaattacctcttcaagaagctgaagttgcagttggtgtcctacctgagttgattcttcggcgcaatttgatcaaaagaggtaagacagttgttccatatgtgctgatcaagtggactggaatgccaactgaattggctacctgggagaatttgtgccaattgaaatctcggtttcctcatgcaccagcttggggtcaagctggtccttaagggagggggaattgttagcatttgggggtactctgttatgtactctgtttttgtaccctgtttctcacgtgactggttcagctcatgtgagcacgacattatcttgtaatgacctgggtgcatgtgtggatcccgtgtcgagctagcggtggttcaactgtacacaggtcgacacatttaaatactctgggtgccattcaggccagggttatgcaatgagaaatcaaacaaaacaactacctccctgtctctgttcttcttcttcctcctaattacccccaaatcctctcgattctaccccaatctgatcacccctaaagctggcaccacgccagattgaggagtgttcgtgacataggtccatttcatcccagcatattcagatatctgacggagcgtaaaccataatatatacttacgatcacaataagcaagtaatttaaatttatagagatcacaccatatgtaggaatacaaaaatcaaggtagcattggtaaatacttgcaagtagccaagctgtccagcatgaagctatgaagaacaggattttaaatttcagagagccaaagcgttttagggggctaccaaaatgtcgataattctggaccaagattattaagaaccctgcaagagaagtgttaataatgagcaatgaagcatgaaacttggccactctaagttgcatcatatatatacagttaacgtttcaaaatacatgatcagcattcttattctcaagcttgtaaatagaggtgatttaggaccgaccatttttcagattccagattcatttcatttattctgtgttagacgtcaatctacttactgcagattgatcacaatttggagtaaaatgtattgccacattctgcactgaccactgagagctgtaaggattcatataatctttgctccatttttatatctttgttataaggataattgcaaaatttgttcttgcactcgtcatgtgatgctgatgtgcagcagcactggagcttccacatgctaagtgaatgcggtcggctacagataggcatcaattatatatctgaagttctgaactgaaggccctagaatcaccatatatggaatgatcatcaattgaagattgcagtgttgctccagcgattttgctgtaggattgtaaaggactattctcaccccaaaagctagccaatgagatgaggggttccctcacttatatattaggtcattttgctcttcacaaccaatgtgagactattcaacatttgtttcccgaatttggatcattgtagttaggactgagaatcatcaggaaatgagccctcccagagatataccagttgcagttgggttgccgcctatatcctggagatgctataccatgtcatccgtttatgacggatggagataatacaaagatttatgtaccctcggacttcaggtctcaaggtggcattcttcctcatcgtagcgtaagccaacggtcatagtgccttgcttcatctcaccaattagattgaggtcatgattagcgtgccaagaacaccaaattatgggatcttgtattctccaagactgctatattatcagctacttgctgatggagtggcggatgcacatcgtcattcattcatggatgttcatgcatgtcaataccaaaaaatattttccatgttgtgcaacaagctaagattatattgttggttagtaaatggatcactcaatctacacgtcatgggttcaatattgccatttgcctcctttgtctcaattgaatttctctctttctttttttttcctcaatgttgcttccaatgttagcatttgattttctggacaagtcttgagcatccatctaatttttttttctgtacaagtcttgagtatccataattttttttctgtacaagtcttgaatgcccatcttgaaaaccctgcctactgcttgatggaaatggtaagcttgttaattgccaggccatgaaaagtaggggaaaaaaatctattttacatcttcggactctcaccaaattaagtgtagaaaacccagtctggtgtttaccgactttacaaaccgtttaattggacataaaatagaccctttcactaaagttatgctcaagaccttaataaagtgctatggctttcaattaaaaaccgggtctctgacctttcatctaaaaaaaacctcaaatgctaccagtcagattcaaacaaaacaaatactagctagtggaaattaagtgattgcacacaaggtatatattaacatacacaattaagtagggcaaagagtccttgcaagcatattttatttctagctgacttctagctgtctaacatttgtggacatgcatcagcttgtgaaccacaaaattagcaactcaagttcactaaagctacacaatagagcagtgcggattgcatgtgccatttcttagccaataattagtagataatcgcagaaacaggttattgactgcatggtttaacaggctcaaaatattcaaatattcaagagatagagcacaagtcaatgtgattattttcaaaatatttttaaaattttgtagaagtatacatgttttaaaaaaaatacaaaagatataccgtgccacatggccaacaggcgacaccaaccatgtcatccatccattgggtgacacagtgggtgtcaccaagtgcccaagctaaccgaagagacatggcggatggtggaaagcaagcagcgctctcagcaactggctagcaacaccagcattattttcctatgtatgggcgaaaagtgcggtgtcgcggcaacacgggaatattttattttttaaaaaaaaatcacaaaatcatgaaagaaaacgtgtacttttttattaaaaaaccaatcgatagttggaaaatgccattatacggcattgatttgaatcacttatatattctcaggctggcaggattgctacatcctgattgggccacttggcactattgaaatttgagataaatcagggaattagggatagtaaaaaaaaactaatcacaatctgcacatccactattaataacaagatagtaacaacatctagattcctgattctagatgcttccgattcaactaccctcaaaaggaataaattcctcgtagttatagctcatgcttgtctttttaatataactagaaaaatgcccgtgtgttacaacgggtgaagtatattttaatcttattgttgttatattgtttagttaagagttcgcttggatatatatatttttagaaaatcatgagctacagttaggagtccgatcgtatcaagttagcatgcgagttttttttaaacggatttcttatatgatttcttctgtattaccaaaagtgaacgatcttaaaaaccgactcaaatacggatatgtattttcaaaagcaaacgaacttaaaaacccgactcatacacagatgacgtaccaaaatatcggtaaaaatatctttaatttttataataatagagatttaagtgtaggcaatttataggaaagagaaacaattttatctgaggaggattagaaacattaatcggcaagtaccaggaaatcctttccttagtagcaccaaccaatagtagtgtggcatgtatcgatgccaatccgtgcacctatgtgaatacgtgaccaagtcacagccgtccaatcgattaaatgcaacagcaatcaatcggagtattcaactcgataccgacttgcgttgacgacgtacgaaattttgctgggaaaaacatctttcatttttataataggtaaagataggctatgttgctaaaatattttcttgaatatactaaaatgatttgctctttcaaatatgtgaagcacggcgattagtagcatatgaaaaagctagccggctattttatttatatatatatgaccatgaatttctgcacagtttgctttatttatagaaaatagaaaatgataattaatttgagtgaattgcacttagtacctggttttattaccacggtttcacatcggaccaggcattaacaaatgtttttagattggaactagatttttttactcaaagtttgcacatttggacaggtggccccacaagtcattcaccagatcgagtcttcttcctcctcaatctggctgtcccctctcctcacacgaccttgcaggatctgctagtgcagctcgtggacgacgtggggtatgccacgcgcacctcacacaagtctcccgtcgttgctgcagtggtctaccgcgtcgaggtccaactactgatcacaacgctgtttatcacctgtacgtccttccccccccccccccaacaacctcacacccattggccggacgacccatatgcatgttggcccaaaaccggaagatgttagcccaatcaggagaaagccatgctacatctcaaaagctaactcaagtgataaggggct

SEQ ID NO: 62807 - DNA, 15791 bp, Oryza sativa
  unsure (1)..(15791): unsure at all n locations
nnnnnnnnnnnnnnnnnnnnnnnnnnnnnnnnnnnnnnnnnnnnnnnnnnnnnnnnnnnnntagtgccaccgcctcggctagatctaggagcacaatgtcacatagaagaacacacttcccatcgtcttcaacatcggtcatgcaggcaaggtagaggttaagctcgagcgcaggcattaatcatgagcattagatagggacacggtatatatataggagtcgagatggaggtgatggtggctgcctcctccagcgatgcgccccctgcccaagctccggccttgttggtccttcactggagctcaccttcgattggtacctgctgccccttgctcagagctgcattaattcatgcaagccctgcttgagctatagattacgagctccccgccagcaccagagcagggggcggtagaccggtggtgatggggtgatagcttgatctgaagagggaagaggacttgatctggtcagtggcttgtgaccacttgtgcaatgtgcgaagtttggtaccaaaatctagcccaatctgaaaacattcgatggtaccgaaactggggtaataaaatatgatcctaactgcaatacactcttaattaaattaaatgtatcgcgataagaaggataaatatagaatgaaaatttgtaatcctaagactcaatagattgttaatggtttatatatacatagattttttaaatttgtgaaagccatattccataaaatacttttcttttttttttaaaaaaaaaggaaagcttggtgaatgtatttcttgacacaagccaacaagaaataagtttttaatgaaattttaagggaattacaatattttttataaagtatttgtagagtaatttgtcggtgagggccaaaattaccgaaattttgaaccaaaatttcaaacactgattgtcactaccatgcacttactatatatgtaataccccgtatattaaaagatacttagatttttttagtttggattgacttgtttaaaataaagatgttaacagaaataaataaaagaaaatatctttagaagtgggccaacatgagaagactcatagacccagcccattagttctcccctaaaacgagagaggggaaccgaatcccacctcccctcatagtgccgccacccatctccctggccggcgcctccttcctcccctcctcctgtgttcgcatctctcccatctacagcaaattgctctccctagatctccaccttcatagcttggatcaagaagcaaagtagaaaaacggaacgaggaggaggagaggagtaaaagggggggttagatcggagtctcccctattgtcttctcacaagttctctaacgaaaccctaggtgaggcttatccccttgttgtatcagttgttctagcatggctttagtgctttaattcgtggttagagaaggctagagaaggagtttgggtagttgcggtttggtttgttgcagttctacatgtgggcagatttgcagtgcttcagtgtttcaatgtttcggggctctaattgttattttctgtgaaagtatacaactaagaagttgtagataatgtttggatgtatcttctgaccaaagggcgtgattttatctcaagtggtttaggagatataatttttttagtacgactgttgtttttgtgtcataatctggatagtagtagattgaactgtttttggacgggttaaacagtggaatcagctaggccacctatagacaaagttgtagaggtttttcttagctttccatattggtaaagtacaccctgattgggcgagtagaactccagttatggttgttttagtgtggacagtctgaaattctggacagattctgaagcctgcattcaagtgcaaattagaccatttaaatggcagaacaaaaatatgatttccacataagagttgtaggccttgttctgtagatttccaaaatgtatttatttgcggttatagccttttcatatttcaagatataaaggtttgaagcagcagtcttgtttatagtccaagcagcgttccttgttattgcgttgtgatgggatggggaagtagattcacctttttcattgttttatatgcatgtttgaatatgttttctgaggtttttttttattaggtggtggtccttcatatcgtgcatgataccaaccctttattagaggcaagtgcatgacaaactaattgtgtgattcatggattgtttgctctatctatttatttccgatatatttctatgtgacatgtgaccgcttatattcatattgttgttcgcgccatttaggttttcatgtctatcctatgtttacgacattattcttgtttcaatattccggattctggttctgcttaaataattcaaattctctgcttgccatggatgtgcagtatggtttcaatttggttctttgattccagtttcaattattcaagtaccatgcgtagtcatgggagtccaatttggttctttattcaagttcctatgggtaagcgttgatcacacttactcggctttaccggcaaatgctaggatgtattcactattgtctgggatggaaactactatttcaattcatgcctgtccgggatgggaactactatcttctttgacttggtgtttgaaaatgcgtttcctatcaacgaaagaaaggtttctgttcatgctttattgccaatgttgtgtatatgtgttttctagttccatattgtacttgctgagtatttttatactctctcttgtgtttcatttagttttaggtacatattgagaccgacatgcataggcgggaagtagcacccttatatacacatctacttgcacactattaaactatattgcttaggtccataatgacacttaaattatatcttggtttggtcttctaataatcttttagatttctaatagtttcttccccatggattataaggatggatcgtattatgagaatgatattgttattagtttagcttacaattgcctatcgtgaatgtccgtatttacaggagagactctgccgaaatttctaataattttggaagttagtggtttgagtgtttttttagtgtggcactctaggtacgtggctacatggggcgttacaatatatactaagagttgtaggttgtaaggattgatatatatagtattacatattatttacatctatattatgtcagctagttgcaaatttgtttttgaactcattatgtgatgctgttgtatgcaattctaatcaaagcttgcacatgcatatgctcactgaatgtcttcgactatagataggcatcaactatctgaactgaaggccctatcgatctgatcatctgaacaggatctaccgcaaatatcagttacttgtaggttcacctcacatacgaaatatatgatcaaaatataagggtagataatttacgaactttcgattcaagatgcttattcgtgttggtgcttgcccagtattaggactaaaagaaaatgagtcaaataggcttgggaggaatctgaggaactcaaagtcactagtggccactgtttggggtaattaaggactgtttggttcatgtcctaaattggccttaccagtatttaggccacataaatagtacaactggtaattttggtttgaatccaaactttggccagcccagcataatacaaggatgtggacatgtggtactggcaataaatggacccgacaaaattgggatggttaattttggcccttacctaaacacaatttcccaaatatcgacatgccaaaacatacctttgaccaaaattaaaattggtaaggctttgttttggcttcaaaccaaatcagctctaagtgatgagccactcggatggtctgtctagttttgcagtggtaccaaatctattgaaaatgagtttttatatattccggaatagtcattcgaaacaaaaataactctatcgtaatctaattgagccccatgaatgcaatcactcctcttacatgttcactctctgaacttctgaagcataaggtagtacattggtatcaagaatgcgctagtacttctcaaagagagaggtcatgaaatcaatataaaattggtgacacctacagcagaaatgtccactagtttgttctaataacaaccaaattaccaaattgtctagttgtgtagtccagtttgaagctttgaactctgtcataatatgtcattcgttgctgatcagtgaagaattaaactcagccggtttatgttgctttggattggtatgcactgggaaaatataatgatcaatatcaagcatggaagtgatgatgtcgtagggacttatatatagagactagcaaaatgcccgtgcttcgctacgacgtattaaaactacagtgctttggtacttttgtgtttttgttcttttaaaatatatgacgttgtccaatcggatagctgcataaaacaaatattttgccaaaaaaatacctaaactggatatattaatttgtctatataaataatacaacttaatataaagtatgtgcagcccaataccaaggtggcctaggaacagcgcccgacccgatgcgggagaagccggggccgtccgatctgatggacggtcctgattgatcccgacctagataaatattctgcagctcaaaccctaaccctaaaatcatttcccccgatccccttgctctttctcttgatctcaaaaagcgacggtggcgaccttccccccccccttccttcccccgtgagcattgccggcggcgccctccctcaccgcgagcgactacagctgcgccatcccccatcacgagcggcggcgccctccgcggcttcccatggccggatccgacagcgacaacgacttcccgtgggcgtcgacgggaagtatatattctctgataattcaatcagcaaagtaaacgatgataaagcttctaatccatctaatctccacattttttataataggcagcatttgccattaattagtgaagctaatttggaataactattacttggacaaattttcacatgctaccactttgagagatcattttggtggagagatattatgcagttcacagatatcttttaatttctggaatggcaaagttagatcagtgattttttcaagagttttttcttgcgcactcaacttaaaagatcagttacagtgttattgggcgggtactaaatcattttgccgcatcgactcatgtcaagactcaacaagacacagatcggacactgtgtcgagtcaatactgaacttggtgagagaagagagggatgaggaatagaaaatgcttgtagtttcacccctcgaccctcaaaatgaaagaaagtggcaatctgcagcttttgctttctttatgataccttctccactctcctgtctcctctagatttctttattgtcctttttatttattcttctctattcgagtggataaaggacacatgcaatagttatcatgtacaactgcaaacaagaagataagatcttttgtacaaaaaaatgtgtgacacattgttttagtgttttacttactaagagtatgttttatttgatgatatatatagtatttttactaaacttatatatatggggcgagtccctgaatcctatattttatagcataccaagttagacactcaagtcggactccaacatatcctggtaacacttcagttaatgtgattgaggttgtgtttagattcagaagtgtaaagttttggcgtgtcacgtttgatatacggacacacatttaaagtattaaacatagactaagaacaaaactaattatagaatccgcctgtaaactgcgagataaatttattaagcttaattaatccgtcattagtaaatgtttactgtagtaccacattgtcagatcatggagcaattaggcttaaaagatttgtctcgtaatttacgcgtaatctgtgtaattagtttttttatatttaatacttcatgcttgggtctaaacattcgatgtaatatatggtgaaaaattttgcaaggggatgcgtgagatcaatcaatacaagcatacggtactcccattgtgtcagagttttcaaattcaaatcatgttgtgtgtttctatctgtttataaatctgccccttctgaagccagatacccaaatggaagtcacagatacacagagaagggccattacatgtaataccggccggcaattaatgatcctcatgttcctgcaacagggaactctcttcacttaagaaaagtatctgatatttccagcaaaaggaagatagaagtgttgctctagccattttgctacccaaattgggtcatatcgttaggactgaaaatcatcaggaaatgcatccctccctctcggattgggatcaggtgcagtcgctatagcgaccgtaactttggcagtccctcgatccatgtcgtccgaaatccatcagaggattagaaatgccgtagacctctcaaccgtgtgatccatcagctacatggcctggtcgccggaggttcttgcattaaccggtgaggtaatgacggtctcggtgtcccggcaagacggtggtggatgccatgatgcacttcgatgatcctgtgaacaacgtctgcaatcaggggcggatctagaatgggggcggcggggtctcgagccctcactactggcgtgaagactatgagagccccacgaagaccccactaatttttttttatcatatatagatgggagaggggactgtacctctatctagtttgctcagattccactgctattttttctggatccgccactgtctgcaatatctgcatctgtgcttcactgaggtcagccaagcctgcacatttggagagttggacttggacattacaacagcagcgtttgtttcccatccacctatttgcgcattgaagtagacagcagtaacgattctgccgacttgggctttccaagtgctcttggataatgtggcaaccgagcgctcggaccacgaaggcaggatgagaatgccttgaccaatgaggagcacaagtaaacctcaattaaccttaatcttgatggaattgaacaatatgacgggatctgtccgttcatccgaattgaatagttgggttttcttgtccaaattgttactgctggaagtgatgaaagtacacagaagaagaaagagagatggaagaagcagatgaacatacgagataacgagaagcagcaaatgaacagagaaaagacttcacttaagtcttagccgtttgattcattttgagcgttatggattgatcaactgtcaaacttgcagtctctatcacaactgcacatgatcccaattgtgtcagggtcttcaaattcacatcgtgtcgtgtttctgtctgtttataaatctgccctttctggagaagtgggtgtcacagatacacagagaagggccattatatataccggccggcaatgatcctcatgttcctgcaacagggaactctcttcacttaagaaaaagtatctgatatttccagcaaaaggaagatagaagtgttgccgctgccattttgctacccaaattaattgggtcataccagttaggactgagaatcatcaggaaatgcatccctcttagatatatcatctgcatgcagatgcagtaggattttcgcgtataacctaagaaaaatatgtactttgttgtatgcttaggatggatcaaggataatagcaagaatgttttgttggactcgatctgacatagatgatccaagcaattgcattctaccctgctggaacttctagttttaccttctgatgatcatagtttgtttatcaactgccacagtgccttggctaatcccaattggcacaaggccatgactagtagcatggcaacttatatcacctggtatcttgtattcttttagacagcaatcacacctaatgattcctttggaaggtaattagcttgtagttgggccattaaaattaaggagaagtccatttcaagttgtcattaacttctaaaccgaaaaatattcatcattcaacattgcaagcagttcaccttttactcctcaaccaaaaccagaccagttataaccttttgtggtgcttacttgacatcccgatcagaaaaaaaaaacaaaaaaaaaaagaagtcccctatctctcccaatccttgtcgtgactcgcacccaacgcataggcactagacgctctgctgaggggtctgggcagtgtcactgtgatgctttgcagtggcagggtgaaaaaaaatacaacaatcgctctctactgttcgtattatacatgtattattagggaaaattaaagatgtactgtattatactacctgtattattaggggaaattaatgatgtactaataaccattgctctccactctctactgttagtattatactacccctattattaggggtaaattagtaatttactaatacggagttacttgttatttatgttttttcccggatagatcaatatatgatcatccattgcgctggcgtcgctcatatttcattgaaaaagctagaaaaggagaaaaaaaaagtttagtcattgctaaatgatgattataaccctccacacctctttttttacaataatatctctccacgtttctactaccactaattggtggtaatataaataaatctaaacccttcgatcaaatgagatcaaaggttcagattgatttctactaccgtagtgaggttataaacggcgatgcatggagtatcatgcattcatgcgcgtgtaaatcagtctgattttttaattgaggggtattaagtgaatggtttggataattgagggatgaataatgtcgagttttataagattatagggcacatttcggagtttcgataaagtttaggaacgtaaaatagacctctttctgtgtccttaaaattattcacaagtgctagcagccaatttcaaactaatagctgattctaagatactacacacaaatactcaagtactttttttttgaaaggtaccagcacaagaatgtgcttattcattgaatatagcaggagaaaaatacaacccctaggggtaaagaaaaagcagaaaacaagaaaagctgtacactatacaaactgcgggatgatctctgcaagacgcttggcgcatgccaaggcccacatgccagcctcttcttttatccttgaaaggagatacgaggttgcggcttccttatgatcaaatatcctcatatttcgcttcttccagacttcccatacgatgagaatcgagcatatctttatttttaggtgccttttattcttctaacttttgtggacatatgttagcatgtgaaccacaaaattagcaactcaagttcactgaacctacactaaaggggttgcaggtgccgaatttcttagccagtcaacaaataatcacattcatgaagtgttcaagagaggggaacacaagtcagtatttggaaaatgccaatatatataaggcattgatttgaattatgcaaattacttactcgcaaaagaaatcctgcaaattactcgttacttcccaaatcattaagccccgattgatcagggttcttattatcgagggcaacccgcttcagattgcagaattgatttgtgtattctgcctatataatgtgttttcactgccacgtactacactgagagagttgtaccttgtgaggattgatataatcttgtatatatttttttatatctatattatggttagttacaagtttgttcttgaattcgttgtacgatgctgatacccattgaataccctcgatctaaggcatcaaactatcaaaagtgaggattgagatcaaatgcagtcactgctaggactacaagttagtaactgcacagtatcatttttcagatcaagggtgcagatcaactactacagtattatcgctacagtagccgcaagatattttttccctgtgtgaacagtgcttcgaggatctcagcccttagatacaacttggatggtactgcacctgaaccaaatcccaaaagtgaagactataccctagctagcatcaacataaatatcggttacttaattgtatgttcacctcacatatgaaatattcagatataattgaaatgtatacgagctagcttctcttttcaattcagtaatgcctattcttgttgaattggcacttgtccactatgactcgaagataaagaatcaaatcaaataggcttgggaggagtctaggaagtcaatgtctccggtggccatgtttagggtaactgtccagagagcggtggtgtatggtctgtctagttttgcagtgggtgcttacaagcattgaaggggttcctacgtacttgcgacgatagctacccatactctctatttacagttgatacatctggagcttgtggtaccaaatctgttgaaaatgagcttagtatatgcatggtctgtcaaccaaaaggcatctaccataatatatttgaagattagaacacatctagcttacattttcactctcagaagcatatggtaatttctgacagagaggccagagtacatttgtagcaactattaattcagtgtagcatttagtagatatgtccactagtttgttctaacatccaaataggctagctgagcctatagtttgaagctttgaaattgtatcttagtgcatcattcattgttgatcaggtgaagaattaaactcactcagtctatgttgcttgcgctatccaaaatttctgactgaggatttccatgtatctgtataatggaatgaagcacacctagttctgaagtcttgaattatcaagtcatgacatatgtttatttgaaattttcttccttcatgggatcttcatgtgtccatggattgaatttctatgttactggactggccttttgtcttggaaggggttgaattttccatattagggagttgagtttttttttatggttcttgtttgagaaagtgatgtgaattattgcaccttttactgtaaatttatggtagtgtcatttcttaactcggccatggacataaatatatcaagggcatttacaaactagtacaagttccaactactacaagagtccaatactgaatgccagtacactatcatgacataaaaaaaacacatgataaaaccagaggatgtggcagcatggccactcctgcttgtttctaaacaatttggtgcaactgtgtcccagtgccagtgaagcaaactgcaagtatgcaaatatacaagagaagcattcagattatcggctatatataaatcatttggacacttgaaaactgcaacaaggaaaggttgtgtatacctccaggtatcgaggacgccgcgagaacatgttcttccattatctacaaaatctctggacaatctgctggtgagaatgggaggcagctgggaagaattgctctacttgggtgtttcttcatgcacaaggtatgcggactctgggtgaaacatgtagcaatgtactgtcacaagctgaacataagaaacttctagtagtctctgtttgacaaattaaacattgaaaaccttctaagactgccaggaagaagttaccctataccgaaccgtgctgatacttcttgtcattgaggatgaaatagtttttttttttttaccgagcggcaaatattcttagcacattttagttctttgagagagttcttcaatattcttcttccaaactcggcttagttatctcattttatcactctaccattgtagcacaggccaagtgaggtatgtaatgtctatgtgccgagctgccgttcatctcagagagagagatctatgcaactcctatatcacatcaaaagctccgtaaaaaggctactcgtagtcggagtcgaatctatgtattctctagtaactcaatcagcaaagtaaatgatgatacagctactgttgagacttggctgtgtagtacacttatggtgtagaggccatattcttaatacattatttaaaagaaaaggctactgttgaaactctgaaaacttcgaaatttagctgaacaattgactgaaatatgaagcacttccccccttttataattggcaatggactagagagaatatgccagagctgattgtgtggatctgttgaggaacatatgccagagctgattttttgaaggctatgttcctagtcataacaatcattttatacttccatttgtatagtgtacaaaaaatcagtgctcagatttctctcaaggatccagttcctttgccaattctctggctgcattagtgaattttgtgctccaacgatatgttttaaaaagtaggcaaaaacagagttttgcacacggggatttgtagtttatgcttatgcacaaaccaaaaaaacagagttttgcacacggggatttgtacattatactccctccgtacgggagtagattctaatccctcgaagggatatcctctcgtatacctttttcttctaaattcgatgtaaatagttatgaaaaattctgaaaaaaattaacaatgtagagtataatgatacctactagtccaccaaaattgaagtccaaagattttgtggatatgtatatatgtgttgtatgaatgttgtcaaattttttcagaattttttataaccgtttagatggtttttaagcaaatgagagaacatcccctagagggattataatagtttcctcctccgtactcgtaaagaaagtcgtttaggacaatgtttaagtcaaacattgggaatataaatcatgaataactttgaaaatgtaaaaattatataaatagatttatcttgaaaaatacttttataaaagtgtgtgtgtgtctataaaaatagaaacaagaagtcaaagttatattttaaagagcatgtcgctgtcttaaacacctttctttacgagcgcagcaagagtactttacaattttattagagtatgacattgcgtattagagtatgaaaatgcgttcattttttctcctgattcaatcttcaacacaaacccagctccacggttcatcgcatcagcgttcatttttttttttcgatcttgtttgtgacggggcagaagaccatgatatggtctaccctttcttttgggggtttgcaatatagagcggaacacttttcaaaggtctccacaatctaaacaagtttgaaatcatgcacatagtacaggtttgaatcatgtcaaaagtaccaacttcagatagaacaatgataaaaatggctccaaaaatgcttcaaactaagttctccatttgtatggtactcaggacaactgatggtgcaaaattttcttccaaaaaagggtctggataaataacattagatttttgatctagaagataatatcagctctggaaatgggagcatctaccgcttcccaccaccaccaccgagctttgggcctttcccaggcttgggagcattgcctttaccagaagccttctgcgattttgccacctctgccttcttcgctttcttctcgtcctttgtcttcttgatgcgctccttgatctcactgttatggaaataacattgataagtgtataatcctagaagggaaaaaggtagcatgcatagacacaataatgtgccgatcatcactagatttagagttcataaactaagacaagctaaaatgattttaataaatctttgcacagcaataatttcttactaccaggaaacgcaagctacacatttcaatacttgaaaacaaagagagccaatagcctgacactgctagcatggtaagatgagaatgtggttgaaatgcattggcttcttcaaatccatacatgaatggtgttaaaagaatccataaaccagagatggcatagaatagcataccgaagagcggattcccttgctgcatcacgaacctctggcttctcagctctcttcttctggatgacttcaagggtagcaccaactatagaccgggagtacggtttcttggtggtgcggcgcctcttcttgactgcctcggcgtgaatatcctgtaaaacattgaattacaaaagtaaacatttgaaggacaatgcattacatcacaaatttaaataaacaatagattaactaagataggtcactggtaccacaacattcagcatgacataaagttaacagttcacaacagccaaaaagtagttacataacatcctgaaccaaacagcactgttccaacaagtttgtctcagcacattcacaggcaacagaccatcggtacaagaaaccttccaagtgaaatatggatgacaaggaattgtcactcataccttcttgtgctgctttctgtacatggctgtccatgtaagcttggctggcttcagacggttgtggaagtagcgcttgcacttcgagtttgaaaacaggaacacctgatatagtttaccaaagaaattgatcagaaataggttagcttttgtcctacacatgtgtatccatcttgccaaagtactcacctgggagtctgcacggatgaatctgatacccttccctgggtaaatcttggcgccgctgaaacggcacagctctgtcctgtacatcagaattcccaaattatgtaagaaactttctatttgcaacattccagcctcgaaaatgcagcacagaatataatgaaattgaattgtgcagggtgcaaaatacatacttgagaaccatcttcgctgcctcaccaaaccttcaatgcctccttacctgcaaattacaacgtcaggaatcatcgctagagcagaatataaatgcattgcaatgtacagaccacaaagatctctcctcttcagcccaacactaccagaccccaatatatagcaatctaaattaacaaaattctagcatttctctatccatcaaacgagtacaagaaatgacgcataaagcaaatgcgattccactaagttgccattccaaatcagtgcccaaaaactaatcaaaggaaatctaaaacacatttgcagcattcggatgcacggacaacgccaccaccacaactccaatccagctgaaacccccattccccatcacagcatcacctcaaccaccaaaacaacaagccccacatctaatcaaacgcctcgatccaatcatacgcgtcgagaacgcgaacaaacctagccgccgcgccgccatcacacaacagcccgcaaaacctaccaagaaacaagcgcgggactcgaaacagcgaatacgctacatacacgagacggcgcagcaacgccatggcagcgagcagcgaagcaaatccatggggggaagaggagctcgactcacctgtgggagcagcaaaaccctagcgcctccgcgtccgcctccgctgcggcgcgcgtgggaggtggtgctcccttttatagtagggcaagcgcgcggcgggatggatcggagccgtccgatgcggtggggggacggaatggacggggtggatgagttggtgtgatgataatgggccgggctggtttgtcgggccttggtcaaagtgggccgtcggcttttcttctgtactcggaataagttcacttcataaccctcaaaagtgactcgaatctaattcatgaccctaaaccgcaaaaccggatatcttcacccccaaactattgaaaccggtgcaatttaactcccttggtggttttggatggcagttttgctgacgtggcagtattgactcggtcttctttccgcgtggcgttgacgtggcgcttaggtggcattaaaaaaaatatgcatgggacccattagacattcacacacaaaataaaaaattgtgggg

SEQ ID NO: 62808 - DNA, 1712 bp, Oryza sativa
  unsure (1)..(1712): unsure at all n locations
nnnnnnnnnnnnnnnnnnnnnnnnnnnnnnnnnnnnnnnnnnnnnnnnnnnnnnnnnntgtgtgtgaatgacaaatgggtcccacatatatgtttttaattgaaatgccacctcagcgccacgtcagcacacagactaggtcaacaccgcccacgtcagcgccacgtcagcgaaaccgccatccaaaaccaccaagggagtcaaattgcaccggtttcaatagtttgggggtgaagatatccggttttgcggtttagggtcatggattagattcgggtctcttttgagggtcatgaagtgaacttattcctctgtactctgtgtctttgtgcgtttctttttctgttcttttaggctattttctgtgctttatgcgtttgtttgtgtgtgtgtgtgttaaaagaaaattttgtgtgctttgtgttgaaaatttaaaacagtttcagaagaaaagagaagaaatcgctaggacgttgacatttgtcttaagatgaccgaaaaattgttgttgcactccatcccaaataagtgtagttttatagtggccctctgtatatctttatattttacttcaacttttccatccagattgtagctattgaaccaatagtaatctctacttacctccccccccccccaaaacacaatcccaccctcttattttcttcatattagtgaaggacgtaatcctatatatttatatagtccatccacactcagtgtagttaatgctatttctctcttctttcatgaaaccatatcatttcaattattttttattctttggatgatagatctatagtacaaatagtcatttctttcctctctcgtaaaaccacacaatctcaattattttttattcaaaattcataagtatcaattacataaaatatgttcaccttgcattatatttgcaatcatgtgttgattatataaaacatatgaagtcattttattttggtttacaaaatataatatagcttatttgtacatacgatacaacttaatttcccgcaacaacgcggcagggtattcatctagttatcttcgttattacctccgtctcatataaattgtaattctaggttatttaatatatattaaggtttgagaataaagactataattttcttattaaatggtgcataggtaagagcgaaagggtagttgaaggtaaaatatgaagaaatttgaatgaggagtgattaataggaccattagtactttattgcgacaattattttgggacaaatttaaaccctataaatacaattattatgggacagaagtagtatcttttaagctcttgcttaatactatgtctttaactctagctatttgaaatgtggttgcgttgatttagggtgtgtttagttcgcgaaaagaaaatttttgggtgtcacatcgaacatctgaccggatgtcggaaggagttttcagacacgaatgaaaaaactaatttcataaatcgcctggaaaccgcaagacgaatttattaagcctaattaatccatcattagcacatgtgggttattgtagcacttatggctaattatggactaattatgctcaaaagattcgtctcgcgatttccatgcaaactgtgcaattatttttttatatctatatttaatgctccatacatgtgtccaaagattcgatgttatgtttttnnnnnnnnnnnnnnnnnnnnnnnnnnnnnnnnnnnnnnn

SEQ ID NO: 62809 - DNA, 12634 bp, Oryza sativa
aattgtaattctaggttatttaatatatattaaggtttgagaataaagactataattttcttattaaatggtgcataggtaagagcgaaagggtagttgaaggtaaaatatgaagaaatttgaatgaggagtgattaataggaccattagtactttattgcgacaattattttgggacaaatttaaaccctataaatacaattattatgggacagaagtagtatcttttaagctcttgcttaatactatgtctttaactctagctatttgaaatgtggttgcgttgatttagggtgtgtttagttcgcgaaaagaaaatttttgggtgtcacatcgaacatctgaccggatgtcggaaggagttttcagacacgaatgaaaaaactaatttcataaatcgcctggaaaccgcaagacgaatttattaagcctaattaatccatcattagcacatgtgggttattgtagcacttatggctaattatggactaattatgctcaaaagattcgtctcgcgatttccatgcaaactgtgcaattatttttttatatctatatttaatgctccatacatgtgtccaaagattcgatgttatgtttttgggtaaagttttttttggaagctttagtgtactgaccggccgttgtgtgtgttcttgacaaggaaaagtatcaattagcacttgtgttagtgacagagtgacaatgacaagttaacgtcagcatccatggcattgatatagaacagagatttttatttttgttaattttactcttttagtttctgacatgaagcaaattgtccactcgtgccacgtttccacgccatcgttctagtgaaattacatgagcaatgccgttcacgtatagttgtcatcacaaattcacgattaattaggaacactgatgctgatgtgtataacaaaattaaccgcctaaccagccatctgcttaaccaaagaatgattaattaaccaagtagtcgctcccttctagaatgatgacgttttagaatgcaatgtattttgatcccaaaatcttagattaataaataaacaaataaatgtcaaaaaaataaataaatatttactatgtgaaagtgatactaagtagatttttggtaccaaaataatttcattgtcattatttttaatatgttattagaaataacaatgattaaatatgtatatcagagactacttacatgtcctaaacatcataagaacgaaaaatgttaattaattggtagaatcggtgggcgcaaatgcatgctaattgattataccatatatctcccctgcactttactcatccataaaattaatatgacatgtgtgcatgagtgcatcgttgttttttttctttcttctatttttctaaaagcacagtagaaatgcaaactatcacagcgtgcgtatgcttatacttatgaatacacgtatgcacctctaattcaatgagtatcttataaaaactgaaccgtaccgttatatgttaagattcacgagatcaccatagacgcatcgttgtcgagttatgtcatctactattgaaagaataattttggtgactcgtattaaacaacaagtaactttgggatgaacgcattgcgtgcatttatatacagtcattgagtctaccagtttttccttaaaaaaaagggaaatttacgcacatatataattcgatcacgattaaccgtgataaagctagcccctcaagctttactttagatgataaagctagcccctcatgtttagtttaattacctgatgtcggttaacctaaccgtcatcgacatgtcaaccatagaaaaaaaagggagaatttgaatcacatccagaggacagacctgttgacaaaatgaccaatactccctcgattccaaaatataaggcacaaccatccttaacccaaagaccaaaaaataattattatcatcttatagtttagatcatcctaataaatataatgcatgcatccaatagaattagatagcatgagagtggaggatttaaaaaagtaataatttaggccctgtttgattcagcttaggattattataatttagcttattaggagtaagctgaaacaaacaagtagattattatagcatattattataatctaataagctgctctagaggagcttttttcagattattgagtggctaaagacccactacccctacatacttgagaaaaattaaccacctatgccatcaaccgaacagatagctgagggcattatagactttatcctttcaaacccaataatccatgcctccaataatccagacaaacaaacaactcacagcttattataatctagtttatagtaatctggcttaataatctagattataataatcataagctgaaacaaataggaccttaatagataagatgtcatagttaattaattgcatgcttgcatgtatgccttaatattacggaacatctaagaaaaatggtcgtttcttgtattatggtattatggaatggagggagtaatcgcacgtaatgcctgccgactcaccgtaatatgaggctgagaagttgattgcagaccatctagtgcaatcaatggcgctcgctttcggtgattgttccaaattaattacggagtaattagcacaacacggctcgccgcccttgccatcccatttaggcacatggacagagttgaaatgtgttgagagctaggctagctagctgattttttcggttatcaaattgagatattcaatctagtctctgaattgactgatatcaaagtttaaaatctttaactatagataaattttaaaatgtttgtattagaaatattggtctcaaaaggtacttcaaaaatcacatttttattgataacaataatcctatatatatattataataaaaaatagtgatcagagttattttttaggccgtgtctttatttaaaacgataagtattattaacccggaaggagtgtatctgatggtattccaaactgattaagactatcgaattagttaccatggtattggttagaaaaaggaacatgcatcgaaaaactaaaaaccaagataccgctatcactttttggggaaaatgtgtaggagcgtccattttcagattcaactatatttttcaagttttcattacatacatgattttcactacgtattttcttcacttgaggttcatacaacagtgatagtggcaacaataatgctggtcgagaaaaactggtaagcatattccctgagctgagtttgaatcggcttttccagcgatcgttttctgtaacatactttttaaaacactttttatatagatttttctcaaaaaagataaattattttttttaatttataatagttcattttcaattaatcgtatactaattgctcatctgttttgcatgcctggaaaagtgtaaccatactgcccaatcgaatgaagtctttagctttgttgtttattcttttatgctcgacagattaaaaaagctacgcacctacatatcatgtattcatgtgtatacagcagattacgaagacggcatgagttcagttctcttaatttgccggattagctggtcgataaccatgtcattatcttggtccccaaggaactatttgtttactaatgagattgatagttgagccatctcaatttaaaaatatagtacttattagacctttggtaaggagtatattaaggggatgagatatttttcaatataaattatgaacaagaaaaaggtatatatagcaaaaaagtaataaaataataaccagatcatacatctagccattaatatctgctagtaccgtagaagaactcatatgaggagtaatcaatagcatgtaagagctctcatattaacttggaaatttagtcgttgattagatgatcgtgttatcatgattatatgtccgtgagtatatttcacaaaactacatatattttgactaaactatcaaaaaactatatatttaaaaatatatatgtatcataaaactacagatatttagcaccaaatttatcataaaactacaggtttaaaacattgtatcacaaaattacagatcgatttagtgatgaagtcatcaaacaactatagattttagtgtttatacgatggcactatcgaggttacaaaagttgtagttttgtgataaaactgatcgatattaaatatgtagttttctaatatgaaaccttaaatctatagttttgtgatacatatccttaaatctacaggtttgtgatagattgatcaaagtccctatagtttagtgaaatttgcatgtattttccatgtgccacgtttaaaagcatatcttctactccctccgtcccataatataagggattttgagtttttacttgcaacgtttgaccactcgtcttatttaattttttttgaaattattgtttattttatttgtgacttactttattatctatagtactttaagcacaacttttcgttttttatatttgcaaaaaaaatttgaataagacgaactcaaaatcccttatattgtgggacggagggagtatatgttgtgagaactgagactccaaaataaatacattgactaaaactccaaatcaagtacaactcaatatttgttaattacaaatttcacaattatttagtcatgccaaatctctttaaccatttttaaacataaaaaataaaaagcattgcaacgcagaagttagcgagtagtatttataaacacgaataagagtatgaattgctacaatacatatagttacttcgcaattcttgttttagccgttgtactatggtatactaattgtaaatgtaggagctctcatattaactagaatgatttagctgttgcttagataattgtattacatgactgcagatctgtatttttcatgttccacattaaaaactcatctattgtgcatgttgtggtgattgagactccaaaccaggtataacttaatgtttgttgattacaaatttcacaattattaaatcatggaaaatctctgttaatatctttgacatcgctcagttatcatatttaactcccaagtcttaaacaaaccaacatgttattacaagaatgtctaatgtaacatcacattccaaagttaactaatgttaccacaatatggaaagacaattaaggttcaatgaggaagattagctaataactatactgcatcttccatcatccttctaaattctaagtagctgatcctcccatctctgtcctcatcgaaggtgtggatcatcctcatacagtcctcatacctttgcccttctttgaaccctagcctcctcatcacgctccacagttccgaggcacatatgaagccatcctcattgcgatcgaacacataaaaggcatccttaagctcaccctcgctcgccatcttcctatccaacagctcatccacggtagcatccatagggatgtcacacccttggcactccatggcggcctccccactcctttgccacctgaggcctaacctcgttgtgacagtcattgcatcaaagcatgacacccctcctccaagcaactgcgaagaaggaggagggtcgttgtccacgaccatagagttgataacactatcgtcatgcgctaagaaccttgcaattgcgctaaataaccttccaatcttattacttaccgaaatcacatctatgatcaatggtcccagtaccaacatcatgagggatgacaccagtggaattaggatgttgtgatccatcatcatcacccactatatatctttgtgtgaaatgcagcaaattgaacagcaatgaaatccagtgtaccttattgaagtgcttactcaaaggaacatctcaacttacatgcaaatagcctgtatatatagctgacatagatccttcaagatatccataaggtgagtctttgcatcatttcggagaaattcagaggaagatggatatgctattattgcctatctttattttttttctatctgtgtagatattggagatgacttcagacttaataaaaggttatggctgcaagctgtcgatgaaacttcctggaaattactcaaaacagctaggacacaaatggttttcgtaactatcaccaagaaggacaaggagatatatgaatattaatgccaaacaataaatggccacatcttttctagccttctagctgatatcaacctcccctctcccccctaggtaccattcgacagaaacccttgcgaaatttcggaagtaatcgcttattgatactcctttctgttataaaataggcttaaaatcaccatcaaaaaccaaacgcgaaaaaaattataggaaattcaaactaatgataacaccgagacacgatattttataacgaagttcatccgggacactgataacaggcgttcctccccgatctaggtttcgatcaaagtgacaacgaccctctacatgttgctgctggcagccgctccctctcgctatgctaagtcgacatgcggttacaacaggtgtgcctctctatttaaaagagatccgaggacataatctgactcttactctatttatagtatacaactccaagtcctaaactgtaaccgactacgtgcacatatttgtcacaaattaaactctaacactttctatcacgacaacatgttgtcttagacatgtatcaagttaaagttcaaaaacatcaaaatgaatattttttttgaaatatttaaattggataatttcttatgggtagatttaactcaaaagcacttttataatattacattaaatcatgtttttcaaatgttttagaaaataaattagcaatcaaagttgcatgttggagacttcttcaatatatagaacgacatgtggccccatcgtttcgctttcgtggaagaaaccaaacggcatgcttgcaaacaaaaagtaatttgtgaataaaacttttatatacgtgttcttagcattctaaaagtaaatgccgaaaaataaacttcgatgaaaaaaccacaagatcagttccaaatttaaggttgaaaattcaaattttggctgataagcttaagagaaaagatgaggccccttcttatgaccagcgcaaagtaacacacccgccaatggtgaacgtgactctgtgagcgatgacaactagattctatacatatatactactatattgaaacatatccgtggaaataacccttgtcttttcaatagaagtaacaatatcatgtttgtctatccaaaactaaagttgtagcacacatattatcttatcattgttgatcctttggccattaatagaagttgtatatccaacaattttcattttgataatataggtcatgccgtgcaaacagactgttttcggttcattgtcaccaaatggaacattaggaagaccactgaacttattttcagaatgaagacaagttcaacgaatagtgtttctttgaatttagaatatgtgtcatctagtaatactagtacactttattctgaatttctgatgccttgaacaagagcgcacacaccagctacatcgtgaaaagcaattagaatgtgatacggtcttagttaatcttccaagactagacacatgcaactcttagttactgttaaataggaaaaatgaaaaggtatgccatggtttatacaacctttttttagttaagaacttcttttcaagaaaatgactaacggctctctgtcattaacaacccgggtggttatagacattacagagaacctccacatgtcaacattgtgcttattaaacatgccagcatacaaattttccttacaactcctttttgaggatgaaatataggttagcatttttttatcataatcactctccaatgaagtccatttcattcaaacatacaatgccaccctttttttttttcctaaaaagtagtgtgcaatacaacttggcaaagcccaatgcttatatggctgttgagtgcacgtaaggttgatatatgccagcactcatcgcactgcctcttcgatgtgatcaatccttgctaggttaacactaataccacttttcaatttactagtcacagtcccctgcattacaaacaggagggtatttgatgaagatggttcaattttttctcttctcccatatttttctctcggttcggtagttttttggtataccagtttttaagagcggttgttttatacatgagattagggtgatgacaaccactattaaaatttaaaaatagtataccagtacagcaacaaccatttgcttaccgtttcagatctaatgttaccgacagttttgctactctacacctgtatggttttttgtcaattttttatccctacactagtgtaagaactacaggaaaggagaagaaatcccttgcatagttgtaatgttattactcggaaatgggccggccatcgatcagacttggtccaagtctttagcccaattccaacacccatatgtggttgtctcttcccaagttccaaacgtccagatagcccacaggatctggcaggttcagactttgacagttgacaaagttctgagacacttcattcgtcgacatcatcaatcaataactcctctaacctcaccgttttttttttgcctaccttgctgatttacacgtccctgtttactgtggtctgctcctcggctgagtctgtgaatttttgtgttgccggtgcgccggtcatgtaattagttaggctggttaattgggtaattagttgctgtgtttggggtttggatgccggtcactgtgatgcttgttcccggttggatggcgctttgtatggcgcgcggcatgtggccatttcttgttttggtccatttgtttcttctgttatttcagtttagcctctctgtcctgtactttggtgccatcgtgcttttctgtttagccccttacgctttttacaaattgaatgtgaagaagacaaaattctgttttgggggtgtgtttgtggttggtagttatgctgggtatgtacatgtgcttttgccctgttgacttttttgggtctttcttgttctctttggattggtgttgtctccccgtcgctggtggcttgctcgtgccggtggccgttgctgcttgtcatcttctgttcctgaatcggtcgaggttagtccatcttgcggatgtgctgttttcattctttgttgttgtactttgggggtgggggtgtgttgttcccctcccggtagtctcttcttcccctttgttgttcctgattctctgttggaggtgactcgatttggtggatttggggagagctgtttctcccccggttcagttactttttcctctgttgtgactgcttctttcggtttcttcttcaatgtgttcctttccagtgtgttcgctgaccggaggaggagccgacgatgatgggtgggatttgcgcgctggtggtcggggatgccgaggaggatgagacggagctctgcgcgatctgcgtccacgtcatggtgcccggacggccggacggccagtgcgcgtcctccccggatgtacccgcgccttccaccacgactacgtccaccggtggcgaaccatctcgccgcgctgcctcgtctgcaatgcgtgggtgacgcagcggtcgcagggacctaaccgtcgccgtcgcccgcccagcctgatctgagttcttggcatgtcggcgttcctactttccttataatggctcagctcttggctcttggtgaggtatagttctattcccgctgattgtcgtagtcggtttctaggctctgcacagtgctccttgccgatttcttgttttttttcttgcgattcttctatgggtctgcatgtaaattgacttgttcttgtatttggtggtagcaagcagtatggtatgcaggttttagcccttttctcaattttttgctgtttacttttttcctacatgtattttgtgcttgcaaattttcccaatgcgtcttgcttaccctttccatgtgttgggtcttgtaaaaaatttcccttttcatgaggcccttgtgtaggaaaaattgccctctttgctgttgtgtgcgatattttattttattttttaaacattgttctagtgttacagttttacatagttagtaaaaagggtaccgttgttcggaaggggtaaaaataactatgggtcaacacacatatggtcatatttatgggacctgcccaattcccgtttgtaagcggcatccccccctctttgggtgatgtaggttgctgtgattgctggtaacttttcaagtgtatttgtcaagtggtcttaatttgttattactgctaccgtatgtatttatgcggttgtcattaccctgccttttttgttgattgagctgatgtttcttgtcgaccttgctgtccggttgtcctgcctgtgggctgattcgttgctgcgtgcgttgtcttctttgaaggcagggtatttactgggggtgattcatgtgcgtgtcgacctcctgtggtatttactggtcctcacaggttgtgctggcgagttaattcactgtttattggtgtaggtgtcggcttgcatgtctattgtttgttgtatgcgtgtccatgcccttgcttgctgtcccttcttgcccctctcctttatatggttactctgtgcatcagtgcttgctcttctgttttcctttctacgaccggttcgttatttgtttcttctttgttcttttttttccctcccgacgcttgctctgttctttcatttatattgtgttaatgttgtactgatcgtacgcctccttgtttctgtaaaattatgatatccatgttcttacttgtgaaatcttattaggcactgggtatacttacttggtcgtattggtttatgctgtctgtatcatctgctagagctcgtcgtgccgcaatccttcgtggtaggagttcttcctcacggccagcatgtgaatcaacacgatcaacaggtaattgccttttccttcgttactatattcatttttactccccttttgcccgaaatgtaaacgtcacttctctagatttgaatttgtctttgtcctttgcttttggaaagtttgattatgttaccttttttttagctacctcgttcaattctggcccttcgtaccagtctttggtcattcggaggaaaaggaaattggcaatcttgcgtcgccggttgtttgcttcaccaggttggttctttagccgtgtttagttgcaaaatttttcttcaaacttccaacttttccatcacatcaaaactttcctacacacaaacttccaacttttccgtcacatcgtttcaatttcaaacaaacttctaattttggcgtgaactaaacacaccctaagggtccaggcaatgaattgcttaagacccctgtactgtagctctatttatccgtacacagtactgcacatgaatagatgattgcctctgttttttttttggtcgaatgctcaggaggccagtaatacaatatgcttttagatttttttctggaaaatattctcattgttgcgataagtcttataagctgacaaataaatgaagcaatcaaaattgatattagggtaagttcttatacttctataaagattaaggccagaaaatagagagggatcttagattttgtcacagatgatatgatacttcaccctgtgtgacattttcaactgaggagttgtaaagaatatctgcaacaataatttggaagtgaatcatgacaagtattcttcatataatttactagcatgattctatttctttttgcaagagatcaatgctgctattaaattcagtcaagagtgtatcattacctttctaacattaatattgcccttggatcataaggccacaccatgaatgcctgcacttttggtctttgaaaatatatttgtattgttttgagggtgaagctagctatggagcaacatgcacagattagaaaaaatgtaaaagtgcttgggaagacatgttgaatactgagcatgcagatgcaggtaatcgaaagaaaagttgaaatggatatattatgcttcctaaggtattaagaaaacatctgttttgttctaacccatgtatgccctatgtcagtgacattctgaaagagcatttggctatatacgattcaaaaaaaaaaagatgctaccgaatttttttggtgcaaacatgcttacatgcttgaagagcgaaccatttgcatcttgcagctgcgctgaagtggtttgaacatgtttgcagacaaaattgtggtttgtaatgagctcttcccacttgtaatcctttatggtggagaagaatgccaatcagagcatccacctaaatgaacacccatttgaaagtgtttgtcctttttgttaataaaaattatagcccaattcacttttttatcgttcatctttgttggtgtattgtcttctattaagccacttaatgacttaatggattcgcaaggacgacttatacttcattgtactctgtttattaaacaaatgtagaccatatttatcaaaatatgtatctactatctaatcattttatgtagaactatttgccatcgcgcgcggcgtggcgccgcgctctcctttctagtaaaagatcaaggaccatttctttctttcctccaacgacttcaacaatggaat

SEQ ID NO: 62810 - DNA, 5668 bp, Oryza sativa
  unsure (1)..(5668): unsure at all n locations
nnnnnnnnnnnnnnnnnnnnnnnnnnnnnnnnnnnnnnnnnnnnnnnnnnnnnnnnnnnnnntaatagcatgcggtaagtcagctgtaaacatattttaaagagataaataaggagagagaagagcagcgggctatagatttgtagccagctatagcacggacttcaagacgcagtgtgtgtatgacagatgggaccagatattaatagtatagtatataactattgtatgaataagcttttagattgactataaatgaattggagctagtagttggctacgctattgaacttgctctgagtttctggcaagacggtcaatctgggaagaggaaaagaactgcagcttacctacaaaacatgcctttctctgaagaatcatagcttcctgaactttctctgaaagcaattgctcttttcatttcatcactctttgcaaattagtaattgctcggtgcaggaggaattaccatatgccagcctgacagaaagggcctttatgaccaggacatctaaagaaatcaatcctgcaatggttcagctgctgcatacaactgattcacctgatgaagagatagatatcaggtatcctttgctgcaaaacaaacgatatactactagtataaggccgagtttagtccctttgaattaaggatttatattagaatttcataggattcaaatcctataggaatttttttctatttggccatttgatttaaaggattgaagttttcaaatcctatgaaattcttatggaatgacacattgcatatgggttttggaggaaatttagcaagagctcaaacctcttggaaaatttcctttgagtttatttctctcatccgattcctgtatttttcacgcgctctaatcaaacgaccattcctgtgttttgcaatcctctgttttacacttcaattcctatcagaatcctatgtttttcctattcctccattatttcaatcatgcgattcaaaggggcccttagttgcaaattttttcttcaaacttccaacttttccatcacatcaaaactttcctacacacacaaacttccaacttttccgtctcattgtttcaatttcaaccaaacttttaattttgacgtgaactaaacacaccctaagctatcatgtgacctgctggttcactgaggcagatatcagctgacagcataaggcctctcacagtgcaagctatggggcccgtacccctagtccaaaaatttggcccaaagacatctatcccacagtgtaagcacccttagttgtgttgtttaattggatgaaggtactgtgtaaataaaccgagcccacagtggggcgttaccctgccgcgtggtcacgggagaggaacgaaattaatttactcacctacccttccagcgacttctcctcgcgctcccctccatcgcccttcgccgccttgtagtccgccgcacccgccgctcctccttcccttccaccaccaggctccgctccagccgctcgtactccccgtcagccgcggcgctctgctctctctctctctctctctctctctctctctctctctctctctctcacctgttccaccggcgctggcgtcgggcccctcctctctcggcggcgacgaggaggtggagcgaggaggaccgcggtggtggcgcggatctggagcggcccgagcttcgcccgtcccgggcgccgccttgctcgccccggctgccgcgtcgtcgaggactaggagctccgtggtgatggcgctcatctccaccttctagaagaaccggcggcgcgaatctggagccccgaggacgcagccacctcctctctctgccgacgacgaggagacggagcgtggtggtggtggtcgccgccacgatctgttattttgcttcttttttctttttcatcttgtggtggcaacaatagtgtttcttgaatccatattcttgagttcttccaatccccaagatcctctgccacatttttgcttgctgaatttgaggattatgcttgggcgggagaggatttaggagggtgaatcgggtatttcgctaggaggattgagtgcgaggtcacgggtcggcgaagcaacgctacccacagcgcgcgttccttccgttttctcctccgcccgtggactcgcgagagcgaggtttcacgcgtctctgcttgggggcgaggagctcagttggggcgcgcttcctcgctccacgcaagtgcacatccgagctggcgaggtggagcaccggtccacgtaggtgcactgtgagaggccttaaccaccatatgcaacaggtctctatcatttcaacctcagcagatgactggagctactgccatgatgattacaggatgcattatgtagccattaatattacggaaaagcaaacggcagagtgcaggactggtatgcgaagcccaggaagatcatgcaatgcaaccatatgcacggcattctacatttggtaaagttctcttaagagtaaattgcacccacggtgtaacaacttggcaggtgggtgtaatttaatgtaataacttgaaaaataagcgttctagcgcaacaacttggcaagaaggtgcaatttagtatcagaactttataagtgatcatataaatgcaacaacttgcaaggtaggtacgattttgatacaataaattaagaagttgtgacaacttaattatttggagcatttttatataaattcaaatttttaagtacttgacaatatactagcgtggatttgtataaacatatttatatttttatcctaataactaataactctaataactaataactgaaagtcaattaaactagatgtagaaattattatatttcggttgatatttgagaagatgaagaaaacaaaaaattcttaaaggtaactgaatgtaaattgtaagtgcaatataattcttaaagattaaattcagtattataaggtaatatccataggattactgtgtattggcatattgatatcgtgaaaaacctcacttagcatatgcttagccaaattgattcaccgaaatactaaattgtcaagttcttgtactaaaacgcacccacttgtcaagttgttgcactcggacgttcaattctcatgttcttgcactatatctcacccatctgccaagttgttgtaccgtgggtgcaatttattcttttcttaaacaggagaaacaactacactacaagaacatactaaggccgtgtttagttccattcccaaaattttttttacgtatacggacacacatttgaagtattaaacgcagtctaataacaaaacaatttacataatccgcctgtaaactgcgagacgaatttattaagtctaattaatccgtcattagcaaatgttactgtagcaccacattgtcaaatcatgacgtaattaggcttaaaagattcgtctcgcaatttacatgcaaactgtgcaattgtttttttcgtccacgtttaatgctccatgcatgtgtccaaatatttgatatgacggaatttttagaagtttgaagggaactaaacacatctaacacgggtccagccttctcgtaattcagatgctacgctaaatactagttattccaataaagtttggtacaatgccaacgatttttgcaataagtaccctcttttgcattctcatcctgactagtttggttcagacttgacaattgacaaaaccggatcactattcacctttctaatctaacacagcctatagggttcatttcgtcctaaccctttttgttcgtttccattcacctaaattcatctgtttacagttttcacgcccgacaaatttggaccaagtttgagaagtttcacaacttaggtagcaaacgactctttggtgttacttattagtgtcgataagaagacgaacaaaacattgcatcgcctgaattggatcggttgggagaagtaaacggccttaacgacgatcacaaggatgcattgctctcaacccaaatgtatagcactgattaaattcagttcaattcaaccacagttaaaaatttactcatgaacatttcgacaaaaaaaaactcaagaacaaacgaaatttacaattcgcttttctcctttaccgattcagagatgagcagcttgtcaaaaataacaatgtgaagttataaacatttaccgattcagagatgagcaacttgtaaaaaataacaatatgaagttataaacagtgaccaaaacgccacatggcgaagaagatgtcaacctagtgctaaaactgccttgatagattgtagtaagagaccaagtgactacagaactagagtagtagctgcatcctcatagcagccgaggaaacaagcaattcgcaggactgaaaactggactgccccgtgcggaagaacacctcaaatgtcagaacatctcaaatgtgtaaaccaatctgagaaaccgaaaggttcgaccgcttcttcaaccacccagctcaagtggctgaccaaaaaaaatgctcaaatggcaccaagaatcccgcagaagttcaagaatgcactgcaacaactgcgatcattaccacagtattttgctgaatgcccctactaagaaaaccctccagtctgcgacataagttctgtacaaatgattatgattcaactataacgatggcctgcagaaggttcccggtattcttatgctggcaacataagttctgtctataacttgagtcagattaagagttcaggggtcttcttagcccagcttccacctgtgaaaaggaaaatgtcaaaataatgtcccaagagtaaatgtgattgcaataatcttttgcataaatacatcaacatagcattcatgaagtactactaagtacactgatgccaattggtagaaagttattccgtcaacatgattcagcaaggattactgaagtgtcagccatgaattaagtatgatacccattccacattctgacagatttatcaactaaaatccgagaactggaaagtgtggtcctccaactgcacatgaccagatatccaaaatcaactaaaatcaatagaggcatcagggacccatatcatcataggccataattatggcttcgtaccaacataatgggtgctcatgataaattgtatttaagacatgtagaaccttcatcaatttgcagaatcaaacccaacttaaatgagacagaaaatgttcttcctaaggacattagaaagccagggttttcgacataaatgatgggattgtagaagtctaagaatgtgttaattacattatgattaaaaatcagacatagacttacatcattggccacaaaagatctactggcaaaagatttaagtcgtggagattgacccgcagatgttgatccactatcattactaccactttgtttatcaccctgcagacagagaagtcgacatgaatctaaatatggtagacttcaagaattgatgacacagacaaagacatatacttgaagcactgaaacttttaaaacatttaattttgtggtatgaaactaatatatttgtggtatgaaaattttatcgctagacatgatagaaattctctcatgatattataattcgaagttgtatatcaaagactgacaaataaaatatgtcaagtaaaaaagcagagtagtgcatatttaaacacctacacacaggaaaatattttaagaaaaaat

SEQ ID NO: 62811 - DNA, 12577 bp, Oryza sativa
  unsure (1)..(12577): unsure at all n locations
caaaaaccttactgaaaacccaataatttgcatccacaacgctagtttgagtgataaaacgaaaagttgaccatacttctcttcaggagtaatattcctgtataaatataatattagattaaaactctgtacaatatcaaaatattctccctgtatcttaaaaaagaagtgtattggcaaatatttccatgtccatccaatagcaagcataacaacaaacttatgttttcaggttataagttgatgcaaggcatggaatactagaagcaaccaagcgccatcacacataaatccaaacaggtttcatcatacaaaggtacttccataacacacttaattccataacaaaataatgcaaaatctacactggcaagtggcctgataccagtgcaattgtcacaaaatgggaaaaagaaaatttgaaggattcccttaacttccaaaagaatttgaaactatttctcagcacaaataaatgacagaaacaagggaatcaagattggcacaacttgaactagaatgagctccaaaggatggtattaggatgtgtgtagcatggtttgcattttactacttttgccccatcacacaaaaattaaaacaggttatgaactataaaatatagtggttgattcattgcagaagacataccatatagcatgtgagaagagaataaaccaagcaacatcaagaacaatagcgaagaacagaaggactgcatatgtccgaccaagtgtctggctgctactctcaattgcaacaacagcaaagagcccaattaccaggttgatcacaagaacgccattgaacaatgctccaagtgacccaatcagcgcacaaccaatctgagaaaatactgagaaattaattatgcagatgaaaacttcagtcttcagtaattcagttttggtgtgcaaacccctatttcagcatgataagcattaaagcagcatgatagtagaaggaaccaaatgtaaaagcaatcagtgaagataagcatttagaatgttaaaccatgatgaccttggaaagaagatagtttttgcttggaatgagagattcagtgcagcatctacaggattaagtcgtattcggtcaaaagtaacttgctgctaacactgtaagcatcaagaagatgactgccgcaattaaaaaaaaaggaggcaaaacaaggacataatacaattatggaagtaacattaaataactcctagattgaagcagaaaattatatgttcattatttcctaaaatgctacctctaacatagaccaaaaatttactcaaatgctaaagttcgctttacatcataaactcataatagagcaaaactaattgctttgcaagacagccatgaagtcgtcagaatctactcaaacatagaaatattgcactagttcacatcaaaataaggtatatctcctctttttcaccatatttgccaaagcccacaatgtacaataccaaaatggaacaaactacaaaatctaagaaaaataatcattgatattggacccttcaaaccctattgtcaagtacaaaagctctctgatatcatttaggccttgtttggtttggaagggattggaggggtttgaggggggcataataggtgtggtacaaaccgaatatctcccttggggattaaccgaacatggccttagttggtcagagtaaagagtgcaaatataacaactataatctccacaagcattttgagagaagaaaaatcccaaaacgcggactaaaaatattgagtgagaagcaggtgagtaggtgatgcttttcctgaaacattggggattgaatctaacgagtggcaaggcccataatctgacaagcaggctacctcaccagaattggggaaattcgcagtcctagcaaaatgacggcattgaacttcacacttcaccccaaaatcagatcgaactgaaactacacacttctcctctctttcttcgtttgattcacgcagaagaacgaaagcctaaacctcattgaaccaaacaccccaattcgccaacacaatccagacgccgcgagcaccaaccacaaatacaaattcggcgctgccattacgccctaacgccgcccgcggcagttgcctctaatagataggtgccacaaaacctagggcacgcgctcaaactctctcgcctctcggttcgcaaaaacaacaagcgatctcgtcccgggggaggcgccgatccggtagatgagggggggaatgcgcgcacctggaggtagatgagggcgagggcgagcgactggagcgcgtcgtagtcgcggaggaaggagcgcagccgcggcccgatcccgatcccgagcgccgccgggcaggggcagcagcagcagcaggagcgcatcccggcaccacgccgagcccggacatgcaaaacctcgcgggcggtggtgcgtttggggggtggcgcggctgcttcctcctcctcctcctcctcctcctccggcggtggcgagcggcgagcggcgtgatcggcggggaggattcgcggcgagggggaagggaggcgaggagatttcgcctgcttcggcttgccctccggcggccgatggttttttttattattattttttgggtgctttaattaattaattcggtgacggcgaaggaggggcaagaagacgtttgcgttgcgttgccagatttgtttgggaactaagggtgtgtttagggggtgtttagttggggaaaagtaaatttttgggtgtcacatcgaaagtttgaccagatgtcggaaggggttttcggacacgaatgaaaaaaataattttagaactcgcctggaaaccgtgagacgaatcttttgagactaattaagccgtcattagcacatgtaggaggttactgtagcacttatggctaatcacggactaattagttttaaaagattcgtctcgcgatttcctccataactgtgcaattagttttgctttttatctatatttaatgattcatgcatgtgtctaaaaattcgatgtgatgtttttgggaaaaaaattttgggaactaaacgggcccttagttggggaaaaggaaatttttgggtgtcacatcgaacgtttgaccggatgtcggaaggggtttttggacacaaatgaaaaaactaatttcagaactcacatgtaaaccgcgagacgaatcttttgagactaattaagccgtcattagcacatgtgggttactgtagcacttatggctaatcacggactaattaggcttaaaagattcatctctcgatttcccccataactgtgtaattagtttttctttttatttatatttaatgcttcatgcatgtgtccaaagattcgatgtgatgtttttggaaaaaagttttggggaactaaacgggccctaattcggtttgccttcgctttattagtggtttccaactgagagactgttggtgaaatgaaaatttttgggtgtcacattagacgtttgaccagatgttagaaaggatttttggacacgaatgaaaaaaactaatttcgtaactcgcctagaaaccgcgagacaaatcttttgagcctaattaagccatcattagcacatgtgggttactgtagcacttatggctcatcatagactaattaggctcaaaagattcgtctcacgatttacatgcaaactgtgcaattagtttttctttttatctatatttaatgctccatatatgtgtccaaatattcgatgtgatatttttgcgaaaagtttttaggtaactaaacaaggcctaactaaactggatgaatacccccttgctgcagaaaattaagttactgtacataatatatataaataatatgtaatttgattatcaaaaataaaacaatttgatataattttaagcctaaaaataattgagattgcatgtttttaagagagagaaagaagagacaatttagaccatagatatatcatctaaaggttagaaataattgagttgatgtgacttaataagagaagagagaaataccattaactatacttagtgaggatgaactatataagtatatataagtatataagtatatagaattagggtttgcgaagccatggttccgatgcatcactacatcacctcatcgagtgctacctccgtttttttaaatatatgatgttgttgaatttttgtaaatgttttcattttattcaaaatattttacaaatataaaaatattatttaagttatacttaaacaatatttgatgataaattaagtcataataaaataaatgataattacatataatttatgaataaaaaaatggtcaaacgtgtcttaaaaatcaatggcaccatatattaaataaatagagggagtaatacatatgaaccagggctaaaaccagcggccccatcgtttggcacgaggaaaaagcgaaacgatatacttgcaaattaaaaaaaaatatgaataaaatttttatatacgtgttcttatatcgatataaaagtaaaggctgaaaaataaactacaataaaaaaatcctaaaattaacttcaaatttatgtttgaaaattcaaattttggctgataagcccaaacaaaaagacgaggctacaatacattcatatactactagccaggataaatgtcgacttggaggtagcgatgatgttatatagcgcgatcgctagtacgcgcgcactcgccggcggcgtgcgtttcaggcccacaaggcctagcgccggcacgcacgcgcctccttccacgctttttttttcgttttctttaccgattttttttgttttttcccacttttttatgattattttttaatctttagcatgctttgagtttgaaagttttaaatttttgagttgaaaatttttaaatctgaacttgaaagttttcaaatttttcaaatctggattttaaagttttcgaatcttgagttgaaagttttcgaatcttaagttgaaagttttcgaatctgagttgaaagttttcaaagtttaactttaaaatttaaatattaaatcaaattttttcaaatctgacttaaaaatttttaatctgttagtaaaaaaatctcccgaaaaaagaaacaaaatcttgagaatcttccctaattagttattagtgttaagtgttaactaatactatagagtagttatagtattagtagttatagggaagtgctcgctgctggcgcgcgcgcgccagctagtagcccccgttatataggaatacactggtcctacctctttttctttttactcttgtcccactcaaaatggtttcatcatagattctatgatcatccaaagaactgattttacttagagggcaatgcacaattgataataagtagtaactcagttaggcagaataactagaagtaggaatcaaggttttttttttatttatatacgatactaaggcaacgggcaatatgttgtaaaaccttcctagtggtaatcttatcagcagagaaatgtgccaactctttattaaaattagggtgcataatttattttgtgtacaataaagtcattgtcgtctaattcccattataactcaattatacaatttatggtagtatttctatatatactgtatatctacgggcctaattggcgacagaagtatgtacacgcgtaagcactaaataaagccgtattgccaatggtcctgctggcagcttaacacgcattacagcgtgactaatctgacgctagctagtccaacttctcgaaccttgattaaaaaaacacttaacttctcaactaattcacttgcaggattcgacaataatattcaatctaatcgaacagcacagctgtgtgaccatgtcatcatcatcgataaaagttgcctaaggatggttagtgactagctaggcaactttgtagttatagtggttataataagagttgtttagaacaatagactatcttagaaaggaatttagtaggattagacagagaaatggctgtaggcaggggtcattgagcctagagaattttagagaatttttagagaatttttaactaaatattagtggcttttcgttgtaattttctgtcatatgtgggactcaagcttaagctgccctgtacactgcgtgcatctttagttggtgtagagatcaaaacttataatttctttgtaaaagagaagatatattagatacgaggttatttttctctatgagcgcctttggatatcgtacaaatgctcattataaattgaattttcattacggataaagttcattggaggaaactaaaacatcattgcccccaccccatcccaccccaaaagaagaaacattatgtcaaatctcatggggaagttttctcaaaagttcaaggcagtctcgctctctctatatggcaagtctagtgagccatacttaaattagtttatcaacctatatgttttagttttctttcttttgtttagattcactaatatttatacacgcatatgaaacacatagatgagtccatatatggctctatttaataccaaaaacaccttaaagaatgtacagtgaaattttttggaatacccaacagacattcaaaggagcaaatgcaccaatgatatcatccactaaaagacatgagacctaccctgtaggcagggccagccctgggcctaggccggttgtgcaactgcctagccccagggccgtgctagggagagcgaggcgctgctttgtctccgcgagatcgaatgccctgtctgagtcgccctaactccaactccacgtctccacctcgcctaaccacctccacgagaccgcgataggccgacagcatcacaacggcacgtcgagtcgcccactcgccttgcctgcctagcgcctgaaccctgaagcctgaagggtgaaccgctgattcctgaagctgaagtactgaactgctgaaggtggtgctaatcaattagttcaatatatatcaattttcatcatttcaattaatggttattgttgtataatttactagaatttcactatttcagatgttacaatgttacctaacaaatatttgtcgggtgctcagtaaagaaacaaaagaaagtgagaagatcaattaattgatctcttattaaggtatttatagtactttgtttccatggtgttttttaattatcaattatattatcgttattatttatcgagaataaattactatattgcaacttgcaaactgattgatttatgagcaattttatagtctttgaggaggtaccaaactttacactaaatttttgatacctcatggtacctcctcaagaattatataattgctcttgatttattatttatcatattagaaatgtttatttctgttatagtatatgtgtttcataaagtatatattagaagtaaaaaaatagccttaacttgtcaagggcccatgctaccaacctcgtatagggccctcgaaattgttgaaccggccctacctgtaggagtaaacccatcacgaatttttcactttcttgtcagtttccctagaagaacaatttctatgggtatttttctgagggtcgaacataaaaaaaaatccactgtcgtcaggtttttttcaccaaaattctgacgtggaactgcaaacgtgaatggtggttgcaaaataatgttagataccagttttagaaaaaaaaagtaattaacaggccagttattatggcactcccaacccataacactagacatggttttcataaactccacatcatcaagaaactagtactagacgctactcttccaatgcaaacaccactattacatacttcaatttaatgctacttatctcacatgatgtcttggatgttgtgtagaacccatgtctcatgcaagatatggtttccttccctttcctcatttattcacttgccacatcattttttatcctatgtagcaacttatttaatgctatggacaccatcctagtcattgggtttgaaatgcccttagtggttaccgggcaaatgtttgaatccgaaatcttaaacctatatttttttttctgtgcaaaatgcatgcatttgggtaggaggaatccttcacgacaattaaaacaggtgattttattaagcacaaaccaaaaacaactcttttccatccactagattaggatcactctatatgcccccaatcccccgttaggtttcttgccgtgggatctattcacttaggttcaagtctatcacactgcacgatgctcatatctatgcctatttattcttttagtagagactatgttcttaatactccatccgttttaaaatatttaacaccgttaactttttagtacatatttgaccgttcgtcttattcaaaaaatttgtgaaatatgtaaaattatatgtgcccatgaaagtatgttancaataaatttatttgtatgaaaagaataaataattacttaatttttttaataaaacgaatagtcaaacacgtaataaaaagtcaacgttgtcaaacattttgaaacggagggagtggtataccaagcaaaagtcttttagagatgtttacaagaataagatgtgtgtttgagtgtatcttcatacggatgagtgtacttccaagatcggttttgcaatctcccaaggaaatattactcccaataacaaattgcagaccagagatgaaaaacattttcccattatctaacattatacataattgcaacaaaactctaatagttaaaactagagctgttaaattaagtttcaaccattctaaaggtaggaagtaagagtaagtttcaaatcaaatacggaaattgaacagtttctcagataatctcttgagtatatattctagctttgatccgagccattcgtctcagatcggacggtcaggaaacgtccatgcagtttctcttcaaatatagtagccgccaaaaaagctgggaatctccagctcgtccagcccgcgaagcacctcgtcgtagtcaaaccagtcaacatcttccggcgccgcgccggagacctcgccggagaagccaccatgctgccggtggtgatcatgatcctcgccgccgtgttgctcgagcaatggcggcaccggcgagtcctccgtcttctgcccttctccctcgacagtggcgccattgccgtcgcccaccagctgttcgagctccggcccggtagtgacggtatcctcgccggagacggagaagtcgacggcggtttggtcggcgctctcaggctcagggcctgcgtgcgccgccgcgctctcggcggagtgcgcgtgctgtggcggcggcggcggcggcggcggcagcaggatgaacgacggcatcacgacgtagcggcgctcgcgctcgccgcggagcgcgctctcccatatggaggactcgagctcggtcagcctggagcggccggccgcggcggcgaggcggccgaagtccggcgcgacgtgcctcacgacggcgacgagcacggccaccttctcggccttcgcgaggcggcgcgggctcgcgaacggcacgggcgtcgccatccgcctcccgcgcaggtgcgccgccacctcggtgccccaccacggctcctccgccgtcggccaccacggcggcggcggcggcggcgtggcgccgctcttcctgtcccgccgcgccaccagcggcggcgtgcactcctgcgccatctccctcatcatgcgctccagcgtgccgttgcggagcctgcagagcgcggcggcgagcgggacgccgccgccggccaccggcgccattggcatcgccacgtagcagagaagctgcgcttgcatggtcaccggcgacagcatcaacggcgcgacgccaaccatgggcatggccgccaccgcattgcgcgccacgccgtgggtctgggagagctcgtcgccgggagcgcgtcgccggcgcttggcatgctgctggtggctcgaggtcgaggaggaagaaaccctcttgccgctcgaactgctggccattggtacagtgcttgattaatcctgaatggacacatgatttaagtttcaattattaataataatttgctttattaccagagcaaattaacaagcaatattgatggaaaaaacttgccctgtcaaaataaaatgatcaaaatgtaagaaagggtgaggcatagtatattttgatgtctgaaatgatctccttttaatagaatccgttcagcattttggaaaactaattcaattctcttcctcttagagtttctcgatatgataagaatgtttgatcttatcatatattttgatgtaatctggcacaatccgtactttcttctgcatagagttcttttcagcaactcgtaataacaattttatcatttttcgtcagggtatgcttttttatcatttttcgtcagggtatgcttttcgaacgtttaaacaatttatcaacatggaaactgaaatttttgtcaataatctcataaagaaaataaatagctggtttcctgccaaaaataacaggagggagaactttacaggctaattaactaagggtctatttgggagctttggcattaggctatattcttcgtcaagggttgggaacccttcccgaaaatgaagcaacagattagcatgtgattaattaagtattaacttaaaatttttttaaaaatagattaatttgatttttaaggaaacttttgtatagattttttttaaaaaaaaacataccgtttagtagttcataaagtatgcacatgaaaaacgaggaagtagaggttgggataagagacttttgaataaagccttacgattctaagaagtcgtttgagggcctaagacatatatagatagatgccaacagttttttttttttgaaattttcgcaggggggagagattccccacgtgaatttcattaaactggaaggggacaggaagaagttcgaattacaaatttagagatcacagggaggaagagaacaattctttccacgaggaaattacaattctttcgcagttatcatgtatacaacttttatcgccaactgtaagcatctggtgcagtcatagaaaaaaaatgtgtagtttcctacccaaaatacaaattattacttcatccgtttcacaatgtaagtcattctagcatttcccatattcatattaatgttaatgaatctagacatatatctatctagattaattaacatcaatataaacgtgaaaaatgctagaatgacttacattgtgaaacggagggagtatcagctatgggacattctatttccagagccagcgcgtccaatgtgaaatggtttggttggacaggtccgatgccacaaaaggatatgtgtttttagaccgagcgtgtgtattgcaagccacacaccatgttgtcatcacaagataacttttacgcacaattatattgtaatcataacctgactcctaaaacatgtttgcgatgactgatgaacatgaaaattatttgttcaaaacttctcttgaaagggttattttatatggttttgcatagtttagagatatctggtcttttatttcggtaaagtcgaccaacagcatagtctaccatatcttttctagcatctaacatttgagaagctcatataaagcaacatatatatagttcattttcttagtgttttaaatcatgtttttgcactccgtgtttttctacattcatggtttctatgtaaaagaatatgtacttgctgaaaaggcttgaaactgtacataaggtcccaatgataggattaactagcaaacaaagttaaaaaatcggcagattttaggagaaaagccattttcaaatgtaaccaaaatcttaacttcatcatagacaaacactactcaaatctttagacaacctcatacctaattacctagaatgcatgaactatttactcgaagtgaaaatcttaacacaaaagatgaataaattgtgtaccttcaagatgatcactcagctgccatcttttcattagagaccaacagccgctttgttagtcttgaagacatagcactcggcatctggaaaacttgtagtcaggtgaacgatggtaatggtcactgtagtcctatatatagggaagagggatgcaatatgagttggaaacagaaaccatggattggtacagttcttccatatatagaagatgaccacgaatgccactatatgcaataattacttgcgaaaacgtatttgatatttccaattttaaatatcccaaagttttacatttgataatgccatggtggcaacatttagagagagggtaggcacatcggtgtcggcttgcaaggggaatgttgaatagttccacattggttgtcaaagggcaagtgacactactggaaaactgatctttgctaggtcgtcccaaaaccacaatagtcccagttataaaaagaatcgggatctttagtcccggtttaaaaccccatagccattctacgatctttagtcccagttggtaacaccaaccagttcatcccctgtcagtcccttgtcagaggggcggggatctttagtcccggttggtgtcacaaaccgggactaaagatcaccattttatcccggttggtaagtaaagatcctacatatttactcccggttggtat

SEQ ID NO: 62812 - DNA, 8805 bp, Oryza sativa
ccccctcctcccatcccggccctctcctccccctcctcccttcccatccgatgcccagcgagggccgcctcctccccctcctgccttcccgcacgcgtcaggcggggccacgcccggcggggccgcacgcaggccgcgcacgggccgagtagcgagcggcggcaggaggcactaccagcatccattcttttttttctttttttttacaatttgtgattcactgagatgtataattttgtaatttgttgtatggatctgagatgtataatatgtgatgtatttgatttgtgtgtaatttttttaaaatttgtgatgtatttgatttgtgtgtacaagtaacttaagatttgtgatgtgaatgttttgggatgttactttgatttggggtttgatttgggaatatgcatcccactcgatttgggagaaaatatagggattaaactctggctaaaaaataatgaaaaaaaaagaaaaggagacctaatgggactgccgctaccctctctttagtcccggttggtgttaccaaccgggactaaagatcgatctttagtcccggttatttcacccaggactaaagatagcgatttttagtcccggattcgtagtcccggttggataaccgggactaaaggggggttatgaaccgggagtacaaagggtttctccaccagtgtgacctaatatataagtggtgggtggccctcacctcattggctatctttaggtgtggaaaaaaccctttaacatcctacaatttgtatcagagtcaagctagttcaacatctctagtccgatggacaagagtgtcaaggcctgatagaccgtgggtgcttgcagggctcgtataccagaaggaccattggtgtatggtgaaggaggtgaacggctgagagacaccaatgtgtaaaggggaagattgttgaatagtcccacatagggtatctctcgcctcattggtagcttttagggtgggaaaaacccattatgatcctgtacgtccactcgcggtccgaccgttagcctaaaaatagcttgataaagcttgtataagaaaaagatgttttcttcaaaaccaaccgttgaatcgagctcaaatctttacaaataaactagacaaactaaggaacaagttcgccgcatggattagcaaactaataaacggtttaagagaaaacactctcaagccaatcgtctcagaaatttcagcaaatctaaacaaaacataaaacgtaagcaaattcaaatctagcaagaaccaataaacgaaaccaccaatcgtcggtctggtcgttggaatttagaaaaacacgtctcgatgaaacagatgtgtttacaaagtgcatctaaagcactcatctcttaactcatgaactagaatcaaagcctcaaagcaaaccctaatttttctttccccaaaatcaatgtatcggctactaacctttacaggtactttggacccaagatgaagttactttggaagctaccaatccccctaaacaaacacatttcctgtggttagctataagagataggattcaaaccacaaaacatctaaaacaaaaaaaaaactgggagggatgtgagttttgtgagctctgagccactcaaaatgcacatgttattttagctgccctatggcatattttgtttggtgttttgctagagacagttttggttgggattttgttccaccatctttttatcatttttttctgtattgatgaaagttgatgatagctctaataatagtttgagatatattgatgtttctggcggcggtaatctggtagctatggctgaccagaaacgatatgatctttagagataagttgtttggcacgcctctaactataatctaccgtgtgatctctctaatgcaacagtggaagattctggggagataaaaggacggagtatttgacctcatcgttgcttgaggggacaaaagtttccacccgcaagaagtgggatgatttttttttcttcaaaagttgttgtcatttttattcccgctagtctagttgtttagaccctttgagatgtgttgtttatggttttaacatctttccttctctatttggcatgcgtaccttttatactgaaacaaagctaaaactataaagctggtctccccagcgaactaattatttttgctttctataaaagcagcgtaatgccttctatcaaaaaaaaagttgaaaagatgatgatgagaaacagcataaactttcaactaggtgaagtcagaaacttagaatcaaaataatgtcaataatcctgacacatagacttgttccgtaagagtgtgaatatagataaaaaaaacacccccttgtactcacgaccaataatgccattggaaactgtaagagatctcaaactgtagatagcacatgtggaatggctccatcgaatgaatttgagcagcttaccgggcagagatgaagatgacccaaggcgacatccatctccaggctgcaggcgctcttgatggtgaggcaagtatcgcggggccagcgacgactggagaatgcgcgtggatggccacgaggagctgcgccgcactcacagctctggtgaggtcttggggatgaaacgatggggacgagagtgaaagtataatatcgaagaccgtgtagaaaacttgcgtgcttcataatttgggatggagggagtattaactatgatctaaaatagcacactagctcttgatggtgaggcaaggtgttgatgcgaaaaacacacactggcctgggagatctgcttagctccagtgcaggtccaaaggttggtaagatgcgggcgtgccagtcagtttgatcctgcaactgataagatatacaaacagcagatcaataagccgatcggctgtcaagccgatggagcaattccagccgatgctgataccagccgatagcgatagggttttaagctatcggctatatgtttgatgtagagtcttaacacttgatataaataaaggcgatcggcttataatgataactaacaaaaatatagcaatataatccagtagagaccaatcggctaataatatgatataatagaacacaagtattgatccgaaggtcaaaatatacatcggctggagatccgatgtcataaaatccacaagattagatagatcaatgaaacatttgttgtcatcggctaaatccaacttatatgtttatgcaatccttataagccaatgcaacatccagataacttatcagctagcaccccgataaaacattagcatgaacctattggcttaacaagacttatattatcaacaacaatctagtggtcgaacctaaccgatgcagcacgagattgtatatgataatctaatactcgatgagccgatagatctgtctaacgtgatggatataacaaatctatttagagcaacattgtgattgtagagatatatcgtctaagatagaagatcggacctaaccgagacagtcccaactaaaccgatgtgtctctaaacacaatgcaattaaagatagaattgagatatcaggtaggcaaatatatcaaccaaaccagagcgatccaagagatcgaagcgatgcagccttgaacaacaccaacgtaaccggtagattcaccagggccggcggaacgtaggacttaccccttcgccggagatcgaactgaatcgatgcagccccgcgtcaggtgccaaattccgccggttgataagtaaaacctcaggaatgagggtggcgatgcgccgagagtagttgtattgatcgagagattgattagaatgaccctgggtatacatatttatacccatagggagatactagtccttgtaagacaagaaagaaactttcctaaagataaaaggaaaacataaagtccttattggacactaaacacactttcctaaagataaaaggaaactaacaaactattcctaattaatagataacttgtcataccgcatcctcattgaactcggattcttctggataaattttctttaattgatccgactccaccaagaacacaactgctggcgatttaacgactcccatcggccgattctaaaactctaaaaccgatactgactctaggccaatgatgacttcgggcttaccaaattttggcgttaacacaaggatcccggggccagcgacgactggagaacacacgtggatgccgacgaggagccgtgccgcactcacagctctggtgaggtcttggcctcttggggatgaaacgatggggatgagaatgtaagtataatatcgaagaccgtgtagaaaacatgcgtgcttcataatttaggatggatggagtattaattatgatctaaaatagcacactgatttgcatttgcctcgtcaaatgtttcttgattttgaatagaaacaatgtagtattaagtactcactctgtttcagattatattgactttagttaaagtcaaactgcttcgagtttatctaaatttatagataatatagtaatatttacattaccaaaattagttttattaaattaataattaaatgtatttttataataaatttatcttagatcgaatatattattatttttttataaacttaatcaaacttaaaacagtttgactttgaccaaagtcaaaatatcttataacttgaaacgaagagagtattagtttaatgcttgtaaccagttcaaagaggtaatcacaaagtacatcatgtttagtccaaagattttgcatacaaattaacttctttacaccattcatttacatccattttggtcaaatgattacataatttaagtatacttaaaacaataaaatgtgtatttttttaaaaaaatatgtattcctaaaacaatggaatgtgctttttaaaattgattcggctcatatcgatgggagaggtttaggccctatttggggagctttagattctaagaagaaactgtttgagcttccgagaatctggaaaagctctgaaacccagcttctccagctttttagttcatttttcagaatcctttgaaaccctctgaaacccagcttctgaaacccagcttctctagcttctgcttcttggtttatttttcagaatctgaagctgtggactgtttggagcagcttctagcagaagcagcagcttttgggaaaagatgcagctgggaaaagctcccccaaacagggccttagcctcacatcgctcagaggtttagcattacaccacaagcatgtcctttcatgtcaattttgataccacttgggattccaaaataccaacttcaataatttttccctcaagctaaatactactccctccgtttcatccgtttcagattataagactttctagcattacccatattcatatagatgttattgaatctagacattatctatatgaatatgggtaatgctattatctatatgaatatagataatgctagaaagtcttacattgtgaaacggaggataattgacaagttccaagtaacatgtcgcggaaacatccatcatgctgtaaatccttgtgcaaaatgaacaggtacaaataatatccaaaagtacggaacattcaagtgaggtatcattacaaaaatattggactcgccgaagccacatgccttacaaaaacagattgaaacagtgcttcgtcctacatatgaatgagatacatgccatagctcctagtcagctccatgtcttaaaggtccacgtatcaagcatcaagcctacaagagcagaacagcgaagttgaaaaaaaaaagagtatacatagaactttgaaaaggcactatctgtgcaagcacagtaccagaataaagtctagtataacaattgaactgagaatgaatagttttgtaccttgctagcaatgttgctggacagccaatccaggccctcatacaaaccctcgccagttgtggcacaagtgctctggatgtacctgtcagaaagaagaccaggttgagatccagagtaccatgggaaaaagtgaagcagtgagtaacatgaataatggcaacatgatgtgttacaatcgaaacaaaggatagaaggaatttcccctagtctataatcagttatcattgagcatcacactatatctacagaaaggactaaaaagaaaagagcaaggatccaccagtaattcgtatttaccagtgacgctgacgaagggaatgtaatccaagcttatcagtaatctcagcagcattcatagcgtttggaagatcttgcttgttggcaaacacaagcaacacagcatcacgcaactcatcctgccataaatccaattaaatttcatcagatagggttgcagaaagttgttagcttatcaattggaatatgatattttcacagttgctttgttaattattatgtacatcgatcaaaccagaggcataattgatcaaataagccatatggtacagcgatagcaaaaaaaagtgacagagaacaatttacctcattcagcatcctgtgcagctcatctctagcttccacaacacggtcgcgatcattgctatccacaacaaagataagaccctgtgtgttctggaagtaatgcctccaaagaggtctgatctgtttttgcaagcatttacaaagatcaatcataaggtgagataacatatgtcaacattttaaatattaaaacaaatcaagacataggacagcttaatgtaaacaacataaataactaggaaaccagatgctaataatgacaaagataaatttaattgaaggcatcaaataaaaatattggtcaaaatatggctgcagttcttaccttgtcttgaccccccacatcccagacagtgaagctaatgttcttgtactcaacagtttcaacattgaaccctataattcaaagaaaatcagttagcttgaaagatacaaataaataaatagaaaaggagataataccatagcacaaggagtcaagaacataaaaggatccaaatgttgaatagtttaaaatttaaaacctaaatagatgcctaataaagttcactccgacaatttaagattcaatcgatatcctacatgtaaagttgaagtcttaaatttcataagaaacagctcccagcgttatgcaatagttcaaatagcttttcaagtaaaacaaatgacaagcagacatctctgcctatcaagtgtgctagtaaaaacttagcattcccatggtcatggaataggacatttcgtctttccatccaattaggaaatttgacgtcaatacagccaagaaaacctagcgacaacaacttttgcagaactaaagtccattctggaaatgaactctaacagcacgcaacaaaggctaaagaattggcatatacaatgtacagaaagtcagaaatgggaatttgatgtttatacaaccatgaaaatagcagcacgaactaaattacattctggaggcctcatcgtttacccattggctcatatgccactgcaaaagaattgaattttaaaacatgattttgaagttgattttgacgctttttcaatgtacctttttcctcagtaatggcttttaagttgctaagaacatataagtaaatatctacatacaaattattttctaatcactaataagacattacggcttataataagtcataggcaacggatggggtcctggatagaacacaaacagcaagcggcaaggccaaagaaattggcatattcctatactactttaaatgatgctagtggtggcatccgagtccgcctccaatgctacgagctgacatgtggtgtctaatcaattaactctatgctataaacttgtaattacatgcctttttcttttggatatagcattatatgcctaatcaattaacaatgctacaaacttgtcattttttgcttttgcttttgattttatttcttacaatatccgtcgcatcgcacgggcatttagctagtaatataacaatgtacatacagaaagagaaacgcatgtggctgaccaatggtggggatggtggtgacgatctcgccgagcttgagcttgtagaggatggtggtctttccggcggcgtcgagccccaccatcaggatccgcatctccttcttcgcgaacagccggctgaacagcttcccgaacgccaaccccatcttcccccctcctctctcctcttttttcacctgcaaatccatacgatcccatccgttaaaatccaaatccgccacgagatccaacctccctccccccacgccctaacgcctcgaaaaccagatcaaatctcgaaacaaatggcgccggatcttcgcccccacgcatcaaccaacgaaatcgaacgcggagaaacggcggatccagtagaatcatcgggcggcggatggatcgccggagaagggaggggcgggagagctcacctgatctgatctgcgatggaattcgggggctggggggtggaagcggatggatttgggggggagggaagggaagagaaggggtggtggagaggagcggagaataatataaggatggtgggcatgggatggagggcgtccgatcttgggatggacggctgagatcggtctccagggaaatttggtggcacgcacatggagagcggagaggcaggaagcttctgaaaacgtgcgaatttctctatacggactaaaaaattttctctccgtccaataaaaaaacaaaattattactggatacaatgggattcttatttcacacgcgctagacgagtaactagtgttcggaagatcggttttgtaggaccgtgatcgtgaggatcacggtacctcctccttctgtctcctcgttaatgtagtgggct

SEQ ID NO: 62813 - DNA, 10917 bp, Oryza sativa
  unsure (1)..(10917): unsure at all n locations
gtaggaccgtgatcgtgaggatcacggtacctcctccttctgtttcctcgttaatgtagtgggcttataccaaatatatatgtatgtatccatatacgacatcctattgtgggtataaatacaatagtgaggttgagggcaaagtaatacttgtaacagagagagaaacatcgataaagttaattgccctccactttcgaacttgccctccactttcgtgtccgtgtgttcgtgtgtgcttgttcgattgttgacaacgtgaattctaacacgttatcagcatgaggtgctcttcagacaaggtatattgtcaacatcgatatgttctaatctcgttctatagggataatgataaacttactagatcgttttctattatttttttctcccgctaatcgttcgatcgatgggttgtactacgtggatttgtcccttatggcgcacgtagcaggagagtttgcggctctccaccccatgcacgacaggcgtatggggttatcccttatacaaccgatctatcgaatgagaagcagttatcgctatagtccgattagatctgttcccagcctttgcgctgggtttcttttcttgcaaacaaagacacgtatatcgtacgccctagatgcgcgaacggatcagacaagccgctgcaagaacgacggtttagaactagtgatacctcgaagggcgacgctacgttcagggtgtaatcgcgatgcacatgagaagaatcgtgtacctggctaacatgatcaccgattccgaacgagtcggcccaaatcctcatgctagtgccgccgtcgtcctgaagttgacgacgacgaaaccgagtcaatgacgccagcatgcgccgtcgtgcccttgccgccgccaacacgcgttgccggtcacccccttcaccgatggccgcagaatcgtgccatcggctttccatcgtcggttcgcccttgaaaagccagccgacgggtcttcaatcgaccgcctgcactcgccgttgacggccgccgcccgcagagacgctgaggagaccgcgtccgcatcccccgccgccggcacgcacggcacacctcccgcgctaccgcacgcgactgggatgggggtcgaagccgccgtggcctcccgctgccgatagctctccgcctcgccagcccgcatgccgaaccaaactccccggcgcacagcaaggagctgcgctagccgaacgccggatatgcccgtagccaaccacgccggcgtcggtgctgcttgtagcctcaccgccgctccgcctctatcgtcgaccccgccgcgctgacgagctccgtcgaccccgccgtgacgacgagccaccgccgcctcgctcgcatgagtcaccgggaaatccgccgccgccgccgaattggggattttggggctagggattcaaccctagccatccgaatcggataaggtgtggctcccctttgttgggctgcaccgtgggccaaggccattagcaggccaacggccctgacgggccggctactaattccttgaatggccggttcatggaggtgggccgaaaaagattttggcctataaaaggagtcgggctcgaatcgaaatttgccccgaaaaacggcaaacttccgaatattttctgatttcatgcggatttggaattttagcggaataatccctcgggattatagaaattacggggaacactataattttggttattctgcattattttatgccgaaacagagaagatgtttaatgctttttctttgtcttagccctcgattttctatgtattaagtgttcattagttaatttttgaatcaaccatagaatcctagagacatggtttttaggaaatgagctctcataatttgaaatttagtacacaccagagagcatcatatttatggtttattttccaagctgttttattttttcaggatactatttaatgggttagtaattcagtaattactttggtacctaaataaataatagtacagcaattctgagaaatgttgggagaattatgggaatatattgacacagtactaaatttagataaccagacaatttactatttgcacacttgtcatgctcttacttgcagtacttattgaattttgcatgactaatgtaggaaaatgactgatattgctaagagagattttgctgaactagcagtcagcggcaagaattacctgacatgggcactagatgccaaaatcatgcttggtgctaagaaactcctgaactgcattcaggacccaactattgcaacatcagctggaggagttaataatttaccaacttcagccgagaaaaatcaggcactgcattacctgaggcaccatttgaatactactctcaagaatgagtatatgactgaggaagatccgaaggtcctttgggactcactgaaggatcgctatggccatcaagtaaaggctttgctcccaaaagcaaaacgtgagtggcttcacttacgtttccaagattacaaatctatggagcaatataactcagttcttcaccgcattgtcacttgtcttaagctatgtggagagaaaatcactgatgctgacatgatagacaaaactttgtccaccttccatgccaatcatgtgaatattcagaggcaataccaccaggctaaatacgagaagtattctgaactggtctccgtgctcatggaagcgcaaggagaagatgagacacttgttgaaaatcatacgtctcgccccactggaagttcagcagcacccgaagcaaatgctagctcctttaagaaggggaaaaaccagaataaccagaacaaagggaagaatttctggaaaaatggtggcaaagttaacaagacatctttcaagaagaaaggaaatcagaacagtaagtctaagaagggctctactagtggtgaatatggaaagcaagatcaggtatgcttcaagtgtggcactaggggacattggtctcgcatttgccgcacccctaagcatctcattgagctttatcaatagaagcacgggaagaagaagtcagagcatgagtcacacttcactgttgagatctagaactcagaggagaagatggctgccatgcatatcgacaagaaggtcgacgagaaggcagtggttgcaatgcacatcgatgataagatggaacataatgcagcagacacagagctgaagctctcagatgatctcatggactctgatcagttatatggggacatttaagtcttccaatttgtatcttagcttcctgcattacaagttactttaaattttagactatgtaatagactaaagttaggtgatttttcaagtgtgcatttagtttgtgttcctagcagaactatagtttctgtaagctccttcagagcatggttatcttaataatttagttaactcttttagtttaatatattctccagatttttatttttctatcttaaagtgttatttttactatatggtcatgaattgattatatttaaatgctttatgatagaacagtgttacgtactatggcaatggaagaggagatgtgtctagtagactgctgtaccaccaatactatctttcgagataccacgtatttccagactttaaagaaaaagactggtcaaatcgctaccattaccggaagcaatgcacacatcgtcggagtgggacgagcaacagtagttctcccacatggtaccaagatcattataaatgatgctctattatatccagagtccagtcgtactctactaagctttaaagatatccgtgctaatggttatcatgtagaaaccaaagatgagaataaactcgaatttcttctcataacgaaattagacggaaatcgtaatactgttgttgaaaaactccattccttgaaatctggcctgtactacactcatataaaacccgaaaatgttgcattgaaaccaatatttaaaaatcctgagtcatacagaatatggtatgacaggttaggacatctaggtctagggatgatgagaagaatcatctcatcttcaaatggccataatttacgaagtaacgatttcccaaaccaagaagattttgtttgcactgattgtgcaacagggaaattaatcgttagaccctctaatttaaaggtgaatgccgaatcaccagtattcttgcaacgaatacaaggagacatatgtggaccaattaatccaatgtccggatcattctagtattttatggtattaattgatgcatcaactcgatggagcattgtttgtttactttctacaagaaaccacgcttttgcgcggcttatttcccaaataatccagttgagagccagtttcccggataaccggatacaatccattagaatggacaatgccggggagtttacctctaaggtatttaatgaatattgcatggctttgggaattaaagtggaacattctgtaccacacgtccacacttagaatggtctcgccgaatcattaattaagaggattaagcttatcgcacctaccaactacatgttggggacacgctgttttgcatgcagcggcgttatttcaaatcagacctactgcataaatgctgtatcccctatgcagcttacacgtggatatgcaccaaatatttcccatctgcgcaaatttggatgtgctgcatacgtccctataccgccacctaagcgtacgtcaatgggtcctcatagaaaattgggaatctatgtaggatttgaatctccgtctatcattaaatttttagaaccattgacaggagacctacatatgggtcgatacgctgattgtatatttaatgaagatcatttcccggcattagggggaggaaagtacctacagaaggtcgaatgccgcgaaattgagtgggaaactaaaaatctcctacatttagatccacgtactaaggaatctgaccaggaagttcagaccataattgatttgcaaagaattgcaaataatctgccagaagccttcactaacccaaaggggatcatgaaatctcatatacctgctgtgaatgcaccggaaagagtagaaatacctcatgacgcagaggaaccggttttcaaattaatttctacatctaccccaacttttaggaagagggggagaccaccagttgcacacaaccaaactaaagtttctaggagacgtccttcgaaacaaaagattggacagaataccacagcactagagaatagtgaaggagctcaccaggtagatgagccacctacagtgatatgcccggatggcaatgaacccaatgagaatgcgcgcacaattgcgggaaacaatgaagatcaggaatgtgaaagaatagaggaaatatccaccaattatgtggatacaagtgaaacatacaatagagagactactattgttgacatatactttgccggaaagatcgctaagatcattgatctggatccagaaccaaagtccatggcagaatgcaaaaagcgttcagactgggtcaaatggaaagaagcaataaaggcagagttaatctcgcttaataaaagaaaagtattcggtcctgttgatcgtacccccatagggatatcccctgtaggatataaatgggtgttcgtccgaaaacgggatgagaacaaccaggtggttcggtataaagcgagaatagtagcacaagggtttactcagagacctggcatcgatttcgatgaaacctattcacctgtaatggatggaattacattccggtttttaatatctatggcagtcaatttgaacttagaaatgcagttgatggatgtagtgaccgcatatttatatgggtcattggattctgaaatctatatgaaagttcccgacgggattcaagttcctgaagaaacaaaacgcaacatatatagtgttaaattgcaacgatcattgtatgggttaaaacaatccggtaggatgtggtacaaccggctcagtgaattcctagaaggaaaaggattcatcaagaatgatgactgtccctgtgtgtttatcaaaaaaatcagaacatggattttgtattatttctgtatatgtggatgatctgaatatcatcgggaccacacaggtgattaaggaagctagttcttacctaaagacggagttcgagatgaaagaattaggtaagactaaatattgcttaggtctgcagcttgagcacactcctgaaggggtattgttacaccagtctgcatatatccagaagatattggagaaatttaatatgaaggattcatatccgacgagaacccccatggtagtaagatctctagcagtagagagtgacccatttagaccacaggaaaataacgaggaattattgggacctgaatgtccatatttaagcgccattggagctttaatgtatctcgcgaatggtaccaggcctgatattgcatttgctgttaacctacttgcaaggttcagttcagctcctaccaaacggcattggaatggtgttaagcaaatcttccgttatttacgtggcacacaatatctcggtttattctttagaaaaaatcaagatttaaccatggtgggatatgctaatgttggatatctgtcagacccccataaagcattgtcacagactgggtatatgtttctctgtggtggtacagccatctcatggaagtcgacgaagtagacgatggtcgcgacatcaacaaatcactcggagattatagcattatttgaagcgagcaaggaatgcatgtggttgaggagggtgatacaacatgtacagaatacatgtgggctgaatatcacaccaactccaaccattatttatgaagataattcagcttgtgttgcacaaatacaaacgggttatgtgaagacgagtctcactaaacatatatcacctaaattcttctatatgcatgaattgcaaaagaaagaagaaatcaaggtgactctcaccaagactagtgaaaatcttgcagatttatttactaagtctttgccaactagtgtttttgagaagcttgtgcatggcatcggtatgagaaggatgagagatgtgcccaaatcagggggagcacttccctgactgtattccgttgatattgatcatgcagatcagtacatcattcttgaagaatgatagagttatccagtagattagcttatggttgtactctttttcccttaagtgagatttctttgaagtttctcacatttaggtttttaatgaggcaacagtgcaatataagtagcatgtactatgtactctttctcctattccttttctcccactgggtttttggaaggagttttgatgaggcatatatataacgcggtattcgcccaaatgggagtgttatgaaaccgatctcccgaaggagtcggatttgtaggaccgtgatcgtgaggatcacggtacctcctcctccttcttctgtttccttatgaataaagtgggcttataccaaatatatatgtatgtatccatatatgacatcctattgtgggtataaaaacaatagtgaggttgagggtaaagtaatacttgtaacagagagagaaacatcaataaagttaattgccctccactttcgtgtccgtgtgttcgtgtgtgcttgttcgattgttgacaacgtgaattctaacaactagcacaagcgcccccccaccccccaggccactaatgcgcacccctagtccactgttcactgatgtttctatatatacgtataaactttatatatatttatataaattttatatgtatgtatataaagtttatatatatgtatgtaaaatgttatataaagtggttttttaaatcataaacactttattaaaaaataagagtttagataaataatcctaggacatcgtcgaataaatcagtttaaagcattagaatcaaaagaacagctaacaaaactaacgaaacaaacctcacaatgaaaccaaacaaacagtagatgagcaaattgacaggggatctgcggcgttgccacagagttacatccttggcctccttttgacatgcactccgcttgacaaatcgatgaccaccttctgctgccaccataggaacaaacatagctttgctgatgaacagtagattttcgtgtgagcttcactagactcagcaaaagcatatccatggagtttgccattgaatatgaggatctcagcctgcaatcctgccaaccaaagttacacatttgattcatactcaacccgaacgataaaccctctatggttactgctgctaggagacaaatagggctatgatttccaatagtgaactccaaaatgaaacaagcccgacactacataatggcatgagaagagaagaaattgaagaaactctaacataacctacttaggggtgggcaaaataagaccgaaccgaaaatcccgagactgagaaattcagtcagtagttaggtctcaaccaatgaaagactgaaatttattcggtcaattttgttagtgacctcggttaaacgaattgatcgatataaccgaattttgatatgtgatgtaatgcatgtcatgtgaaattgagaactaagtgcatgatgcttttggtttattcttgctacttgatcctatcttttgatatttgtttggtgtttggtgttgcctattatcttgtatttttgtgatatataactgtcaaaagttgtctaaaagaggttcagtgctgtcaaaatttatcattgcaaattttatctcctggaactggcacagttcggttaggactaagactgacaattttgcgttgttatttttcttcactttttaatgaccgaactgacaactttgcattgttatttggacttcacttttttatgaccgaccgtgaccaaaattttcgatcgaactgaatactcaccctaaacctactgacgaactatgcccaacccgaaaacctaatctagtgaggaaggtgttggcaacttttttgacaagtcgacaagcacgatcgcagcacctaaacgctttgcggtgatatggagtcgccaaccacctcgatctagccaaaaggccaaatcaagatgggtttttgtagaaaatagctaaaccggctatcggagccgatttagagatcaaaatcagcctctaggccgatttagatcgatatgaggataaccacccgtctcgtgggaaaacagaaggttttcaggacaagcctacaaagaggtgtcacactctcgcagcggtggcggacgttttacgacgcaaaccgacaaagatggactaaaactagggtaaagtagaaaacatggctgaaaagtaatgataaaagaaaaggcgattcaagtagattgtatgtttggggtattacaattgaaccggtcttgtctcttaaataggggttagtctctctctacatgcctttctccatgtccaactcaggatagaaaccaaaagaaaactcggaacatgccttcccaagcaaggaaacccgagacccaataaaaacagactcggagcagacccaaagaaacccaaaacatgcctttccaagcagacccaacgaaaacagactcagactcggaccctaacggtcagaccggccacatacctgcggtcagaccggccacatacaagcctccgtctcagtaaccttactactttgctcttgtttatctttgtttatctgtgtagatgtttgcttaaggccaaagggtgtaacttgcagggaagttaaaaggtccagacgatttaggagaggttacattcggttaaatttcattatacgagagtacgagacaatcgccaaacagaatatatcttaatggctacacataaattgagccttacatgcaaagatcctcacgggaacacacgctcatcattctaagataacaaaaaaaaaatgactaatgcttgtataagcatacgcatgcatagtcctcagcaccatgtctcaggcacacagacaaaggccacaaaagagaaacagaacaactgttttcgtcgattccaggatccagagaatgcagtacgtattaggaaagaattgaactgctaaacatgaggcattcatcaaatcctatgagcagcaatatatgttttgtagcaaaaagctggtagaatgtgtagtaaggtattggacaggttcatcacaacatgcccacgggaacatcatactgcaaatccttgtgcaaaacgaccacaggttggggtaggtacaaataatacggagaagataacgatggagtgaggtatcattacaaaaatattgggcttgccgaagacacctaacaagattgaaacagtgttcgtcctacgtatgaatgagatacatgcatagctcctagtcagctcgaagttttacggtcggagttccaagcctcaagcctgtgcacaacagcaaagaaaaggccaaacaagtatatacattagaactttgaacaggaaacaattttactagcctattatcggaataatctccagaaatgacagaactaaaatgataatgaggtaccttgctagcaatgttgctggacagccaatccaggccctcgtacagaccctcaccagttgtggcacaagtgctctggatgtacctgtgaggaagaaaacagatttagatcaagaatataaaaccatgcgtcgcattctagtttctagatgcaggatataatgaatacaagagtatccaagggaaaagtgaggcagtgagttacatcaatggtaaaaaaaaactatgaatcacaatccagatgcaggatacaatgaatttaaaatagtattgtattcgcttattggagagcttcaagctatatccacagcaaaaacaatatataagggcaagaatccattggtggtccttatttaccagtgtcgctggcgaagggagtgcagtccaagcttgagtattctatagtgtcacctannnnnnnnnnnnnnnnnnnnnnnnnnnnnnnnnnnnnnnnnnnnnnnnnnnnnnnnn

SEQ ID NO: 62814 - DNA, 773 bp, Oryza sativa
  unsure (1)..(773): unsure at all n locations
ccgaaccgaaaatcccgagactgagaattcaagtcagtagttaggtctcaaccaatgaaagactgaattttattcgggtcatttgtttagtgacctcggttaaccgaattgatcgatataaccgaattttgatatgtgatgtaatgcatgtcatgtgaaattgagaactaagtgcatgatgctttgggtttattcttgctacttgatcctatcttttgatatttgtttggtgttgggtgttgcctattatcttgtatttttgtgatatataactgtcaaaagttgtctaaaagaggttcagtgctgtcaaaatttatcattgcaaattttatctcctggaactggcacagttcggttaggactaagactgacaattttgcgttgttatttttcttcactttttaatgaccgaactgacaactttgcattgttatttggacttcacttttttatgaccgaccgtgaccaaaattttcgatcgaactgaatactcaccctaaacctactgacgaactatgcccaacccgaaaacctaatctagtgaggaaggtgttggcaacttttttgacaagtcgacaagcacgatcgcagcacctaaacgctttgcggtgatatggagtcgccaaccacctcgatctagccaaaaggccaaatcaagatgggtttttgtagaaaatagctaaaccggctatcggagccgatttagagatcaaaatcagcctaggccgattnnnnnnnnnnnnnnnnnnnnnnnnnnnnnnnnnnnnnnnnnn

SEQ ID NO: 62815 - DNA, 956 bp, Oryza sativa
  unsure (1)..(956): unsure at all n locations
cgagacccaaatttcccccatctgagtcatctgaccatctcctccaacctccgccaatccccatcggcggacggcggctgctgcggtgcgcgccgcgcgcgggaaggcagggtgaggtgaggagggcgtggccaccaggcttccagagctgcggctgcggcatccgctccggcaaggcggcggcgcgaccagccgccagggcccaaatgggcaggcgcgcagcgcaggaagagcagagacaaaggcagggtgggacgaatggcacaacagcagtgcaagcgtgcagcaccaagcggcgacagcaagcaagcggcaagccaactagccatgcatccatcactccatcaacaggttcaacatatgtgaacattaatcaatctttggtaatatatctgtcgatactcagtactgtacttcctatttgtgatgtattgttgaaagcgtgaatcttaggaagttgaggtatttttttgagtacctactcttctatctatacttgtttgcaaatagatgatgaatcatcaacttgtaattagttcttgtttaccatgcttaatgtagacttgttaagataatattgcatcatataataacgtgcattgagatttttcgttctgtgctaacttccatggtaattcgtaggccacacctaaaattttttccgtcctccgccactgactatatagctaatcagctatacctcaatgcatggctcatttgtagataaataataactagcacagctaattgcaagttatcgacgtctttcttcgatctgcatcgactcacatcacaccactgtacttctaaacactactccatcacccttttcgctaaatctggttcattaattcctcttctgggagaatcataagtccctggtgcctcctaatcctaagaaaataaatagtgtctatannnnnnnnnnnnnnnnnnnnnnnnnnnnnnnnnnnnnn

SEQ ID NO: 62816 - DNA, 1107 bp, Oryza sativa
attttatgtctggttagttgctaaatgaatgaattttatttctggattttgtgatgcttgtggccttagcagcaccagttgaaggagatgcaatgcgggatgagttggtggtgatgatggggctggcgcgggagttgacggccatgcagcgagctcgagcaatgacttgatgacatcatcgttgcaatgcttaatagcgtagctcaatggcggccctcgctcgcctaatatcacgcccagaaattcacgagtaattttcgaactaatttgtacattaaatccttgtccaggaatcagcccaggtacacaaactgacaatttaatatacagattcatcaaaataactaaaacgataaatacttacataaaaggcacttagtcctcatcacgaagaaaactgcaacggaaaacaaaatctagcgaagcttcagctccactcccacaggcagctcaactgggatctaagccaaaggtcttctccttctggatcctttttcttcaactgagatttgatgattattgcaaggtgagtaaatgacatactccgcaagccacacagcaagtatgcaagtgcataggaataccaaaggatggcataatatagggttcatttgcgaaagcagcatttagcaaagatttaagagtagtaaaactgtagaataattaatcatcaatattaatcaatcactgaacagcacacccaatgctgcacaggcccaaccaaacctgaacaaccaactccggtcgtacagatcaaacctccaaaccaggaattagccattccaaaccaggagccaaattaactttcacattattatcattgatgagtagtgtgggactaatcacgaaaaatattgttagacccgcccataaccacgggcacggctattcgaatagttttactctggccagaggtgtaccactgtacccacaagacataacctcaacatcatgtctaccatgcgtcgccatactggaaagtacccgaatagaggctgtgacaatactccacacaacacaactcaccacagtgcaccgttcctgtatcataatcaccccctcaataaccagaggcatggactccccagcgacccccacggacttttc

SEQ ID NO: 62817 - DNA, 5093 bp, Oryza sativa
aactagttgataccccgcgctttgttgcggaatatgtgaaagaatgtatgttatacattacagatatgatatatgtataggatgaaataatgtgaaaatgatgtggagataatgatttgacattgcttgcatattaagctctaaaaatataacaaaattgaaaatgatatatcatgtttgtatgatatttaaagtactctagataataattgctagtgggtgataatatggtacactggcatgtaatttaaaatactctagataataattgctaatgggtgatgatatgacatgcttgcatgttgaactttagaggttagtgggcatttacttcataataacataggatttgtggacaagtgattattattaagaagtttgtttctattggattgtttactgtttcatggtgtggttgctgaggttgtgttcattgatatcgcaagatgtagaggccgaccgagatatttattccattatctagaaattcctcctcctaacattatttatttccctgtgatgaattttatcggcaatggttgagtgaatacacagcctagcttgaaatcctatatccactactgcagacagactttgatagtggtgcagtggtgaattccagtatatgtagccatgatcatgttagaattaaatcggctaggccccatttaatcttagtaaatttcatgggccgacaaataatgttaaaggattaataccaccttatatacactgctaattcagagcacttgttgagcggttgaggtgatggtaggactgccacacatgcgcgcgtcaagccaagccatggccgaggcctaagcatgggtgcagtgcggtgcggacggctacctgtctccctaacattttgctttgatgagcaaaggcgtaactgacggcgttaatcatgacgttactcaaaaatggacgaaatcatcataaataatgctttgatgagcaaaggcgtaaccgacagcgattaatgatgacattacttcaataacagacaaaatcatcatcattaataaattgtgtcaactccctgtaacgttcctctttcttgcatgcatccttatcacctcctccgggatagacaaaaagaactctctttttggttcatctcatatgtgatcctcccgttctttatcggtacaccacaccaactccccgtaacattcctcctccagtgattaatggtgatgttactgaaagtaaaggtgtaaccgacggtgattaatgatgatgtttctccaataatggacgaaatcatcatcattaatcgctatgaactccccgtaaggccgtaacgttcctctctctcatgcgcatccttatcacttcctccgggatagacacctgtaacgttcctctgtctctcgcgcatccttatcacttcctctgagatagacagaaagaactcacttctcggttcatctctcctatgatcctcctattcttcctcggtacaccacaccttctggtctgttcctgcactacttctgcttttcctcagttctgagcacttgcgcgcacgagtgctcagaacgagcagtcctcccgaactccgtccacctgaggacttgcgcgcattagtgctcggaacgagcaggcctccggaactctgtccacctaagaacctgcattggtaggtgagcgattatgtttttgggagcgtgttcttcgcacaactactctcggtactgcatcctctttgtcaaggtcttctctctctacaacgtcatgtctacccggtgccagtgctactggaggaggagggaatggtagcactgtaggaggcaaaaccgagaacgtcaacatcaacggaggcaacaccaatgcctcatcattctctcgagtgttcactgggtatattactctactcatattagtgttaaatatgttactagatgatgctattactgttattagcatgttcatgtttagtactaatcattggatcactccattattaacatgtcatgcttactatgttatttatctggattaaaatatgccgaattatatatgactatatttccagtgggggagaaagccccatttcaccaatgtagaagtatgggcagcatccatgaagcgacaaaccagaaccagggcaggaggccggtggtgccggcagttgccacaccaacgtccatcaagcgcgcaggccggaggatgagtggtgggaaggagattgctttaagatcctcgtcagctacctgtcacaataccagaagaggcctccagagatgagggattagtccgtgttgcatagaaattttttcgcagcttctcccccaatgttacgagggctaattttctgatgattcccaatccttacatccaattttggtatctatgagcatatgactgaagcagcaattgatattgccatgcaggtttacaacagtctggattgcttacaacaagatatgttactgagaaaaataagcacatgtggctatataaatggtctttcatccatggtgtgatctccaatatagtgatcttcactgaatgcaaccttgctttaaagtgcagcagtacaaagctttcagttaaatttgaagacagtaacatgcatggatagtgtgctatggcttcattgaacttgagttggctacttgtgtggttcgcatatgcatttgcaaaatatacaacaacaacaaaaatgaatttcacctaaacatgaagatatgcttgtactctggctctctggcctactttagtgtctaaatttacttcgtgtgcaatttcatacaactagctattagtttgaatcttgctgctaaacttgtgcatagttttaatggctaagccaaaagcttaacctctccaatctgcatcagtaggttatgaccaaattgagcattgtatgaatccctcacaaggaggatacaatttaggtaaaacagaacagccttcgggcacatatggctgcttgagacaaaatgggcggtatagtataaatcacatcctaattttgtgcaaaaaacctaccgtaaacagtatttccgagagggtaaatttcctgagaaagtaaacagtatttccgagagggtaaatttcctgatgattctcagtcctatctgctgagacccagttcaggtatcaaatggctagagagcaacactgtcatcttccttctgctaggaattccagatgccttcaaagtttcagtgaagattctcaatgtttgttttcttggaagtgagtgagagttcaatgtggcaagaatgagggtcattggaggttatctgtttactgttggaaatttggtcataattcggtatattttaatctaaaatattaagacaataaacatgacatttgtaatttgagtagatttagtggcagtgctagatgtgtacaacatgagcatgtttaatatagaataagcatcaacatagataagagaacgcaataatattgcgactgacagttgtaggaaacgaagaacgaatggtaatagtgaaacgttataccccgaaaatagccctccgctggagtttgaggcagtattgcctccgttggtgttgacgggaggctccttctccttgtctccagtgttgttgttgtcgccggttgtcaatatgttggtgaagatgatgcagagcagtcgcgcttgaagcggtacccaaaaacttgatcgcccgcctacccgttcaggttctcaagcggacggagttttggaggcacctgctcgttccgatcacccgtgcatgcgggacgaacagaactggggaaacagagagacaacgcaggaacagaaggagagtatcgccaagaaccaacagcaggaggaagacacaatctttgagagcctctgccttgcgttatatatagagagagacatctccattaacacacaaataaatctcatttgttgtgatggttaccacaaaataaatctcatttgttgtgaaggttaccacacaataaatctctcatttgttgtggatgttataacacaatgaatctctcatttgttggggaggttataacacaatgaatttcatttgttaatggtgactttattctcatctgttacaaaacggaagagcagcaggcaggctcagctcggtcggccacctcgcctcgccacgcccacggccgaggcccacttggcacgtgcgcgcgtggcagtccaaccatcacctatactggtcaacagtgaatctccatatcaccctatttaagtcgaggttcttccacctaaattttcaagacagtattattgtctctaacattacttgtgggctcttgatattttaattgaattaaattgggcctagcccatttattccaataattacgtggtgtgtcgtttgttgtgactttcttcttatatataatctatatcctgaaggggttgacctatactttctataaagttacagcccattaactctaaatctcaacacgcaaccatgtcacatcattacccactagcaataactacatatttaaccccatgcaaacatgcaacatcatttgtaatctatttaatttccacaaattggcatgcaagtatttgtaatatttagcatatattttagcaatattttaacaaatctatctatcattttataatatttaacatatatttatcaatatgttccacattaaagcacgggtatcatttgtttgtttcatgataagtactgaaaaaccctgacgtttcttttttcttaactcctagctctttgattttcaatgaattcgaagacgaggctggcaaaatgggagtactgtgtgcattttgattgatagtgtaaaacttgaacattaacttttttactagagaattcattattagtccacggaaactgttgtccatttgtaatatgcatgaattgttgaaacaaatttcatactgtttattccatacattccttacatctgataatatatagcagaattattgcacacttctactacagaacagccaatgcttgacccctataacatctgaaggttctatcagaaccatttcagagtctgagatttagcttgaagtcataaaccgttagtgattattccaaagcttggaagattaacaggaacacatcttagagattaatcagccatct

SEQ ID NO: 62818 - DNA, 7426 bp, Oryza sativa
tatcaatatgttccacattaaagcacgggtatcatttgtttgtttcatgataagtactgaaaaaccctgacgtttcttttttcttaactcctagctctttgattttcaatgaattcgaagacgaggctggcaaaatgggagtactgtgtgcattttgattgatagtgtaaaacttgaacattaacttttttactagagaattcattattagtccacggaaactgttgtccatttgtaatatgcatgaattgttgaaacaaatttcatactgtttattccatacattccttacatctgataatatatagcagaattattgcacacttctactacagaacagccaatgcttgacccctataacatctgaaggttctatcagaaccatttcagagtctgagatttagcttgaagtcataaaccgttagtgattattccaaagcttggaagattaacaggaacacatcttagagattaatcagccatctaaatttaaccatcgtgcatgcccatctttgtgagactgacatatatataatcgtagtaaaaacattgtaaatggacattaggaatttgtttcttcacgatggcgtatttcgcctaatcaatgtctagctgcataaatcgctgtggtggataaatgtcaagaggactttcaggatgagttcacgaatctgcgtagagactagaatttggatctacacaataactcaactgtagaagtccctaacactgtcatgacggctttactgatacttctcaatcctaagatccaatatttggtacctatgactgaagcaccaatgcttctatgcaggctggacattctatattgcttctgttcagatgatgattttcaccaacaatattactgaacgactactgaggaataaagatgactcgttatatagatggtccctgcttaattccatagtgtaatactaggattgtttttttagcaaatacaacagttgaagggcatgtttcaggtgagctcagcactattcttttatagaactttctatatattaatttcatagagtattttttttaaatccatttttcaattttactatgtgtatttaatttgtttcaatggcaaatcgttgaatcgggcaagcttcgtggcatagagtgaattttctctaattttaaagggtcgtcaccagcttaacctttccatcagtatgtattaactttggctcaaagactgcataacgtgtacaagtgatgagaaaattctataatactcacgtcacattcacatattccctttaacaacctctatctatttaacttacttgcttattaagatctcatatatgtaagcttcattttggatctctgaatttactgaaacaaattgtcttttccttccattaaaatctgaagaggaaatgaactgctctccaatcccttttgattggatcaagagcacaccctctactacagctctacaatttggttgagagcagtggtcaggtgaatccgcttcctgtagcccagccgctgagcgatgaaccaaatgagtaattcttgcaaatgctgggatatttctcagaagcacaccatcatttgcatccctgagatgatgaacaaagatatggcacatccattttccccggttctgagcacttgcacgcaagagtgctcggaagcaagcaggcctcccgaactccatccacctaagaacatacgcggacgagtgctcggaacgaacaggtctatggaactccgttcatctaagaacctgcacgggtatatatcccagccgcagagcaattaaccaaatgagcaattcttgcaaaagctgggatatttctcagaagcacactatcatttgcatacctgagatgataggacaaagatatggcacatccatattcctgacgcatcccaatccctgcattggctcacactgaggatgaatttgagctcttcgtggttgtgaagtcttggaaaaaaaaacaatggacatgttactgacaacggtgtaatatatacagcaaattcttggcacgcaataatgaccaaagttaagaagatcgtcaatttaatgcatctgaaaaatatcaggaaacataatgtatttcagaaattaatttgggaactaacttgtaatttacataattcgaattaaatacttatatttcaaagttttgtttcttgtgttccatctcttgaatacttcacaagtgtgattgtctgttgctccctccatttcgggtctgttcagtgaagcaccaactcctaaatttagcttcagaagttgggtctggagtatagttgtgtagcaatctaaactcagctccacctccttattttattttgtgagtgtgcctcacctagctccgctcccattttagatggagctaaaactgtttggctgagctctaactctaggagaggtggagaaggagctagagttgtgccaaacagacccttcatattatgcaaaatttgctacatgacactcaaaatttgtataatttgttgttagacattgtaaaaacatgtcatgactgaaagacactctaaaacactggtaatttgctagaggacactttcggctcaattggagagagaattttttaaaaaaatacaagaatgtccctagagtcaaaagcttttgagttgagactggagtgaagatggaatatgatgtacgctaatgatgtacttggggtgatgacatctaaatttttactctaacgtcatgtttgaaacatgtggttctaggggcattcccgtctttcttaagaatttatctctccaatttagccaaatatatcctatagcaaattatcatattcaggatatctttcattaatgacacgttttttatgtctgtccacaaataacacaaattttgagtatcctgaagcaaaatttacctttatattataggtcgtcttgattttttcttagtcaattttaatttagttgaccaagtttatagaaaaatagaacaacatccaaaataccaattttatttcattaaatatattttggtaatatatttattttgtgttgaaaacgctgttataattttttaaaaaattgaatagaaaaaggtcaaaatgactaataatatgaaatgactaaaaaaggtcaaaatttggcacctgtattgccccctcctgtgtgctgtagcttcagtaaatatgagtttataattttgtggttcacatgcttatatacaaccacaaaacttagaaaaataaatgtcacctaaaaataaagatatgtttctactcactctctgacctacttgagtgtttcagtaaatatgagctcctccttggcggagccatgctttgtggttctcgacgtgctcgtccggggccgtcagttgtgcgcccgctcttctctccgcgacggcggccaccgcggagacaccatgctcgctatacatcggggctgcaaagttggtacgcggagatggagatgaaagaggcggtgtcaaatgaaacaatccaagtggatgagaccgaatcagccatgcgatagtacaaaagtacccttccacctccacatcctaatgcagtgccaccacaagaacaagtgggtgcctcacgatactcagtgatgacagccgttggatcctatccactcaatggcgacgatttggtaccgcatcggcatgttatatggtaaaaaatctcttacttttttttttttgcaatctctccaccaattgtaattttgaatctggctgctaccactttatgcataattttaatggctcaaccacaagcttaaccttccatcagtgggtgatcgctatcttgaagactgaagagtacaagataatatcccagatgttgttagctttcaagacatggcctcgcatcaatagggataagccaaggcgctatgacaattagcaacaaacaaacacaatcagaagatcacttcgatctcggtggaatggaatagccagttcagagatggcggcttgaggccaacaaaaacttctttcagtggcggagccagcattgtcatcaagtctggacaactaatagcgtttttcagtgatcgattaattttaataggtgtcaacagctgttcgtagtggagacgacatcggcagagcccgacctgcccaggtggtggctccaccactgatttctttctaatatatatccttgatgcatccctaacggatggttacagaacatctcctacccacagacaacaaccctcctggagatgaaaattctgtgaggataaatttcctgatgattctcagtcctaactgctctgctcagacccaatttgtgtatcaaatgcaaatggctagagcaacactgctatcttcttctgctgggaatttcatgtgcttcaaattcccattgaaaattctcaatgtttgttttcctgaatgatgaaggagagttcactgtgtgacaagaaatgagggccattggtttacatataatggctttctctgtttatatggtgtgtccattgttctgattttcatttcataatctggctcctgacagtgctgatttaaatacagaaaggaacaccacatactctttgattacgagtgaacttgaagatgacactggcaaaatgagagtactgtctgacgttgctataagctcctgcaagcctacaccagtgagacccgaggccttctgctctacacctctcaagcccatgtgtttttcagttctccaagtgttaatggtgttaactaatatttttcacgaacgccaattaactaatatttctgttattatttagacaatttcattttctcatagcctttgaatggaatatttgtccaactccaagcgttgatatattttctatcctatgaagatatttcttttgttcttccaccgatatattgggaaatatcttcttattactgttgtgtcttttgctcaaaactatttttgtccatgacgatcatatactaatatattactccctccgtccctaaatatttgacgccgttgattttttttaaacatatttgaccgttcgtcttattcaaaaaaaattaagtaattatcaattctttttctatcatttgattcattgttaaatatacttttatgaatatatatagttttatatatttcataaaagtttttgaataaaacgaatagtcaaatatgtataaaaaagtcaacagtgtcaaatatttagagacagagggattactaaacatgaaaaacaaaggttgtgtgctctgtaacacataatattttttttgtttaataaaaagaacaattatctaatgtattacgtattaaacacgaaaaaacagaggttttgtgttcagtaacacataatattggccccctctgcattttgggtcaagctccaccactgatcattagcagcaaatgtgcaaacatggctgaacccgcacaatccactaccacagcatcagcaattatatgtttcaagcctaggagatcccagacttcctttgctctttcaccagtgaaaaaaaaaatgcaaagtatcttcacaaaaggttttacaaagagggcataggctactcacaatcagatgtggctacttgagaccaacaaatatttattggtttctaatatcctctattcatcactaacggatgattgcacaacatctactacccatagacaacaaccctactggaaatgaaaatgaggtgaggatgaatttcccggtgattctcagtcctaactgctcagacccaatttgggtatcaaatggctagagcagtgctgctatctttctctgctagaagtttcatatgcttctaatttctatcgaaaattctcaatgtgtgtttcacgaatgtgaaggagagtttacagtgtggcaagaagtgagggccagtaattggtttcatcaggatggcatatttcacctattcaatctctagacgcatgaaactcagtggtggataactatctttcagcattttctaacaggctcatccggatcacttcaccgtttcactggctggcgggcttggttgaaaggttctctacacaataataacccaactgtagaagcccccaatgcgctgcgagcgctaatttcctgatgcttctcaaccctaacatcaatccaaaattttgtagctatatatatggctggagctgtggatcagcaatgttgctatgcaggttgaacattctagattgcttgcacttcagatgagagttcccaacaaaaaagttgctgaatgaataagcatgtgcccctgctcctatggtgcgcttttaaatattgtgatttcactcaatgcaactttcgctataaattgcagtactacaaaacttttgtgagatcgaatacaagaaccaagtctaccaaagggaggtgaatggtagaaacactaaaaacaaatctttttgcacaattaaaacattaccctcaagcgtgacaaaattgcactgtacctcggtctgactgtcagatctctggtctgaccacagtatagccgctggtctgaccgccgccttgccgccggttggaccgcctctctacgccagttagaccatcgctaagccaccggttagactgcccaatgaactccaatcaaaccgcttcctgaaagtatatcaactttattgcatcaatatgtgtttacaaagtgtatctgaagtacacctctctcaactcacgaactaggattgaaacctcgaatcaaaccctaacttttatctccagaaaaatagatctcttctagcctcaactaggactcctaaccatgaatccaactaaaactaggactcctgatcacatatataggaaacctaccatacctgggaaagaacatccccatacaattccacactccaatcttcccaaacttagactccaatccaaattttactcatctttccgtacgcacacaacactacgttcaaatgtaacaattatgatccaagtatgtatgatatgtgttcatcgatcaaattatgatatgtgtaggatcataatttgataccttgaccaagtttcgtgcttcatcgattgtgccagaaagtgctcctggattcacaataatcttggactgcaattcttgaaacttcccctaggtgcaccgccgcgcacacggaatgatttggctctctggaatcaaaaaaccatgttctttgacagcttcatgttgaagttggaaagtagaccaattggaggtgttagaacaaagcagtggatgaatctgcaacaaattttacaaatgctcccttgattttttatatttttacatttggcatgatctctatgtattcgagttactcgcttattaagatcacctacatgcatgatgctttaggcttcgttttggatatctgaattggccgagttgaattctgttggacattcaattcagatatactgtggggaaatgaattgctctccaattccttttcagctattaatcttttttttgaagactcttttgtgt

SEQ ID NO: 62819 - DNA, 1774 bp, Oryza sativa
tcaggatttggaatgtcattggtggcgggcggcttctccactcggtggagagccatgtcaagacggtgatggccctcgcgctcgccaagatgaccaacaccggcgagacgcggctgcttagcgcggggagtgatggttatgtcaagagctttgattatggcgagcttaagctcacgcactcgatgcatatcctaaggaattgctttccttggcgtgctcgccgtgtgggacagtgctggttgctggatcttcaaagggcacaatttatatgggtaggaggaaaaagaagtcgacaggggaggacgaggaagagggtaagggtgttggtggtgagcttgattgggcaccaaccaagccggagaagcggcggttggcaccgtccaactataggtacttcctccgtggacaaaatgcgaaggctaaggaaggtgaccttgtgattgagaagcctaagaaggtgaaggttgctgaacacgataagttgctgaggaagttcaggcacaaggatgctctagtttcagcgttagctcgaaacaatccaaggagcatagtggcggtgatggaggagctagtttcaaggagaaagctggtcagatgcatcgagaacttggacacggaagaactcgttcttctcctgctgttcctgcaccgaaatgcaaccttgccaaggtatgccaggttcttgatgggggtggcaaacaaggtgctggagatgcgcgcggatgatatccgatcagatgagaacctaaggggttgtgttagaaatcttaagaggatggctgcagaggagattcagatacagcacacattgcaggggatccaagggatgatttcacccatgcttgcacttgccagtagatgaacaggtgcttttcttgtatcggaattcttttttggtctgttagtttacagtgaggcatgccacatacatgatgatgtatgctagtttacaaactattatcgccactgaaattttggctgtcatccaatcgatatactctgttgtgccgcgaaaagttttgatcagttcattccagctatggtcatgtttgcactatgcagttttgccttttgggtgttgctatggattgttcattgcgcttgttaactatttttcagcttacttcgcatggttcagtttttgttcattatgtatcatctttgcggtgtagcagcaatgcatgtgatgtttgtggttagttctgttttgggtgaattggtggcttgatttcacattgccagtaggattcttgttgtgatgcagagtacactatttggttgtgtatcatgtccagaatgtcatatgcagactacactgttaatgttatcttttatgttattgtaaacaagatcttttgtattattgtgaaatagagtggcagtactggggtcacgcatgcttaatgatgtgctggacatggatggacaaagctaatttctttggaaatttttgggtggatataatgctttcttgtatgctgacataaatcctgatttctcatcttaggctttgaatatcattttgcctaagctattattacaacatgttgtggatgcataaatctttccatagcagagtgaaatggccctgatggatgcatctgggcagcaaacagtgagcgagttctctccaaaatgtagatattattttggccactaactgcaacttagtcggtgacgatcttcatggatatacggctaatgagatatcacaatgttgatgatcaagtgtatagtgttctaactgaattttgtacgaattagtcattttcta

SEQ ID NO: 62820 - DNA, 1761 bp, Oryza sativa
  unsure (1)..(1761): unsure at all n locations
nnnnnnnnnnnnnnnnnnnnnnnnnnnnnnnnnnnnnnnnnnnnnnnnnnnnnnttgatgcaatattccttctgatgaaagaaagctactaaattcattgtttatatactcccctccattatcagttctaataaactggacccgagcattaaaatgatttttaatgtatgcatagaaatttagaaaacatttaagcacctcatccttatgtctcataagatataaccatgtcatgcgagagtagcaatcaataaagttaacaaaatacttcattccactcatagagaccacaggtgaagtccaaacatctgagtgaattagcataaatggtaacatactccggagtcctctactcacatatgatgttcttgtatgttttccatactcacatgcatcacatactaacttatgtttatccactctacttagttctgctgggaacatcttactcatagtttcaaaagatatgtgccccagtcgacaatgcaaaagtaataccttagcctcttcttcacttgtagaagccatcaatgcaagacatacatcttcacttgtcgcctttcgatccaaataccaaagtccatcacgcctgacgtcaatcccaagtttcttccctgtttccctctcctgaattaaacaattctcacgatcaagggagacccgacaattcatatgatcaacaagagaacttatcgaaaccaaattcactggaaaagaagggacatataacactgatgataaagtgattgaaggagtacactgtactgtaccctctcccttaactgggcatgatgtcccatcagcagtttgaattgtttcttttcgtgtaaatgggtatggtttatatgatgcaaattctccacacatacccgtgacatgtctagatgcacccgagtcaagtatccaatttgaatgagaactattgatagacataaatgtttggtttgagttacctgaagaagaatgaacaagattggcaacatcaacatttgtagatccagaacaacccttttcaagagtgaccacattagctctgtgatcacttttatattcatagcctctacctctattacctctacctgcataacctcttccacctcttgctccacccctatcaccaaatcttcctctcccataactaggcttgcgaggagcgcggcaatcacgtataaggtgccccatttcaccacaattgaagcactccctggtctctttactttgtgcaactacataggtggggcttggtgaagatggtgtggcactaggcaatactttcttcttaagctcctcctgtgccatagctgcaatagcctcatccaaggtagtaagggtggtttgatgaaacattgcatcccttcttccttcaaactccgaatttaagcccttcaagaactcaatgacccttctacgctcaatccattttctcatttttgctatacaatcagggtgctctaacccaagaggatcataatgatccaaatcagaccacaaatgcttcaattcagcaacatattctgcaatagaacgctccccctgtctcaaaacacttatcttctcctgtgcctccaccattaacatcacatttccttctcctgagtagagattagtaagagttttccacatctcacttgcactagagatggtctcaacagttgtagcaatagcagggataagtgaggttaacaaccatgctactactaacgagttggtagtcctccaagtcttccattcaacacttgatatgttctcaggctcctttac

SEQ ID NO: 62821 - DNA, 722 bp, Oryza sativa
cagaagatattatgcccatgtcgtaagtgtttgaatcggttacatcaatataaaggacgtgtggaggatgacttacttatgtacgggatgtctaacacatacactcggtggatacatcatggagaaccattggtcattgtcactggaaatgttgagcatttgaatgaagatattggctgcaatgttgagcatttgaatgaagatgttagctgcaatgttgaatttgagacgaatgagcctccggatgacccaaagatgatcaaatgtaccgtatggtacaggatctgtacccagatcaaaatcatggaccaagaacaaagtcaaagtttgccaccatattagaagagatgaaacaggtgctacaccccggtggtccctatactaggttttcttttgtggtgaagttgctccacatcaagtcattttacagaatcagcaatgttgcattcagtgctttttttgaccttttaagttcagcatttccaaattgttctctccctgcatcctatgctgaagcgaagaattttattcgtgcattaggacttggatatgagtcaatacatgtgtgtccgaataactgtgttcttttccgaaaggagttggctaaaaaggatgcatgcccaatatgtggtgcttcaagatggaaggatgcagatagccgaaggaagattccagaaaaggttctaaggcatttcctttgattccaaggttgaaaaggatgt

SEQ ID NO: 62822 - DNA, 958 bp, Oryza sativa
tggcaaggcctgagggctccattgcagaggcatatgtcgcaaatgagtgcttgactgcttgctcaaggtattttgctgatgttgacactaggcacaatcgtgagggtaggaacaaagagcgtgttcctatgagtagatgtggtttatctattttccagcatggagcaaatctgttgggggcaccaaggcttacatatgagtagaaggagtatgataggatggtttggtatgtcctcaacaatactaaggaggtcgagccatttatagagtatgtccttgaatagcgcacctgtttttatttgtgtatcatataaaattttagctcttacatgggagttgtgcacctgtttgtaggatttacatgaaggatttacaaactgctggcagtcatgatgttgaggggaaccttgctaaggaatttccaggatggtttaggaaacatgtgagtcattatttaagtattttcagttttgactctgtgataatatatcattatttaagtatttccagtatattgcaaatgaatatatctcatacatatctcatttactgaagtgagaatgcaaatgaaatttacatatgtacatgaataaaatgcagctgtgctatcatgcatcattgcttctactgttgaaaaccttgcttggcagaatgaagcacatgagaggaatagagcatcgtgtgcattttttgtttttttacaacaaatgattttattagcagcatgtttagttttgagattagatgactaaattaagtgcagctgcctcttctgccatgatgacattcctgatagctccctgtatataagtctgataggatgattgttgtgcgtattggtgatggagattcccagtccagcgtccttgttcatctgtggggtgttgtcaggctgtgtggctacatccacatagcattttgttcctgtcaaaagagctggtagggctatggtgctgtg

SEQ ID NO: 62823 - DNA, 867 bp, Oryza sativa
ttcctccctctccgcatttctctccccaaaataccccccccccgccttaaaccctccgccgccgccgccgcggggcccggcttgtcgccgccatgcgccgcttcgtcggggccctccgcccgctccgcaccctaaccctcagccccatcccgacggcgctccgcgtcctctccaccgcctcggcctcctcttcctccggctccgccgccgcctcctcatcggactccgactccgccgccgccccggacgccgacttcgacagctcggagttcgcgctgccgccctcggggccgacgccgccgccgccgccgcagcaggcgcgcaacccggtctccgcgctccggaagctccggttcgacccctccctccgcgcgcgcgccgacgaggcgctgttcgggaaggagaggggtggggtggacgatgcggtggaggaggagcggtcgcgggaggttgcgctggccctgctcgaggccgcgctcgagccgcccgacgacgacttgggccctggcgaggtcagggaggaggaccagatgtcgctgtccgtcggcatcgtcggcgcccccaacgccggcaagtcctcgctcacaaacaccatggtacgtgtgttcacgcattgaaagaacaaaaatcttgtgacatggaaatggtttggtttagctcgttgtaacatttcttagaggagcattaggagtttgaagtgcagttgtgtgttttgacactttacagtgatcatagtataatcctatatttctttgtaggtttaacaaacaccatggtacgtattttcatgtcacagcattgaaaattttgtgacatggaaatggttattttgttgtagcattccttagagcaccctatatttgtttg

SEQ ID NO: 62824 - DNA, 1390 bp, Oryza sativa
cactactgaattctcatcgctagtttctgcacgtacagaaccagcgagagcaggcctccgaaaccatgccccgctgcgacgtttgcacggacgggcgagcgatcaggattttagggagcgcaaggcgtgactgctcactgttcgtttgcttcatcttcttcttggtaccgtcagtgagagcaaggactgcatccacaatagcaaccaatggcgagaaaggtggcaccgatggagcggagaacatcaacaccaacggtggcaactacaacaataatgcctcatcctcaggagcgttctctaggtatattactctaattaccttagtgttaaacatgttactagattatactattattattagtagcatgttcatgtttagcactatcactggattatttcggttttcacatgtcgtgtttattatcttttttttcttgattaaaatatgccaaattatgaccatatttccaacaatccaaaaacaggtcgagggaggttctagcgccaatttggtgtagaagaagaaccctcatgcatcccacaacaacaacaacaatgtcaaacctgacatcaaacccaaggctacaaccaattttaagaagaaaggcaagagaaaggcaaagggcaactgctttgtgtgtggtaagcctgggcattaggccaaggattgtcctgagcgcaaggacaaaaagtctgcaaacatggtcattatcgagggcggaggaacatcggggtatggtaaatttttacctacagttctctctgtttttcattcacctgattggtgggttgatcctagtgctaatattcatgtgcgtgctgacgtttccttgttttcttcttatcaggtcgggagatgttcctccttgttgatgggaaacagatcgcttgtggctgttcatggtgttggtatggtcgatctgaagtttacttcgggaaggaccgtgcagctgaagaacgtgcagcatgtcccttcaataaagaagaatctaattagcggctctctattgtgtaaagatggttttagacttgtttttaaatctaataagtgtgttgtttctaaatatggaacttctattggaaaatgttatgacagcggaggcttgttccgtttttctttggatgatatgtgtaataaagttgtgaaccatgcaacaaatgatgatgagtccaatttgtggcattcgtgactttgtcatgtgaattttgagtgtatgacacgcttagctaacatgagtttaatcccaaaattcaatttagtcaaaggatctaagtccatacttatgttcaatcgaaacaatctcgcaagcctcacaaggcacctgaggcgagaaatttggcacctctacaacttgttcattccgatctgtgcgaaatgaacggcgtgttg

SEQ ID NO: 62825 - DNA, 745 bp, Oryza sativa
tgatggtgttaatttgccaattacaacgtccattaccaataaatgatgttgttcaatgggaataatggtgtttcggtttcaacatcatctcctttacctctgtacgcatataatcagagaaggagctagctcctggatgtatggaacaaaaacacatcactccaccctgttgttgctgcactagtgcattctcatcgctagtttctgcgtgcacagaactagcgagagcaggcctccgaaaccacgccccgctgcgacgtttgcacggaggggcgggcgatcaggattttagggaacgcaaggcgtgactgctcactgttcgtttgcttcatcttcttctttgtgccgtcagcgagagcaaggactgcatccacgatagcaaccaatgacgagaaaggtggcaccgatggagcggagaacatcaatgccaacggaggcaacaacaacaataatgcctcatcctcagaagcattctctgggtatattactctaactaccttagtgttaaacatgttactagattatgctattattattagtagcatattcatgtttagcgctatcactggatcatttcagttttcacatgtcatgtttattatctcgtttttctggattaaaatatgctgaattatgaccatatttccaacatgttcatgttgatatgcttgagagatattagtgatggacttgcattcgtatgttttgctcactgaagttcaaatactgatttctgcaattgtag

SEQ ID NO: 62826 - DNA, 2072 bp, Oryza sativa
acatttagaaattttatttcccacatttaactttacttgtaaattaatgaatatttaatataaattgtagaaataatttattaaataatttataaatcctgaaacgaaaatcagggtgtgtgttgatgcgaaaaacacacaccggcctgagatatgcttaactctagtgcaggtccaaatcttggtttcgagttcgagggtatgccagttggtttgatcctgcaacgaacaagaaataaagaaacacatttaaatccataaacgatagccgatcgggcagtcaccgatgacatatcaattgtaacttagccgatgtaacgtgaattagatcagcaatgaaatataaggtaaaaggaaggttagacctagtcgatcggctatagatatcaacagtatataatatatacctcaagatatatttaaacaagtgattgggatagatcggacagcttgccgagatagtataaatcacttatgtttaaaagtaacttgaatcagatattatatatgttcatagcatagccggtgttttagatctaacatgtattggctaatactccgataccactttatactaagataacaatataaacaaaatatattaaatagagatcaatcaagtgttaagatgacttaacagatcaataacaagcttaatatatttaattacagtgatatcttaatataaagggcatatttagcatatcaagtaaacataaaataaggtaagatcggctgaaaccccgatactaccctaatcggcaaccaattaacaggctagaaattataattctaaacacgacttaaacacgacttaatagatcaaacttaactgatacaacattaagtataaaaagaagaacaatatctagacaatcaagtcattggatgattcatagagtggtggatatgctatataatctaagtcaacattgagatctagcttaatcggccgccttccagtgatagatgttagccgatttgaggttagatagcaatattgatctagattatatagaatatatgataacttgacgattcacataaacaagatttgtggacatccctagtattataccatccagtgtccaacgcgaccaccacatactattggagaagtgggatctatacacgcataaatagccactcatcctcaatgtgtccattatcacagttgacaccttctactataataaccggaatgccgagtagtgactgcgagagataaccataagatagcttgccagtccactccgtcatatgctcgtcaaaccatatgaaggcggcgaccaaaaacataccccagtaactcgatccaaaagcgctatccccaagtatctcaagcgatcaaaacctgttactcatgcttagctagtccccaggaatgcgactagcctcacactttcatcgcaagccattagtaaacatagcaagtaccataatagggtttaagtgcagcaagatacatgacacataatagggtccgaggtcccaacatacaacacataaatatagcagcgaaagtctcaaatagagttcataagcaaaagataaaaccggtggtgccacaaccccactagggcaaaccaaccgggcaagagccaaactgcaagagatcactcatcgccctcgccgccctcggcagagcaatgaccacacaagaagcataactcataaccggtatcctcacctgaaacagcggcgccgggttaagtacaagattgtactcgcaagtcttacccaaaattaaatatacataagggagagagaagtatgcaagctttctagccaacagtgggtctctaggttcaacatttgcataaagctaattttattgagcaattaatgagtaaaataagtaaggacaagtaaatctagcatcatttttatttatggacagcaagtatataattctgagatgtataagcaaatgagcccaaacggcgctctcattatcaaccatggactaccaaagtccataccaacatggcacaacatggcaacaccaccatcaaatagaatcccatccataataatccatatttggtgctaacataactgactaacacatc

SEQ ID NO: 62827 - DNA, 1805 bp, Oryza sativa
gaattttctacacatttgtgaagttagtacaatttcagcacatgttgaaaacagttttccattaagagtcctcgaacttcctgaatattacagagtggtcaaggctacagggttatgtgtcttggtctgttttttgggaaaaaaccctcagtttatctaattcaccgatgaggtccctggctcgagctcacgggaggcagccatggctgggctcagtctagagcttgccgacggcgaacggaggctcggatggggtcgagttcaacagagaaactgtagaggaggaccatgcgaacacgtaggtgtccgcgctgatgaacaagctacagctacagcggtggtctgtagctcgcgaaaaacaagctacagcggcggtggttcttggtatgtgcatgcgtgtcgagctacagctctgaatgggctatatgggtgcatgcatggggtgttcaggggtatgcagtgtctcaccgtgcagctgaaaggggtcggagaggtccaggaagcatcgacggcgttggagatgcccggcaacacaatgaacacgatgaggacccgagaacgactagatctggccataaaaaccccaaataaacgcttgaatgagctagaacattgcatgcagagtctttttggccaaggtaaaggatctggagctcaccggacagggaggaacaaagccaacgtgtctagacggggctgaggaaacaaggcgagcgttctccacgcctggagctcggcttgggctgattcttgacggtgttacatctgggaggaagatgaattagaatgagcagcaccaccctgtatctcggcctggaacgtcgggaacactggaagcttgggtgacgcgacgacaccggccgcgctccggggctccaaaaagagatgtgcgttcccagagattcactgcatgaaaatcgatgaaattttgaggggagttagggcatgcataggagagcagggaacgagggttggacggcgaagaagacgaccagaaacacggcggcgacgacgaagttctctcggccagcaaggaggaagaaggaagatgggggcgaaatgaggtgctctcaccttgcgtttatttctctggaagggagtgggaggagtggagaaagtggccagaagcttagaggagaagggagagtaaagagagaggtgtcacacttgtctctctcccttgcatggccaaaacgtggcatggctattcttctgcttgtcccctgagtatgagagggttgggccactgccatgtgggccagggactgctggtgggatccacatgtcaaagagagaggggttggagaggaagagacaagaagaaaagacaaaactaagatttattccctcttctcactcatgacctgctaattcgaattgcttaggaggggattcaaattttggcctctggtccagagatgggtcttggaacatgctttctaatccaattggtttcactaaaaaatgttgagttaaataattctagtgaaaaagtgaattcagttaatctgaaagttagtttgaatttttaggaggtctaaaaagagaggaaaaattccacaaaatttatatttgttggtgataaataaactagtatttgaataaattattaaacatgtacacttctgttcaagttattgttcaaatagaagtggtttcaattttaccgattagagttaattttgttatcgcatatgatcaaattgcaatatagtaaatatgcaatctaaaagacaacaaatgcacttctaaatacctggttatgagctagggctattacaagattagagtatcatgaagataga

SEQ ID NO: 62828 - DNA, 1230 bp, Oryza sativa
gctagtcctatttatccctaatttagcctatttcctatataaatttcattctataaatcctaatttttgcacaaatggagtttactcaatatttgtgctattttaaccaaaagattcaccctagattaattttacccatattttatttttatataatttatttgaatttttaattagggccaattcttattccatcgcacttaaatttaattgttaccaatatggttgcgataatattttatttatttctatcctcacctaatctttatttaaaattatatttcaattatttattttgacaatttatttttagggtttattcctaattaattattccttactcacgattaatgaactccgaaatcaaatccaaataaaataggcgaataaaaccggcatgatgcaatttatttaaaaagtttttgaaggtccgtatttttagggttttgattttgttagtcgaattttcagcgtgttaaaataccggggatatataaagaagaatatttcattaattcagaaagtactacagaagagattacaaaagctgctagagccataccgaaactcttccgaagactccgagggactccaaatactattctatttctactccacttagcactaaactattaatactaaagtatgaagaggaaattgcttgcttgagtgtgtgttgaagtgaaatgagctcctctatttatagggccggtatgacggttattgaaaggtgagttgtcggttttgcccctgtaaccgtcattggggatgcatcctggacgtccttgtggagggccgagctgcgacgctgcagccaaagttcggttcggccgaaccttggccggcccagcaggcctccaaccttggccagggcactgacaggtgggacattatgacggttaagcagttaaaaccgtttcccgacggttacccctgacaagtgggccaccatattatccatggctcgcttgggagtgagttttcctcaattcttttattgtatttggcaattcgtgcaaaatgttattttccaagtacaagtggaaatacatattatttagaaataaaatgcattgtaagcatagctaattctccattattttagttaaattgatggtcgaactttgtcggtaacgaccatcaacagagaggattaggtgctaacatttccttggatcaaggcaagttctctcctcccaacctttgaacacattgaatcccatgatttga

SEQ ID NO: 62829 - DNA, 795 bp, Oryza sativa
cgagggtaagggagaataggagagaaggcgttagcgttagatagctcgccgatcagccaagctgtaacaaacccaaattgtgaaaacaaaaaccttagaaagtcaatataatgagatttttcatttatatttattgtggtgaaaatttattttggttgttttttttggattttctacgcatcattgcatttttgcatatttaaattaaaattgagaaaaacaaaacatgtgtatatgtgtttgtgtgtgtatatatatatatatatatactagcaaaggtgcccgtgcgttgcaacgggaagtgtacagaacaaaaaaattgagaaaaagttaaaaaaaatttacattatgtaattcattaaaatatttggtatttttaagtaggtaggtgtataattaaatcaatttacaagtaaagcaagtgtgaaaaataaaatgacatggttaaatttaatttgattaaattctcatgattagttatgctctttggaatttattggaattatcagagcttaattgctaatttttaataatacaaaaatcatttaacaaattatttaattggaaaaaaaaatcaaaatcctcctttctatgtttgggccgaatatagaaaagtttatattccctcccttttgtctattctatgtgtctggcctgttttctttctccattgaagtctattttgcgtcctccattcggtggcccaataggccggcggcccgacgtgggagcagctggagccgtccgatcgaatggacagtccagattaatcctaagctaaataaaaatacccaa

SEQ ID NO: 62830 - DNA, 972 bp, Oryza sativa
agcacaagcacctcacctcctctctgtctcctccctttttttcctttcaacagcacaagcacctccgtcgcacagctcttctctgtctcctctcacagcacaagtaccaaatccaagcagcagcaacagcgccaagcacactaccaacgcacagctcttctctgtctcctctcacagaacaagtaccaaatccaacagcagcaacagcacaagtacactaccaaatccaagcagcagcaacagcacaagcacacttactcactccttccttcacaagcacaagcacacctagcactgcagccctgctccctccttcacaccggccgcgctgcagcagccgtcgccgtctccggcgtcgacgtggcctctccgcctcaaccgtcgacgctgccgctccacctcagcagtcgacgggtgcagcactcctccgctcacagcgccgccgctacacgtcctccccaacaccagcgtctccctcctcgacgagctccggcgaggctagggtttagccgtcgccagccactagccggttggctctgataccatgaagtcttgtgattttttctctggaagcttcactttctctattgccattctcacttacatatacatgggatgggccctcttcaatagatgggccagcacacaagacacacacagataactagtctatttacagcccaacaaggaattctatacctaccttccatctttagttgagggggctgaacacactacctacccagggctgaatgagataggcataggtctgcacaccccacacctccagctagcaggctttgttcgtgcgctagatatgctttatcgctccacctttgctgagctgcaacgcgtccgcacaagggtagcaactttagaaaggagtatcttgcctaggttttgccagggataccatactccggagttcatgtatggagaagatgctatgcttgctccagcgaggacatacct

SEQ ID NO: 62831 - DNA, 2121 bp, Oryza sativa
tgcatctaaacgaactaagttactgaaataaaaactacagggaacaaaactagtggtagcagcattcgcagctgctgaaggccatctcatccctacagaagaaaatcaggcgatcaataattcaaaatcggttagttgatcaattcgtttgtatataatcatcacttgaacctagccctcatagttttaatgaagcaaataagtaatttaataattaattcacttgccttgcagttagaatataacattccagaaaggaaaatttcattgagttttgcccccaccaccagagcacgctcctgcattacttcctgtgtattaagaagcaaatgttgaataaattgtaaattattattagatcatcatagtacccatattcaattagacatccagaaatataaaatcaagtaatttgaatacctaatagttgcatattaacatcatcgtcctcaaccgtatcagttagaattgaatagggatcaccaaaacctaaaacatcagaattccaaagttcaacataaataagtttatggcccataatataagtagcaatgaacaaggtaggctccataccatctgctcgcatctaatcttgaaggcaaaccaatgcctccacagttccattagccagcctactcctatagtcactaatgattctagatccagtagaaaatgcagaatctgatgcaactgaagatgcagggacagcaagcaaatcaagcgccatgcgtgataatattggatatttgcatgagtttaccctccaccactggagtatgtcaaaatcatcatcagggaaatcattttcttgaggaatatcttcgagatagctagttaactcagtctttctttactcttgctttgatcatgaagatattgcctccagtcagcaaattggctgccaccaacattcactccactagttgatgcttcttgagaattgattgcgcttggaccaccaatttgtgaagaatattcaacaaaccaactgcggactatcctcttaattctagacagatatccatttggaccagttgccttatctccaaaacctgctttcagcctaaactcaaggaatttcaacttaaatctgggataaaaaataacaggaacacaaatctgcaggaactgcagatcccaatatttctgaaattttgtatccattttagaaaccatgctagcgacaagaacatcctcactgttggactcatttagaagcatcaccttcactttccaaaattcatgaaagtagcgagaaacagtgggatatgatgtcccggaaaccacaacagttgcatcatagaagatcttgagatgtttgcaaagaacttctgcattgtcccaatcaaaaaatagtggagcatcttgaaagtttggatcaaaccgatccaatgaatcaaaagccctcctgaataataaggatgaggaaagcatcaaataggtggaattccaacgagtggacacatcaagtgaaggacgcttctcttcaacaattccgacttgtgcaatgatttcttcaaatttttgctcacatgcttctgatgcttttatatactttacactttcccttatcctagatatggcaccactgatagtactcaatccatcttgaacaataagattaaggatgtgagctgcgcaccggaaatgaaatagctcccctttgcaaggcatggcaagcttacccaagagatttcctttcaattccacaaccatagaatcattaacagatgcattgtctactgtaatactgaacaacttactttctatctgccaatcctgaatacactttagaatttcattgaagagagctatactatcatgtgggtacgcacttgagtgaatcttatgatcctcttttgaatattccattcattgtcaatgaagtgacaagttatacacatgtaacctaggttttgattagatgaccacatgtcagccgccagtgaaacccgagaatttgttttcctcagtacctcaaacaaagctaacttttgttcttgataggcagccaagcaatcaccctttatagtaattctggaaagcaccctaaagtacgggttcaagcttgcacaaaatcttctaaaaccagggtgttcaacaaaactgaaaggaagttct

SEQ ID NO: 62832 - DNA, 740 bp, Oryza sativa
ggaggtggaccgcgccgcggaaagcgtgaggcacggctcggctcaccgggtcgactgggccaccctcctctagtatgtcgcggagaaggtgacgacagaaatggccaataggcgttccggccatgctgcctgctttttcggtgcttactggcagaggctcatctaggtgcagaggccggacctcttcagtttgttaggaaacgataagctaacaaacgataaagaaaacaatagatcaatcacagaagacacgagatttaacgtggaaaaccctcctaaagtaggagagaaaaaaccacgggcgccagccagcaaaatatcttcactatatctggggtgaggttaccacgccgcatgtaacaccctaaaaattcgacgacgaaatctaaactctaaaaatacggaccttcaaaaactttttaaataaagttgcatcatgccgattttgttcgattattttaatgaattttgatctcggagtttataaatcgcgaataatggaaaattagttaggagtaaaccctaaaaagtaaattgactaagtaaataattaaagagcaatttaaaataatatttagagaggatagaaatgagtaaaatattattaggactataattgtatcaattaaatcgaaaagtgtaggaataagaattaactctaattaaattcaagaaaattatataaaaataaaatatgagtaatattaatctagggggatcctctagagtcgacctgcagg

SEQ ID NO: 62833 - DNA, 1249 bp, Oryza sativa
ccgtttagtagtttgggaagcgtgctaacggaaaatgaggaagttgaagtttatagttggagtatagaacagggcctaattcttggacatattgctactgtgtaattggtactatttgattctgagagaaaattaacaatatgccaccctattggatgtccttataaagatgccactccatagagcataccccttaatctgtttagaggttttttgacagaaatgacacgcgaaatgacaaaagtacccctagctcctttttgcaatgttcgggtcagatttctccctcaaattacagcagcatcaaatacaaatcagttactaccacacagcataaattgcaaatcagttaccacctcgtttagcacacagaagtccaccatacaaataaattgtgcatttagcacacaatagtaaagcatttgcagcacacatcagtatagcatttgcagcccatacaccatagcacgatctgtgctccctcaaattgcagcgcacacaacagtaagcatttgcagcacataaacaaataaattgcagcaagcacacagcagcacagaggtctccagcagcacatataggcatagtattgcagcacatagcacatagcattccagcacatagcacatagcatattggtacatgaagcatcaaagagacccaaaagaaatacagttcacaagcctaacaaattcagtagttcagtagcttgacaaatacattacagtagttcacatttacaactaaaatacattaggttgacttcattttcttgggagtcattttttcttggatggtcctgcagaagtactagccatctctctcggctctctagccccttccactccagaagtactggtcactcccaaaagcattgcaagtcgcctatgcatgtatacccaaaagccaagttacacacacaattgatttgaagcatgcacagcaaggagaataattctaacttgtcatttgaccatcaacttacctccttgtaaccattccgggctttcttgcattattgtagcttcattggttgttctttgtggtgtggaaggttcaggtggaaggttctttttgttgtttttcctaggcttccttttcctgcatatatttatacatataggatgaagtaccacaaatttaaaaggatgtaaagtgaaaaaaacagaaatattaaaaccttttttttggaccattcagtgggcaattaaaggtagcttgcctatgacctttttcaccacattttttg

SEQ ID NO: 62834 - DNA, 1003 bp, Oryza sativa
tctcgttttacatatcttcccaatttacttcttttctcttctctcgaactcccagctagctcaaaagcaaaccccagaaaaatccaccggctgccacaagcagccaccgtcagaccatcacatatacacatcgccattagcagtcgagctgtcgaggtcagggagccggctaatttagcccatgcatgatagctccaattcctccatcctataaaataatttcgtatcttttacctctaccattcttttcaaaatgacatcacttctttcactttatttatatctaatccataaattaattagttttattttgttgatatttcttatccacttagaacaagttttatagtaaagatgatgatcacctctaatttatcttcatattacttgccttagatatacacccgtgctaatataccataataatatattttactatattactatattagtttctttctctcctccccgtagaagtttgtgtagagattgcttctttcatgacatgagaggtggtttctcctctctctcctttgttttacttttccatctcatcatgtgatcctattatcctacaaatacgagcgtttggatgtccgtagtacttgctctcataaatatataatattattttttcttttaaggagagacactttggtagtatatttttacttcatatcaatttgtgttatgatgataaaagatgaagttatttttggaacgcatgtagtactatagctggtgcataaggctgcggtgcagtgccaccagcagctagagatgaattgatcggctgcacaagaggagggcggctaaggcctctcagagcgcaagcaccggttgccggatcctagcccaaaaattgtcccaaagacactcctccccacagtacaagaatcctattctgtgtagcttaattgaatgaaggtactatggaaggacactgagcccacagtgggcggaaccccaagcgcatgacacgggtagtgcggaacaaatttat

SEQ ID NO: 62835 - DNA, 737 bp, Oryza sativa
ttcaaccaaaataacatttcccccaaaccgaaccaacccattttatatttttggctgaaaccatttccaaaaaccaatccaactatcggaggcgctgccgtcggcgctcgctcatcctattgatgttgatcatcagacaaagaaaggaatgaaaattgatgaattgagttacatgtatgagttgtttccggacggcctgaaactcgtcgttccttgatgagcagagcatggttgagcaactcctttgctcgcatatcatccatcatattatctttgtcttgctctagcttcttctccacattgtcttggtcgagctgcttcgacgtcgcgccaagctccggcatcttctaagtggcagcgatggccgagctccggcatcttctcggcggcggtgatggcagccttggcagggatgcggctcctgctcattgggtagtaccagcggcaacgacggcaaactgtgttgagttgtaatccaaattcatttgcacttaataaagaccagcttctgccgtagtggagcggaggcccgtcgccgggaggcttgggccggagcaaaacggatcgtcatcccttttagggttccaccatatatatacctcttgtaagccgccgtgcggcgtggtaacctcaccccagatatagtgaagatattttgctggctggcgtccgtggttttttctctcctactttgggagggttttccacgttaaatctcgtgtcttctgtgattgatc

SEQ ID NO: 62836 - DNA, 1021 bp, Oryza sativa
  unsure (1)..(1021): unsure at all n locations
tcatcggtttttctttttcccgattttataatagattaaatcttcggacaatcataactaaataaccgtagatccgttttaggtggttcaagttgttaattttttctaaaatcaagatttacatgttaaaaatatccacatgtactgtttatgcttgtttttgtactgttttgttgatttttgtttaattgctttagtttctgacgttccggaggagagcgtttcctttgaggaaggttccgaagcgtttgcggaagcccaaggcaagtcacacagatcccaaacaaccctttgagcatgttgaacccgtttaaagctattattttatttcaactatgcattgttttcgaatgtcatcgggtggtgaacctttcccaattaaataatggccgaagatgactttattttcctatgggttataatttgattagcatgaaccttatatattggattggttcagctaaatgctatatgtaagtttgcttagccatgcctagaaacatagctaattaaagggattaattataaactatgttatattaatgttttaattatggttacattaaatggtagctcacgatggttaatcgtgtgatgttaattaattgataattaaaacctggttaaggtgggttgtgagcatatggttttgatggttgtgctcatgacaattaaggaccggttcgcgagctactgttgtgaaacatttatcgtgccaaccacaagccagcgtgggcaacggctttatcttttgtatagcgtgattcattatagtgcgtcagactgagaagtggcgagaagtccacgggggtcgctggggagtccatgccttgtttataaggggggtgattatgatccaggaaaggtgcgctgtaatgggttatgttgtgcaaggggtattgtcacaactcctttccgaggtaccgtggtggtattgaggcccatgctgacatgatgtggggttnnnnnnnnnnnnnnnnnnnnnnnnnnnnnnnnnnnnnnnnnnnnnnnnnnnnnnnnn

SEQ ID NO: 62837 - DNA, 1342 bp, Oryza sativa
ctccaaacctttgcaacagatggctgacaatgagaaaggcaataaggtcagaagtcaggacgttggtacctcaagctcccgagtgaacgaagcaccagacaccagttgtgtgacactggtccaacacctgattaaccagaaccgattgcttatagagatactgcagcagcatcagacgccaattctgaacctgagtcagatacaacctcaagtgcagttggaggcagtccaagcacccacaccacaagtcagcatgccgccagcatcccgaaggacccatggtgacgtgccacatgttgactcaaaagaagcaagtatcatttgttttatgtgtgatgagcaagggcactatgcaagggagtgtcctcagcagaaaagagaaacaccaatgcgaaccgaagatgaagtccgtaagatgatcattaccagcacagaatggcctccaccaggaatgacaaaacgtcagagaagaaataccttccgaggtgcaccacagttgacagagcatcttttagctaatggaggtagagtgtctgatagtgaagattcagatcaagtctcctcagatgatgaagacgagaagtctccccaaggtttcaaccaggataaaatggaacgtaaggcatgctctcgttgtggagaaatcggtcatgttgccagctcgtgtgccactacatgcattcattgtgaggaagaccatccacccgacaggtgtccaacgagcaggatcacttgtttcttttgtgaaggaactgatcatgtaccaaaagattgtcaattcagttttctgttgacgaagaagatggccaaccaacctgccagttccaacggagagaagcatcaaggccacacaaatcctccccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccagcacgtcagtccacgcaactccctgcaatcagaagcttgctcctcagcgaattgtcatccatgcatcccgaagcagtcctatagcccgcggtgcaacagctccaactccagctagtgcattaccacaaggtgtcaatgctcaatttcagccgcagccaccagttgacaagacagaggccagtatcggcattgtacctttggatgttccagcacagcagccaagaaatcaagtacaagatgaagaacccgagcgtaagaaattattgtcggttacaactgtagtacctgttaaggaaacagacatgccaatcgccaagtggtcactg

SEQ ID NO: 62838 - DNA, 5686 bp, Oryza sativa
  unsure (1)..(5686): unsure at all n locations
nnnnnnnnnnnnnnnnnnnnnnnnnnnnnnnnnnnnnnntaattatgttgcttgaaaaatattatgcattgataggatcgcacttaatctgttgtcccgtctgcaaggcagattggtagacctacctaatttgttgcatttgatcctttctttgttaattgtgataccatgtccctttgcaaccatctagttgcgtctcgatattcgcgcacctagtgcgagtatcagcggacgccttcaaacttaaaatctgaaaaacaacttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttagaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggttcgatgtttggaaaatctgcagctgatgggatcagctaggcccgggtggccgtttggaagttgttggcccgggtggccgtttgaaaagctgttggccgggtgccaaccttgtttcaaaatctaaagactaatacattgcacatactccgaccggacgagacacactgtctcatccgtgtcgtttgagaagcactcacttagttgtttcagaaaagagttcaaataaaatcaattgcaaaaacaccagcctctccttgaagcctgcattaaacacttatttcccctggcttgctgagtactccagtactcacccttgctctatataaataatcccccccagatgctgaagaagatgaagcggatcctgctgatgaggagttcttccaggagcaagccggctacgatgagttttagggtttcggcctagttcccaagtcgcgcctgtgttgtttagcctgagtcctggcttccgtttcccttttgtaatgcagttgtgagctcgggatctgtccgcagcccaacatgactgtactcctactctataataaagagacctctgttgctgtgatattctatcttcctgtgataccagcactgttttctaggactggtatcgattaacaggttaatttggagcgtcacggtttagttccagtcgggactagttcggggcgtgacatttagctagggtgaacttgactgtgagaattcgcttggatatatttttctttgagaaaatcatgagctataattaggagtctgactttcatctgaaattagtaagtgagtttttttaaagagatttcttatacgacttcttttgtatttctaaaagtaaacgaacttaaaatctgattcaaacacggataatgtaccaaaatctcggcaaaaacatcttcaatttacacacagacacaaagtattatgcatgttataccgcaagatttatattttagagtactttaatgtgatgctaattttatatttgtccgaaacataatatgaaataaattaatgatcaagtatgttattgaagaccgtatagaaaaaatataggccttctaatttgggacgcagggagaatctgatttcaaggttttactgcagtgtatatatgtattgaagtttatggaactatggagcctaagactgagaggtttgaatgggttagcacactgggacaaggctgcaaacttcttcagattacgcctagcttggggaaagcctgtagatcatcgtgtaataccctgtgttctagagaatggttggacgaattcgagggcgaatttaattaaagggggaagaatgtaatgccccgagtttccaattaatatgtttcgtggaatattagaataaacgcacaaaagttcaatttttaaaccgttgtttgaataggcgatcaggaaatatttcgtggaatattagaacaaacgcacaaaagttaaatttttaaaccgttgtttgaataggcgatcaggaaccgcggatgcgtagagctcgccgagtagtgcaaaatagacaataagtttatagtaatcggtgatcgaattaatatgggccattcgatcttcatcaggatatctattaaaccaactgaaaaaaaacaaaaaaaaaagaaaaggggaagagatcgatagcccagcagctgctacaagccctagccgccatcacccaaatcgctgctgccgtcgcgatttgttcttcactactgcatttttcagccatttaagttactgatgtacatccggatgcctcctaaacctactgcatgatgcacacccaaaaggtcatatacatgacgaggtgtaaattcacatttgagtgagcaacaggagaatatatgtttcattcggaggagtcctctggaccagaaatggtactggcaaacaagcgacttatattatatatatagtcctcaaagctggatacatatggtgtcacaacccatttattcgattacaagggagacatacatcgagcaaaaataaaaaaaaatgcatgccacaaatagatatttcatgtaacctatataatagacttgtgatactaccacggaacgggctaccactgctggttcagtgtgaattaacactttaacagtgatagggcaacactaccggttcaatgctttttcacatccaatcctacctaaaagtcataaaacctgcgggttcaggccatgaagtagcactacactagtacttatgctgtgtttagttcacactgaaatttaaaaatttggttgaaattatatgatgtgatagaaaagttacgtgtgtatgaaaggtttgatgtgatggaaagttgaaagtttgaaaacaaaactttggatctaaacagggccttaatggactggacaatacggatcattatccaaactatcatatacatcgagtatcgaattgaaagtgatgcccaaattgcagtttctttaaacaataataataacttatttcatgaagtgttgtgcgcggttgcagtttatttccttggctgtcaccatctaatatcatagtggtagctagtggcattcacaaacactgttcagttatgcatcatgcggtttttttacacagtttggtggtcacctatttatactagtcacgagcagggtttttaatttcgattttggctgaaatttcggtatttttgggactttttggaccttttctttaaatgttaacataatttaactgaatttgactaaatatttggtcaaaaaattgagaaaaaacaaaaaattcagctgagataatcacttgccgggagggtttgaaatttctgaaattgcaatccctattcacaagttcaaaaaaaaaattacacattagaattgcccggcccattcgtaggtcaaaaaaaaaattcatagccatgttagaattgccatgatctctttacaacacatcagtgccaattgcacatttgcacctttctcctacatattttaccatcgttgcttgccctagcgttctcatcggagtcgtgtcacgctaaaccataaagtatcgcagtacttcattcccttcacaaagagatttctaagttaccattgcctcctaaacctacttgctaggctttatgcacctaggaatcaaccgtgccacgtggatggaacatccatataacttacaaaaaacaaatagatgactatatgtaagcaatatgtgtgaagataagcaaagtcacgatgactttgtatatgtaggtagaaacaaaggaagtgcagtaaatggtttctatgactattgccattgacattagggacataactaagtttaagaatacatggaagaggccggcataaacatatacgtaaggataaaacatggatgctagcgataaacgtggatgcacaagcgatatttctcctgtgtgcccatgtgtttatgtaaatgctagtgcatcacttcgattattggaattgggactacctatacatttgtcgacaaatttttctccaaaaatttgatagatgtaattatagtacaatcgtagtataattacactgtaacttatatgtaattacactgtaacttgcatataactacagtgtaacttatatgtaagtttcacataattttgaatcgttaaatctattacacgatttgttttggtgaggaagaaaacaaatcatagcacacacatatgtgaaagaatttgttcccacgacctccattttaccgaaataacatgttacggagagatttttgaaagctacatgcaagttacactatagttacagtgtaattacatataagttacagtgtaattacactacgattgtactgtaattacatctgtcaaatttttagagaaaaatttttcgataaatatatagcaaaatcgattggaattatgtacggctctaactatgtcatccatctattgagtttcacaaattgaaccctggtatgtttaaccccatagccatctcatcagtagacaatactcaatacatatctcttttgtggataatgctcttgttcccaggctttaggaatatatgctctctctcactttttatttttactcgtctccctcctcgattatttttcctcaccaatttcaccttccattctctcgatgcacaacctagcagataatcatggtgggccttactacttttactatatatatgtggaatgattgatatcgtgttcacttgcaagctcgaccctgcattcctaatgcctacgaaccctattatataccccgtaaatttaaaaaaatttgatggtccaagaaaagagaaagtgacacagcttccaaaaaggacagatgtggccgtcaaacattgtagtgtagcaaccaagagagtcatgcatacagtgcacacaacctatagggatcctccatgttacacctaagagcaagtttaatagtatagcccactaatagctccaattcatctatagccaatctaatagccaattaatacagtagttgcttactatacaattaatatatggtcccacccgtcatacacatattgcgtcttatagtccgtgctgcagctggctacagatttgtagcccgcttctcttctctctcatcttttatcttattaaaatatgtttatagttggctaatagtctgctattgtatctgctctaagtctagcatgcaaatctctagtccattttgctaataggtaatgtttcttgattttctgcacttaggaacttcaaattccattgtagaatcctacaagcgtgcaatatcttaaagggttcttaccatgaaacatactgtgannnnnnnnnnnnnnnnnnnnnnnnnnnnnnnnnnnnnnnnnnnnnnnnnnnnnnnnnnnnnnnnnnnnnnnn

SEQ ID NO: 62839 - DNA, 12192 bp, Oryza sativa
  unsure (1)..(12192): unsure at all n locations
nnnnnnnnnnnnnnnnnnnnnnnnnnnnnnnnnnnnnnnatatggtcccacccgtcatacacatattgcgtcttatagtccgtgctgcagctggctacagatttgtagcccgcttctcttctctctcatcttttatcttattaaaatatgtttatagttggctaatagtctgctattgtatctgctctaagtctagcatgcaaatctctagtccattttgctaataggtaatgtttcttgattttctgcacttaggaacttcaaattccattgtagaatcctacaagcgtgcaatatcttaaagggttattacaatgaaacatactgtgaggcggtcttctctagtagagtagcaaactttggaagacatataagtgaatcctcattctctgtttataagaattcaaacccaatgccttccatttggtctgaaacttgtgatcccgatacctcctaagcctctatatacaatgtactagctaacaagaaagagttgcacaaacaaattgacaatgcatacacaatagcctagttatatacacgaaatttcatatttcctgttagcaaaataacactaggaaatgggcttaaataaagagtatcgagacaactgttagtattgagagcagagtagcggatcacacatgccaacttcaatattataggttacaaaaatagagagagagtgcacggcaatcaactaggcgtctagaagctctctcactttgataactcatgatctgactagataacaagcaacaataaggctatttataagctgattttttgcataagggcatcataagtagacgtgtgcgaaaataggggttcatttttgcaaacacaaccagttatggttcatctacaacctataggggttcttgtacagaaaaatcatttccgtagtagtattagctgcatggttgatgccctgaatggttcagtagacagagatgggctcatgatgtttagagaacttatctttttattaaatttatactacaaccaagtaattgtcttccacggaaagatgatgcgtgctctctcacaatagtccaattttagacaaccggtaaacagaacaagttacttatattggattagttgttgaaacattggaatggctatcacggctaaagttacccgttactttctgtttatgttacctaatgttgaaacataggaattaacgagatcttttacggtgcttgaaaggtccctcccatacctcttgtagaaatgagtatccaccgttgattacagaagaatctcgaagggtagattggtaacaaacaatgacacaaatacaggtagtaattgtttacagaaaaaatcgttggtcgttagatacctttatgatcaactagttttgcgttataactccaaagagatggcaaagagatcctggagtgttctttactctgcatcgcttgcttatgccatcagatgttgcatccatgccgtcgttcatttggtcaatcacgagtatttctggttgacttgctgtttttaccatacagaggctacacgattgtggggatgatgcagaattactcttcttagtagatgatgccttctagttccatttgacaacgacaaattaaatctctcatgcacactcttcagatgatcagattcgatctattagtcaatttacatcacatttttgttccgcgtcaattgttgcagcccaaaaaccacacaaatcgaacaaatggtcattcaaccagacgataaaataatgattcaatgaaaattaccgtaacagatgaactaatttgccctaaaactaaggaggacataatgggaagccgattgctattctaaccttccactttcgtacccgatccacaactttaagtaccctctcactagtacctttaatcacagttcgctagattctatttgatcaatgcctcttatacataccaagcaacgtagaaagccactactttcaattcaaactacctgtcgaaacaatatttcagcaatataaaggggtagcgtacgagatctaaaagtggatggatgcggagacaaaggatttaaacaggttcaggctctttcaatgagaggtaataccctattactatttgagaatttgaatccgccaagtgtattgtagatccgacgatcaggggtgtcaatatccccctagaaggtctcctgcccaccttatataggatggaggtaggattacaacatagaaaccataaccaatacggtatcggtatcctaaatttactttacaatattatcaaatcaggactttaggccgttctataatatacaaggtaacgtaatacccaagtcatgatccgttatatattctatagatacaagctatcccctataactagtcggataaccataccgtgtaggtatggggtacctatagatggccatgtgggccgcccggcacagcacggcccaggcccggccgtgcctgggccgaggcttgtcgggccggcacggcccgaccgacacaccgggccgtgccgtgccagcccacgtgccgcactcacagcccaggcacggcccaacacgcctcgggccgtgccgggccggcccgaaggcacgatgggccatcgtgcttttcctcagaataagtctaaattttctccctcctattgggctgtgacattgtatagctaaaaaaagtctattttacctccctcttctttgtgatgtggtatataaatagctaaaataagtctatttaaggtccctattctttagacattgacatttatatgtctatttttagtccctatactttgtgtaccgggtctggcctgccagcccatcgtgccgggccggcccgaccgtgccaggccagcccagcgtgctggtggggaggcccaggcacggcccgacggtcgagccgggccggcacgggcccgacccaagtcgggccgtgccgtgcttgggccgggccaaaaaggcgtgccgtgggctgggccttcgggcctcgggccttatggccaactataggggtacccataatctccacgctacccattaaaataaactgtagatgtttaataggaagggagttactagaagcacctcccccccccccccccgaactataaaaaagactcctctgcagttagtaagcagttgtccatctctcccctgttcttaaggtgaaaacgagaagtgttctattagatgggcatacggatcaatagttctcaatgtgtcataagcctactgagctaggagtaataactaggaacctatgaaacagagatgtcaggcagagatcaatgagatggagcagtggaatcgaagcagatgtgcaaagtttcatgctgaatttatgtaggccggaacagagcacagaagcgaaaattcatactgaaaaaaggacctccatgtgtgcaactgcaaaatacaaaatttgagttctagtgtgcaaaaaacatacgaccacaactacaccaccatgataaagctaaggtgtttccctgactacacgtagaactggactgtagttgaatgcgaaattgaagtaaagctaaggtgtttccctaactacacgtaaaacatatgtggttgcctggttggtttatagtacatgcgaaattgatgtaaacgtatgtaaatgctccagtttctttcacttgctatgcttgaacactgaattgatgtaaatgcatatcaagtttatgtttcaagtttcaactatatataggataatctcaatggtgacggagagggtagactcagcattacactccttgcctcctaagcctaatatatactccctccgtattttaatatatgacgccgttgacttttcgaccaacgtttgaccatttgttttattcaactttttttttgcaaatatgaaaatatttatgtcatgcttaaaaaatatttgatgacgaatcaagtcataataaaataaataataattacataatttttttaataagacgaatggtcaaacgttagacaaaaagtcaacggtgtcatacattaaaatatggagggagtatattgtgcataccaaagattaaaaggcatgtatgcaatacatggagacatgcccaaacattatccatatgtacatataagaagttatacatggcgaacctcagttaggctttaggtttgttagctggaaaggttttcaaaaaaaggtttgttagccggaaaagatgttgataacatgataaaataataatgtcacttttaacctgatggatatccctcaacaataaaccattccactggattgagtgcttcatgtattgatgtgtgcaacaatctgataattcattacccagtatcctgaataagctgaatccgaatttcccatcgcctcctaggcctagctacgctttgcacctagctaactaccactggcgatatggatggacgaacaaacgttcgtgtataattagagcaagaccaaatcagatgactgtccgtgactatattgtaagcactgagcagacaagcaacatatataagtcatgataggaacgagagcatctattctatgcccctgagtttactccagttcaacgatttgctattgactttatctccctctataatatgccaccaactttgttaattttttctacaatatgccattagggtggatattttttaaaaaatacataaagtgcccttcaagccatagagggttgacaattaatttacctaccagaagtattgtaagaatataaatttttttacatagtccccacacataatataaagtgtgtgtggattttaagattttcaatttgcatttattaatttttttgaaaatataatttatgtttcatatgctaataaaatactgtaacgttgagtttgtttatataaataatctttcatatgctacacaaaattatttttctaatgtagctatgttttgtgtatgtgattcatctttcatataccacataaaaatattttgaaaaaaatcttaaaatatataaaaaaaactttatatcgtataagaaggctacactaaaactttcatatttttttcaaaacttataaagagccaatcaatcggcaatccttgtatggcttgaagggcattttaggtattttttgaaaattatccatcctgatggcatattatagaaaaaattgataaagtcggtggtatattatagaggaagacaaagtcgatgggaaatcattgaactagagtaaactcaggggcatataatggattctctctatatagctacgtcaaaaccgagggaagaaggaaataaatgatttctttggttgccactaacatggttacttttgggatggcatagaagaggcaaaattgtacatacgcgttaataaacacatgcatatatataacacatggatggtagctggagataaataaatggatctgacaaaaattctccattgaacgtattttatgtaagacttctctactactgttgtatgtctgtgcttagccccaactgtacaatatttcttttaaaactctgtggctaaaggggccaatttaattatccaagcataagcatgataactcgtttatcaacacagtgatctttttccaagaagacagggatcgacaaaagactcctttcagtccttcaggacaaaggccatagacatttccatgtttagtccctagtgattggcaccccttcagtttcacctccatccaccgctcggcagctattggggcatttagagcaagcatattacaatctaatacatgtttgaattttcccggtgaatacaaacttaccgatgcctcctaagactactaaagattgtattaatgcacctaataataaacagatttatcatggttatgcaaaagacatgctcatgtataggcttgttaaaaaaaacaatgagataagtatgaactctagcctctctctagtagcagatgtccaaagtggtgctggatttacataggccaaagcagaggaagcacaacaatattttacatgttgtgcaacactcaatatttttctatttaagttgagtcttttatgttggatttgtgtgcattttcttgaatatttgtgtatccttgattgttatatatatatagctcggtttggcttcaaaccacccatcaacacctccaccaaatccagtactgtttgattatttaattcattcatattatttagagaataaatcatatttggtacctcaaccatggtatcagatccactttaaaactatcggcacctggggatttaattcccaaatacctagaaacgtaccctgtactagtcccgccaactagccatataaacatctacaacattgttatcaaatccatataatgcacatggcacataagtacataaagtggctcttataacttagaggtggcaacagtcctacaaaatggttccaccaattggccaaacaaaaagagtttcaaacgcagcggaaaatatacataagttctccggtatacgtatctatcaaatcacaaatgcaacctactaagaatcaccctagaaaagaaccatccctagaaactccgataaacggaagcacccgcttcctacaaataagactaaaagaaacaacgagggatgggccaatacacaagatattggcaagtcctacccaagccatgggaaacctaggactattgcaagctgagattaaagatgactatatttgtggctcatttttagcataaagaaaattttgtttcgcaatagtaaataataatatattacaacaaaatatttaaatcaaagagtaaaccataataatagtagcataaatatcatcatagtatcattcttgtgccttctatggcagtaagtgaactttttttctcagcccgcaccgggcaaaatcatcattattacccaccatacccatttcacaaatcatttagtaaatcaccaacactatacttgtatcatttcaccaagccgctcataaccgtgagcatggctaatcgattagttttagactctgtagagtttatacagctttactcacatgatgtgattattctagttgtccggtacccgatggtagcatcacactctacatattgaatatagtctagagatcacaacaaagctgttacattatctaatgccaatacttcgggatcatccactgggagtagtgttccacctatttgtttccttctcaaaagctaaagcattctagtgagttgctgttgggcgcaatatcagacgatccgccacctagcgccctagctagagctgttggggcattaattgaagaaaaaacattacaattacaatagtaactgtaacatataatgtgaatctaaagttctcaatgtcttttaaggatgtgttcaatatatagtagcggttcaaaaattttcccttcacgtaaaatagagcagttggcatggctaactaattattagctaaaaaacttaaaaatataaccttttgttattatagaatatttttgaaataaacacaatatttaacatttcaaaaagtgtgcacgtgaaaaacgagagagtagaagttggaaagaggtacaaactagtatatatataacacacctaagcctactatgtaagcttgtatgaacctatggagaaaaggcttatatgacagctgcaacagacatgatcatatatagcctagagaaaaaaagaacattgagatgattgtgctgtgcacagtgggagcagacctgcaaaggcatgtttaacttatataggtcaaaccaaagtttgcacttttagtttgggccgaaattttggtgtcactgaaattatacgaattttggtgtttccagtacttctttgctcagaattattttaaatcttaacaaattttgattgaatttgaataaatcttgaccacatgcacaaaatatttggagaagttcaaaaatttcgagcgagatatatagttgcttgctggtggggtccaaaatttcgaaccaaaattttaatcactaggcgaaacaaaggaagcacaaaagcaaaattcatacagaaaaggacatgcatgtctacaattgcagaaatcaatatttgaacttcagtgagcaaaacatacgaatgcaagtccatcactaatatctctcaagcatatcaacatgaacatgttggaaatatggtcataattcagcatattttaatccagaaaaacgagataataaacatgacatgtgaaaactgaaatgatccagtgatagcgctaaacatgaatatgctactaataataatagcataatctagtaacatgtttaacactaaggtagttagagtaatatacccagagaatgcttctgaggatgaggcattattgttgttgttgcctccgttggcattgatgttctccgctccatcggtgccacctttctcgccattggttgctattgtggatgcagtccttgctctcactgacggtaccaagaagaagatgaagcaaacgaacagtgagcagtcacgccttgcgctccctaaaatcctgatcgctcgcccgtccgtgcaaacgtcgcagcggggcatggtttcggaggcctgctctcgctggttctgtacgtgcagaaactagcgatgagaattcagtagtgcagcagcaacagagggtggagtgatgtgtttttgttccatacatccaggagctagctccttctctgattatatgcgtacagaggtaaaggagatgatgttgaaaccgattactcccattggacaacatcagttactggtaatggacgttgttaatttgccaaattaacaccatcaatcaacagtaatagtcaggatttatattgttctctaattgagtcatcaatcctccgtgtcaattgaattatcaattcttgaacaaaaacctttcacacatcatgtccggtaattcttcagcatttaacgcgtgccttgaatattatagatttaattgaaaataaatgtgccaaacacaaataaatccaacaatccccaccaatatttcacggcgcacgagaaatgctctcagctccactgctgttttgatatacccgtattttctagaggagagtgttaagttgaagatccaccttgaacagaggctacacttatccacaactgaccaatggactatgccttgaattgacagttttgtgtgaacaagcttcaccaaagccctttactagtactaggctactaaagcatccactcggtttggagcatataagtcatactctaggcctcttcatgagtttctagagatcacccaaatctataagactgtgactagcagtcagactcatataggtgtgttccttctaagatgttatataggccaacatctctactttaagaaaagtcactcggatcatattaaggtatgcaccaacttgccatagagacaaggagataagtacatcagataaatgagccaatctaagggcctctcctcccagccacccaatagcttgtttcaccatcctaattcacgggcctctcctctcagccacccaatagcttgttaccactattgtgtaacttcaagtgggtctcaagcccatttcattcgatgcactgtctatcacattatgcgataggcccttagtaaactgatctgccagatttttagccgtctagacataatccaatgctatcactccgaagtttttcaactttctgacaggatttcagtcttctctttacatgcctagatgacttcatgttgtccttcgaattgttcaccttaataatcaccgtttgattatcacagtttatcaagatagctagtagtggtttttcaaaaactggcaaatccattaggagctcacaaagccactcggcctcaacagtggcagtatctaaagctatgagttctacttgcattgttgacctcattaagatggtatgcttgcaagacttccatgaaacagcgccacctccaagtgtgaatacatatccacttgtggcctttatctcatcagcatcagatatccaatttgaatcactatagccctccagtactattgggtacccggcatagtgaattccatagctcactgtcccttttagatagcgcattactctttccagagcatgccaatgatcgtcgcccggatttgaaacaaatcagctcaacttactcatagcaaatgagatgtcaagtctcgttgcactagttaagtacatcaatgaaccaatgtttgggagtatattaatagatcccttgctattcttcggtttttccttaatagcacactgggatcataaggagtaggagctggcttgcagtcacttataatcaaagcgactcaagaccttgtctacatagtgagactgcacaagtgtaatcccaccatcatctcctctcaatagcttaatgttaataataacatcagccactcccaaatccttcatttcaaagcttttggacagaaagtccttgacctcctcaatcacattgaggctagtcccaaagattaatatgtcatcgacatataaacacaagatcactccctctcccccaccatagcgatagtacacacatttgtcagtttcgctcacaacaaagccaacagatgtaagtgttttgtcaaacttctcatgccactgcttaagtgcttgtttaaagccatacaaagacttcagcagcctacacaccattccctcttgaccttctagtacatacccatctggttgatccatatagatcttctcctccaactctccattgaggaaagctgtcttaacatccatctgatggacgagaagaccgtgagaggctgccagagcgagtagtactcaaatcgtggttaagcgagcaaccggtgaataagtgtcgaaaaaatcctcgccttccttctgggtataacccttggccacaagtcttgccttgtacttttcaattgtatcatcaggcctaagttttttcttgaaaacccattttcatcctataggcttgcacccatatggacgctcgacgacttcccaagtaccattagatataatcgagtccatctcactgcataccacttccttccaatagtcagcgtcaggagatgaatatgcctcttctatggttcttggagtgtcatccacgaggtatacaatgtagttatcaccaaaggactttgcagtcctttgtcttttactctttcgagtatctacaatgttttcctcctcaagatttccctcaaacatttgatcaatgtgttctatcggtgtaaagtgctcaggggatgaaataggttcttgactagaagtgctaggtgcttttttcataggaaattcattctaaaaaaatgtagcatctatggactcagtaattgtaccaatacacatgtcaggtactctggaatttactattaagaacctatatcccacactgtggatagcgtaaccaaggaaaacacaatctacagtttttggtccaagtttgtgctttttggctataggtacatttaccttggccaaacagccccatgtgcgtaggtatgtgagatttaatttcttcttttcacattcctccaatggtgttacttccttatacttgattggaattttattcaggacatgacatgcagtcaaaattgcctcaccccaccattccttggaaagtcccgcagtgtctaacatggcattcaccatctcagttagagtgcggttctttctttcggccaccccgtttgactggggtgaacaggaaggcgtcctctcatgaataattccaaactcttcgtagaaagaactaaattcattggaaaaatactcttcatccctatcagacctcaaccgtttgattttcctttccagttggttttctgcctcaaccttatagatcttaaagtaatgcaatgcttcatcctttgttttcaataagtacacatagcaaaatctagtgcaatcatctatcaatgtaatgaaatatttctttccccctttagtcaacacgccgttcatttcgcacagatcggaatgaacaagttgtagaggtgccaaatttctcgcctcaggtgccttgtgaggcttgcgagattgtttcgattgaacataagtatggcacttagatcctttgactaaattgaattttgggattaaactcatgttagctaagcgtgtcatacactcaaaattcacatgacaaagtcacgaatgccacaaattggactcatcatcatttgttgcatggttcacaactttattacacatatcatccaaagaaaaacggaacaagcctccgctgtcataacatt

SEQ ID NO: 62840 - DNA, 1542 bp, Oryza sativa
atcaaattcttgaacagaaaccttttacacatcatgtccggtaattcatcagcatttaacgtgtgccttgaatattatagattaattgaaaataaatgtgccaaacacaaataaatccaacagaacatctcggcgagtagcccatcacaattatctataggaaaatcttcggtaatggatgatgaaattaaagattacataggtagttagggtcggctggtttaatttagttaccggccggtcattgaggagcttattaacaccaaaatagatgaacaaaccccaagaagacaaccgcaacaagtcgagcggcaaaaactggaattgtgtgttcttcttgctgcagcatttgtctccatggaaagagaggcgtgcactgcaatgtgtcgacgtcgcgtgcgtgcagttcatgggcttcggttgatcccatcagcacacagtatttgcattgggatttcatgatgaagtctacccatcaattttgcagtgtacacatgcatggatctgctccatcggcggagccttgaactcgctgttgcaatcctggcacctcctatgcccattgcactagctgtcgtagaaacacaaggcacatatatatgctcaaaagtccaaatggtgttgcaaattttgaaaggagaaaagagactagcaaaagagtttataaatagggatcaacggatcgacttgcacgggccttatagatagggatgaattaataagcacatggtgggtaagaaaatttatgatggtctattgatcaagaaattccaaaattatcaaaatcactttgcaattacttttcgaggcaagagatatgctggtactttattatatatctccggagtgggacaaacttttgtgaataatctaattcacattgtactttgagtttttgagacattctaccagagctatatttaaattattcaagctgataattgtaactggtcatttggcttaggagtggtaaacagcagttaatctacatcaatatttcttaaagtatctatcttatggggtcaatgaacttataaaatttaagttataaacaaaacgaccaaatccaaacaagagcagtttttttcgtgtatcgtgtgtaattctcgataaagtttatggttggacttgggctcgttagaaactataaaattctgccttaatgatgcatatggatattaaattagaactagaagttaatttataaataaattgtcatgctttggtcttgttcccattgggcaacactttgtctactatagaccacctttcttctacagattggcctgactattttgacccttttttcataggagttgcgtatgtttgacttttaattacaaatttgcaatacttttctcctatcctttccctcgtacacttgacaagaagactggcctgcgtgagcgtgtccaaagatcactcctcacatggttgatgatctttggagacaattcgaaactcaaaagtgtccatgatctgaaggctgaattcccattgcctcctaagcctgctatactttatgcaattatacttagctaa

SEQ ID NO: 62841 - DNA, 6085 bp, Oryza sativa
tgcctgctggtcgactctagaggatccccctagaattgaaagaaaagactgaggaaattgcaaacatatttgcagaaccaaagcaagtgcttatcacagctgacttcaacctgatcgtcaaaaccatttttataagaaaaaggattaaaacccgacatctatatttaaatcagatgtacatagttaacaacaactgtacaagactatttagacttacatacaaaggttcttgccaacaaagacattcaccgagcactaagcctcaaactcttcactcgagaggtcaacccaaccttaaaaccataaatatctcgaattctcgatagaacacatgtctatgcacatattatcctacattagtgccatataatagcatgaaacaatatgaatgtgcatatgtgaggctgatatattttccactgcaaaatctatgtaaatgtcaatatttcataatgcatttctttgtacgtggatgatgaaataacagaaatactacaaacttcaagctataaaaagaagcaaacaaatcgagcattttctatacatcatgtgtaaaactcgataaagttttgtcatcagattagctagttacaaattgtacaatttatttaaatgatcgatatatacggctattaaattagaactcaaagatagtttatacaaaatttgtcatgcttctcttgtttccattgggcaacgcttgtctaatgtagagtacactttctgccaggaattgtgctgcctattttgagccatttttcataggagttgcccatgttcgactttgaataacaaatttacaatgcctttctgctatcttttcccctcatcctcgacagcttcctcatatgcatgtgtgagtgtgatagatgacacctcagacacgtcttgccaatcactgctccacctgatcaatgatttccagagagtatatgacaattcaaaactcgaaaggattcatcctctcaatgctgaattcccactgcctcctaatcctagtagactttatgcattcccctaaggaacaactctaacagcgttggatggaagattcatccatgctcgttgtcttaagagtattactagcaattggagtagacgaagtcatgtcgactttatatcagtcgaaagtatgcatatgcttatctaactaacgactgacgactgtacgtagtgaaggatcgcacaagaccaaacaaacctaccagagggaggtgaatggtagggaaaccaaaaacccaaaaatcttttgcagaattaaagattaccctcgaatgaagttgatgacgaagtcctatcgctgccggtcaaaccaccctcctaccgccggccagaccgcctagacacctacggtcagaccgccactatcccactggtcagaccgtgcgcatacctgcggttagaccgtcgggatccagaaataccggtaaatggcaaactcaaagatgtagattgaaacttttcgactttattgtatcaactagtgtttacaaagtgcaccaacaacactccccaccaaaatttcgaactaaattcgaaaccctaactttctctcaactctagtctctctaaaaccgataccgggaggcctcaccctccctctctatttatacatgaggtaggctgtgcaaagcccacgaatctaatacaacttaggactcctaatccacgtaggtaactctctcttgcaagtatccaacttatctctttcctgatctcaatcaatcttcccgaattcggactcccttccaaattcgactcctctttccatatgtaaacaatccctcttgtataccatatagatttcttcatcaccacgtgcattgtcctctagcctttagtattccgcatgatctcttgatccctggacatcaactttttccaagttgactccgatctatcactggcaacactctcccgtggcctcaagcaacacctgcacatgcaacaaccaagaaaccatattccgagcctaagttcgtcccaccttaactcacattagtataacaacagtatccatacgcatagaaaccatctagaagccaaatccccaaaagaaacatccaaatccaacaaaacaacccgaaaccgaatacgatcaggaacctgccggtcaaaccgttgggccggccggtctgaccaccgcaacacctgcggtctgactggctacacacgaccggtctaactgccagggtcaaccgaaactgcacacttcacaaaatcaaccgtcttataaaatcttcaaattaacattagcaaaccaccaatattttcatcacaaaatctaaatcaactccttgattttacacatagataactctaactgacgactgacgactgacgcccatatgcttatctatgtacattcatcagtcgggtgtgttttaacctggacattgtattcacgaatcttaaaatgaaaataaaaatcattgcggagttaacaggagctagcatagtaacacatgcatacacaatttcatggcctatgtccttctgcaaaaatgttaataagaaagccaaactattgtggactttatacatcatatatatatatgggccatgaacatttctgtggtccagaagatcaaataaccctctcaaatgtctaccttctcacgctgttttgtactaaccagagttaggaggccatcttggaccaatatgttcaatgactcaactctttttttcttttgcgaacgcgcaaaaggattgcacgtcaatatattagcaggaaaagagtttttgttacacaaagcaatcagttagactggcttatgcctaaagggggggacatgaagctaggaactactacgacggttaaaaacgcaactccaaacagcgggagggggcagagccacgctacactcccaagaaatccccaaaacaagtaacaccggctaaagaccacagctggccctccgagcggaaggactctagaaccactgtgaccgaagcgagcacagagtcgaaaaccctggagtttcgttccttccacagctgccaagagactaggagtaccaagaagtcgaagccgctgcgaaggtgctcaggtaaacataccctggaggatgaccaccaatcctggagccagctgccacgagggggagagagggcagcccagccaggaggggacaacacacggagccagacctgccgagcgaacacgcaatcgatgaggatgtggttcgctgtctcaagctcctgagcgcaaaaggggcaagcagagtggctatcaataccacgcttttggagaagatcggcagtccagcagcgctgctgaaatgcaaaccaaaggaagaacttgcatttagcagggcccttccgtgccagagtaagtcggcacaggcaaaagagtgctggccaaggaagaacgcctgatacgccgatcgcgctgagtagcactggtcacccgtccaacgccagacgaggtgatcctcaacacccggcgagagctgggtaggaaccaccgcgtcctagactaacaggaactgagagatgaccgggacagtgagggcgccacgtatgtcaccaacctaggagttgttcgctaacccagcagcaactgtgcgcgatccccggaagcatggaggcacgacgtggaggaggtcaaatgactcaactctgaattgtgcaatcctgatacctcctaagcgtaagccttctcaaagacccatgtacacatccatgtaaatgaaaagattaaaatgcaccaatgaatgtaaaccgtaaacaccagtggccagcaaactacatatcaaagttgcacaaatatatatgttgaaatagggggaattcaccactgagattgatgatatatacctactggcaagagacagatctcacctgaaggagtcctgacatgatcgataatgctatttaaaaccatgcgtgcctcggattaactaaatatgagatcaatttctttactgtcctagagtaggtgtatagtaagatcagaaaatgcgatgcactgaaccataaaaattcaaatagaaatatatatatcctgtgagcaaacacgtatgctgatgtgtatgtgtggcaggtcagttatgttattgttgtaggttggactaatgccagagcattttcttccatattgatctatgtggtgactagtgagtcaactgaagtggattaaaacagatacattttctggttattccaagtgaataagcacttgatcgattagcaaggcatacggcccacctgggttataatcccacctgcccacctaggttctaatcccacttctgcacctcctttctaagttcatgccagcagtttatatatcccacaaaatgaccatgccacttaactattctctcaaaccagacctcattcaaattaaaaaaaaaagaaaataaaaaacagacctcatatgcaagatatctcatttgttgaatgactgacactagatagaaatatcacatcaacacattttaacaaaaaaaaatgttgggccatgaatattatggacctgtttagggagtttctaggagttgcagcttctcttagaagaagctcccccaaataggtcagcttttcatccagattctgagaagctgtagttataaaatcttaaaagctagctaccaactgttttcagaattttaagttcttccaaataagccctacatctcccacaatatgccgatattcacagctagtaatcaaattagatgactgaaaatagaaacaggtcaacgcatcttgacaaaagagagccttgggtcatcatcagtatgagtcactcgtgctgatcctgcattctcgatatgaatctgcctataggctcgagtgagtcgggaatctcaacctaaggtgtggctgtgcatctatatgcagaagatcaaaacattcaaccaacctatgagtttgtacatacaagttcaccttatattcctgacgtctcctaagactactaaattgtttatgcaaatgcttgacatatatagtacagacataaaagtacttaaaatatctaggcctggtaataccaactcaactcattttgtacatatggctagagcatgtcaaattagacagttggtagtgtcatccaatatgtgtgacaacaatatatagctatgcagaaaagtaatggcagaaatgaacactgaagtgaattccaaacctaattaatcaatatatctttttggtaggtgtgctgtgtagtagagaaaataaatgaatgatgattcttatttgcctggaacttcacttctagttgatccaaattttaaactcagttgtagctcactttacctcatgaacgatgattgaaatgtaaaattacatcagattatccaaaaaaaaaaccctgaccgagcctccgggacttgtgcctaatgttgtctaagaaaagttcggttgaacgtcagttggatttttgtccatatattgttggaagagtcatttttttcccattgaccatatgcctggaggggtccagatccgctagagttaactccaacttcagcgggtagatttacccaaatctctgtcatgtactgttctctacggctgagatcaaaccaccttaatttcaactatttttttcttttgataaataattccatgtaatctttataacaactagttgttcaaagaaagaagatatgccgtgctttttgacatagtgattccagttctggctggccgacttttttttttcataagaatggcttcatctctattatataaaaaagaaatattgaatatgattaacaaggttctcttttgttattatatgtatacgaggaaacattttgttggcatattattgttaatttgaggaagagaacatgtactctgttaacttaatttgttggttgcaacgttatcattgctaaatgtcaagaaaataattttcctttacatccatgtgattaataaaattaatcaggagatgtggcttcttatcagccgtagaaaaaaatagatggcagagatttagctaaatctacccggtagagttgaagccaactccacgggatccaaacccgcctggagaagatgagtgcacatcatcaatttattttaggttaacttaacaagttctatgactataccaccccca

SEQ ID NO: 62842 - DNA, 3594 bp, Oryza sativa
atctttggtaatatatctgtcgatactcagtactgtacttcctatttgtgatgtattgtgaaagcgtgaatcttaggaagttgaggtatttttttgagtacctactcttctatctatacttgtttgcaaatagatgatgaatcatcaacttgtaattagttcttgtttaccatgcttaatgtagacttgttaagataatattgcatcatataataacgtgcattgagatttttcgttctgtgctaacttccatggtaattcgtaggccacacctaaaattttttccgtcctccgccactgactatatagctaatcagctatacctcaatgcatggctcatttgtagataaataataactagcacagctaattgcaagttatcgacgtctttcttcgatctgcatcgactcacatcacaccactgtacttctaaacactactccatcacccttttcgctaaatctggttcattaattcctcttctgggagaatcataagtccctggtgcctcctaatcctaagaaaataaatagtgtctatacgcatgactcacactagagatataatttcatcaaccaaaaaagtgcaacagaaggcaaggcatgtggatgggtgaaaattttcaagccatctcacacatttatgcacagtagaggtaggtgtgcttcaatgaaaatcctaggaggttcacaaattgaacccttaccccgtctgaatttcacatatttaaaaccatctatcagaaatttcaacatattgcacaagtctatttattatactcaatactattatatcataataatgcgaagcgacgtatataaatgcgtatggtttttgtacatcccgtggctaaatcggtgccctaaagtctttatcttttgtggccgatgaatgaaccgaaaaatcaaataattgatgtttaaaacaaaacaaacacatcctagcagagcaagtgaaagtgtgaagtccaaaatagactaattgagattgcatttgcatcacgtactcacatagtgataaaaaactattattcatggtaaacctaaaaatgatcatctaagcccaaggttttgttcagtagtaagctttctatatcttctaccatctcattttccgcatgcaagtttcctaaaaataaaaaacttttggtgcatatttaaaacaatatagttattttaagtcatattaatctaatttttaagttttttactaagtattaattaattatgcattaatccatagcttcgttttatgtgcgaggaagtttcccaacatgcacaaatgaacatagcctaattaaggctctgttcttatgtcccaactcccctaccatgttttccgcgcccacgctttttaaactgctaaacggtgcgttcttttgcaaaaagtttatatatgaaagttacttaaaaatcatattgatccatttttgaaaaaaaaaatagcaaataactaattaataacgtactaatggactgcttcgtttttcgtgtcggagggataggtttccaacccaggcaaacgatcagagcctaaagacttagcactgctttaagtgacatcttccaggcagaaaattaaatgatatttacgtcacatgtgaacattttgttgtcgttgatgaataattttgttgaaacttaaatgattgatcctttatttttctcactttgtgtctgatgactaggagatgactctgaacataatatatcaaaatcatatctggaagtagtgactctggtcgtacaaaaattgaaaaacactgtaatttaccgagtaccaagaataggagctctggtaactttctggccacgtcagagctccaaccgccgtggtagtgcaacttaggaaacaggcagataccccttgaactttcatcatctagacaatgtcttctcgtggagtgattctactgtgctgagtgagaaattgcaagaacctgatacctcctaaacctattagacagtactgcagcctatctaagagaacttttttttctcgaatacacaggagatctacatatcattccattaagagagtaaaaaaaaaggtggagagaaagatcccccacaaaggccttcaccaaataaatcgaaaataacacacacatccacgccaactttcttacggagctagcactataggagacattctactatgtgacttatgtgacttgatatgtaagaaaactgacttggtatgtgactataggagacattctcaaattactatgtcctatatatgcgtctatctatttaaataaaaaaactagtaaatgattttagagaaattatgagcactaggagcagatcatatagtgtaatgtaggcattatatataggttgaaatcgaaaccgtacatgtaaatcatttttttcattacatggatgacacacacactagcatattcaagtgtggctcatgtgtgttagttcttcaatagaacaggtacatacatattatatgtgcgggttcttaattaacaaggttgtcacgtataattcagtttagtgaccgttagtgagtcccgtcatatctgtctacttgcgagatgaaatggcactgaaactgtgaaattcaagtcacatataatgggactcactataggtcactaaccgaacttcattgtgaaattcaattgctatccaaaattataagaaataggtagcaaaacatagaacaataaaatcgccctttcgtagatcaaatcattcatgatatctgcacccacatttacatggtcagcagctagctagttgtggatcaagagagcagcctagcattaatgaaccgggagctactttgcatttgagagaggcagcttgcaatgctgaaaaccgggaaacatttttttcatcaccctgacaacaatctgaactgaacgtttcaaatcagcaacctcttcatattctttctggctagggctgtgtttaattagttcagcgcaaagtttagattttggttgaaattgaagatgatgtgactgaaaagttatgtgtgtatgacaggttgatgtgatagaaaaaaaaaactgaagtttagaaacacaacctagaaagaagaagcaccaccgaccgtttcgataagatcatattcaatcgagtatgcagtataatcatggaacagtaccgaaaggtttgtttgttgagaaatttttagtatttaggaaagtacctagaggtaccaagattttacactagaaattttacattggaacaatctaaggttgttttgctaaagataccaaattttacactagaaaatgtggtaccacccggtaccttctaaaggatggtaaaattacacgtgcttgtttctttaaaatggaatgatatctccattagcaacttgggcaaaaaataaacagttagtattgctggaaattctatatgcaattgtggcaaacgagattgtcgcgagggaaacccacctcagaaataaacagtctatgagatggatgagcaagaatggactgttattattggaagttgaattttaaccaagcaatttcattcacggtacaagaactcgtcaggcgggtgtgttatagaaatctcgtaatatgaaaaatgagcataaagtgaatcgtctctg

SEQ ID NO: 62843 - DNA, 3092 bp, Oryza sativa
  unsure (1)..(3092): unsure at all n locations
nnnnnnnnnnnnnnnnnnnnnnnnnnnnnnnnnnnnnnnnnnnnnnnnnnnnnnnnnnnttattattggaagttgaattttaaccaagcaatttcattcacggtacaagaactcgtcaggcgggtgtgttataggcttctagtaatatgaaaaatgagcataaagtgaatcgtctctgtcgacgtttgatgtcgcgattccagtatttgcatggtatagggatcgttggtactatgatatacgcgagactgaggtaaaagagacagagacgaggatttttatacaggttcgggcccctgaattatcaggtaataaccctacatcctgttggccgaagccggagttattttttattcaccataatcacaccagtacaatatgtgaggtagcctatctaagtattgtcgacatggcggtctgaagttctgactcgtagtcgacaacagggtagtcttcctcctcgaatccgtgcacggcgagatcagagatagcgctttcgtctctcctgacagtatccggagacaccgtaggggactagccatgctaatccctgaagttgatatccggtatcttgtcttagcgtatgttggcttgtatgttgtggcttctgttgttccgtagactgtggtgtgtgttgattgaggtggtcgtgtcccctctcctcgtaaggggccttgtatttatacccataagtgtccccttatccaagtagaactagggaaaccaatatggatacaatccgagtagtccttgtcgtttccatgtagaactctggttgtctttccttatccgaaactccctccatatccgatgtcagtttccgtataagacatggtatgtggtgggtcctgccgagatgtagtcgactactattaggtatgtggtatccataaccctgacagtctcattgtcatgactatatgaacacctctcttttcccatgatgaatacaagttcaaatttggagttcttaaattatttgctaagaagcatgataaaaaaataaagcatggcaaaaacaatcctagaagagatggagtacaagaaaagataagagaaaatcaatcctataagaaatgaagtacaagaaaagaaaagataagtgcagaacaaccctagtagaagaaaagatatagaagagctgaaaaatagcagaagtaaaagaaaagatgtataagagctgaaaaatagaaataagtgcagaacaaccctagtagaagaaaagatatacaagagctgaaaaatataaacggagtgaaaattatgtcagaagtgggatttgaacccacgccctcgttagaggaccagaacttgagtctggcgccttagaccactcggccatcctgacttgatgtaattacttgaaataatttcatacaaatttcgtatattttacgtgattcgattctgctttcatgtcgatgactcattcaagatcgagcagccctactcacctgtaaggctgtaaacaaagagagttgacagaaacttaacctgaaaaaagaacatataaataagtagtatctgaactctgaagtatccatattctcctatgaaacattggagtcaccccgagacagagtgtggttgtgaatttatggactactctatattatgttcgtcaaaggtgaaaaatatgtgctgaatagattgatcttcatctagctgaatatacgccaaagacataatactaatttggaaatgggaggcttcaggtcattgagatttgcattgctggatcaacctaccgtgccctcttccttggctgttggccgtcttcagatcccatagaaaatgagacgctagctagtttatagcatgtgtattttcttaagaaataatacactcaaaataattatttaaaggttttcttaattttaaatttgtaaaattaagctagactagtaaaatcatcctaattagtggtcttatcatgctgatcggactatttaatttggataaatgactaaacctgacatatattggtgaaaaaacgtgttttattaatattcaacacaattgtcataatcctgcaagtgatagagtttgtataattagttggaaatacatatctaaaataaatgtgtctacaattacctatttctttatgctggtttcatttaaaaataagggacattgacatggtaaagatactgaatgcaacacagctggttaatttccgttgtttcaatggtagacaatctaccaatcttcatcaatccaaatatactcttgacgacctagtttttggaggggctcatatagatttacgtaagtaagtgtacgcaggtgtatatgagcgtctatatttattttgtgcttcacacataaaatttatagcaaaattattattattacttacccatgttccaaaataaatgaattcctagcacacagaaaatataatgtgaggagagaaaaacaaaaatgttccgaacaaataggaaagtagtggtgaacttatcggttaacatggaataaacctatatgtccatctaatttcatattttattctttctattatatagaaatttagatattttctcgtctgaagtaaacttattgtagattgtatttatctgaagactttcgattgttctaccatctaatttcacattttattctttccattatatagaaatttagatattttctcgtctgaagtaaacttattgtagattgtatttatctgaagactttcgattgttctaacacaatcattgctgctactctattattttttatttattttcactattttttttaattttctagaaacgcatgatgctaacgtgaagtgacgactttccctcgttccgactctgtagtggattaattgtaatcctattgttttagggccggtttggattggattcaagccaaaacgtgccctaccaagattttgggtaacataaatagtaaatgtgctagtttggattgaagctaaatagttggtagtgctcatgctcaatttagctatattctaaaatcttcttcacaaccctactaaaatttgattttatattggtatcaaaccaaatatagattagctaattttgccctacctaaaaattggtagtgccaaaatctac

SEQ ID NO: 62844 - DNA, 864 bp, Oryza sativa
ccagggttcggcctggttcggccgaaccagtagctagcccaattagcccaattcttcatcagctggtagttatccttgtcccaaggcggttatgaccggttaaactgaagaaaccgtcactggacacatgtcacaaagagatgaagctaaggagaatatgctccttggatgcttggagcatatccactctcccaaggcaactcatgtcacactgttaacgaccaaatttggtaaatcaagtatcggaattggagataaaaccgaagcagaatcaaagggaattaacagtttcggaaatagagtacacatcggctggggtccgaatcggctacaatctacattggtagagtttaagtcggacagggtagccgatgaagtcgattccgacaatatggcgatagaaacattgtcggattgggttgatatgcttcatatcaattgccacgcacggattgagtcctaagaaggtaatttgtatctattaattaggatattttatataattttcttgtactttgagtcggtaagagtccaccttaaggacttgtttgtttcctaagttgtaatagagttaggagtcgtgtccgacaagggcatatcatgtattttgggtataaaagtagcccaaaaccagtgtaacaaagtaacaatcagttcaataacactttcgacgcatcgccaacctttcactttcgtttactttcgatgagttcttgctttcgagttgggctgcatcagtttgatctccgacgacaaggtaaaacttgttatggcggtttgtgttctcgggattagtggttctatcttcatgatactctaatcttgtaatagccctagctcataaccaggtatttagaagtgcat

SEQ ID NO: 62845 - DNA, 902 bp, Oryza sativa
atagaaattgagaaggagttaaaaattgagttggcaatgagatgaactccttctaccggccatccccttcttatagtgcacctccaacggctataattgtgacacggacccactaaccattggtgtgcaaaagaagggaggtgactattgcctgttgacggtcgtcatcgatcagttacatccgtcaatattaccggaataaatgaagaactagttatgcttgcaatgcatttagtgtcataataaaataaaaaccactagcacttggttcactaaccctttgcagagaatgagccataaatggagaagaatcggcatcaaaacaagcgaataatcaatcggacgatgtcgagaaacagaattgtgtgtagatgggccagaaactcagaattgacacgatcaatttgggccaaaattcacaagtctacaaagagcagaagcaaaggagcccgccagccgaaaatgggctggtttggcctagcccagggttcggccgaacctccctcacggccgttcgatccaagtggacggcttggatcactccccaatgacggttagagggcaatcctgacaattccaactgccataaccgtcattggcagcctatttaaggcattcactccctccatttcttcacacactccaagcatcgaagctctcactctctctcaagtttagtttagtgttcttaagctagtggagtaggaatagaatagtagtcggagtctggaagtctttggaagagttcgggtatggcctctagtagctttcctttcttcttttgcaagactagtatttaatttagaatattcctctatatacgactctagtattgtaatattttccgaatatatgaataccagctttacaatatgtccgagatattatgattatactgctag

SEQ ID NO: 62846 - DNA, 4394 bp, Oryza sativa
actcgaagtaccaggagggcatcagaaagggggtaatagctagttaatcatatatttaggatgtatgtacactatgtatactagaagtataggaatagattcttttctatattctttccacttagcttagagatttaatataggaatgagtagcttgagcttgtgtgtcattctaccctggaattatctttaccccttcttaggcacgactagtacaagtaacatataaatattagtttagttctctctattataatcttcccacgggataacaaatacgatacccttggaaaactctcaggtgaaatgctacaatggtatatccgtgcgcttgcggataatctctgtaaccataatataccttgactatttctggcgccactgctgggaattatatttctagtaatgtcgttaggaaataccaacaagcatttctggcgccgttgctggggaagatttataagaagagattcctaaaactaatatcttatatttacctctgtatagtcaatatcctttgcaggttaaccttgttgttttcaccctttgttgtgaaaatagggtagtgtataattgtttttgacctgccggaaaacttccaggaaaatccataagtcttcttctgaagcataaaactgcgggttgttcccccgcagaagactcttccgacaaagaagccaaacgtactagcgccaccaactttcaagaccatggctgacaagactcttcgcgagttcgctgctccctcctctaagaatgtggccactgggccgcagctcaatttgggagacatggactttgatctgaagtccagcctcattacgatggcgcaggctagcccattctgtcgcaagccgaacgaggatgctaatgcacacctgcaacaatttctggagatttgcagcacgtacactgtgaagggcgtcagtcctgatatcgtcaggctgaggctgttcccattttccctcctcgggaaagcgaagaagtgattctatgccaatcgtgctgtgataaactcttgggaaaaatgttcgacagcattcttgtcaaagttcttcccgatgggcaagattaatgcccttcgtgggtgaatttcgggcttctagcagatgcgggatgagtccattccggaagcatgggaacgtttgcaggaatacgtggccgtctgtcctcatcatggaatgtacgactggctgatcctgcaaaagttttacaatggactcactcccacgtcccgcaaccacctggatgcggcagctggaggagctttcttctctaagatggtcagaggagccatcgacctcatagagaagatagtctctaacatgggttggagcgaggaacggctccaatcccgtcagcgaggaatgcacactgccaaggagacggaaatactcgctgcaaaactcgacctcctaatgaaacgacttgacgaacacgacaagaagccccaatgcaccgtcaaggccttggactcgcacatcacgtgctaagtctgtggcaacacgggacattctgggaatgactgcccagagacccatgaagaggcgatgtacatgggtaacaacaacaacaacgggtaccacccgcaaggaggtcaggggtggaaccagccccgtccgtatttccaagaaggcaataaccaagctaactactgacgcacttaataaaaagatggttgctaatgacaagatcttagaaaatataaatgtgaaactagatggctttgcttccgcattccaaaaccagctaagtttcaatgaaatgattgaaacccagttggcacaattagctgctctagttcctacaaatgaatctgggaggattccggggcaacccgaaccctccatagaaaatgttaaggcgatcacgacgaggggaggtaagtccacttgcgatccgccataccctaacaatgcaggtactagcagcaacagcagggaaacaccgtctgacgcagcggctgaagaagaaattcagccagaaaagaccgtgccgcagcattactgcgacacgaggttgctgccattcccccagaggatgaggaagccgtcagtggacgagcagttcgctcgtttcattgaggtgatctagaagattcacatcaacgtccgttgttggacgctatgcaagtgccaacatatgcacgttatctcaaagacatcctcaacaacaagtgaccactaccgacgaccgaggtggtcaagctgacagaggaatgcagcaacgcgatcctccacaaactcccggagaagaagaaagattcggggtgtcccacaatcacttgctcaatctagacacaaaaattcgaccaggcactctgcgaccttggggcaagtgtaagcgtcatgcccaaggacgtcttcgacaaactcaactttacggtgttggcaccaacaccgatgcgccttcagctggctgactcgtcggtccgctacctagccgggatagcagaagacgtgccggtaaagatacgggattgctttatcccggtcgatttcgtggtgctggacatggacaccggtaaggagactccgctcatcctgggcgtccattcctgagtaccgcagaggcaaacattgatgtcggaacaagaagcatccgtttccacatcaatggaaaggaggagaagttcgagttccagccgaggacgaaacaatgctccatggtccggttaaagtacgggccagccccgtagaatattcagacggtcgaagtggagccacccaaaatggacagcctcatcgctttcatgaagaaatctctggagatacaaccttccaggatgaggtcccgttattggaagacaccggcctagaaggaagagaaaccggctcaaaagaagccgccgcccataccaaggacaaataaggtatggtggctgaaacagaagacgcccgctccatcacctccggagacgggtgaaaaatccatgaaatgaacgccggaggtacggtcttgcacgtcggacttgaaatgacgccgccctcgccaataggtaaattggtatgtatcctcatatttattttcaccaatttgatttctgcatcatcaaagcatgtttgaatttctcaaaatttgcatttaggtttgaattttgaggcaaatattcaaaatgaatttttcagagcaaaattttcaatcaaaatttagtttgccacgaccacactggccgttggaacccaacggttaaaagtggggccggttgggcccactaggggttcggccgaacggccaggcaacggtcggccgccacttttggcagaccaacggctagtgggacccacatgacagtttcgaccgttgttggtgccctatataagccaaccggtcgagagagaggaatccaccccatttcaactcattttcatttcctctccaactttgctctcaaaatccatttcaagttttgcaagcttgtctcaaaatcaaacactttagttgcatacacaagttgtttcgttgaagctaaccggtgggtagaacttcttgctatcctaacccccgccgagttagtccattcttatttgtgcagaacgaggcgatggttgtcccgtctgttcaagaagggatctggctcttcatcgggaacgaccaccgacatatcgatggaagacaccgacataccgacaagcctcttgaccgacaccaacctcaaccttatcggtgatcaggaattacaagcctaccatatgctgaaggaccggaagttcagccacactcgggcgtacgatccggaacttctgaggaaaacaggtatggatagtgattttcatgccatttggaatgctgtaatttggcagagatttgcagtagtagatgaaccaggttctcatttgcttaatatacaatttctgtgcactttgaaagaatcagaagatggcatatcctttcttttttccgtaaagagtatacgctttcatggaaaggattaagtacacttcttggttttcacgataactgtaaaaccgatcttcagaaaggaattcccgggttcaagaaaaacagattttgggaagacatttctggtgctccaacttgcagacgtcctaggacaaatgacatccataatcctacacttagacttatgcacaaatggattgctatgactttgtgtagacccccatttttataacaggaatcaatcgtgtaaatagtaccatttccctggatcaagtagtctggtacacacgaattcatagctaaaataccaagtgcacatacacgagtgtctaatacgaattattacatcataagcccgcaggcatagtcttaaatcatcggaccgagcggtccggaatacatccaaaagcagaaatagataaggcagcggaattcaggcagcggcatgccattgccacaggcaacaaccgtactaagacctactgagcgcc

SEQ ID NO: 62847 - DNA, 3082 bp, Oryza sativa
ttccgtaaagagtatacgctttcatggaaaggattaagtacacttcttggttttcacgataactgtaaaaccgatcttcagaaaggaattcccgggttcaagaaaaacagattttgggaagacatttctggtgctccaacttgcagacgtcctaggacaaatgacatccataatcctacacttagacttatgcacaaatggattgctatgactttgtgtagacccccatttttataacaggaatcaatcgtgtaaatagtaccatttccctggatcaagtagtctggtacacacgaattcatagctaaaataccaagtgcacatacacgagtgtctaatacgaattattacatcataagcccgcaggcatagtcttaaatcatcggaccgagcggtccggaatacatccaaaagcagaaatagataaggcagcggaattcaggcagcggcatgccattgccacaggcaacaaccgtactaagacctactgagcgccatcgtcttcatctccctcctggtagtaggcatagggatcctccgaggcttcatctcccgcttctgattaattttatatttgcaagggtgagtaccaaccgtactcagcaagccatcatagcaatgatgcacatgacagaggaattcaaaggatggctatggttctttttgcacaaagcaagttttgtaattcttttcacaagcctaagacctagcatagactgttcaagttttaataccagtgttcatattaaataatgacggttctgtccaccatccattgtgatcccaaggatagcttcccgccattgagtcgttatggttttctgaggacgtccacattcccgcctcttaggaagtggctccatcagcataaaaattcatcatgcaatatcccatcccacacaagttaagaatttagagtctagccaagtgtaatacatgtcccggtgctcaataaccgcgagcacggctattcgaatagatttggtttactcacactgcagtggatgtacactttacccgcactccgcgactacccaacacatgagcctcgtcccaacacatgagacacgtcacggcaaagcttttcgataacctcgcattggcagtacccgctccatgaacttaaatcctcatgcactctaggcgtccatgtttctagcagtgagaggagttctggcgctcccggggaaagagaagtctcacacgcatattaaattatggttcaagttaagttctctctctcacacactcatggcagtcctaccaatggcaacaccgatatagggcacgcctctcggccctacctcaacggctgtcccatcgtagcgcacctgcctcaatcaggggtgaaccatctatgcagggatactgcctccacttggctatctaatctgctaggtctatacccattcgagaagtacggttgtacggggggtcgtttcatgcttaacttcatggctcggtccttaattgactagggacggtactagccttttccagataccacccaaatcctccgtccgccccagtcgaaaacagttgttttaattttatttctcctttcacaaatcatgtcatcaacatcatggcaatgtggcgctcatgtctccacatgccgcatctcaattaccttcccgaaggtaattgcccaagcatatagcatttgataaatatgagtatgcatgattctacaatagcatttctaagcaattgtcatagttgactagggactcatacgtaagcatggttacaaagatttaagggtaaacaataatcaaggcatggcataatcacaagtaggatgttcattatttcatgcaatttttatttgtaaacaaaacaatttcgtaattaggatcaacatgttcgaggaatagtgatgacttgccttgctcagagtcttgcaggtctcggccttcgcttggatccgcaactccctcgggctctatagttacgtgcaaaaattgatttgaattcggttagaattcaaataaaaatccaaataaatccaaatgaaagtcgaatgtgaaagtcgattcctttttattaactttactatctgcgaactacggcaaacccaattcgacttaaactattttgcgggcataaatattttgttgtcataagtttttaatttactcttcccgagcattatatccatataatagggtagaaatttctattaagagctaaatatcggaggaaatcctagaaatattatacaatttaatttattctatgactaaacgattaaatataatatgcggctaagattcttagtaattaaattcgaatttctaccgtgaaccgatgacttatagagattaccaaaaataatctataataatctataagaattcatctaattgtttagttattaattatatctaaattactaccaattttaatctaatctgatcaagaaacatattttataattaactcggaatttcgatcgaaatactattacgctcgaggaatttccaaaaataatctatgattaaccccgaccatttttatttcctaaatcctcctaatttctcccccaatttcccttctattttctccttttcttcttttctattttcccaatttttctctcctctttttctttttctctcttttctctccctctctttctttttctctcttttctctccctctctttctttttctctgccggcctctcttttctttttcttttctttttttttccttctcttctctcctcccggctcctttctttcttcccttctcttcctctatcctctttcggctccttctcctcctctctctcgtcctgcctaccgcgaccggctgaggaaaggaaaaaggcggcggcggcatggcttaccggcggcaacggcaatggcggcggcgcacggtggctgcgacggcggcggcgcacggcgactgcgacggcggcggggaacgcgcacggccaaagcgcggcgcggcagctctatgcgacgacgcggcggcgtgaggcggcgtggtggggtgggtagaggagaggaggtgaggatggagggaaagagtgggagtagggggggattatataagggaaggggaaagagataat

SEQ ID NO: 62848 - DNA, 4104 bp, Oryza sativa
  unsure (1)..(4104): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaataaaatatgagtaatattaatctagtgtaatttccgtataaatttgattccacaattcttaattttgcatatatgcattttactcaatatttgtgttatcttaactaatgaattcaccctagattaatattactcatattttatttttatgtaatttatttgagttttaattagggttaattcttattccatcgtatttaaatttaattgatccaaatatggtcgcgataatattttatttatttctatcccacctaatctttattttgtatttattttaccaatttgtttttaaggtttattcctaattaactattctttactcacgattaataatcttcgatatcaaattcagataaaatacactaataagatcggcatcatgtaattagtttaaaaagtttttgaaaatccgtatttttatagtcttgattctgtcggtcaaattttcacggtgttacactttgtttcctacaggtgatctttgacccattcaaggagatgaattgattatcatgtttgccatggttagaaaaattaaaatcgctcctgttaaatgtatgataaggcaatggttagtgtcgcgaccgagaaaattgcattttcccgaacgctagtgtattaatccccgtcccagcaaaagccggggtacaccatacaaacatgatataaaagacacatctgtattatatcgataatatttacattattacaaaggcacttaagcctgacaatcaaaaataaacagcagcggactatcgggcctactgctccatcttcacaggcgctcaactggggtataagccaggactcacacctaagacttcttctccaaagcttctcttactgaagaggggaaagattgagcaagaatgagtacaaccacagtactcagcaagtcacaccggcagatgcatgattaatgcaagggggtacaaggggataataataggggttaagttttgcagtaaacagcatttaaaagtcacttagttgcccaaagccattttataaagacgatcctagagttacacagtgttattaatcaaggccgtgaacccacacgaacctgccttaacccaaggcctacgatgattcagaccgaactagcaacccgaccctgggtcccagctcgtcccaagccaacccaggccaaccattccatattttagttgttaagcaaattttaggaattaaaacgctaacttgggtacattgctcggcttgcccataaccgagggcgcggctattcgaatagattatactctgatcagaggtgtacaactttacccacaagacacatcttcctcacgtgcaaccacgtgccacataccaccacggtatacaggcggaagacgtgacatagtttccaacccatcctagccatagagaagagtaccgacccaatcccacctacggccggaacctccgggacaggcaggcaggactgagcccccagcagcagggcaccaaccctgtaccatgacatctcgactaccgggccgcagctcgtgtagccttcatttgccctggagaatgtccatcgacccccgacttcatccacctccaatcgttacttttgtttataacttgactgagccacaaactaagccttacccactagacatgtgaaagtacggtagtgctttgcaacagaggcccgaagaccggtccttatatggccgaggtgctactatcaaaaccatgcaccccgagcccagcctaaaaccattttggggattttgaatagagggggcggtgtgaatccaattccacaataaaccaacaattccaaagtgtccaagtgatatgagaattccccaagtctaaagttataaaaccacctaatattgtctaattaaacagcgaagcatctacctaaaatcatactagtggtaccatgagtagagtatccactagttggggttttgtttaatctagggtggacaaggtaataataacaataacaacaataatacggtcataacaaaggtaaataggcatggcttagtaaacccgtgataacgcgggaatttaaataaagcgataatgcaataatttaaatcaaaataattttataaactgggattcaatatgttcaaggatgatgtgacttgccttgctcactttcccaaacgccggcttcaacttccacgaagagcggatcttccgaagctgcagcgtctacacgaccaacggaaaagaaaaggcttttacgctaataaattccacataacagcagaaacaaagcacaaaaatgggttcttgacttcttaaggaaaaattagagacttgaacggtccaattacgagttcaaatggccaagttatggccatttgaagttatatgttctttaaatggatatttgcgaatttcttcatttaaattttaatttaaaatcgaattattgcgtcagccgggagagagggcgcgcggaccgggtccacgggagtgggacccacgcggcagcctctcggtccacggtggaccgggtgcacgcggctggcgccgtgggtcccacgcgtcagccgcacccgcgggcgcgagcggctgacggccgggccccacctggcagccgcggggcgcgcccgaaggcggcctcgccggcacggccgacgggaggcggcgcgcccgcgccccgatggtcactgccggcgaccaccggcgcggcggagcggcgcccgagagagaggagagaagagggaagcgaagcggcggtcttcggctcaccccgggtcgacggcggcgacggaaacggcgaccgaagcggaggaaggcggcggcgcggttcgggtcgacgaggacggcggtgctccgcggtcggcgggcgaaacggaggagcggacgaggtcgacaggacgcggcgaagccaaaggaggtgacgccgagacgagaggaggtccggggcgacgacagcggcgaaccggagctcggcggcgacggcggagagagaggacgacggcgcgggctcgattccgaaggggagagtgagcggcgagccgcggaaacggaggagggaggcacggggaacgattaaatagcgtcgggagggggagagagcggccgggcgagggggaaacggccgcgaaagatgcggccgccattgatgccgacgaggtttaggggaaagattccgagcgaatccgagggagagagagagggaaaagtgggggaaaagggagagggaatcacggggaatgattccccccactttattgcgcgcggggacggcgggatgcggcggaatccgcggcggcggcggcggcgctagggcacgggcgggcggcgggagcggcgcgaggatagggatgacaggcgggccccacctgtcagcgagggtggcgggcgggcccgcccgtcagcggcgcgcgcgcggggagaggccgagtgggccgcggggagaggagagggagggggagggacatgggccgagccggcccaagaggggaaggggggaaaaagaagactttttaggatttttctttttataaaatcattttaactttgtttatttcttaataattattatttgtgctctgagaattccactaaaatttgagggctccttttagaccaaggagaatttaacaaaaaatctccgggccacatttgaatttttcttatacgtattttagtgtttgccaatttcttttcgaattttaattaattctattattccttttagaaaatgatttttatttcgggatgaatttatcaggacgtgacaaatccaccccccttacaagaatctcgtccccgagattcgaggaggctagcatgaagataggttgggcggtcttctcttcttgtctgacttcttccgtcgcgtcttctataacgaacttgcctagcaaaacttctccactctggactgcttggctcgatctcctgttga

SEQ ID NO: 62849 - DNA, 896 bp, Oryza sativa
acatgaatatatttatgtattacatgattgctgcgaactttcgattacacaatgataggtagcgaactgaaacccccaaatatggctgctcattttgattctggagagatatagctggcattgttctagtgactgcatccttgattagttctgtgatgatgtgataggactgcatattgctatcattcacaggagaagcttccttctgattgtgggttgaagcggatgacggtcttctgcttggtatcgccctccggaggttgattgccctttgctcggcctggagtaggtcggggagagacacaacttcttccatcgacgacaattctttgctgaggctgtcggtgcagagaatggttggtgctaaaggtattattgctatgatttattgcagagctaggtggagcattggtgctgtggatgatatcgtcgatgttgctgttggagctgactagctgatgagacaatcgtagggttgttcgttggatttctgcggtcttggtcaacaacacactgagttggcaatccttgggcacatggtttgttccttcgcacagaaaacatgtcaccttgcgagtgggacactcccctggtggatggtcttcttcctagtgagtgcagagtgtgagacacatgctagcaacgtgtccaatttctccacaacgggtgcatgcctttgatccgaagaagacatatctgaaactcttagtccaaacaaatgtctctttggttgatcacttgattttcttcgccatcaatcgctaggttatttgattcataatagattatgagcttacggaaatgagaccctaggtccccctaatcaacaacaaaatgtacacaactcacagctcttgcaatcttaacatggatccttcataaacttatcaaactca

SEQ ID NO: 62850 - DNA, 7626 bp, Oryza sativa
  unsure (1)..(7626): unsure at all n locations
gtcttttgtttgcaaatcaaaagcagattcaatgcagcttggacaaaattgttgatttctctagtacccctctgcttcatattataaatcgctttaacttttttttcttaatcaaacttataaagtttgactaagtttattaaaaactagcaatatctataatactaaagtagtttcattaaatctagatttgaatatgttttgataatatattattctttaggtaagtttaccattctttaaaagatactaggaggtaccatattttctgatgtgtaactttggtaccttcatgtactataggtataggataccaaaattttaagtataaaatttaggtaccttgatatacttttctcaatgactgtaatatttattttgtcttgtgcattggaaatgtttctacgtttttctataagcatggtcaaaattaaagatgtttaaggtcctataatatgatatggagggagtagcaaggatgatctttttgtttgttcagttgtaaaggaacttccctttctcacttatgtggaaattaaaccagcaagaaaagaatgctatcacttgtcacagctctaatgatgatgctgtaacattgtaatccaatccttcaatcagcctccatactagttatacaactagcttactaccactgctacactatataactgaccaaagtttcttctctgaattctgatcaagacactgaagtctgaactacatacagtgtacagtcacctaaacatgaattctgaacaacttgatcccttgtaagctgcttcttctagggacatataagccatgtcgacggattcaagccatgtaatctacaacaaccgaacagccctagtcacctgtaaattaagagagttgagaggcactgaacatggaaaagaacatataaataagtagtatctgaagtatcatgttctcctatgaaaaattgtactcttttcgagacagagtgtggttgtgagtttgtggactacactatattgtgttcatcaaatatgaaacatgtgctgactagattcattttcatctagctgaatatgcgccaaagacatgctactaatttggaaatgggaggcttcgggtcattgcgatttgcgcagcttgatcaacctacagtgccctcttccttggccgtctcaagtttccttccttgccatgacacagaaaaccagggtttacagggaaataaatggagggaaacaacagggtatacaacaattccagggtgacctggatggagccttgttgaggaatctttgctctctgttgtcatgttgtttttttatgattctttttgtttgtgaagttgtaacctaaactttgcgccttttccttcttaatgcaatatcgcacaactcccttcaagttttctgtttataaaatttgcagcatcattcttgtcccacagattcagtccaactcactggttacttaaaccatttcactgaatctgtttataaaagaacttttctttctcacatctatggagtgaacacggtcagtcagaacatacaaacaacaagcaaacatggtaaattaaccagcaagaaaaaaatgttatcacttgtcacagctctaatgatgatgctgttacattgtaatccaatcatttaatccgcctccatactagttataccactagcctactaccactgctacactacattcctgaccaagtttcttctctgaattcagaacaagacactctgaagtctgaagtacatacagtgtacagtcacctaaacatagagagctctgaattctgaacaatttgatcccctgtaacttgcttcttcaagggacatataaacctgaccacattatgtacacagcaatcactcttaggcctgaatgtctgatgatagatgctgcctggcaatgctgccatttggccttccatgcgtcaaggtttgtttaagccattaaatctgcaattgttaagcagctaaaagtttttctttgcaaaattcgttgaggacaataccttataatagaaaataaaatataataactattttactagtgcctgaaacttttcagatgaacaaaaaaactcctttcgtatgacataacgtatgtaattcaggtgttttcacgttatgtttgccgcgtacaatgttatttctcataccagatagtttcgaagtccaacgaaagttttcttcaaggtatccctcgtcctacctatctgatggtgacaaggtggtcaaaacaaactgtccaaatcaccaaattcagctcattgactgaagaacaatatcacttctagtctcatattctcatgctattcactcttaagtcatgttgtaatcggcaatattcgagcagccaaattcatctgtaaagagacttgagtcacttgacagacactgaccttggagaaaaaacatagagaaaatataggacttttacggtacattctactgcaagtatatacttgcagtatataaaagggtatgtttggtatttgttaaaaatctgaaaatggctgtttagtcatttgaagttaggatttatttttatcgggagtaattttccaccggtagtagagattttttggtcgcacttgcatctgaaaatatttatcagcactgttaagttttggcatgcatagccatgatccatcaatttgatagatggtgactagttagtccatacttttttgccagacatatcaagttctcagtatctactatgttgatttctcagtttatgatgggatgatttgccagttttatcaatccccgcacggaggcggcaccaggagacagtcatgcaaaatgaaaacgactatggctatcagtacaatttctcaatggggctggggctggcgaccgggcgaacgagaggctgggacgcgtcgtcgccgacggcaccgagtttggctctggcgcttggagagttttggttgtcgacggcggcgatagcgcatggaacgaaggaaagctaacctctcgagcggatttatctcaagccggatctgacaaaaaaacgcgaaaatacaaaaataccctttttaatttatactgcaaactaatttagagagagatcagatgaatctgtaccgttggatcgtttatactgcaagtatatacttgcagtatagagtaccgtaatcagtttgtgagctctgattctgaggtatccatgttttcctatgaaacattaggcttggactacatattaagtttatcaatattgaaagttgttaagagcattatagtcttctcccatctcttttacatatcatatatacctatttggcctaactcaatattgcaacaagttcgatcctcaatttctctcttctttcagtatttgacaaaagtgaaacaagtgttccctatatccatgttcatgatgagttatctattcgaagacgtgccggaaatcctaattaatttggaaatgagaggcttcgggtcgttacagtgccagatcaacctacagtgccctcctccttggccatctccagctttctgttcttgccatgacagagaaatccttggccccaatttgttgcaaatactcgcaagacttgcagtgggtgtcgctgttactggactgcatcatgccttgagaaaagagaactatcaccccagggaactgcatatgtgtgatcaagttacacagagaaacattgatcacatttgatgaaattatcagggaactgcgttttgttctgtatgattgtgcttttggttagctattttgtttgttcagttgtggccagactctgcacttcttcttgatggaatgaatgcgcacacacatctttcgcacattccctaaaacatatgtgtgcacttcttgttttctgttataatatttacaggttacagcaccagttgttgtcccacaaatgtgctcagctcaagccctatgtccaagtcattgattagaccatcccaatgaattgaatctcttgtactaaatgaagttctctttctcacctgtggagtggtcagtcaatcagaaagaacaagaaactagggctgtgtttagttcccttcaaacttctaactttttcgtgtaggatcaaatcacagtaactaagccaaccagagggggagtgaatggttggtatacccaaaaactgaaaacttttagcggaaataaaagctaccctcaaattcgacggatcgcggtctgaccgaaggtgttgcgctggtctgaccgcctgataaacgtcggtctgaccgatgtagattgatcggttgaaccaccgagatcgcctactagctcctgccttcgctgccggtctgaccgcctcgtacccgccggtctgaccgccgcaatgttgccggtctgaccgccggtgcgttgccggttagaccgccgaaacccggagaacacaaatcgaagaactcttaaagtggatgacgactttattgattctctctgtgtttacaaagtgcaccaacagcactccttacaaaaatttcgactaaactcgaaaccataattcaaaactcaactcaattgctctcaaaagcgatatcgggaagcctcacgctccccctctatttatacccgaggtaggcagcctaaagccacgaaccaaactcatactaggagtcctaaacaccttaggaaaccctttaacacaagaaccaaactttacataaccaattataccaaatttggactcctttcaaattcgacttcgcatcccatatgcacacaataactccatcgtatgccatatggaatcttcaccaaccacgtgcatcaactctagcctaagtatcccgcatgatttctgaccaccacggacgtcgtcttatccccaagccgactcccggtccatcaccgcaaatactctccccgaggcatcgagtcacctacacatgaaataaacaaagaaatcatattccgagaccaagctatctccaacttgactcattagtagcaaacaacagtattacatacgtatagtatccatctagaagccataatcatgaaataatcacggatatccaaacaaacaacccgaaaccgaaaccgacacagagtcggccggttagaccacgggctaggccagtctgaccgcgcgatacacgccggtctgaccggcaacacttgcccggtctgaccggtcacatgaaataacagcagtatcctgtagattcaccagtgaaatccaatcatctccataaccacttcgtgaataaattccaaatatcaaaaccaataatctccgatgccaattgttcattacaaaataataatcaaaaacacttttgattttacatttcgtcacatcaaatgtttagacacatgcatgaagcattaaatgtagaggaaaaaaatcaattgcacagtttccatgtaaattgcgagacaaatcttttgagcctaattacgccatgatttgacaatgtggtgctaaagtaaacatttgctaatgagggattaattaggcttaatagattcgtctcgctgtttacagacggaatctgtaatttgtaattgttttgttattagtctacgtttaatacttcaaatgtgtgtccgtatacgtcaaatttttttttgccagaataactaaacacggcctaggtaaacttgaaagaaaatactgttctcacaggtctaatgatgatgattccattggaatccaatcctcccgattcttttctgattaagatatatattttatctcggtttccgttaccacacttttcaaaccactaaacggtacattttgcacgaaaactttctatataggaattgctttaaaatatcagataaatctattttcaagtttagaataattaaaacttaattaatcatacgctattggttttcttgttttattatgtgaactcaaatagggtaaagtactaacagaagtttttttttccctttttctgaacaaggctgaccaaattatgtagcccgcaatctattgctcgatactccctccttactcataaaagaagttgtttagggcaatgtttaagtcaaaccttcggaatataaatcatgaataactctcaagttgttgagtttaaaaatataaaaattatatgaatatatttgtcttgaaaaatactttcataaaaatatacatttatcacttttcaataaatatttttatagaaaaaaaaatcaaagttgtgttttggagaccgtgtcgcttttcaaaatgactttctttactagtaccgagggagtacatgctttggcttccctgaaaggcgaagggctgctcttgacctcaattctgcatcaatttttaccatatatcaaggtttgtttaacccatcaaatctgctctcattaagcagacatcttggcttagcacattaatatttatataacatactgtatataataaccagttactagtttctgaatcctttttttagatgagcacagaatctatgttcgtcaggcagcgtttgtcatgttccttcatggatgaaagctgtgtaacgtcatctttgtcgcgtacaattttatttctcaaattgtcatgccagatactttcaaagtccaatagaaaatttctacagggtatcgatcgtcctgcccgtctgatggtgacaaggtggtcaaaagaaactgcccaaatcacaagatttcactgctagtctcatgctctcatggtatgatcactcgtcttctttaaatgcacaacaatccgtgtcaaatcatcaaaagcaaggaactcaagcaatggcaaattaaggagggatgtgtttagcactcagttaatcgtctgacatacaattcttaccgcatggtaaaccagaaaaaagaaacaaagaattttgtgaattgacacagcttgtacttcagttcagatactatggcctgcttggactttgttcacaaaattctttgtttcttttttttccggattgtcacagttcagatactatattcacaaatgtatctaacttaagtactcatgttctctgatgaacattggactttgttcctgagaaagagtgaggttgtgagtttatgagctatattatgttcatcaagggtgaaacatatgcttgctccatgttttctgtttataaaatttgcagcatcattcttgccccacagatgagctcaactcaattcctatatccaagtcatggattaaaccatctcactgaacctctctttctcacttcaacagagaagaacacatggtaagccagaaatgtataaagagggtaatcacttgtcactcctctaatgatatgactgcatcgtaatctaatcctttaatcagccaacatactagttataccactgctacactacactttgtaactaactaaaggtttcttctcggaattctgcacaagacactctggattctgattgtctgaacaacatacagtgtacattcccctaaacacagagagctctgaaatcttaaccacttgatcccctacaaactttcttcttcaaaggacaaatgaacctgaccaaaaagtctgtttaagccattaaatctgcaaatcttaaagcagccaatatttttctttagcaaaattggttgaggacaaaaccataaataaataaatacagtataaccaattnnnnnnnnnnnnnnnnnnnnnnnnnnnnnnnnnnnnnnnnnnnnnnnnnnnnnnnnnnnnn

SEQ ID NO: 62851 - DNA, 2564 bp, Oryza sativa
aaatcttaaccacttgatcccctacaaacttttttcttcaaaggacaaatgatcctgaccaaaaagtctgtttaagccattaaatctgcaaatcttaaagcagccaatatttttctttagcaaaattggttgaggacaaaaccataaataaataaatacagtataaccaatttaggctgtgtttagttcaagccaaagtttggattttggttgaaattgaagatgatgtgactgaaaagttgtgtgtgtatgacagattgatgtgatgggaaaaataggaagtttggatgaaaagtttggatctaaacacacccttactagcgtctgaagctcggatgaacatttgactttgttcgtcacacatagcatcgtcatggatgaagtctgtgttcacgtcatctttggcgcgtagaatttaatatcacaaatcatcatacctgatattttcagagactaataaaaaatttcttcagagtatcgccttgacctacctatctgatggtgacaaggtggtcaaaagaagtggcccaaagcaccaaattcagctcattgactgaagaaggacatcactgctagtctcaacttgtatcaaatccttgttaaatcatcgaatgaaaagaacataagcaatgccaattcaaggatggatgtgcatttatccacaaatcttgagcacaacatggtgaacttgatccaggaaataaaaaaaaaaagaattgtcacttgacacagctctgatgaatctgtgatgatgagtaacactcagtatactacattaattagaatcaaatcattaatcaaatctccaatctggagtaacactgctaaactagaaactaacctgcatatcatactgctcataagccactaatccttaaccatctctgaattctgaacttgcctgagaactctgaatactgaacatgtctgaaaactctgaatttatatacagtggtgcagtcacagagagagagagagagagagagagagagagagctcagaagaatggcgcgccgagcggctccgtcttcgccgccggcggcggcgcgagcatggagaggtcgtcggcctgcagcagcgagccgaggccctggaggtcgtcgaggctcatccccatgagccagtcgtcgtcgcgcgcctcctccttgggcagcagggcgtcgtcgaacgacgccgccggcagcgagtagtccatctccgggaacgcgtcgctgtcgacgacctccgactccggcgtccgcgtctccccccacgactgcgccgccgccatggcctcctcctcctccttcctgctctgcatcttctcccactcgttcttcttgttgtacagccggcacagcacccagtcatccagcctgagcgcgcccgcgcccgcggcggcggcggcgccgcccttcttggcgaggcggtactcgtgcatgatccactccgtcttgacgccgcgggggggcttgccgtggtagaacacgagcgccttcttgatcccggccgtcctgccgttgtgcagcacgggcttgtcggcgccggtggccttccagtagcccgaggcggcggcgcggttggggcgggagccgttggggtacttgcggtcgcgcggggtgaagaagtaccactcgcggcggccgaagagggcgcggtgggggaggtcccatgggtcgtggcggtagaggtcgagctcggcgatgatggggaccggggcggcgcggcccgcggcgcgcgggcagaggtagtgcgccaccagctcctcgtcggtggggtggaagcggaagcccggcgggaggttcaggtccgcctccgcgtcgcgcactcgccgcttcgccgccgccatggacacgaggtgttcgatcttgggacttgagggaatgagggtggtgggttgttggatgtgagtggcggcgggggtgggagggagatatatatagagggaggtgggaatggagaagattcgtggaaagaagagggggggtcgaggtggatatggggagggtggaggaggagaaaaaagcactgcagcggcatattcggtcgtctgtctgtcctctgtcggtaccccggttgatgttcatctgctttttttttacctttaattttaaaagttaaccgttctaaaatttgttttaaaaatctaaacctttttacaatgttagcctgcttacgcgtggcaaaataataccgtcacactcacaaagcccgcaatggttgtgatagttttgtcatgtcacggtgacatagcaggacaatattgtcacgccagctaggggtgaaagcggtcacggaaattaccgatcgaccggatgtcgttttcgtttaaggggtactgtttccgaccgtatcgattttggctatttttaaattgagtaaagtccatcaccggtccctaaacttgtactgctgtgtcatcccggtccctaaactcgcaaatcgaccgttcaggtcctcaaacttgttctactgtgtcatcccggtccctaaacttgcagatcactcgtttaggttctccaacttgttcagttgtgtcaccccggtctctaaacttggatttgaatatcatctgggtcaaatag

SEQ ID NO: 62852 - DNA, 2002 bp, Oryza sativa
  unsure (1)..(2002): unsure at all n locations
nnnnnnnnnnnnnnnnnnnnnnnnnnnnnnnnnnnnnnnnnnnnnnnnnnnnnnnnnttgaattttttttattttaagtcatttttttgtcccaaaatgtaattttaaaattaaaatttaaaaatctataaacatgcaacaatattttgggaccctaaacagttttaattcaaaaaattttcaactacaaagttgtaggttgcgtcgagggctacaattttgatataaagtttgtcttcattagagttcacatgaaaaagttatgaattattttttatataaagtttttagaccgtcatgtttagggaccggggtgacacaattgaataagttggaggacctaaacgagtgatctgcaagtttagagaccgggatgacacagtcgaacaagtttgaggacctgaacggtcgatttgcgagtttagggaccaggatgacacaatagtataagtttagggaccggtgatggactttactcttttaaattttattttttctaatttctttctgcatcgtattaatgtagatactgaatactttaaatgataaatattgtcaataaccggcctatcgagcatcgtttccgaagtgatgctatcgattccgaccgtttccgatcgttttcacccctaacgccaaccataccgacatggccaaatagcattgtcacactatttagacgagcgtggtaatggtgttttaccacactaacccgcctggcatgatcaataaaattaaagattttttaggttataactgttgtatcaaaatatgaggattcctacaatgactcacatgattccaatcacttcaataattctaaatccaaccacatgcttgcaaaggaaatctaggcaactaaaaattcaaacattgacaactgtagtgactaaaagaaaatcatttgatttaaccatggtacgtgctaaatgaccttacaattcttattttatctaacaaagggaataagtagtagtaccagctaataattaatactccctccgtccctaaatgtttgacgctgttgactttatttaaatatgtttgaccgttcgttttattcaaaaacttttacaaaatatgtaaaactatatgtataaataaaagtatgtttaacaataaatcaaatgataggaaaagaattaataattacttaaatcttttgaataagacgaacggtcaaacatgtttaaaaagtcaacaatgtcaaacatttagggatggagggagtatattacttcctctgtagcagagtactattcttcgtctaaatagtatatccctttagtttaaatttgaactagagaagtacactcattttaggacgaagagagtaccaaattaagcacatccgctatctagttttttaaatttattttggaaccgatggggtacgtgggagtaacgaacaccacagcgaaagcgacggtaaacatacatgatgcgaaaccgctaattcgcatcacgtattatatatatagagagagagagagagagaaaaaacgagggaacaaaacctaccgcgcgtacgttaacgccgatcggccgatcgatgtctgggtcgttttcaactgtatagtagagtgagtggtctctggcgtggcggcacgtgcggccatcgcctaatttcatcacaaaaaggaaagaagaaagaaaggcgaccgatggagacgtggacggggggtcgcgcgcgaacgtacgtgtggattcatcgaacctgactgacccgacccgatcgacccgagcttctggacgcttttgttatctaggccgacggcgacgtatacaggcctcgtgtagtttgcgaaaaaataaattttaggttatacttcctccttcgtattttaatatatgaaaaagtacgaattacctttcgaactattacggtcatctgaattaccctcttgaaccacaaaaccggatatttttcaccccgaactatgtaaaccggacgaattacccccctcgatccaaaccgcggtggttttggtctacgtggcgg

SEQ ID NO: 62853 - DNA, 7925 bp, Oryza sativa
  unsure (1)..(7925): unsure at all n locations
agcccccgccgccgctcgccgcctcatcccccgccgctcgcctccaccgccgccgccgctccctgtcgcccgcctacctccgcggcacgcgtgagtgagagagaatgagaggagagagagaggaatagttggataggagtatgacaggtggggtcccacatttttttaataaatataatgctgactggactgccacgcgtacgccaggtagagcaaatccaccacggtttgggtcgaggggggtaattcgtccggtttacatagttcggggtgaagaatgtccggttttgtggttcggggggtaattcagacgaccgcgatagttcggggggtaattcatactttttcctttaatatatgacgccgttgattttttaataaacgtttgacctttcgtcttattcaaaaaatttatgtaattatcatttattttactgtgacttgatttatcatctaatgttctttgagcatgatataagtatttttgtatttgcataaaaaatttgaataagacgaatggtcaaacgttagttaaaaagtcaacggcgtcatacattaaaatacagatggagtatcggatattagaatggattttttacacgaataaaaatactaattttataactcgtctggaatcttttcagtctaattaatccgtaattagcacttaggctcaaaagatttgtctcatgatttcttccctaactgtgcaattagttttttttaaatctatatttaatgcttcacgtatgtgtctaacaatttgatgggatgtttttaggaaaatttttttgataactaaagcaggccatataattaatactattggcagcgatgacgtcagtgccgacttcatccactcttgcacgtataattaattatattattacttctagattactactgcccggacgggaggtgatgccataggctacagcaatgtgtgtaggtacgtggttcttctgcagccatggaagtgtgtggtccgtttgtgtgcatattctttacctgctttgccggttgaatgtcgatgcaaaagttttcaattacggatagttgttcatgtgtactcctctgtcccttaaaaacataaatctaaaattagatgtgacacattctaatacaaagaatttagacagagacatatctagatttataatactataatgtattatattcagtactaggttaatttttttatgggacgaagggagtgagtgatcttgagaagcatatattgtttacggtatgtggcacttacatcaggtgccatatggcagaggatatcaatatatgaagcactccctagattaatatatatttggggggggggtaaaattgatttttttaatgtatttacaatgaaagttgaccgtgatagcgaagaaaggaaagcacactagcgcggtagcattttgtttaactcatgtttatccatgataaaatgtgtagtagtagtagtatacttgaactttttgtttcattctcatgaatccgtgcggcatcaaatactctctccattccatattaattaatcatcatataaacatatagaaatttcaaattgatcatcatataaacctggtccctttatttgacatgcagtattattattgcatctatgcatgtaaattgagtatccatgcatacatttagggataggtaagcatttgtttcttgtgcatacgaggagttatagcctacatgtttcttgattctttccctccacatacttagattatataaaatgcataatagttttttcttcttagtggaaagacttatatgataactaatatgaaatggttggggtactagctacgggcctatacatcgcacatgatctagatccaccaatcggtactacaagtgtaactgtacacacttgcgtacgtcctactagtagctagtaggtagtaattctatgtcctatagaaactaacatttaaagttttcactaatatcctgcaaaacatgtcattcaacaatataatcaaagaagttccctaaaaaaagaattaatcaataaagaagtgggaccatatacttcaaaaattttaaatatgctaaagattattttgccatgtgtcgtaatttctgtgaccatatagctcctgcgttcgaaatacaacatggcaatgagttgtggaaaggatcgactaattaattaattacacgcggagagattattcgtgctcctgtcaaccacattgcacgcacttgaccataaaatgacagctgagtcttagtaacctggtcatttctagtaggaaaactaatttgcctctaaaaccttcttacaaccgtcgagttttgtgggacgaaagaagtaggtgaagtagtagagtggagcagaagatcctgagcctcgagggatcaatgcgtgcatgcgacagtgctgacctttccctgtcgccctgtcggttccctgttggatgatgattccaggtgatgagagagtggcgcgcaagtagccgccgcctccttccatagcatatccacgaaccacgatggccgtccgtcaaggggagcgaggggccgcggtttattggctccgtagtacgtactacctccgttttaaaataaatacagccgtaaatattcctccctaacatttgatcatccattttatttaaaaattttataaaaaattcaaaaatatttagttacacgtaaagtactattcatattttatcatctaataacaataaaaatactaatcataaaaaaatttcaaataagacgagcggttgaacgttgaacgtgaatagtgcagaactacacttattttgggacggagggagtacgagctaggcagccgcgtgcaattttggctgtgtttagttacacactaaaaatgaaagtttaattaagttttttaaaaaaattggaagtttatgtatgcagaaatgttttaatgtgatgaaaaagttagaagtttgaagaaaaaattgggaactgaactcagcctttacattctctttcaatgaacgaacgctcgatcgcaggttgttgacggacgcatgcatttccacgtgctgaataaaaatcatactccagcaatgagcctgctgcctacttcgatgcgtcgcatatggatatgggccatatgcaatgcagtgcaccccacatcgttccatatacgcacggcgcacaccctgctaattaatttggtcaagcctgacctttactgctcgtgctaatactaatattcaggcccacttctattcttcagcttcaagcacacttaatttccaactattagatgatactttttttttaaaaaaaaaaatctttatagaagttgttcaaaaaatttaaataaaaccatttttcaagtttataattattaatacttaattaattatatgctaatgagatttctcgtttcgtgtgtggtacaaatcttgctcatccacctgtaatagaacgaatcataagaatgtgttctgttggttgatttatcaattccatgccccaaaaaattaaaaataaaagataaagttctattttatatttttggtgcaaaataaattcgcatataacatggcattaaccccagctcaccaccatccctgtaaaaggaagagtaggaggggggacgccccaactctctcaattctaaaaccctagaacctaagtcgtccgatcaactgatgcgggaagagattagtgaggtgatctatataattttcttttgttttattgacagaaaagccaacgccctatacttctcctacagtgagaagaattacgagaagatgagaaaagaaagaacaagaagtaaatcaaagtgaccggcttcaatggcttcatcctcaagttagcagataaataaattctgcattgagtaaaagtgatcatgtttaaactaaatcattgagattatgtaaattagactcaacacgttcaaaactccattttagtttggctacttcctcaatttttgttagcacacatttaaaattgctaaacgttacgtttcttctaaaaacttcctatataacgagttgctttaaaaaaataaaaaatatatgtttttcaagattttaataactaatacccaattaatcatatacttatcacgcttctcgttttacacatggctaatcatccgttcaaaagcactttagaatgcaccctaataatagcatcttctaactaaaaaaattatctcaaaacatatcaatttctagctacttcaatcacaatcatctctcatttaatttctctatttttactttctcatgtcttaacttatcacaaacttttctcatttaatttcacattttcccttaatttccgtaaaaaaatacttatatatttttagatggagggcgtagtccactgtgatgctacaatttgtgattttagattttcgggctttcttcattgttttttgttactcaacttttatattgttatgaagaaaagtaaaagaagatgacctaaaattattattaaaaagagttaaaatccaaaattagcttgaaaaaagctgaaccaaatttaaaagctacctttgcaaacataggtagagggaggaatagcttcaaattaacatattgtttttcaacgagcatgccaacctccctgtgttataaggtgagggtggggaaacttccctttcagcatgagaatcgaaacgatggattagtgcacgattaataaagtattataaaaaaactctaaaaataggttaataaacttttttaaaacaacttttctatatttattatttttatttatcttaaaaaaaggcatatcttttagtagtccggtaaacgtgcgcgtgaaaaagggagcgagttgcgaaagagaagaaaaaacacacccaccactatatgtcttcaccgttgacagcacggcatgtacgccaagctgcatcttacatatgcctcctcaatatatattcggattccttatacttttaataaaaatcagcgcataaaaatctcttatactactgcagattcttcaacttttttacacctaaaagtctgaaaaacctttttgtccaatgtaaaaacatgggaagaaaggcttttaccctcgtgggattctagacacttgagtacatgaatccaaaaaaaaaaggcaaatggaccttttggatttagtgagcataggcgcagaccatacacgactagatgtggaatttacacttacatcttccctaattgaaaaccgaaaattccttcttgttaggttgaatgaaccgtcaaactttcgtataccagtagagaacacagtaaaaagcataattaacttattactctaaacaagtttcagatgctgatcgactccaattaccacatggttggtccacatgtaaatcagaaaagagagtagcgtcgcccaacacatatttttaacagacataatactaggattaacacagcaacttaggcaagcaggcagcatcaagttaccagatatggaagctgcagcttccagatgcctccactatctaaggctcctttcatcttgaaagaatcagcacccaaaatttcacactagatactgcttttcacttttctcaagttcagaacgttttacatgtaaacaacgcagaatcttcagattttcttggtataggcactgaaagaataacccagtgtcaaaagcaaaaggtgatctgatttggagacaaagatggagagagagccccacacctctcagatctggcacatttttcttaccaacgtagtacatggtatcttgtcttccagaagggttgggccctgagatatgtagccacctttgtcttccagatgtctgaggcatatggaagaggacatgagattttggattagtatgcaatcacatcaaaggactacacatgtaattcatgcttagtgaagacgacagtggaacaatggacctaagcttgaccacagcagcaccattaattcaaatgttattctaggatttgacgatttgttactgattctgcaggagcctaagggggataagttactagcgagaatgacctggccaacttttgttttgattaaatgtaagattattcgtcacaaactagcataccggttcacacaattgattattctttggtagtattgcctgaaccatcaatcaacatatatgaccctccgtacacacaaaaagacattccgccatatgtaaaaggtggactccattctggaacagagaatgggtttcgtgaaaatgcattattgagcaatacaatggttggtttaactccacgagacctacaaaaaatcaaactaacaccagccttgaaatcaaatacagtgtcatgttatctacctatccaatatccaggtgctcagctgccttaatatagaaatgcaggaaacctattagtagcattgaactgaccgggatgttaaggtctatataaactccttgcagttcaataatttattttgtttatatcaaagatctcgatcatgcaaagtaatttgtaggtacttacaaaaatatttttttgtaaattataggtgaggtgtttgattaaaaaaaattataagtgagggttttctaatgttaaaaggctcttcataattttggttggttctgcagtgtaacatcagtagcatgtaacaactagtttcactacaaatggattgcatcaatgtcctctccaaaagagaaaagaaaaaaaaatatttgggaaaaagatcggaagggtgtgaattgcatgcactgagccactgactactccactaccagcaatactatttcaaagcttgtgccatttagtattgagataccatacaagcgccagacaaattattaaagaaaagcttcattggtaaatgatgagaaactaagcaactgacaaggatgtgtaagatcataaaattggggagattaaaagcatgacagcaaatctgaaagttctatcaggcttaacatttgtgattgtctcatgaaatgtttgatacgaagaaacaaagtacatcactgatgtgcgtacggcgtaccatctagtgccagaatgctaggaccacagcaatactgaaaagtatcaacaaagcaacattcccaccaggcaaaatatcttcacatgaaccagacgatctgtatgaagaaacatacacaaaactggtcattacacactaaaatgataatatgtcgaacactaaatcatagaacaccaacagtttagaaactcaagttttttttgtgttactgtagttttataatattttatattacaaaacataacatcatttaatcattttaaaaaaacatgtcttgcatctggaaccaatgatcctatgtcacatatattgcatcatgttactcacacacacataagataagatgtgaaacaaagtcaaagatatctctggtttgccaagagaatgaaagggatggatagctacttaattttagaattataaagctggcttggttgttactaattcacaccagtgactatcatagttcttgaagagtgacaggtttaaatctagaaaaaaggtacaactaatgtctcgaaaaccatgtgattgtattgacaaaaggaggtgaaatgtcctatcttgaggctaacttgagtagtaataatggtttgttacagatgtgaaaagaatgagacacatgattcacaaagaaagtacatcaatagtgatgttaagaatgatattttgagctggaggttgtggacaggcccaaagctctgatccttgaataaaatgcatgatttagtgccttccaatggttttcgtattcagtacatgtcaatcttgctttcaatccctaattgttacttttacaacctcttttttaatttcctacttgacccagtacaatatgaaatttcagtcttgtattttgtcataagttttcttagttaccatgcaccatgctgnnnnnnnnnnnnnnnnnnnnnnnnnnnnnnnnnnnnnnnnnnnnnnnnnnnnnnnnnnnnn

SEQ ID NO: 62854 - DNA, 2838 bp, Oryza sativa
gagcatttctatatcctccttatttgcttccgattcataattgttgcctttctgactatttttgtaatttcccaccaaaccttttcttatggttcatcatgaactttttgtagttaccatgcaccagttccacatagttacacggtccagttcttttagacattgtacaagataaggagaatttataccaaattttcataaataataatgctactgatcatcatacattatttgatctgagctctctctatcctccttgatggttatctaaatttatatcagatatattgagttattgactaactgcaaaaagtatcttctagaagagacatggtctaatgaagttacctctttcataaacttttgtttatttaccatgcaccagttctgcatagttcccatgttgcagttctgctaatcattatctaagataaagagaggctgctacctggacgatttatatataatcgttccacagatcattacacactgtttgagcatctctctattcctcctttaattgttttctgaatttcatactataaggcatattgaaaactgaaaagtttatcttctactagaagagacatggcataaagcataattgatgttacctctttctcttctgtgaccggtgaatccaggccatgacaggagggaggatcccaaaaaggaagcagtttgcataaaccccagcaaaatccagtgccttggagaaggccgctgagaagaacgacgcaataacgataggaataatcagcacaatccatgtgagaatagccccatttcttccatggccaccgctagattcagagagctgcccaattcctcgcttcggagaaaacctctgcccaatcaactccactgtatcagccagctgcttcggaaagctcaccgcgtatcctatcaagctcgtcgccaatgcggcaaacgcaaagcctcgaacggcaggcaatgctgctggattcaccgagagcagcagcttaattggatcatcgaatctcgcaccgccactggaacttgccaacccgagaatgacggcattccaggacaacaccatggccaatgggacggcaccgccgatcagtattgcgcgccgcgcatcgtacactgaatcccccacaatcttgcagatgaacggcgtgatgacatggaacccaagcgtcaggacggtcaccggaattgcaggcaggatggtagcagggcgccagcaggcgtagccgagcgatctcagcatgctgctccggccgacggaaacgccggtgacaacaagcgcggtgatggaggcgagcatcaggccgcagagcgcgcggttggcgccgtcgacggccttgaaggggaagaacgcgatgagcgtcccggcgaagcacgggaagatggcgttggccaaggccggatccaccgccgggaagagctgggacaccagcgagccgatgccggcgacgcaggcgacgagcagggagaagctgagggcggcgtagacgacggccacgaccgccccgagcgtcgcccccaaggtgctcgacgcaagtcccgtgaagctgacctcgtcgacgccgccgtcctccatcgcggcgaagctgagctccgcgacgaggacgatggaggacaccacgtagacccacgagagcacgatcgccgccgtggacgggaccggcccggagcggatggtggcggacggcagccccagcatccccggccccaccgccgttccgacgatgaggctcaccgccgcccagaagctcttcttctcccctccaccggataccccgtcctcgacgagcggcgccggtgattcttcttcggcggcgtcggcgtcgccgtagtcgctccgccaccgccattgccgcctcggcgacagccaggacagcggcaacggctgcggctgcggcggcgcggggttcttggaagctagtggcggagggcgacgcgttcgtggctccgggaggccgaggcggcggcggcggcggagcggagaggggcaggttgccggcgaggagggcgtggcgaggtggaggcggctggagagtaacatggtcaacggtaaattttggtagggtcaaaggaggcgggtgaattctgggcctcttttaccattcgaggcccagtttttcaacatacgagtttctaaaacattttggattgggaatttgaagaatgaataataatacgtagtacaaactgagcggattcatgtaaaaaaatactgtaaaatttctgcgtcctaatggagcctcagcaaggccttggaagatttgggattagagaaattaatatggctgaatttacgtttccattgaaacggaagaattttagtgaattttcattatcattagtaagtagttcaagtgttcaacccatgcaagaatccttgaaaacaatcctacggttaacgcgctccacttgtgatggaggaattttgcaaaaatgaagtaataaagcctcgtagtgatcgattgaggctaccagtttggtgtgttaaggccattcgcactagtttgaggagctgagactaccacataggacgaagacacggaaaaaataatacttaccacaagtttcacagttctttgtgaaagtcattctctcctccatctccgaccgccgctcttccccccttctcccctcctctggtggctgccgctcccccttcctcctccaaccacgcctcctctttcttcttccggccgccggccaccgcgctacccactgggtatgcgcctcacctcctccatctccggccgccgcggctcccccacttcctccgaccgtgctcctctggggtcgccgtcaccatccgcacaccgcccggagacggagacgaaaggaaggacgaca

SEQ ID NO: 62855 - DNA, 1426 bp, Oryza sativa
tcccgtgtgccgtcgcgccgtcatctgtccgccgccgcgccgcccctccgcgccacccctcccgtgcgctgccgccgtgccaccccctcccgagcgccgccgccgtgccgccccccaagcaccgtcgcctctacctccgcctcccaacgccgccccctcctgagcgccgccccttcctgactcctgtgcatggtgcgccatgccgccgctagacagagacagagagacacgggagggagtgagaactgagaaactagggttagggttaataagttgtgaaatatataccatctgataatgggccaatggttgggcctaactcctgaggagggatgttaaactacaggcacattttcgggtcgggcatggattatccagggcgaaatgtaaaacccggctgtgcccactaagttagctggtgtcgggtcaggcgtgcccacggacaaaataacgcgcccacgcccatgcccatcgggtcgggtatccgcggatacccgagcccgtgggcattactaccatccctaccaaagctgctactgttttggctccctggtaggccctccccctcgcctcgttctatctttctcgcactagctaacaaatctctgacgcattttgacaaggaacacgtgactaactttggatccacgttcctcatctgggcacgggagagaccgacgtggctgggaatattcgagttgaagggctgaggatgaatgccagcggtgctcactataaatgcccttagtgatctcgtccaattattaaaaaaaaaatcaaatactctattcctaagtacaacaaaatcaaatcgtaaacaaactactaataaaacatgggaactccaattcagtgactttgtgcatgttggccaattgatttctctactcttaagggtttgaatgaatttaggtaatatttttctcccattccatatagaaaatgaactaattcgtacaaaattcagttagaacactatacacttgatcatcaacattgtgatatctcattagccgtatatccatgaagatcgtcaccgactaagttgcagttagtggccaaaataatatctacattttggagagaactcgctcactgtttgctgcccagatgcatccatcagggccatttcactctgctatggaaagatttatgcatccacaacatgttgtaataatagcttaggcaaaatgatattcaaagcctaagatgagaaatcaggatttatgtcagcatacaagaaagcattatatccacccaaaaatttccaaagaaattagctttgtccatccatgtccagcacatcattaagcatgcgtgaccccagtactgccactctatttcacaataatacaaaagatcttgtttacaataacataaaagataacattaacagtgtagtctgcatatgacattctggacatga

SEQ ID NO: 62856 - DNA, 773 bp, Oryza sativa
gctgacatgccaccatgacataccggaaagaggtcgtgacaggaccattagcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctgatgcgtcggctagaggaaagctacgctacaagcccaccgttgcccacgctggcttgtagtaagtacgataagttcttccagggcatcccgcgaaccggtccttagctgccatgggtgcgaccagcaaaaccatgcacccacagcccaccatgtgatttattttaattaaccaacaccaaagcggtggcactaatccaacaataccattagaaccgacagtctaaacattaataggatcttccccatttgtgaactagttgaactaagcatggctaagcaatccctagtccatctctagtcatgttataaccccaagctgacaaagggacatggtacaacaatagcatggctatgacaataggtaaacatcccatagtaacattataaaacaatgcaatatttgaaagaaacaatagagcatttgcaatataggatcaacatgttcaagtgacaagcatgacttgccttgctctgctgctggaggaacctcggcgactatttcgaagtacaccgaagcgtcgggggaaccggaatctagcgacatacaaggcaaacattgcaaacagact

SEQ ID NO: 62857 - DNA, 910 bp, Oryza sativa
tgttcacttgttcagtgaagaatcaaataatccccagcgttgtctcctttttctctagtctttcagaaatgcaaaactgtagcttcttattcctgatgaaatctgcaatttgtttcagaaatatataccgcttgtgtggctcacctgaaacctgaattttattccagaaacctctgaaacctgacactgatagtttaaactgttgccactgaatgtatggtttgatttgattctctgttttaaacagaacaatgctgaagtaacagaaacattcttttgatttgccgcgttgttcttccctgcagaattgtttaactggcagagaatatatgcaaaagggattaaactggaccatgctgagatcaaaaggcaaagatgcagagaacgaaagcatgaggagaacgcaaccatggcatgaggcccctgcggccctgcaccgtccaatgggttgcaggacagaacaggatgcttctctgttttcttttcctctcttgtacaggaggatgcggaaacgaacacacactaccacacacgcataggtatcctcggcggtgcatgaacatgatctactgaaagatacaaggaaaaatcgttcacgcggttttttcacagtgtactcctacaattggtgaacacggatactaacttatggacatttaggaggtttttggcagggctccaaatctaaaactgatataattttgttgggactaaacaattttgctatatatttgtcgacaaattttcttctaaaaatttaacaaatgtaattatagtacaatcgtagtgtaattacactgtaacttgaatgtaactacaatgtaacttgcccataattttgaaccattaaattgttcaatatttgtgcaagtgaaggaaaaaagtcatttcgcgcacatatatgagatga

SEQ ID NO: 62858 - DNA, 1314 bp, Oryza sativa
aacggccacaccgcggcggccatgtccatgggcgggctgatgaacaagatgaccgggcgcatcggcaaggccatcatacgctccacgctggcgcgcgacgtcgccgccgtgatgaagtaaggggcgccgggctgcaggaggccatcgactactgcgtcaaggaacggctggacaaagggttcatcgggctcatcgcggtgttcggcaccggcgaggtggcgcacgggttcaactgcaccggcatgttcagcgagtgcggctgcaggagaaaagagagagaagggagggagaggggggaggaataagggttggagagagaaaggatgacatgtgagtcccacaatatattttgtgtgcaaatgacagacgggccctacaaaatatttttaattgtaatgccacataagcgccacgtgggatgaagaccgggtcaacaccgccatgtcagcgccacgtcagcaaaaccgccatccaaaaccgctgagggagtcaaattgcactagtttgaatagttcggggagtcatcatatccggttttacggttgagggtcacggattagattcgggtgacttttaagggagtcaaaatggactttttcctcccgaataaacaggctggaactaccctcctgccatctttaatgggctgtaattagcccacgatacccgtttaatggactgaaactaaatacttggcccactaccttattatctcaaatgtttggcccaccagttacaataaaagggctcaaacagtttttaggccctgggtgatcttaaacaggccaggacaaattaggcctatatatgattttggtaaggcggaattaggagcggaacaaacataaacaggccaggacaaaatttaggcacacaacagtttttggaagagcgaattttgacccataaacacgtaataatcaggctgaattttgtcgatttgtaagtctatatatccaataggcttcgctagcagctgttttctagcctcatcgtttgccctgaaaaaaattagcagctaccaaaaattaaattataaaatttaattttggagttaactttagggtattcaatatagttttgttttcagcattggattttaagtcatcaagtacatgcatataagagctttacctacaaattatttttggtcatgttttgtcatgtactacctccgttttttaatagatgacatcgtcgactttttctcacaggtttgaccattcgtcttattcaaaaattttaagcaaatgtataagatataaatcacacaaagtattatgagtgataaaacaactcataacaaaataaatt

SEQ ID NO: 62859 - DNA, 1327 bp, Oryza sativa
cttgacgttattacttttctgactgtctccagatatacaaatataagaatgtggagatcagcataatttatcttcagtgtgccaattctgaactaactcagcagaccaagctaatttttatagatagctcgaactggtgaagttgactgctttgtacctgtaccttctaggttctaaactagaagttcctactttcaatagataaagccagcggaataaatatatgttctttatatcatttatataacatgtgatatatctaaaccatgatattcctttttacctacagttcctaacaaacaacaatctctaacctgcctaatattataaccaaagaagagtaagattatctgtcgtaagacatggaatctactttctccgcctatatttggccaacttcagaactgaaagtcactgtgatgaaaaccaaaaccctagatttcttagccatatgagatcatatgtagttaaggacttacattgcagtaaagtttcgtgcttgtctagataccagtgcattagccactacaaaagaccctactccgagatccatctgttggacaatgaggcagataccttagtatcatgtcattgaatggggaagaaaacacagaaactttttaagtttcaaacatgatgggaaacacaaataatccaaatcacaagcatgcagaataggtaacagagtggatgcacaatttgcagccagtgtctacttttgcaaaaacaagttcatgattcattaaaaatgctttgagacagtaaagaactaaaatacaaccaatgaaaaagatgaaagatacaacttacgatgccacaaccatatgtttcagccttggcataacgtctagggaagattttgaagtccactgctaatatgcacaggcatgttactagaaccttcaaaacaccccatcaccattaacttcaatagttctgttggatatatagtactgagaagtaattaaatgagtagtatttttccaattaatcaacttttacgtaccacagatactctgtatgatgatatatctgctcggagcaaaggcagctcatttggtccagctttgagatgagatcgagaccttagaatatagggaatgcattagtttctaatcagcatggattttgttgcataaaggaaatagggtggtcgactagaattgtaatagaaattagagagaatgtggcaagaaaaacaggtgtaagaactcagatatggtacctcttaaacatggtgaggatagatatcagcattacaagagaaagtgcacaagcacaagcccattcagctaaaacctgtaacaaaccaaggaataatcaaaag

SEQ ID NO: 62860 - DNA, 771 bp, Oryza sativa
ctgcaactcaggtgtgttttggggcttgcgggattttattcctgtgtaccttgtgagtaatcaatttgtgttccttactcctgagttcaattggtataacataactttaaaaagaaagtttggttcttaattaatgccaaatggaatagttgggcccttattgcttcacataatctggaagccaatatttaggtctgatatgatttcaaaatctattgacctaatcatgttagcaaaagtttttcaacttctaagtggatcaggggtcatatgcatgaacagaacaccacggcatcggcgattcggcgtggaagtcgtggcccttggccccaacattggttacgctcctgtacaggatgacgttgggatccaccttgccgatgatcaccagtcgacagaaatgcccttggttaaggggcggaagctgtagcctgtaggcagcagcgctatcgaggagatctcacgccgtcgctgctccccaccaagcgtcgacgcatacacacgcctggactcgccccctccacacaaacaagcgcttcacgtggactgggccgaggaggctttcctggtggcccaagggataagccctggtccaacctacaaagcatggtaaagaaagatgttgtcaagtgaaaatataagtttatccctggtccaatgtgccaatcaggtaaatatatatgacccaaagtaaaatttactctaataaaaatataccatgtaagttcacgtggcatgccacgtatgcaagatcattgtcaaacaagactg

SEQ ID NO: 62861 - DNA, 1103 bp, Oryza sativa
actagtatagaagaagaagaaacgccattggcgacggcgttaagcaacctccaccccagtcgacgagcaaatatcaattcagagcaacatatccgaagcatagctaaccaattcagagcatcatatattacatctaactgttcattgatttgatggttaactgtgcttcggatatactctctccgtctcataatataagggattttaagtttttcttgcactgtttgaccattcgtcttactaaaaaaagtgaaattgttatttatttttttgacttactttattatccaaagtattttaagcacaacttttcattttttatatttgcacaaattttttgaataagacgagtggtcaaacagtacgagtaaaaactcaaaatcccttatattatgggacggagggagtattgctctgatatatcaattcaatcgacggcagcttaaacatctcctggaacatgcagagagctcgttcgtcggtgacgatctcgagcaccagaactccaaagtactccggcacgatgaagcccaagcgggtttcatggttttctgtgactttgttaacgctacgtatacatcacatcagttaaaatcgtcatctaaacagattaggatcttatttgcactggttttgagagttgagggacacgtcatatctggtattgttgttcagggatgaattccagactcgacgacaaattgagggacctaaagtaaacttactacggaggaagaagaagcacttactgggccatggcccacaacatccggtccatctattttcatcgccactatacctccggcccacggacgcgacgcgcttacacacatggcccacatgccatggtgcgcaagcgcaaccctttcttcctcctctgtcgctctctctctctctctctctctctcctcttctccactttctccctcctcgctagtgcgctctccttggcgagctcgctccgacgaacgccaagcccattgctccgcgtgtggttgggagagtgagaagagaggagatattttcggtgcggtggggaggggggattgagagaggccgaatcaaccaaccaacacctgcctgattcatcttctcgatcgatc

SEQ ID NO: 62862 - DNA, 1216 bp, Oryza sativa
ttggcctttgttccttcttctatctcttgggtgtgtggcagagaagtggtttcggaagaggagacagcatagcagctgtggtgaacgaacagactaaatgcgtggttcttccaaacctgaattttgaaacccatcatagtgcttcagaccttcctaatgatactgggagtactgaggttaaaactttcgagccatgtgatgcacagtacacagattacactccctgtgaggagcaaaagcgtgcaatgaccttccctagggataatatgatatatcgggagaggcattgcccacctgaaaaggataagctctattgtctggttccagcaccaaagggttatgctgctccttttcattggccaaagagccgtgattatgttcattatgcaaatatccctcacaagagcctcacggttgagaaggctatccagaattgggttcactacgagggtaaagtgttcaggtttcctggtggtggaacacagtttcctcagggtgcagacaagtatatagaccatcttgcttctgttatcccaatagccaatgggaaagtgagaacagcactcgacactggttgtggggtacgtaaaggattcaactctaaagatgcaaacttagatgagcaatcaagcattagtttttgttgttcttatcatgttacggagtttaatcttttaatgctttttcctgccacaattttgttcaggttgctagtctaggtgcttacctgttgaagaaaaatgttttgaccatgtcatttgcaccaagggataatcatgaggctcaagtacagtttgcactggagagaggtgttcccgcatatataggtgttctcggatcaatgaaactgtcattcccatcacgtgtctttgacatggcccactgctcaaggtgtttaattccatggagtggaaatggtaaaatcacttttagaatccttactgtttaaaatgttctcatttaaagtttacacatctgaagcaagctggttgctctggttctgcagatggaatgtacatgatggaagttgatagggtactaaggcctggagggtattgggtactctcaggcccaccaattggctggaagattcactataagggatggcaacgaacaaaggatgatcttcaaagtgagcagagaagaatagaacaatttgcagaacttctttgttggaataagatttctgagaaggatggtattgctatatggagaa

SEQ ID NO: 62863 - DNA, 2984 bp, Oryza sativa
ttgcttcagaaacatgtcaaaaacggatcaatttatttacttctgtagagactgaaggataggattgaactttagctctgccaatatcagttcaagctcttcatggtgaagttgcataataataaaatcagtctgttagttattctgctattgtaaatatgtgtttgttttgactgtgctgactgttagctttgatcagttgaaatctgaaaagcattggttgcttcttgttacataggtatatgtgttgaccatagtttttttattctttgtacaggtgtgaaggattttctacatatccaaggacatatgatctcatacatgctaacgctgtgttcagcttatatgagaataagtaagaatgtcatacattgcaaaaacaagaatgtgctcctaagttggtacatcttcctaattgatattttctatttacaaaaaacaggtgtcaatttgaagatatactattggaaatggaccggatcttacgaccagagggcgcagttataatccgtgacaaggttgatgttcttgtaaaggtggagaaaatagctaacgccatgaggtggcagacaagattgactgatcatgagggtggccctcatgtgcctgagaagatactctttgcggttaaacaatactgggttgttgaaagcaagagcagctaattacatatgctgggttgtttttttccactgagctcccaacaagacctaagacatgacttaattacatatgaagggtatgcatcatctacctcctctgtaaacttatagccactgtagtcaggaatgaactcttggcagcttgagttttccgaaaagttagcacccttgcaatgtggccttgccagttcttttcaaggtaaattgcactgcaggtataaatctttttcaaaaccggctgcctcagtcttgacaatctcaaccacaggtttcatcttttgatgtaaatggcttggatttgaaagttcatgtatgcaaggcttgtcatgaccgtatttcttttagccagttttgtctagccttagctggtgcgacaatttgagaatgctcaaactggcctctaatcttgcttgtttggtgcatttgtgctctaaggaggtgtcgcactgtaatgaaactgagatccataagattctagtattctgatcgtctgaaccgaggtgaccaataatcaaatttagctacgtatgtaatagttttttttctgttggtaacagacgaacgatttatttttagtgctatttgaggctgtccttttgagattcagttatacaaatgttgttcgattttgatggagctgcaacttgcagttcgtctgttgcaggcatttctctactgaaaatctgaaatgggtattggtctgtcggagtgttttgttttaccgggaaaaacaatttttctattgccagtcacctgtttttttggagggttttgcttatgtgtccgtattaatagtaattaccaaaattcaaaatgattttattctaaatggttttaacttgggctaaccaaacggatggttagatgtattcactctcgtgcatgcaatgtacaaaacttgcgtgcaggaattatgtactatgccggatggttagatggttaacttgggctaaccaaacggatggttagatgtactatgccggtttagaagcctcatattattttttttttcatactttgatggaaattcgggttccatgacgcctcacacttttaaccctaaaaatagaagtgacggactgtagattatcagttaacaaatagttattttattattaaataatagtcccagcaacatattgcaaccaagaaatagaagcacctttactttgtaataactggaagtccctaagacaatctttagcctttacaccatcttgcgcatgcaatgtacaaaacttgcgtgcaggaattatgtagcaaggtttactcaacaagtcaatatatactgccagagaaaactaataatggatgcatgaataataatttaacaatttatattttacacttccatcattcataactcatcatcgagtctaaatgtatttttgtaaaagaggttttcctaaaaagatttgaataacaagagaaatgcgtgaatcataatttgttataacattgtgaaagctcgtgggccacatcttttgtcttacaacgtatcccctccatcccaaaaaacataattaaaccttaggtttgaatctggacacacacatgtgatgtgtttagattcaaactcatagtttaatttttttctgggacatagtagtatatgctcataccaaaatttaaatcttaaaacttaattttagaattaattttaaggtttttattatggcttctttttttaatatcggagtttaaatcattaaaaacacatatgtaaaagttttaaccatatattatttttttacgctaatatgtcttttggcgtattatcagcaattggccaactgatggcagcttgtatcgcattacaaatcatgtatttgtaaatacttgctttctcttttttatataatggaatgtacttccggcctttactcaatgagctatagccaattattacgtcaaatcgctcaaaagcgctcacaatctaataagaccacaaaacacaccaatttaacataaagcaacacaaattaataagcaccaacacaagatgaaagacccataattattgaatcatatttgtaaatacttactttctcttatttttcgcccatcgaatgcatcatcgcaaaaaatattttctctataccaaacaataaaaaataggtctttttaatgccctgtttatagtccagataatttatatgaattttgaagaaatcaacatatttagccaaatggtagtactaggcttgacagcaaggtgtgacatgcatagccattatccagtcaccaatatccccattgttttacttatgcttaccctttaagccaaaattaaatttaaatttaattcagagtgatttaagg

SEQ ID NO: 62864 - DNA, 3942 bp, Oryza sativa
  unsure (1)..(3942): unsure at all n locations
aattagtttattattagtctatatttaatatttttaatatattagtcccgatatccaaacaccacctttaaaaaaaaactacggaggaactgggatagttgatgcgcaccggggcacgcacgcgccgtgcgttgggcgtgtggcgcaaccccacgcaccggcacgcgccaggccggcgctcccgcctccagaggccgccaccggccacgcgcccctccacgtggctcctggcccaccaccagatctctccaccgacccccacagacaggtgggcccgttcactcccgtggcccccacgtgccagtgagaaaccacccgccgccgcaacgcgcgcgccacgcgccgcgtcgtgcccctcccgcgcttgactcgcctcgccgccctctcccccttgctgttattgctcccttcgcggctctccttcttcttcttcaatcttcgccctcctcctcctcctcgtacgcgcccacgcggttctctttctgccccctcgatcgatttgaggtttgcccttgtttgctgtgatgttttgcgctgttaattgggtgattaatttgggggggtcgggttgggttgggtggatcgatggctgatgggttctttcttggtcgattggttttcagcagggaacggaagggggaggtttttggaggaggccatggtgccgtcggagaggggggacgtcgccaccgccatcagacccgccgctgccgacaagctcgtccatgggtgagtgactgaagtttcttggttgtctcgtttggggacttgggggatagttcttgttcttggaggaagcaaagagatagatgctctggggatgctaaaatttttgtttcatgatttgtctcgaggcgcagtttgtttgttaggcatcataccatagtgaatctacagaattagtgatgatgctcactactcaagcagcaaccctgcaatagtaaatgtggaagcctgccaatcatactgcgttagacgccgttggtggcgtagagctatatagtggtattggcaaattatttgtcgtcaggtttattgacttagttgttatctctgcatgtcgatttaattcttatcccttttccatttgggaggaaatgaaagttgagaattgtgcattgttgctaatgttgtaagttcccattgaaaccttgtgcaggcctatctctgacaagaagtgccggaagaaggtcccgaggaaggttcacaaatctgagagggagaagcttaaacgcgggcatctcaatgatctgttcggcgagctgggtaatatgctaggtaagctgttttgatcacaaggcattgcgtcagttctatgtgtctgaattggaaatttattatagcttgttgcgcagaaatacaaaccacatatctctctcttgaatgtcattatataattcgtattactagcaactggattcatcattgcttaaatttgctgctatttagcatctgatcaaatacaacaaccttctgcagaagcggataggcagagtaatgggaaggcatgcatactaactgacaccacccggatcttaagagatctgctttctcaagtaaaatctctccggcaagaaaacagcaccctccagaatgaatctaattatgtaagtaatatttgctatggaaaaaaaaaactgttgatttgttgcagttgtagaaccatttccctttctttggcgtgcttgatgatttacattgctaacttgtcgtatgcataatgcaacactcattccaacattgttttttctcccacaaacaggttacgatggaaaggaatgagttgcaggatgaaaatggtgcgctacgcagcgaaatctctgacctccaaaacgagctgaggatgcgtgcgacagggagtccaggttggggccatggcgcgactggatcacctctccccgttcctccctctccaggcacggttttcccatcgcagcagccaatgcagccatctcccatgacaacaagcacagtgttccccttgcagcagccactgccacaaccaacagtcattgagccctctgcaagacagccactggaactgaagctcttcctagaagcaccccccgccgaagaccctgaaccatcagaagaccaggaggctccgaacaatgtggcacgaccgcagccgaggtacccaacagaggcatcttcttggcctattagcctgggacttccaagaatggaagatgagcaaatgtagtggtagcacgatagatgatagcacaggtagagattgagagggtctgtttttaatgcatgcaggaattccacacgaaaacacttctgtccttgcatgaaaactggaaaatttcctgcattccaagtaagacctgagtagatcagctccaaccaatcagaaactcactttgagcctagaggatatactactgaatgatgtgcatgtaaatatttcaatctcccttttgtttctgtaaactctagtgagaatagaacccgttttatccccttgcaaatattgatgtccaattaaaatgcatttatgcgataattgcaatcgaaggaaaagttatgaaagaacaaaaattgtaagactatacgcctgtaaccagcctccaagccaacattatcacaattctatcgagtctgacgaaccagcaacatctcaatacaactatgcagcacctggcaaccaaacaggctgatatatagtagtatagcattaacattgaacacttgaatattttccattgctgttattcagaagaacaatccgtacaaaattttatgaactactccactccgtagctggaaaaagtcaccatgtcctttcgcacataatgtatctactgatacatcttcaaacacaccaacggaaatacgcgagagattatggccggtttcctctgaatggcgaaccagatgcaattgcaggtggctcttccctgtacggctgagtagcaggatcagtcacactgggcagtctctgtacgctccccttcccttttctagcattagggccaatttcttcgatcatgtacttccatccgtcaataggacgcctccggctaaatatgtgtgttttgatgaagctagcaatctgcagtcgcatttcaacaccatgtcagaaataactagaataacagcaaaaaaaattgtggagagagagtgattgtgagaccagactgtttactgaaagcaatccgcctttcgaattcttggagaagaatgtcatcttaacgctgtgagatatcccatatgctaccatccagtcctctagaggtggtttcccaaccatcaggcttggttttgatctcagcagtgcttggaatctttgaatcgccaaaatctgtatttccagaatcgaaaatcctgtatttcacaaaattataagccagctacgtgttatagattgctaagcattttgctcacatgaaaaatatgcattcctaacttagcaaaaccaagagcttacggaaactaaaacattgtacaagccataaagcctccccaatcatgcagcaaaaaattgttatggcaggaagatatgcaaaaatgacaaatagactgacagtagcattaggagttttggagtgctgccataataccgagactatgagagtttatgttttaatgcctgatatgctgattactaagcaattgtagcaaatgaaaagaaaactgcataactaatgtcattccaaatgctcctgcttctatcaactaaatggtgagcagcaaatgacgctaacatatgcttgttcctaagcaaaatcaagtaaacatcgaagcacagtacttcctattttttgagaaaaaaataaatttgagggtgaaagatgtgaactgtactagatccagaagaaattcacatagtacgcataatttgtgaaaccaagctgctacattggnnnnnnnnnnnnnnnnnnnnnnnnnnnnnnnnnnnnnnnnnnnnnnnnnnnnnnnnnnnnnnnnnnnnnn

SEQ ID NO: 62865 - DNA, 968 bp, Oryza sativa
caccataaatattcaaacactcttacctcttcatgacaatctccatcattgctagctctgacatatcttgtggcggtttttcatttgaagtgttcccacaaaagtcaagcaacatcctacaaaggcaacatgtaacatgtacggtgagataatgcaagaccattttataatactcaatgtgtttcagaaaataaatgcaatgcaaacctgaaattttacatagttccaagaaaatgtgggaataaagtacatagctccagggtgatgaatattgtcaagggactagaaaaggcaaaaaaagaaaaaaagaaaaaaaaagaaggaagcaagcaagaaacaggatgtaggttatgagatgaagccctttttgttgattactaacgaaaattagtcaatctcaacagtcaacagatcgatattacctgagatatataaaaaaggcacaagaagcaaaacctaattttaacccacaatttcatacaggaacacttccaagaaagtaaaagggcgcatataattcaaatggcatggatgtctggtacattactgaaccatatatagtcattgtaaaatcttgaaactgcagatacatgtcatcttgtttgggtaaggaggtgaaacttaggccatatcaaatggatattaacttagaacacttctataaaaagttttggtaaggagaaaggcacgtgtaggtttgaaggagaaaagcctaattcagaacaatacttatctaagttttgagtaaggaagcatgcatgtgtaagctttacaaaagagcatgggcatcattggaataacctgcgcaatgattcttcagtttgttggacctcttgtttttccatttcatgtctagatctttgtttgaatgtctcaaaaagttcatccctgatggaaatgatctaatgattctcaaagagaagaatgaggtcatgatagagcttagtaatatagatgatttctaaatt

SEQ ID NO: 62866 - DNA, 851 bp, Oryza sativa
tgggcatatacaactaaaacaccacacacagattcatgccgagaccaggcagagatggcgttaggtggtggcaccacgtcaacagaggagggtgaagatcaggtcaggagaaaacgagggtagaaaggaaattgagaagaggaaaaggaaggatttaaggtgataatagcagttaatggagtaacatcgcggtgaaaataaaagttaacagcaatatttcagtggtatgaagttaaacatgtgtaatttcagtgaaaagggaactaacttttgcaaaaaagaaaaagaaaagattcactggacaatgctaaactagtactttgagaatatttggtgtttcaacagattaaccttcttatccacacggttattatgataaaagagttgtcagttagaatcaactaccgttgtgtcttgcattatatctatacttctaccactagtttctagactgaaagcattcacattgcatggacagaaattagttgctaagttgtgtaaacacaaatattttctacaggaagcacaaacaggtacagccatagagggtgatctatagaaatgctccctcaatacgccttcaccaactcggttagcattaatgtggaacccgcaaggctgagaagtaacaatatggcatgtgtcttgttgtaaaaaggagagttgattacctgatcagaaataaaatcatcgaacttctggaggttttggtagatcaatgttatagcatttgctgataacacctctgtccactctgaactctcaacatcaacttctggcaatctttcaaagataagttcaggcgacttcccatcatgtgtgcataatagagtttgtccctgaagaaatga

SEQ ID NO: 62867 - DNA, 1018 bp, Oryza sativa
  unsure (1)..(1018): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatacgaacgaaagattaccgcggaatcgacggacgaaaacgcggtgacgatcggaaagttacccattttcttttccctttgtttttatttctttttcctgataataggagagcatgcatatttatatttgaccattaggatgggtcaattatttgactgggccaaaaatagaaagatgcacacacgcgcgcaggccatctccatctgaccttcccaggcgcattgtgcacctctctcatcgctacgttgccaagcccatctcttgattgctggatcgcggaaaaaaaggagaactgaatcggaggaggcgatgtgatgcgctacgggctgagaaaaaaaaaaggaaacacatgcgagcgccgagaaaaaaaaaacgatgacgagggaagtgattaggattcgaaggcaacggaccaaactatccggcaaaaatatttttaattttataatagtagagatttaataacttgttattaaaataagagtggtaaaagattgaacatgaatagtgttagcgacatgtaattggaaatggaggcagtgccacattcgtctgtcctgcccccctttgcttctgctgagcaacgcataattttcttgtctgttgtcttacggcccacatctcaaagtaaaaacatcaatttggaggaggcagggcaacgcgtttgggaggccattgtggtgccagcactgctgcagcgatcttggcagtaccagcaacaacagtcagccggttactaatatatactttccttggattcgatcggatgtcattatgaacgattatgggcatgtcacttgatgcaatt

SEQ ID NO: 62868 - DNA, 3470 bp, Oryza sativa
tgctaccgacaagaaaaaaaatgtctgaaaaatatgggcctcagttttctgtttgttctgacatgacagcgaagatgtcaacactgaaacagcgtcccaattactgagccaccataattagcatcgtaaaatctccgtggagaattctaagatctcgcagtgcacagaggctcttttactgaagatgctgtgtgcatcagtgcaatgtacccagccctgagatgctgttctttcctatctttcctggatctgcatagtttgatgccaacaggcagcaggacatcatgatctgaaattgggagacttccataactgatatccatggcctatctctgttcataaatatgcctacacagtcttcagtctcacgcacagatcttgttggtttcatctccaccgtacgtaccaaatactagttggttactggttacaacttacaaccaaacaggagcaacttgcaggctggagagatctattagcatccatatcatcacctacctacctctggcactggcaatggcaaaagagccaagaatggttttatacttgtatgcacaatgcaattggaaggagaaggtaaagaaaaggggatgtagtttgagaagaacacacagaggcagttccccaattggttgtggaggcttaaaggcttgtcttgcctgcacatttagtgcccccacatgtatgcagattgcagccactctttgcaatcttgttggagatggtctagggatcttgacatcatgggatatgtcatggttgctgctggtcctgcttggcttatgcaatgcaggtagcattcaatttagcctcaggcatgcaaaccacaagcatgcaccgtacatgaaactgatgagcggatacagactacaaaaggggccatggatgtgctgttctgctgtagatttggtccctcgaagggaaatgcacaacatggttgtcgcatctagtcatttactacttcatataagaattaaaggtgtgaaacacactttgaagcaaaatgtagacccatttcatggttctgcattaatattttgcatgtggttttggctttgcaagccatctctgattacataactgaaggctgaatagcaggcggcctaaatttgaaacgatacatttgacttgcttttttctcataaatattcgggatgtaaactttttagcagaaatatatcgtcaatctcgcacaaccgttacacgaaaataacgacgcgagcagtctcgcccgacgaaacaacgagaccgaacggcgaaaacaaggacatgcgcggtggcgacgcgagaccgtgcggccaaaccgcgagaccgagcagtctcgctgaaccagccagcgataccgactgacatgccgattgaaaattgttaattagtgattaagtaccctaattatccattaattaattaaagaaacaatacatgtagtgtacaatatgaggtaaaatttagaacagaaactaaaatgatttctgaaaattggaaaaatgaaataaaagttcaagtagtaatataatttataaataaaaaatgagaatgaaaaatgttgaatgttgaaagttctatcagtataaaacacaaatagtagtaaatgaaaataaagtgggtaggagcaacttgctcttgggtgacattggttgatgggatatataaaactataaataaaaccttaaaaaatattatatttgatttttaaaattcctattacgattaaaaggagaataacaagcatatcgttaagcaactcagcctcaacggttggtgggacttttagccattaattaatcaattaataattactaattatgattaattaattattaattagggtaattactcactaattaagcggcaccgttggacaagacgttcggtctcgctgattccttatgcaagaccattccgcgcgtgtcgtcacgccaacatcattttcacacaacagttgtgcaagatcgatgatatatttctgctaaaaaattacatcccaaaatttctgagaaaaaagcaaatcattatgttttcaaatttaattctcgtagcaggccagccctgacctttttatcggcagatcagaactgtacagtgtctgtactgtagcaattaaccacatgaaaatatgcatgctacctagctttatattcttatcacccaaaaactatttgaactccttgcattttggagaaaagttgtagagtactacttcctccgttttatattataagactttctagtattgctcacgttcgtatatatgttaatgaatctaaacatatatatatgtttagatttattaacatctatataaatatgtgtaatgctataaagtctaataatatgaaacggagggagtatttattaaggcccttgtcgaggagtgatcctctctagcgggagatcgtgagatccccttttatgagttcggccaggggaaaagggttcacctctcgaaatcgtgtatccgccctaagtgtttcctaaccgcgtatgggcgacaagattatacaggttcgggccgctatggagcgtaataccctactcctgtgtgtgggatttatggttgaatgttacaagggttcctcaactccggagaacgttcttgctcttcgcttcctggagtttaggcctactgagtgtcgtcctctttttcggcggggaaggtcctccttttatagttcaaggggataccacatgtgctgcttctacctcttctctcacgggagaggaaccctccttaccttgatcggaccacgatccgtgccttcgcccggaagctaagcagcagtccgtccttgagtgggacccggcgccgccccccgcctgacacgggggacagccctgtcattccctcttaaatgagcgaaggcttgtggcggtcctcctcacgtggagggaactccggataacgctccgatgggacaggacatacctacctccactccgccggatacagaggcgacgtgggggcacgaccgcccgtccaatcggcaataggccggtcacagattggtcacacccgattgacgtgggtccatcgggcggcaccgcacgtctgcccttaccgcattaaacgcggtgagggacagttgggacgccgcgcgcactgatggctgttcagcctgggtctcctccccgctcgcttcccccgccacatggcagttgggcgagggcctcggggcgaggcagcgcgagggcccgaggggtgtgacgtggaaccccgaggccccctggctgcttctgcgactcgcgagacgcggggggagggccaggctgtagagccacgtggctggatgggaaggtgacttcccctcactttgcattcccccgggcctatatctccgatagccctgtttcttttagcttgggattattataatctagattattgagtcagattactataagctagattgttataatctgtagtagaataagcggttagttgtttcttttctagattattagagcctaga

SEQ ID NO: 62869 - DNA, 8110 bp, Oryza sativa
ataatctggcattataataatcccaagctaaaagaaacagggccctaatatacttagaaaaaatgcccgtgcgttgcaacgggtgaaaactattttaatcttattattgttatacggtttagttaaggtgaaattcactatgagaattcgtttggatatataattttctagaaaatcattagctacaattaggagtccgatcatctcaagttagcatgcgagttttttttgaaaagatttcttatacgactccttctgtatttctaaaaacggacaaacttaaaacacgacccaaatacggtttccaaaagagaatgaacttaaaaaccgactcatacacggatgacgtgttaaagtaccagcaaaaacatcttcaatttttataatagtagagatattgaaagttgttagtcatagagcagtgacgatgccataaatttttaaagactagaggtaaggtaaggcacaactaataaagtattggttttctataaaatttacgtagtatatttaatacaatttaaacaagattttggaagcctgcctctgccccaagtcacaggatcgatgcccatgaacaaccttgttcatggacagcctgaagcctaaactctgaatgacggtgagatcgacgaggttctgggacgattcaattgtataaaaatttcgggctccaccacaatgaatgaagttcggaaatttcggatgtcaaattcaaactaaataggatataagagcacccgcaatggtaagtaagatgctctctataaaatatgtacatctcagcaatagactagattaatagtaaaccatctcaatagtatgtctacatgggtatctatagctctttaatacattgcctcgtttttctctatatactatcttcaggttagtagatagctttgctctctctcttcatttaatctcttccaagtagaaaaatatgctaatatagatatcttgtagagagcctatagataaccattgcgggtgccctaatgttgtgtaggttctcactgaaatcaaaatggatgaaatttgcccgattttcgatacacacttacgtatgagagaaaaggcatgcattcgtgctgtcggaggaacaaggacgggtccccgggcctctgcggtcttggggacaacaaatgtgacgtacttccttcgttttataacgtaagtctttataggattatccatatttacatagatgttaatatacatatacatatatatatatatatatatatatatatatatatatatatatatatatatatatatatatatatatatataggacactcatatggggcaccatggtgcccgggcaccatggtttcaaatgcacaaaatcacttaaatttttcaaaattttcaaattgtgagtatatacctagttataagaattcgattcatacctatacctatcaacaaaacaactcaaatttaactttatttcacaatccatgattacatacctaactaattatatgtatggatgctatatacctagaatcaaaatctaacaaaaacaagttcaaattcagttcaaacttgctttcaactagttagtaaagtagttaatattaatacctaaataattgaaaaagtttcatgctcatttgaattgggtatatactcaatttcaacaatggtgcccgggcaccatggagcaccaaacaaatttactatatatatatatatatatatatatatatatatatatgtgtgtgtgtgtttagattcattaacatttacatgaatatgaacaatgctagaaagtcttacattatgaaacggagggagtatttctttaaaagacgtactccctccgttaaaaaaaacaaaaagacaaccgagagggatagtataactaatttggacaaccctccatccaaattcgttgtacaagatctatatgttcaaattgccgaagagacaactggcaacttagtacaccccatcctccatgggcggagtacttgttcatcatcgacatcttcaaaaagctcgttcatactaacaagaaaacctgtaaatatattagttttgtaagttgtaatattaaatatattttgataatatgtttattttgggttaacaatattactatatattttttcacaaatttagtcaaacttaaaaatgtttaactaagaaaaaaaagttaaagtaacttataatatgaagccgaatgagtaaattacaaactcatacgcacggtttgaaattttgattcgaaatttctaaaatttcggtaatttcaccctcgccggcatgctcaaatcttgcccgaaatttttggttttttgcatttttttataaatttggtcaaattttcaaataatttcggtcagagattcccgaaatttccaatatttcgttcacctccggcataacacctaatttcgaaattgaaaacctgctcgtagtcatatgtgttttcttctatgttttagctagccagctatggcgcctatataaatcccccacacgaacgaacaaaacgatcgatgtgtcgaagtggacaagctgcttaactaatcagctttccctttcgcttgcgcacgtacgtacgatacgacaatggcgccgccgtcgctaccgattctcctcgtcttgctctcgctgtcgtcgtcgctgtcctcctcctcggcggcggcggccggccgctggaccgacgcccacgccaccttctacggcggcgccgacgcctccggcaccatgggtacgtaaccaatgcacgccgatacatatacatctatctcagctcagaattgatcgaagtggcggcaatggcgccgccggttgtgtgcaggtggcgcgtgcgggtacgggaacacgtacgggcaggggtacggcacggacacggcggcgctgagcgcggtgatgttcggggacgggctgagctgcggcgcctgcttcgagctgcggtgcggcggcggcggcggcggcgaccggcgggggtgcctgccgccggcggccggcaagtccatcgtggtgacggccaccgacctgtgcccggccaaccacgcgctccccggcgaccgcggcggctggtgcaacccgccgctccaccacttcgacctctcccagcccgccttcctccgcatcgcccgcttccagtccggcatcgtccccgtctcctaccgccggtcagcaaccgccgccgccgccatcgattgatcaactcgtcgtactagctgataattaatccgccattgatttacccgtcttgtttagctcccaaaataaaaaattaaatatagaaaaaaacaattatgtgtaaatgacgagatgaattttttaagcctaattacgtcatgatttaacaatatggtgctataataaacatttactaatgatagattaattaggcttcattgataaattcgtctcgcagattcgtagcggaatctgtaatttattttgttattatacttcaaatgtgtgtccgtatattctatgtgacatgttaaaacaaaatttttcgctgactaaacaaggtctaaatgtgtgtgtagggtggcgtgccggaggaagggagggatgaggttcaccatcaacgggcactcctacttcaacctggtgctggtgagcaacgtgggcggcgccggcgacgtgcacgcggtggcggtgaaggccggcgggggaaggaaggcgcggtggcaggccatggcgaggaactggggccagaactggcagagcggcgcgctgctcgacgggcaggcgctgtcgttcacggtgaccaccggcgaccgccgatccgtcgtgtcgtacaacgtcgcgccggcgggatgggcgttcggccagaccttcaccggacgccagttcacctgagaagatcgatgagatgactcgtacgtatagtagcgcgcctagaacgatgatgtatgttgtccattgataggtcggataaaaaaaacaagatttcgaggaagagacatcccttaaacttcagattgaaatcgcataccccttgccacttattgcataccccttgccacttattaagtggatctccatcgatcgatcaatcattaggttcgattgacacgtaggaattccactgtattgcaatagtatgttgttagtagtgcgatggatgtaatatgtgaaactgacgtaatccagacaacactaatgtaatatattccccgtcttaaattagttgtcttactggattttaaattttgtttcaaaataattattattaaagtactacttatctcatcaatgaccccatataaatttctttccattttaccccaaccaccttctcactacaatacaaataagggcactataatttttccttccttactaaaccttaatttatgctaaataacctagaacgataaatattgtaggatgaaggtagtatgtaataggagaattgatccatgtgtcagttgcatgttgttggtgtactgctcatatgtttttggtggtgcgctattttctgtgcttgttaggtactatatatggatttcgcaagacatatcgagaagacatgtttaaatatagtgttataataaaacttacaacattcttctactgagcaatactaccacttcgtgttgccaatatgcttccaattccaattagacttgttaaacctagcccttcccattgttctcgttgactacccctctacctagcttgatctttgatcctctatcctccatctcccatccttcaaatttcattatactcctattactaatctcgcccaacactaactaccaacccaattgcttcactgttgttgccgcaacatcaacgtccctatttttcaccacccatcacagggtccaccctgtccgttagctttatgagcccgggatactcttcttttttctcatcgcactccaattacaattgtttggtgtgttcaggagagattgttgtagttgcagcttctttgcagcaacagtggcagctacagctagaatgttgatagatattattggtgctaagcagctgctgccgcaaataactaaagtgaacagattgttatctgtatcgttcctaccatcaaatctcatcgaaatggcgaagatagataatgtcactacaaaaacatagagtatattcagggagttaaagaagtttgcaacattttatccttattttttaatcggatttaccacctaattttaccatctttttcaggttggaccaggtttatggcatgggttgtgcttcggcctaatccacacgagcagctggtgtttgctcatggtggcgatggtgcgcgataccaggagcgtgcgcgacgcgtcggggtggtcatcagtgagggctagcatgtcgtcgtccagtggacgcctgacacggaccctgtggtgatcatgctcggccctatcgcactcaaaacaatactacgacacatctgattatgttgacaggatctaagactataccagaactatcccattcagatcatgcatgagaagcaaaaaaggccaactattacatttagcagtaatcaagatccgatcttctcttttcatgagaaaattcaacatgtttccgattaccaagcgaggaacacggattaattactctagttttttgaagagcataagaggaatattgattgccccacaaaacccaaatctcctaggaattactgaatacattgctttgtttcactctcccagatctcagggtcaactttcctccatggattgctccatgatcgaatagcagacgcatacctgtgtacctcataaacccaaaacaagcatgatagcaacgagccagccgacgaccccaatgattccatcttcaggaagccatcgatcgaggtggcatgggcgtccaccaggcagaggcccttcgccctgacgctagcgacatggccggatgacgagactttctccaccttggcaccgacgacctccagccgtatgcaacaagggtcttcagccggtggccggtggacctagatggtagcgtttgtgtgttgactgttgagtttgatcatgctgctgcatagcagttgcgtgtgaagggagacttttttaggttgggagggaagtactcgtaccagagaggcaggcggaaccgccgtcgagggatccctcgccggagcctggagaaggggactgccgaccgctagtaaatgcataccaagtgacccaatcagtaaacatggttcaacttgcaaaggatggtaaaaataggtggtgtaaaaatcgtcttttacccctatgccattaaaaaagttgcagcttacctgtgtgccacaaaaaagtttggagtcacctgtatgccatgagaaaaactttcgttgacccgtgtgacattccgtccaccttctgttagaacttaacggttccatagctctgacatgtgggacccatgtatgaaaatgactaatttgcccctaaggattttcagctctattctcctctcctgctatctcccgtgagtgcatgctctctcccagttgcgctgcaagccgccgcaccctaaccctagccgcacgccgccgccgcctcgcctcgccggagccgtcgccgcctcgcctcgctggagccggagccgtcgccgtgcgcccaggccgtcgtgcctcctcctctcctcctccagggcccacgcgttcccgcgtcctccctcgtcgcgcggcacgtgggcggcacgcgcggcgggtggtggttggtccgggagggcggcatcgtcgtcggtcaccgggtggtgcagcgccgtcgcgccctccgtcgatggccgccaccgcaggtgagcgagtgagatatttgcggtggtcacgtgagattcgaatcacgatgtgctagctgtggctactgctctcgtgctatctcttgatctctcgctctcgctctctcgtgtggggtttcaagatgcatctgtatatggtttggagttctcgtcttttgcgagaaacggaatttggaattatgcgattgcttttggaaattggtgccctttggaagctctatgtgtatgcttgattcgaagcattaaataaaaaaaagggcatatgcttgtttttatgtattggacaataatacctgcccacatgaatttctgtcactcacactaaactataatatttgattacccgttatttgtcggtatgcaatggtcatgcacctgttttttcctttttacaaaatttatttccaatttttccttattttttccaccattttctaatatttcccacattttccttttttcccggatttttaaacacttttaaaatttattctcactttttctgatttttaccttttttaaatattatttttcattttttctgatttttaacgcttttcctaaattatttttcacttttctaattttttaaacccattattgtacataagggcaaaaccgtctttacacagcccctaacaacccctaacacctctgttatgtctccatccatccaaaatagcacacgggtcaacgaaagttgggctcatggtatacatgtaactctaaacttttttttggcatacaggtaaccagcaactttattaatgacatagggtaaaggactccaaatttgaaggcgcagacagtagggtttttggtaatagaagggggtgttttgtgattttgtgaaaggttgagggggtaaagcagagagttttccccgaacagtcagaaaaaaaaaagggaaattcgaagtccgcagccggaggcccccacggcggcggcgctatggcgatctctccgcctccgccgagccctagctccggcgacccgatcgaggccgcgagacacgccgccgcggccgccctggcagtgcccgcacgcctatggggctccctcctcgcccgcctcccttcgctctcggaccgccgcccccgccgccgccgacgccctgctcttccgctccccttccgcacagccgccgcccattccgcccggtgagaaaccactgcttggattttagtgtgcctcctgtgcttcttatgcttgtgctgcaagctctcgcttgctagtgttatgctagtgcattcgtggactggacagaccgagtaaatttgggcaaattttggggttttaggttggtagctggtggtatgtgaggaattcgtacaatgcgtttggaattagtgactaggtgcat

SEQ ID NO: 62870 - DNA, 4048 bp, Oryza sativa
tggtttcagatttaataaatgccaatatatttgtagaagaatgtgtttgtttttattgtgagaatttctgctaatgaaaaacatttaaagttggctctgtatgcaaataatgatcatatatatttcagttgttttcacttttatctatatggtaggtcagagctggagtacagtataattttgactaaactataccgagtgttaaataatcaatatgatgttatcagctatataaaaatatcaaaataaaattgaatgtacatactgagatatataaaaaggtaaccatagatgtctgctcatggtcacgcaaggcgtgacttaaatggctagtctaaacttgattcatggacccggcacttaatattatgaattttttctctctttgtttaaattctcgttcttcagcttcgaaacaggtaaaataaccagtctctcaactcccagaacggtaaaactcgtccacttcaaaaaaaataaatagggggaacggtaaaactcttaaagccttgaatggtaggacatcgtacgggaaactacaatgaaacaaacaagctaggaagagaaaaatatacttcccgatcaaaagcatactatcacgaattcgaaaactttggagaaattcaaatttgaaatgaacaaaccataaaaaaaatcctacaaatacgattatattgatagtaaaaattttcaaaaagaaatattgaatttacccatcgtttttgaatggaacagatgggaacaatatgtgaaaatgagaaaaaaatgcctaatgggctgacgactcaataagcccaaaacacacgcgagtccaaagcatcacagcacgagccgtcgcggcgtctccggccgccgccgcagccgccgccgccgtagcacatctcccgctcgctggagtatggctgcttcgccgcctccgcggagccctagctccggcgatccggctgaggccgccgacctggccgcctccgccgccgccgctctagcatctcccgctcgcgtatggagctccctcctcgcccgccttccctcgctctcggactactcccgcctcctctccgtaggccgcggccgcggccgccgacggcgtcgcgccgctctcccgctccccattcggcctgccgccgcccactccgcccggtgaggaatcccctcggctcctatgcttcttatgcttcgcaggcttttcatggagtagtgtagtaactagtaccattaccatgtacttgtgattcgtggattggtggacatgacaggtaaaacaaattggggcgaattctcggttagcaggtggtgtatgtggaactcgtactaatgtgtttcgatgttgatcactgcttgcagtatgtgctaatgtgcatcagtttttcttctactatattcgatgcatcttgttatgtggctggttcatgtaatgcattactgatttttcacatgccattgattattggtgtgcacagagttacttggatatgtttctgactatatgttattcgcaggattgccggtcagatgcccaaagcttttgacatcctacaagatgttgcgcaacacactctgtctaatttgcatgatatccagaagagcttaatattttggcagtccaaagcagaggtataaagttgattcataaaaattgaagtgcttctacacttttaatatgtagagaagtccactacttactcatcttccgttgtcctatgctattttctccagggaacaagttcacagaaactgtattaaatgatctttgaaagaggtccaagggcctttgtcgaagcagcatggcaaacactgactagactcaagagcaatgggagtccagtcccgcaccttttgcactctgcttctgatatggtctcaacaaaacttgctgtcctgacaagtatgcaacactgcttggctgcttttcttgctgaggtttgtttagtcagatgtttatcattacaaatgcttatgtctagtagaataaaactcgtgtcagcagttctttcaaagctaactttgtagttgctcgcttccaaaaattgctgtactactctagtcagatcattcaaacccaattttctaactctttgataacattgtttgttttacatgacacagttccacatttataaatccaaatcataccttgcttgttctataggtttattgcgaagttgacaaattcaaagaaggattaactgaaaattcagataaatcgcttcacacactgtttgctgttttgaatactgtcttctccaaattggaggtatcactccaaaatgtttgtgaggtatgcattgtttgcttttcttgcatttggatgttatatgtataatatacttttgtgtttggcattatgtaatatattttcttcaggggcatactctactgttcgcactcgatggaagcccatctgaacttctctttgaaagattaccagaaattgattatgataactcagagtggacagaggcctcctcaacagatgctatatgttttatctaccaaaacctccagaagctagataaccttgtttgctctcaggtaagcaactttctctttcaacaacagcaacttgtctcgcatttgctacttctattaatgttacctgagttgtagatggggtatggttggatcaatgttatactattggaggttctatgattgggcctgttcggctgcctgttctgcagttgtggcacagccggcaccaacagtgccacatgcacacgcgcagccgcagccgccgctgccagcttgctgaacaggcccactacctgtttgtgcttgctgtataaaatgtttatatagctatatgcatatgcattgtttcagactataaatgagtggtattgtcatacctatagttctgaacaggcgccccattagcatgcatataatggagcaacatgctgattatcaaaaccatgagatttgagatgtgagaattaatcatgtggatgaactagtgaaaatgtgttcaatgccaaacttgtatctcaatacagagtaaatgtgtaaatgtatagcattctccaggtagtattttattttttgtgatttctccatttatcatatttttacttttataaactatgtaagttgcagttatgtagaaataagtgggtttgttcactgtacaacaataaatcttacatttcttatcagatgattatatgttgcttaattgcctgaagcaaatattttctgcaattatagctctcaaggcataaaaaaccaagacatatgaccatatactggttgccctacacatgtggagcgttgggtctctcggcatgttctctgtggcttttgcgacacagtagcttgatgggaagttctgacatcgacaactgggttcaaagtgccaaagagtcaatagctggattttgggatgtgcatgttgagaaacctgtaggatactttctatttatgtccttctattatttatcttatgcatttttaaatgatgctagtgtaagttaactgagggtgaatcaaggcattctagttaaagtcttttctcgttattccgacattgacatatatgagatgttctctgaggtacaggaggataagattttgttaatctattcatgcaaatatttgtctaacaaaaaggaaaaccagataaagggaaagaaaagcatgctgccttgtgcatactagccgtactgttttcttatagtataagcatatatgatagagtatagaaacaatttcatgtgtttgtttactgcagcacttgcacttattaccatgaacatccttaagtttacatgtgtatataaggcatataactaactactatctttgttgacaattataaggcacacacgtagtttcaaaattttggacattgtaattttttaccaataaataagtaatgtaagatgcaacattatatagttgtgtgatacaaaaatggtaattttgaatttttgtttgcaataacttatgatcatgatttgtagttacacacgctatattgcaaaagattcacagtcataaattcattttggcagaccacaccaagtcaaatcgcacacaatattatata

SEQ ID NO: 62871 - DNA, 1988 bp, Oryza sativa
ggtaaccttatcattatcttaaattagactacatgaccttatcttgatcttaaattagactacattgacatttatttggatgagggacaaaatacttgatctggtttcctgttggtggctattcccttctctaagaaatactaccttcgttttttaataaataacaccgttgactttcagaattacgtttgatcatttgtcttattaattaaaaaaactagtgtaaatatactaaagtacaagtcatatttaaagtttctttaatgataaaacatgtcacagcaaaacaaatgacatttgtataaatttttttaataggatgaatggttaaatgtcatgtcataagtcaacaacttgaaaaaacagagggagtatataacgctttcctattgtattttgtctgcaaaaaccttattccttcacctagtatgagaaaacaagaaactgccattttcaagattggacatccccaccttcgtcttgaaaatccaagattgaagtgctttcgtattgatgagaaagtcattttctttcgactttcgaattacaaacttgaaaaatattaggattacaatacgtactaataaatgtctggctgaatttcctaattttacaggaggaagaggcatgctgtaagttcgggttaacactgtacacccttgatagactatacaaagctgttgaatcgcaggcgagagaaacaggagagtggtcaaggtgagtctcaaactcatagctctttttgatacttcccttggctacctaggtttgattgcctgtgaaccaaaaaaatcgttttccgattgcagcttgagagaagacatgtttgatctggcaaagcctggtgtgggcatggaagacaagctggttctgctgtcccggctcaaagggatgtacgactgcttacttccatcaccgtcaggtgtcttgccccgtctgtagtcttctcatcttcctttcctttccttttcttcttttctttttggtcacgtgtgacgattagtgaaccccaatcttagacgacatgaatttgcttggcgttttaagagtcgtcaaattttgaattttttatgccccgggtactttgattgtagccctttcggctccatggagtgatgatggcttttgtgctgctgcaatgtttgcaccagagattactgactgtaaatccaaaatctcttctaactggatgcttaattcatgtgccacacccattttacatttgtttctcatcattgaagcacatcgaaatttagggtggggatcctctaccataatatcactatcattataagtcacttggtatgtgggtctcattctcctattgtcctacacataagtgtctataattggagtgccactatggtagaggatgtaaaccctgaaatttggccctggaaagcgtgaatgtgtccagatactccatgttactagtatttcgtagtatatgttagctgtgatctaaggttgtgttttttcctccaacttcaatgaacgatatgttttttcacaaattttctataggaaagttgtttaaaaaaatcacattaatctatttttcaaaaaaagttaatacttaattaatcatgtgctaataaatcgtttcgttttatgtgcgcgtgagatgggttctcaactcattgggaagaacatagcctaaatccacactgcaacttccatttttagttagtacgcttttcaaactatattaaaatagtatattttttcttaaaaaatgtttctaaaaagctcattttaaagtgagtaataattaatactccatccccaaaatatatgacactgttattttttattttttcataaaaaatatagtataaatatgtaaaagtataagttaatgaaattgtagattacagtttcttttgatgataaaacaggtaaaaaaattattcagatggtttttgaaaaaaaagagactaacatccattttcattttccatgacggagataagaaaatactactaata

SEQ ID NO: 62872 - DNA, 820 bp, Oryza sativa
aaaggggtttgatgattcacaattttggaatgttcttggaagatctctttgatgattgacaattttggggtgttcttggaagatttctcatggtggagccatgtgcgcagaaactcagcaaaaaggcagacctgtgaatttgttgatatatactggattgttattgacatttttgaccttttgtaactatgcaaaatactacaggtcaacataaactgtgacgtactctacaatttaaaaatgctttctggagaaatttaaacacagaaaagaatcacatatcagattgatgaaacggcagcagatttgacttgatttgtcagaagcagcaatgatcaggtagagtgccaacgcaattcagccccagaagaaagaaggctaatccttggagatagagatttatgtagaagctgttctttccatggaagacaaggttgtaggatgcacaaaagatgaggaacaccgataatccgatctcaggtagattcactctgcagcaaatgacaatgtcaggttaagcatgcatgcagaactccagcacctaccactaccagcttatctaaagattgcagtagcaaattggagaaataaattttacctgtttattaaccttttcctggatttttgaagcaatggagtctcattattctcgtcgaaggcattgttccccactttcttcgtcacaatccattggttgaattcttgcagttgcagcagaccagctacagcagctctcaaccgatgcatggacatgacgctctcgaataaaatcccagtggcactgtgtgcagatttctggagtgaaaagacagtatggcaa

SEQ ID NO: 62873 - DNA, 3248 bp, Oryza sativa
ctgagaaggaaatccggttctggctggaaatcagcatcaaatatggcaacatattcgcattgcttggcatagtcccactccattcccttcttcaaggctcctgctttgaaccctttgcggccacttctggtggcatacttaatgtttagacctttgcttgcccaatcctcacattccagctcaaccaaattctgcaaattaagtaaattcttgttcattttcattacattttcacaaggtagatgattaatttattgcccttctgtgttaacaaagtgctagggactgcaaatatatgcacactaaaatgacatgtacagatgtactaaggacgactagaggttgagttgggtaatttataacttttcagcttggataagaaaatatttacacatgccagtcaaaggtgacatcattcagttcaccagatgccaaatgctgagatatcccgaccgcaactgccttttatccaactacaactgcctttttacacaaaaagtaagccacaaaggtaattgatgtaaatagtagtttgtcaaataggatgtctcatgcaagtaaattactatttaagattaagtacttattgtctagacaaggatacttgaatcagctaatacttctttacatgaaactaaccatttatgacagtgatcatgttttttacagctacagggtatgtcgtcatccttttctttaaaaggtaatgatcaatgacgtgcatttcatttttcttagagaagggtttttttttttacctggcctctacatccaaccagatatatgcaaccttacaaattgagaacttagcccctcgaataacccaatctgaaattcgctcttatggagatttaaactcaggactttaggatgctacttaggtcactgtaaccactagactacatgctcttttactgtaatcacgtgcatttcatatggtccaggcacatgacttagctttcagtcctaggacctaagacagttaactacttaaggttaggttcctatgacgaaacttagttgcttttgctcctttttatactgatagtgatatatgaaagtgaaaagcaatgtcatccttatgtacaactaatccaactcattactcttcagtcttcacacaggaacaatgctaactcgttaagctaacatacagaaaaagtgataatctacactaattacagattttcagaggtctaagctcctgacgaaaaaaaaacccggagtttggacatctcaatcatatcattcagccagaaacttgcctaacaataagaaaaaggagagataccttgataaatgcgtccgtggaatcatccaaaacttggattatcaacctctcctttggccacttgagcccacaaactgctccgattgacaacttgtacacctacacccaagaatccaaaacatttgaattcggccgtatttgtgtctaatttgaatcttgttgaattgattggttattacctcgagctcattatacatgggtatctggaccatgaccatgggataagcagcagcagcagcctcccccttctcctcgtcgccggcgccggcgccgccgccgaggggctcccacttgaaccaccgctccggcctccagccgacgagcctggcggcgacgctgacggcggagttgtaggtggcctccaccaccagcatcaccgacatcaccatgcacgcccacaccccgacctgcagcgccggcgccaccgcgcgcgaccgcgcccccacccacgcctcgcgccaccacgcgccgccgccgctccccggcgacgtcgacgatccctcgccgacgactgggaacgtaccacgacaagagctcagctcactgaaagcaagaagctaattaacttggatgggaaaataaaaatggaaagaaaatcttggaacctgtgacgaggtaggtgaagtcgagggcgccggtggagacggcggcgaggagggagacggcggcggcgaggaggaagaggacggcgccggctgcctcgccggcctccattgtttctccgggcggtggcggctgccgtggcctctggagagagagaggagaggagagtgatgtacaacggaggctgagctgagctgagctgagcagttggatttttatcgctcagctctcggggggcacgtggacgggacagcgacacggcggggccattatattgggtctcaatgccaatattttgcgcttaatagtttagggatatttaccattttcgttaattgcttattaaatcaaaaaccgtcctaaaaaaacgagagaggatgataatagtgatatggtgatggactggtggattcatttgatttgttgcattctgggtaaggacaaggaaagattcatattcagcttaatttgtcaaaatgttgagaattaaagcactatagtttaaattatatctatgagtatattatacacttatgagtgtcctttcaaggattcaaatcgatttccataagattaaacacacaaaattgcgttcccaatagtttagtgcacaatatgttggagatggatttcttatccctcgaggaaatatcctcttgttatgtgtctgttatttaaaaaatcatcaaaaatttgaaaataaattatgaagataaatcaatatatgaaatacctttgccacaaacatacatgttaaaatttgaaatataagattcgaaacaaaaataataaatttgactgcggttacgcgttctattcatagtcaaatttgttattttgttttttcttgtataagttgaatttgaacgtgcatgtttgtgaagtgacatatcacatattgatctatcttactatttttttctattttttatgacttttaagttacataaaaaaaataaggggatattcccttaagaaatgaatagagtttccccaattgttactagttgtgagtagagcagggtcgcggctctaggctaaggccggttgtgggatcgcctaaggcacaaaccaaagggaacctcagccctcaaatcaaatcgatatcgtgccaaaaaaggcgtgcggacagccatgtttagaagggcaatttaatttgatgatctagggtgtcaagcgtgttgagtattttagatctttcagttgaggcattgagccattgaatatctcgggcatcatgtccgtcggtttgtcctcgatctggcggttgtgacacatgtgtagtttatgttacagttaaaaagaaaagccttacgagcctatagtgtcgaactatcaaatttacctaggccct

SEQ ID NO: 62874 - DNA, 2687 bp, Oryza sativa
ttttttttggcattgcacaggtgcaaatatcataataaaaaggaaaataaatcagttcgggtggtatggtgatttggagagagagagcaatgtgctggaaagatggtgagtcaccagtcaaatgtcatatgtggctgtgtcatatgagattgaagcttgcccattgcatgatgagctaagaattaaaatttcctgcgagaaacatcctgagagagaacacctgtcacccggaaagattagtttagatcgcccccatttgcatagtactagtatatagtactatgagccaaaattagtaggtcacgatggaaaacgttacaatatttcagagaaacaacctaactaaagttttacttgtttctcttgccttcttctcagatcgatcaatctattatatctatttaccagagtgttgcacaccggctgaccgatttgctgtgtaattatctatggtactatgcgccacgtggataaattaaatgctgtcgaatttaagctgcaaatcctaacaagttagtggtggcagttgagctctcatccatgcctagaaaatccaggtgtacaactttagcggacagagatttgatagcaggggacgaaagaagaagaagaagaagaacaagttgcaatttgcatcatgcatgtaatcatcatacgtgtgcctgaattttgaacgagatgatgatcgagcttgaagaaccagcctaaaattaaatgaaacctatgcaggattaaccaaataatccaagtggcgagagctagctagcttagggcggaggtggagtggagtatgggagggccgatcgaggggctgcccacgaatccggtcaaacaaaattttgtagccatatcttacttattttcaccatatatacaccctctcaatacaaacttatacatccacatctgcttaaatttgatctaaagtaaattaagcaagtgttactctctatttcgttctagctccgcccttaaatttacagcgcgccaaatctaatggtccaacaataattaactaattaagctggctgatctcggccgtatcatatgtgtgttttgctgggtaaatcatcgatgcatgcgcgcgactgcatatatatgcagggatttggagaaaacaaaaaggaaatgtccagctcgatataaagtgtgcaatttaattgtcctgctctattctatcataaatatttgacaatcagaataaattttgataaatagtttctcaaatgcttagtgtaaaacacaaacaaaatagtatacctacatttgcattgaaaaataatattatatatcatgaacttattggattttataaacttatactgatatataaaattaatggtcaaaaatttgaaaaaaatggatcagacattgcttaaatatttataactgggtaaagtatctgttttcctataaagcgatgacatgtatgatatgtaccgtttcttccttggactcctcgatctattctactacttcacttacatataaatcatcttatcaatcaagttgaatgaaaatatgtcaagttcattttttttggctaaggttaaaatggctgaaatgcatctttataggtggaagtagcaactccttgcgctaggtgtatgtaaaaattgaggttttcctaggcgatcaacacaactgcaagtgaaaaataggatttttgcatgtggcacatcacgatgcttgcctgtaaaaagaatttttagccaaaaagaaaatttttgaaaccctagcttggtagcggtcgtcgttcccatgcccagggtcgttgtcaccgctgcccctaaggtcaccacaatctttagtcaccactcaccgctcctgaggcaggcagcattcgatccgcactcctaaggctaccgtagtcgttagtcgatcctcccatgcatggcggatccaccactcccaaggccagcggcggtaggtccgcactcccgaggccattgcggtcgtcgttgccactcccatgcctggtggcagtaaatctgctattgaggtcggcggcggtagatccgttctcttgaggccgttgcagtcatcattgctgctcccatgccgcccggtggcgacaaatccattctcctaaggcttctacagtcgtcgttgctgctcccatatgcccggtggcggcgacaaatccattctcctgaggctgctacagtcgtcattgctgctcccatatgcccggcgatggcggatccatgcgctaagtatggggagaagcgatggaagggagaggtcaccggtggatccgcttctcctgttgctaccgacggatccacatacctcgagtctaccgtcattgtcgtggtcccacttagccgatgtttcgcccctccccaccgtcgtcgtggtcaccctagcaaccatcacggcatcgccccttcccgcacgaggcaaatctgacgcctccaccaccactcatcccaccccttcgccgctatcggatccggttaccaaccgtcgaggagaggagataaagggaggagaggccgaaaggaggataggtgaagtaatagggaggatggaaaaggaattaacgcatgggaggagagaaaaggagagggagcgggactacgaaaataaaccatgtaggtaggttttttattgggccccctcctattttttctacattttacatactagtaagcatgcacgtgaaatccacgtgactaaatatt

SEQ ID NO: 62875 - DNA, 2231 bp, Oryza sativa
agggcaaccaatttagattacaatgctccaatccaacaggattgagccgccgccgccatcgccaccaagttgcccgttctgagttttaattcagttcattacattgcttatgtctgaatctcacccactcactcgttctttcccctcacacacgccaattcacacagctttcaacagcacacttacatggcccaatcaggcccataattacgaggattcgccttggcctgtctagccggacgccgagtctgaattgggtccttcaggctggacggcctcccctgtagcccatccgatacgcctccttgttcagcagtatcatccccttctggtacatcatcagtgctcctggcacatctgcagtttggtaataagctcataaacatcccactacttgaactcacattatgttcatatcaatttgaaacatctttggggatacaataactgacgggtctgcactttaaagttctgaaagaaaacttgatccaagacagaagacatggagatatgtcagtgttaacctgttggtaagatctgtgtagggaagagacctgaaagatggaaaaagacctgaaaggaagtgaattgaagtggcctgtatacaattcgctggtgttttttgcagggataatgcttaccaggctgtgcaaaggcagacgatggtgcaggtccaatggaaggcatgagcgtgggtcagtcggcggcaggagcgcggttgccagcctaggaaaaggcaaggggtcagtcggcggcagcgttcaggcagggcaatggcgaggagaggcgacgccggcgggagcgcgcgcggttgccggtggagagaaggcgaggggtcagtcgatggcagcggtgttcaggcgaagtgatcgcgatggcgagataggctgggtgcaggcggagtgcggttaccggtcgaggtcaagggaaggcggaggcacggagggcaggcgtgttatcgatcgagaggtgaggcggaggcggagcacgtgggctaggggtcgtgggactgaaggaggattgcgtgtttccttcggaaaatccaagacttaatcccgtgcgttaattcgagtggatcggacggataggaaagacctgtggggggtagtccaagttgctccattgtagtatagacggttctttttaaccttgccaaaaaactgagggtgtatgaaaaatcatttctttacattgtgctaactctctactcatgccaacgtaaatcaaatacagcctctacagttcatgagccaacgttgttatcctcataaaaaaaactgataaatggggacaaattaatgctataatctgaaaatctccacaacgcataaattaaactctatcctgtttaggagtccatctgacaacaaaaccgccaccaaattcacaacctatgcatgcaatgctccaaaaatacatccaaacctatggggatgctctactagctaaattaattaattatgaatctcggctcttaattcgctatagctagcacacagatagctagagagatcacgaacataatcacatgccaacaaacccaagtgaaaaagatctcacgaacataaaaactgcattgccaacccagagatcgagagaattaatttgccccccggaatataatcgacacgggattttgtttccttactatagccgcatgcatatctcgacagtatccatggcggcgcccccccctgccgaatttgggatcccgttcgttcgttcgcaggagacaacaagaagttaatgacggaaatgcaagctcaccacacgcgtatctgatcattcatgtttgccgatcaatgccgagatcgatacagctcggttaattagtttccccatcgagcagatcgatcgctctccctcttcttttttaaccgcgcagtgaagtagccgatcgatcggttgacgatcgacgcgcgcgtgctcggcggcgtttggtttgtgtgatcgatcgatgtggcgatccatggagaacggcggcggcggaggtggaggtggagggatcgccgggaagaagaggaaggcggttggtggcggcggcggcggcggaggaggaggcgggtccggctacggcgagagggcggcggcggcggcggtgatgaggagggagccgcggcgagggctcggggtggcggagctggagaggatcagagtgcagctcgaggcggcgcagagcctcttcatgatcccgccgtcgctgctgccctcgtcgtcgtcgtcatcgtcgg

SEQ ID NO: 62876 - DNA, 2387 bp, Oryza sativa
aaagcaaagtgagcatggctcaactagttaggttcgttgtggtggaaccaaactacctggtagtagacgacctacccgatgctcggttaattattctttaagtggtagacgagtacccggcgcctggctaactaaggcaaatgtggtgacttcgatataccggtccagcttttcaaaggtgcttataggtgtgcgtgttcatagggataattgctcgtgtcatgagcacttgtgtttttatgtttataataaaaatacttatataaaagatcagatgagcttaagttaatgtcacgccccggactagtaccgaccggaactagcccgtgacgctccaaattaccctgttaatcgataccagtcccaggaaacagtgctggtatcacaggaagacagattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcggcgggatccgcttcatcttcttcagcaactgggggggaaattatttatatagagcaagggtgagtacgggagtactcagcaagccatgggaaataagtgtttaatgcaggcttcaaggaaagactgttgtttttgcaattgattttatttaaactcttctctaaaaacaactaagtgagtgcttctcaaacgacacggatgagacagtgtgtctcgtccggtcggagtttgtgcaatgtatcagtcttttgaaatgattcaaggttggcacccggccaacagcttttcaaacggccacccgggccaacaactttcaaacggccacctgggcctagctgatcccatcagctgcagatttttcaatcatcgaacccctttccacaacagcaatttcacaagcagtagtcaaacaaaactacgctaggaatcacctcacatccacccatgaccgtgggcacggctgttcgaacagtttgttaacctctgcagagggggtacactttacccacacgacattactaacccggatcacccagctcgtggggatcagccacgtcgggagacctccaagctttcatgacaaggcatttccaaagccgacacaggtttaccatatgccaacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcagatgaaattccaaggaaacggtccttaggtgcaagagcgggaaaaccgtacacccagtacgtttcccggtccgcggttttggaaatccatttagttcgcaagcaccgacccaggtgtcgggttttccaagtcttttgtataacccaagttttacccaagaagtttttcagattttaagtttgaaggcgtccgtcgatactcgcacagggtgcacgaatatcgagacgcaactagatggttacaaggggacacgatataacaattatcaaaggaaggatcaaatgcaacaaattaggtaggtccgccaatctgccttgtagacgggacaacagattaagtgcgatcctatcaatgcataatatttttcaagcaacataattaaatttcaagtataggctcaagatgttcaaaggtggcttgccttgctcgagatctggagcttgatcctcgaaatcctcgcactgcgggtcttcgggctctgaaactacacgcgaaacgggacaactcaacaaacggcaaaaataaggccttattaatgacctctaagcgtgccattagatagatctcgagatttgaggaattttggaagttgaacggagtcaaacggatttacggttgggaagatattaaatttctaagattattggatttttggtctaaaggaaaaggatttaattaaatcctttttggaaaagaaaagaaaagaaaagaaaagagggagggaatatagacttttcctcggcggctagggcgcggcccgagagaaatggggcggtccggccgagctaaatgggccggccggcccaaggcggcccaaggcgcgcgcgcgggaggggaggagagagagagagtcggtggaccgggctcaccacgcgtggtcccgggtgggacccgcttgtcggtgacacggttcaccgtgcggagcgagcacgcggcgcacgcgcgcgggcgggggagggacccggtgcacgcgcgcggt

SEQ ID NO: 62877 - DNA, 3015 bp, Oryza sativa
gaaaaccgggactataggggggttacgaaccgggagtaaagcccctttctccaccagtgtcatcacccactagcaataattgcatgcaagcatacaccatcatctacaatatatttaattctacaaatcaacatacaagcatatcaaatcaccaccctcacatcatttacacaatattttaacaaatctatctatcatttttatagtatttaacataaatttatcaacatgttgaaaaaatatagtcagaattacttagtaatctcacagcaaagcgcggggaatcacctagctaactaatagatgggtacctgcgcgttgcggccaagccctgctcgatgttggcatatatggtgccgtggggttttggcaccagtggctggaaggtgtcggcccaatcaatctccttaacttgcttctagaaaaaaaaaatctatactaccaatcatgtatatactatgacagcacacgtgcttttgtttcacatcctatcgaataattaaatgttagcttgtttgagttgtggcttataaattgaaatcagttttgaatggtagaacataattttaggattagcttagggattttcttttgtcactgtgtcttattattttctatgttaaaagtagatctagaaaatgtaaaattttaccctaaaattattttgaattccaccagtcacatgtttttagctcataaaccgtacggggaaaaaacatccagctagaccctagatcgtcctagacctgccgaatatatatagctagcatccccgacaaatatttccattttatatcaacaagctatttatatatgtatatattttaataacatattagcgagatgtatgataaaataattatgtatgaataaaaacagtacaagaatattacagttgacttgtctacaaaatttactagagaaattttacacagtgtagttctaggaaaagcatttctcacggagagagtgtgcgcttctatacgcacaattgcacgagtcgcaagtcgcaacacgatttttttctgttattatacctgccaagtaacaagccaccttttcaatcttagaacacataaattgtataagttctttatggggggtttgttcgatttccctaaaaattcttcacggtttctccatttcaaaggaggctggttccctgaagtgtagtgtgactgcaacataagcaatcacaggctacaactattcgatttgaatttaagggtaaggatttgctatagatgagctattatagcgcaatagatctgaattcttcgtgcaaaaaaatggatggacaagatcaactgcagttacgactgtagctgatctcaatccatgggagctcctgtgacaccaaaataatctaatggcatgggagctcctgcgtcacattggaggcccccagttggtgtggtgttctctgtggcgatgttccaaccagaccggcttcaatggttagagcgatggcaagatctaggcgaatgactgaattacgtcccagttaatctgcaacgttatctttctttgtggttcttatggtcaatgatgtgagtgagattcaatctgtaatgatcatctcatgtttttagagattatgtttctttgtttgagaagatcataattaaatataacttgcaagctattgggaaacaacggttatatacacagattctcaatagcagttttacctctgtctttaggttgatagttcaagcagttttctcgttttaatttaagttgtgattttgtaattcatagttatttgaccagtaatctgtgtaataataattggctatatatatatatatatatatatatatatatatatatatatatatatatagtttagagcaagactagaatcaattcaatctctgctattataaaaattaaagatgtttttgccgatattttggtacgtcatccgtgtatgagtcggtttttaagttcgtttgattttagaaatacatatccgtatttgagtcggttttaagatcattcacttttggtaatacagaaggaatcatataagaaatctgtataaaaaaaaactcgcatgctaacttaaaacgatcggactcctaactgcagctcattattttccaaaaaaatatatatccaagcgaactcccacagtgaacttcatcttaactaaaccatataacagtaataagattaaaatagacttcacccgttgcaacgcactggcattttttatagttatttaaaaaaaacaagatggtatgcaccatagggagtagtattaatatagacacgtatgcatgatactaataaatataaaaaataattttacattttgataagtattatttttctacctgctccactgactcttgctaatccatgtaacagatcagtgtatattcatgtgtgtactgttgtacggatccagagcactagtagcaagagtaaacagtaaaatccagcaacaactagtagtagtaaccactggctcgctagctaggctaaaagctaagcaattaactcgaattaattcttaatcaagtcgtgtggctctagtaccagtacttgcattgattggtagtaattaattaattaattaattagaaagcgtaattacggagagctacgtccagcagctgctcgtccagtgccagctgcggctctccgctgtcgtcgagcagcagccacgactcgatcgccgacagcggcgccaccccggccgccgtcgccgtcgcgtcgccgtcgtcgcacgcgaggagcatggacgacggcaggcagttggacgcgctggagtcgccgccgccggagcagcagtcggcggtgagctccaacgacgtcccggccgtggacgcgctctccgcggcggcgccaccgggcgtcgtcgtcgccgccgccgggttgcaggctgacaatcctttcctggccggaggcggcgccgcccagccgctcagcatcacggagatgttgcgctcgctcagggcgtacgccgccgccgccgccggcgcgggcggcccgctgctgatcatc

SEQ ID NO: 62878 - DNA, 8659 bp, Oryza sativa
gcggtgggggaggtaggaggcgatggcggcccagcggttgccgaggagggcctggaggtggaggatgaggcgctcctcgtggtgggagaagccgccgcggcggatgcccgggcggaggtagttggtccagcggaggcggcagctcttgctgcagcggaggaggcccgtcctgggcggcacggcgcgccagttgcccgggccgtgctcctgcacgtacgacgccagcaccatgtcctcctccggcgtccatggccccttcttcaccccctccttctcgcaacacggcggccgccccatcgatcgatcgatccgtggtccaacacttgctatagctataccagatggaaggaagcttgagcttagctttatatatatatacacacagagacagagagagggagaaaaatgtgaaagtgactgtagcccggtggttataagatcgttagtagtacttttgggagtgaattttccataatttaacggctttgtgcttttagtgataagcgacgtacgtacccgttgacagcgaagcgtctggggtgatttcatcaatctccaggatttgctagcccgttcttcgaaggttctcaatagggtaaggtttgcgtgcgtgcgtttatagaggtgagtgtgcgtgtcttgtaagggtctgtgttgtactgtgtaattaaaaaaaacagggagaatgcccaggcaagcatgtgtgtgtatgcacatatagcctagagctgactagctggatcgtcataattgtttcaacagtggtatccatattagatttagtttttgtatggtgacccagaattatttatttaggagaatggattttaaactatccacgtgttgtctctttatttcttgtatgacattcaaatagttatgaattttttttaaaaaaaagagagaagatagattaattaatacatgatcgattacactgcattttacaaagatataagttaaaattcgacatccataagttgtagaaataataaattaaactttagcttagttaacatatatttacatgcaaatttgtttttaatgttgtagaagtaatatttaaaacttgcatgtgtacggagcaatatatcacatattatctatgttatcgaaatattttaattttttgcacaaccctttatatgacttgtaaggaactggcgaatatattcgcatcagtttagaatcgtttcagttatttagatttaaagtaacagtaagtactctctatgttcataaatacttatcgccgatttaatgagtaaatttcacaaagctacatcagatttaagatttatgagtaaattttacaaaaaatatggatactttgaccaaattatcacaaaattataggtatataataaatttattacaaaactatatgtttaaagctaaatatctaaaactacagatgatataataaaattatgataaaattatagattttagagtttaaagttttaatattatgtttgagttataaatattcaaattttatgattaattaacttgacgttagacttgtagttttatgataactttattattacatatgtagtagttttgtgatatatcattttaaatctatacttttatacttctatgaggtaatgtcaattaataatacttaaaattgtgttacctttcaaacgtaaaatcacttcattaaaattagattctttcgagtcaaaatcgtaactttggattcttccttaattaatcaaagtccagaaagagattttaaggcaacggtacgtgaacggtgtgaatggtgacggacggacggatgcggtgttaagttgatgatagtatcgccgcgtgcgtgcatttatattataaaatattgtataatgacgtacatatagtaatttattaaacttcaatgtggtacaacaatatcggtcaatacctttaatgctatatatgagccaaatacaaatggactaggaaatataattgacaaatttaacatagtacttataatattattattagataatggaattcattccggcctttgctttaaagaagctaaaaccaattattacaaagattatagctcaaaagactataaatgacaaaatcatagcttgattaaaaaacaaagaaaactatttagactacaacctaaagaccaggataagccaatggcttataagttgtacgtatagtctttgtcttcctaagctatgaagcagaatatccaaaaacaattactgatcattaccgattgaaacgcgcatatcatcgatgtcaacacagcgaaagataatgtcggagagcaactaagatgtaaaacaatcctacgcagtggcgaatctagaaaatcgattcattggtgtcataacgtgtctatcggtgtcatagtatactaattatacttaaatcatagtataataatacatggataagcagttttgttataggttttgccgaaagtcgttggtgtcacctgacaccggccctattattgtagctccgcccctgatcctacgctcaaatcttaccaccagcctaaccatcgaaaacggcaacagggatgtacactgcaccaacgggcaggggtgaaaatggtacggaaacagacggaaacaacttttatcgttttcgttttcatattttttccggaatcggaatcggaatcggaaaccccggaaacgaaaacggaaacgaatattatcgaaaccgaaaacggagcgaaaacgaaccggcgcggatacggtaacaaaaattattagaatacaaaaaccccttaaactaagcttcaaacttttgtcaagtccaattctcaactctcaacagtccacaattcatcataaaacacaattatatgaaatcgtctcaacaacaaaatatattcctctataacttcatataatttgcataacaaatattctaaaaaaattacagcaaaaaaccatggtacaaggtatacaatatacactattattcagtgctatactgctaatctgctatgagctatcactccatcatcagtacatagttcatcaatcatcattcatcagtcatcacagaacagcaacacacatcagtccatcagtacagtacttagttcaatcacaaaacagctacttgcatttgatgattcgatccatcgtaaatctgcagcacaaaagaaatcaaatcgatttaggctcgtcggctcgtcgctaggctgctgggactgctgaggcgaggcgtcgtcggctcgtcggtgtggctgtggcgtcgtcgtcagtggttgtagcggcggcgaaacagcgggatggcgccgtggctgcgagacggccgcgaaacggcgggacagcgccgcaagatagtggcggtatgagacggcgaaaacggtgggggcgaggtcgcgaggagccgaggacggcagagaagcggtggcgcgggcaccgggcggtgggcgctggcggtgcgcggagcgcgatgctccgccgccggctcacggtctcgcgaagtcgtgtgcctgtctctctcctctctagggttagccactatttgggttgggctggaaacttagggatgagttatagactattgattctatgggtctttttaacttcggaaattccgacaaattttccagaatttttccgaccgattccgagtttcgacggaaactgctattatcatattcaattccgtttccaagaaaatatttccgttttcgattccgtttccgagaaattccgaaaaaattctgaccggctgattccgtttccgaaaacaggcctggaatccggaaagtttccgtaccgttttcacccctaccaacagggacctctaacacgacgcctctaagaaggtcgtggcatctatggtgtcgtcatcgctattatgggcaaacctgaagtatctactcgaaagcatgaagatgagctagagcattgcgacatcgccttcaggaaggtgtgtggagtccacaggcatcatcgatgttgaacactgccgtcaacctacatcgccacctaagccatgcgtcccctccgtcgccactacaaccagcaccgataagcagcctctggcttggtggtccgcggctgccttcgactctcggccaaatccagctggccctccaactagaagtggccgcagccgcacctgtcatcaacacctatgacatggatctgaggacaagcatacttcgggactttcgctagaggtaagtgcatgatgatgtcatggcaccgcgccaccaccacaatcattcctgccgtgcaacaacggatagctgcagcgatgaggatgccgcaaccgcaccgcaagggccaccgccacgttgcatacgccatgcaacgctgcaacctggagctcacccttcaccccgccgcaacggtcagccacatcgcgatagctgccgtcgtgatgaatccaaaccttgctgccgccttccttgctactacgttggcagtgaacttgagcgttggcgaggcggatgggagaaggaggatgagccggagggaggagggagctcaccaaagggctttgtctgtcgccctaacctgctccgcttgccgtcgccgctgtcattgctcgactgcgtgtcctcttctccgttagagcagttcgcgggagggaaaaggagagggctcactggaggtccgtcacaatcgctggagactcgtcgctcactgttggcgtagagaaagaatgagaggaggggaggggagaggaagggaggggaagaaatggataaggtgagagagagaagggaatagaatggataaggtgagagaaaggggcacacaacttaatctgtcagcgtgcgcgcattagaacccctcatattttggagcgaagggaatactaaacactcaagggtgttggactacgactgataagaaaaaaacgaagcaaccaaaaataatttatgaataaaacctttatatttgcattactagctattgagagccaaagctagaaaatagattaagataaaaagaacctaataaactataaaattaaattaattttaaaaatttaaatttggattataataaaagaaaatgtgtaggcgcatgcgttccttgcgccagagatggctgacttgttcaatcagattgggcggcaagtggtcaatcgaagccctaaatgcagcaagagagaaagaaattaaaagctagctaagctaatcttcctcctgatcacaatcctaccaaccagtctgaagaagaaaaaagaggaccgagtcagctgcatgctttgctagcagccgatgagctctccccatccacgtacaccattcaatgcggtgtatgccatcacagatctgacatccatcaatttggctcgagaaatatatgtgcaggatattgaagattagcccatcatgcaaacgaaccggctcacgaacccacttattttataatataaatagatggataacccggtatataggtttttagattggtccacttatcccttacatcaaatcaaagagaattatcatgcagctaggtattgtctgcggtaagccggtaattaccactgacatataagtctttcatatattttttaaggggagtgctttattaattaggaaatagcagcacagtcttagctcacagccaattttacaaaatcatggaaaaaaaatctccacactgcactagcctcattcctacaagcaaactgagaaaataaatgagctactcagtactcactactaaccagctccatcattttgcttatacttatccttaattatggtttattagtagaaccaataaataatttatgaataaaatttttatatacatatttttaacgatttaaaataaaatactgtaaaataaactacgatgaaaaatatcataaagtcaccttcaaaattaaattttagaattgaaattttagcttaattgtaagcataaatgaaaagaggtagttgatcatatgttctaatattataatactcactctgtttctaaatatttgacatcgttgattttttattacatgtttgaccgttcgtcttattcaaaaacttttgtgaaatatgtaaaactatatgtatacgtataagtatatttaacaatgaattaaatgataggaaaagaattaaaaattacttaaattttttgaataagacgaacggtcaaacatatttaaaaaagttaacggcgttaaatatttagaaacggagagagtattataagtgtcattgataactagtgacacgacagtaagtggttgtacacgtacattttcctaggctgaaaaaaaaaagaagcagccttgtagttgtacttgttcatcgtcctagcaattaaatatgcagtgcaagtgtgcaactagatgtcctgaacagcacactaacacaaccatcaataattaatatagacaagcaggagcatgcaccggcaatcactattatgagacgagaaacagtagaaaaatacaaaagagttaatcaaggccctatttagaatggtgaaaaacgttctgttgatcttaatctacacggagaaaatggactgatttatgtgcaattcagcatttttaatcaaatcgctgagaaaccaaatcggttcacacaaatcggctaacctgcaataacaaagcaatgttttcaggaagctctagatcactatcatttcaattagtagtagggacaaccgtaaaaattattcatcaattattaattgttagacaataatggcagtaatagactaacaacagtggcatgaagtaaaagatagtaattatattgaggcttattcttgcatgcgtttgagaaacagccaagaagaagaccattcaatttcttcccggatatattccagttacgccgaaacggtaagcagaaataaaagcatgaccgacatttaatcatataagctgtggccagcttcaattcctaatctcgccaagagttacgtatgtaatttatcaatcatgaccgacaattaatcatataaaaaatgtattaaaacgtgtcacaaactaagctagtagctactagctgtagctataattaatgacatgcaaattaaagaatccaaagctatatatatagttgttgtcttgtttacattccttcaaatttaagccaaattaaaggcatcacgaatatgaagatatatagagcgttccgcgttgtttggaaataaatttgaaaatacactgttgttgactcgtttttttctcacaaatatttggaatgtaaatttattagcataaatatatcgtcgatctcgcacaacagttccgcgaaagtgacgtggatgtgacgacgcaaacggtctcgcacaatgacagcgcgagaccgcacgatgtcacgtggtggtagcgtgagaccgcacggtctcgcacgatgaaactacgacaccgaacggcgaaatcgaggacgtgtgtggtggcggcgtcagaccacgcggtctcgcacggccaaaccgcgagaccgagcaatctcgctcacccaatgagcgatagcaacggttgaaaattgttagttactttctccgtttcacaatacaagttattctagtatttttcatattcatattaatgttaatgaatttagatagatatatatgtctagattctttaacaccaatatgatataggaaatgctagaataacttacattgcgaaacggagagagtagtgattgattatcctaattagcaattaattaatattaattaatcgctaattaggataattaatagttaattagagtaattaatcactaattaagcagcactgatggacaagacgttcggtctcgctgattccttgtgcgggaccgttcgctctcgctgttttatctcgcgataccacgcggtctcgcgcgacaccgcgtgcatcgtcacgctctcgtcactttcgcgcaacgattgcgcaagatcgacggtatatttctgctaaaaaaattacatcatgaatatttctaagaaaaaaacgaatcacagtatattttcaaatttaatttcgttgtttgcgtgattggcttccttcttactattaattgacgcgtctgatccttgcagttgtagcctaaatgcctaataactaccggcaaaacgatggacttgtcctacgtacagttgccgaggattcaatgcatccaaatacccaatatttgcattggcatggccaaaatattcgagatatatatatacaagaccatatttacattagaaaatatggcactttctcggattcaaaaatataagtgatgggtatgaatatacttatattttgatttatagcaataaatgcttatattttaaaatgaagtgacgagctaaagaacccagagaaaaagaattgtaattaaaatcatttttcaactaatcttcatcaacattgtaagcccagttatcactgcaaatactatagcaagggattttaaatgatccaacaagtttttagcatacaaaatttgagggctgaatctaaaatagtgtggattaaaattttatgtatttttaatctaaaaatatagaagggctaggtagaattgtgaaagaacccatgcattggtctttacccattagttaccaccgctaattatagttctttaattttttttctatctgaatattaaggggttgtttagttgtcagccacactttactatgaatgttttatcaataaaaataaggtggtcaaatttttagccataccattaattatagcaagt

SEQ ID NO: 62879 - DNA, 3434 bp, Oryza sativa
tgtcctaagaaatggaaaacatgtacaaggaaaacaaggaggatgtagagttgaggacctttgatgtaaaatagaaattttcagttgctaagaaatgtccacgaagctcaggtacaaaagttggtccaagttggcattgttgatatcggcactcttctgcacttaggacataaaatttcagaagataaaagtggtaatgaactgacacatcatgctaaattgaccttgggtcagaacaaagaaaaaactccaacaaagtattcaagctacagaagatattaagtctatgaaatcaaagaacctcccatctttgttgatgttgaacaattgaaggataacctgatatttaaccattataaccttgtttatcttcatcttactggtatgatattttagctaatgatcacatataaaacttttcttcagatcattttcatggtattcttaagcacacaaacagtgaaagtaaaagaaagaaatctgttagcaactaagtaaccaggtaaataaagccttttagggattaacaaaaaacatggcacattcatttcctaccgttgccttttttcagcagtgccaaagaagaagatctgcacactgtaaagtctccatccccactatcagcaaattgattctctaattttgattttgaagcactgcttggtcttgatattacttctttgatgcgagaatatcctttaggagcacatggatcaacaagtgtaccatttttggagtctgcaaccacatgagtcatgataaggcactgctttgaacttcagtacatgcagccaagttcctctaaaagctaattaacgaaaataaaatagaatttgtgtattcatattggtttcattcagagcataaaatgcataaaagaataacaatacaatgatggatgcaagtacataacagctttgatattcaacccagcactcatcaaacttaaaatgtacaactgttgctttgaactatagtcctgacatatttgtgtcactgtagcacatcagaagtagaatagccatagttagtatactaattattgatgttctattggctaacatcagcacatcatatttgttagctgtgaataatattctgatattctcatttctgggaacttagtgttcccttgtcaacctagctaccattgtaagggatgccaaatgtctattttttttgctatcctttacattgaaagaataagtaaaaagataccttttgaccgcagtatttcacggaaggattcttgtgcagcattctgcaaaagaaattgaatcatatggtcagcatatcgtatcatattacaagattgtccataacataagtggtgggtgattcaatgtatacaaatagctcacttgtccaaagtttagaaagctgttgctatagagagtatatgttgttccaccaaaagtgaaatttcttgacagttccggaggaagtacttcatcagaaacaaatgtcagctgaaacaataagcaataattagattggcagaaaatcattaatataaccaaagcattaagcaccgtgttaacattgatattcaaatgtggagcttggttctagataacaccatctcaggtaagtgagtcttttcagattaaataacttaactttattacttattagtaccatcttattagcatggattttaatttaaagaggattcatggctcaaaatcaaaggaaaggaaaggaatcaaagaatttatctgtctttatcagagaacctgtgctgaggcgcccccaagttcaattattccaatggttttgtgtggatcccctccaagtgtgccaagagcatagtttgccgcaacccaagcatagataccctcatcagagcctataagaaatgaaccagccaaaaaatgagcatccatactgacaatatttcagctaatgatgaaaaaccatctgtatccaccatccaatggattttccctttactgattcactacccaaattactttatacaccgctttccctttcgaatagccggattcagtttcttgatgcctctcactaaaccagaatataaaccgaattgaggccgtatttctcaggagtactacacttcaacccgcaacgatacagcctagagaagaaacaacggtaatatccactacacatttttcagaaaatcattcatttcaggaatcaccaatgtgcaaccatcacaacaacgactgaattgacaaccgcggctgtctcagcatgacaccttagcatttccatggaatatgtcagattcatcaccagattcaaattctaacgtctcacctaaatcgaattcccagtcccccatctataaggcaaccagctatatcacttgagcattacgaactgggaagaaatcgacactacctgggatcacctcggcccaagagtcctcgaaccggaatccggaagccctgagcacgtccctgcaggacgacaggatggcctcctggaggcgcccctcctgcagccgcagcccggcggtggccatgagccgcacttccgccgcggcgcccccgaccttctccctggcgaaatcaatcagcggccgcagcgaatccccggcccgcgcgggctcgtcggcgaacgaggagagccccggggtgacgcgcatcacggccgaccgcgccagatccggccgcccgccgggccccgtggcgaagacgtgcgcccggctgccggtgctccccccgtcgatgatgaccgcgaagcgcggtggcgaggaggagggggagggccgcggcggctgcagctgcggctgcggctgcggcggggagaagaggtgggcgagggaggagacgaggagggcgaggagcgcggtgccgaggcagatgccgcagaggcggcagcggcggcggcgggggcgaggggaagggggtttggtgaggtcgggcatggcggggacacggccggggcgcgcccggccggtaccggcaccgccgccgcctctttgactcgtcggcggcgagggagacggcgacgacgacgagctttattttttattaattattaatggatttttaaatttccagggaggggcgtttttatagtacaggctggcacttggacggcgggggtggaggcgccctccaactttacgtaaactttaaaccgaaacgtaattacgtaagcttagagtttttcaatacagaaatgagaaatcagaagtgtttctgaattctgagcgactatgaattcagagtataaataaattactactgaactcaacgttccaatcttttgagttgcaaatttataccactgaattggaaattttggaatatatatattgaagaaagagggcgtctccggggtaataagttacccccaaatgctagtacaactgaactttctatgcaaagaacaaagaatctgttcgtttcagtttaaatctcaacaatctgacagcaatgtgcggatccacaaatggt

SEQ ID NO: 62880 - DNA, 1045 bp, Oryza sativa
tgtctagagcctgagctccaagtccaattctttcccggcgcggtcgccggcagcagcctcctcgtcgtcgtcgtcgtcgacgaggttcacaaacggaataatactctgagatctactcgccgccgcagtcgtctcgccgtgcagctccatctgcggctgcgctcgacggcggcgataatcctgcagctgcatcctgtatagctcctgcatatatatcattagagcagtgtcaattatattatagagtaaatttcagaaaactgcaatttaaaaaaactattcgtttactgcaattttagcgatatgttttagtttgcttcagcaatagtgtgaaaaattattacaaaactgtaacttttacgttatatactgctacagtatatatgtaacaactgtagcagcaaattaactattatattatattgctactatctagtaactaattaactagcagaatttctcgcgcaattgcacaagtacacatatatatacctgatcagatgaaccctgttgctgtcttaggagaggggacgcgttcacgacgcacttgcctgaagcatcctgattgatctgacgttggaaataagcttggctgctgctgctgctgctgtttgatgcaagtaatagcctgctaataacacaattaaacacgcagaattaagaaaatttagtgattagcagagggtaaaatggaggctaggtcaggacgagtaggaagtaagattttgctctgactttgtcagtatcaaaaggcaaaattaagctaggcacgtgcctggtcaaagcatcattaggagtagtagtgtaatgctgctgcttctgcagtggcgatgagccgtaataatacggagtgaaatggtgatctcttgttcgcgctgctgctccatttccaacctgcacatataaataccaatatcatcgtcagctagggttttgattggatgatgtaagaaaaaattccttgattttcacgtacgtattgttgttgttgttgttgttgttggtggccgtagcgcacgccggccacgtgagacggcagcagcgg

SEQ ID NO: 62881 - DNA, 1790 bp, Oryza sativa
aaaagagcagttggatggaccggtccatcggtcaaccgatcgggagttttctcccaagtgtattatagtatcttttgaattttatattggtatatgttttatacttttattgggtagaaatgaaattatgtttggagggagctaatgttcacgttttaaattgaagggagctaatgtaccatatattgggggtaccttttaaattgctggtactcaatcgatcctaatgttcacgtttcatatggatcatcatctatcattcttttaattcacctgccggccggctatttaaattttactttttgtcatttaccacggacgacgaattaataatgaattaaagagaggcgtacttacattgggtatcactcactatatagtagatcccaaagccacgagctcgatcgatcggtctcgtcgcaattaagctagtaacttaattacatcatcgaccgatcgttacctaaccgatcgatcgagcagacgtacgaatttttccgttccactctccaggaaaccatgcctcccatggatcgccatcgtctcgccgacggcgacgattcgtcgatcccgttttgccattaaagggattattgattaattgtctgctgatcaaccactagatagctagatcgacagaaaccttgatcatagagtatacatagtgaaaaaagttcgagcaattcttaaacatatatagaagttagggtctgctagattttaagcaatgcacgattttagttcaatttatatttaattgtgttattatataagattttattttattttattatctattttatgtacttttgcatatttgcgtatgttaggataatttattatattcaacccttttatctaaagatgtgactttgtttataaataaataaaatgggataaaataaatgactgaacttaaaattttctttttttagataatggaaataataaaaaaaatctaaacactcttaattagttgtactttctttaagcaaacggtgaaaatgagctggagataagtctggcaccactaactctccattgttttataagaaaacaaaagtgtgggttaaacgatctacgtgtcaaccgaaaggtacgactaagtaatacgatgtataaaaagtaatgaaaaataaattaatgataatgctaagtttaaaaaatgtgttgcaactcgcggtccacgggcaatatatgctattactccctcggtaccagaatatagcaactaatgggatgagacacatcctaggacaatctaaaaaaatatattacctctcattgagagggcctgaacctgtctaaatcctttgtctccacatccatccacttttaggtctcgtgcgctacccccttttattattgccgaattcatgtttcgacagttggcgcgccaggtaggggttgcgtcgagtttcctatcaacgagcgcgatggaattaacttcatgagtcgccgacttcgttttcgcttcgggagttttcacttcctttccgtcgaccacttcttcaagctcctcttctctgacttgatccaaatcagtcagggggaaactcaatcgagggattacaacaatctaccgcggcaagtttcagattcaatctcctatggctgccgtcagcaccgccttcatcttcggaccggttcttttcttctggagttcggcttgcatcgccgccgccggaaattccgacgggacgtcagtcgtcaacttgatcgtttgacatgccgagtccatcatctgatgatgtcaaatctcctggcgatattcaattactaatctaaat

SEQ ID NO: 62882 - DNA, 10435 bp, Oryza sativa
agctaagtgcctttatttttcctctttatgtgatattttccattgagcaatttttttatatctactcatgctaactactcgtccagcgccggacgcctagttttatcattatttatcatattgatttttaatctcagattaatctcttgttattttttgttgttgttcgcatataattacgcggcactattgaggcgattaatgctggtcatggagtcgaggcgtctcagctttccggtcgatcggccgcgagtccactttgccggcttgtcttcgccaccgccattgctgataacaacaacgacttcaccgccggcctgcttccgtcgccgccgagtggtgcctccgcctacacggctggcctattatgccgccgctgttaggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgctgctgttgggcgtcaacgacttcaccgccggcctgcctccgttgccgccgagtggtgcctccgcctacacggctggcctattatgccgccgctgttaggcgtctacgacttcaccgccggcctgcctccatcgccgccgactggtgtcctcgcctatacggttggttggtcacaccaccgttcatgggcgtccacgtcttcgccgaccggctggccttcgccgccgccgactggtgtttttgcctatacggttggcggacttcgccgctgttaatgggcttcatcatctacaccactggcttggttccactggcgccgactggtgtttttgtcaccattgatggactgcttcgttcccacatcggctacttttgctgtcatcgagggaatacgacaaagctaagtcatcatttattttattctttatatgatattttgctttttcctttgcctcgctacctcaactggttcgccgttgactagtgagtcgggggctatagatgttatatcgtattttttaaacaattttcataatatttatcttgattgcttgcgacataatctgagtacaaaagtacctatcgagttatggagttctatcttcctatgctttccgtttggtttgccaatggatggttgcctttgggccgattcctagcacccggggactcgttggatggaccgagtaacgcaaggtgctgagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaaatgcctaggccgactcccgatgcttgggggctatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccaccgccgactggtgtttccgcctgcacggctggcctattatgccgccgttgttgggcgtctacgtcttcatcgaccggcttgccttcgccgccgccgactggtgtttctgcctgcacggctggcctattatgccgccgttgttgggcgtctacatcttcaccgaccggccgcctcgaccgccgccgactggtgtttccgcctgcacggctggcctattatgccgccgttgttgggcgtctactagtatgagtcttatcccattatagattgctatattctgggacggagagagagagagagtagcttttaacaaagatatgacacatgcctgtacatgtacggttcttgttgcctggctgccacaatataattcagatctgaactgggttggcaactgctgcctttgcctccattctataaaaatgtatggctagatttatagtattaaaatgtgttatatcagtactaggttgattttttatgggacggaggaagtatatcatactaaattacatggagtcatggatatatatttttgtacacctaccacgtttcaaatgcataacttaatttggaccattgaacgactaggctaacacacattttgttgttggagtgtgacgtggagtatcgtggagcacagatatatatgagcagcttaattagctagctagatcgtcatctttcgctctcattaattcccattaccgttagcctggatatgcaacagttttgcatttaaggcgccaaagctccatataggcatcaaaattttgcgaacctttaatcactgtcactgtatgaatgaatctttaattaggctgatatatatatgcggcatgtgtctaaattaattatgatcgatcagtagccatgaattaaatggttgatgcatttgcttgtaccttctgttggcccgttggagcgcgagtatcatgtagtgccacaatatgctgacataacaaatattgcattatttattattattattattattattattattattattattattattattattattattattattattattattattattattattattattattattatttcataggttagtttgattggatgcgcgtgcgcgtgcgtgcgtggagaacgagttacagtggagtacttatataatcgtgtatactgttctcacaacacgatacatcagtctgaattacgaaagctctcgagcataagtaagcttaataatgttgtgcacatgtaactaagatcatggactcgtggatgtgtgtggttgcccaaatttattttagttattaaaagaaaaggaaaaataaccgtgttcgtctatttatatttatgaacgaagggagtttgttacaatgatttattcgtgaactgtttctattcttcaattaatcgagagaaagggacacaaagtaacactcctttttgcccacgaaccgaaaaaaacactgctaattagtcatccatggatccatcttctcccttccgacaagggcaatagagacgacgacggttgctccactgctctccggccgccgtgtcgtggtggtcgcctcgtcggcacggtggtcaacttggcccatctatgtaagtcggttgatcgtcggcacggcgccattaattaattactccggccgaaagtgaccatatatacgtactgtacaactctccggcatgcagatttgttgatccgctataagttaatatcactcgcgttgttcttttcatctacttcatcgaatttgaagtaattatgtagaaattattggagaaatgttgtgattgattgacaagataaaaatagatgaataatttaaatggagaatgcttgtaaagaaatagtattattttgggtgaacagctaaagtgatcctccaagttttattctaggctcagtttagtccttaatgtttcaatttgtccatattagttcttcaagtttttattttagtttaaacttatccttaaacccacttagaagccacatgactaaacataacgaacaactcttaataaataacgcttatactccttcattcactagaaaaaattgcatgcaatgattttttttatagataatgcatagtacttatgtaaaacaaaaataaattatgtactttcaattgtatagatagccattaggcttaagtttcatgtgcacatattaaaataatagaaattacatctgcaatattgtttattcatcttgtttttctcttttatagtgtagtatacaaattaaaggcgaaagggacattttctaataaaaatgttgactaaaaatagccatatggcacatcaagtgggtaaaaggatgattttaatccaaaacaaatacttagaggacctatatggacaaaacgaaacctaaaggatcaaattgagccttcggtgaaacccgagggactgaattagctattcaccctattattttaagacaaaatactatactagacatatagctatattttaaaatgaaggtggtagagatcaatataaactgttgatttgattctatgtaaggggcaacatttatttatactatcgtctcaattaattaattgaaggtataaatattagagggtatatataatcttcaataatacaaatatatagaattgggtacttcaaaatttgggaccaaaatagccaatcgatacttcccaaattgtagcgataaaataagatatcaacgggtactttctaaacagtccaaataaatcgatatacttcacaaaaataaatgggatgagtagtaagaaaaataattatcgttcaaactatttcttctactattaatagtagaatattatatagagaaccataacaaataaagctcatggaaagtgtccacgtcgcaatgacggtgggaacatgtgggcggagtgtccatgctattttaatcccagcagaacgggagatgtaaccgacatacgggcggctcccctgtgatgaaaaccaacgtgatcatgatgcgtgcattatgtcagcttacacgtaatgtatgtacccctctgtctaaaaaaatattaatcctacctacgaatttagaaacatatatgttcgagttcgtggctaggaattcattttttaaggatggaatagtacgtttgaaatttggctggatacatttctatataaaattagaatcacccgtagtattctaccgctagtagaatactactatataaaccattaatttatgggcatgttcggctgcccgggctgcagctgcgccgcagccggcacgaacagtgccgcactcactgtgcgcagccgcagccacggctgcagctatcggcctgccgaacaggccctataagggcacgtaatatattctattaatatatagttagagataattgcaacattatttttttcttttcgagcctcgctacggtgctttctactagtagccgaaaacaatctgaagtgttaattttattttatcgaaggattccgatctatttatactaccaccccagttagcggtagtagaaatatggagatacattattgtcaaaaaaaataagtgtggagggatatatatacttgttatttagcaatgactaaactttttttcctcttttttggctttttgatgaaaaatgagtgatgccggcgtaatagatgatatgattacagatggatttagttgaaaaaaataaaagataaagtaacttctaatcattatattaataaattactctctttgttcctgatatttgacgtcgttgactttttttaaatatgtttaaccgttcgtcttattaaaaaattaagtaattattaattctttttctatcatttgattcattgttaaatatatacttttatgtatacatatagttttacatattttacaaaagttgttgataatatgaatggttaaacatattttaaaaaaatcaacaatgtcaaatatttagggacggatggagtactattttagctctcataatatactaccaataaagttcttttctttatagtgaccagtcactggtcctttcgttcccgcgtgcgctcaactccagcggcagtgccctctctcctccgtcgaacagacaaaatcaggcaagctattactatactgaacaaatcaatatatatagtcaacatcgagcagcaagaacacaagtaattaatgttagacactccccatgattatctttaaaacacatatatttgattagtttctccacatgctgtgttctgttcttaattaagtcgttaacagtgctgaatttctccaaaggatcgtacccaagtatttcagttcagaatagtcatttgcgcagttcagagtgcccattagaatggtgctcaaaacactgtaatgttgattggcgcttaaatccttgaattgacaaggtttcttgccctagtctcaaggtgcaccagccctggccagcgcatgacctaagtcacaaaagttaatggatggatggattgagaaactggaatgcaggacattattttctaaaaaaataaaacgacgaggtatacctcctcctaaaatatggaacgttagttggaacgtgttcctaagttatttggaatgcccctctatctcttcatggtcatcgcacagcgcgacaagagcaatgcttgtccagtctccactgcatgatggtgctgacgcccgtacatacacaacatgatattggcgagcagtgagggagcaacaacagcgcttgtcccatccagatgagttcaaatttagtgaaagttaatcaaattatagattttgcttgatttggattgtctttccatcattcgctccatcgtgttgtatttctttatcagaccgctctattgttactccatcataccttgtactaggatgacaagttccatccattttcgggacaaaaattccacatagttcccgcttctcaatccggaacgaggaacacacttaagttccacgttctatgtgacatagcgcatgacctccttatgtggtttccaacttatatttcaaaagtacaaatttacccctccacacatctgtattaatgtggactattataccctcttatgtttttattgttgttaattgaggtggtggtataataagatttgatcccttttgtagaactagcatagtggctcgcgcagattgcgcggctagtatcattatattttctctcatataatagtatatatgttttctcattatattattcaaatatattaaaatgataacataattttaaattttgcaataactttacaaaactactaatgtgtaatattcatatatattttatatacatgttagttattaattacttttaatatcaaattttagttatttgtaaattatatatattcctatatggactctagactcgtcttttaatatttctttttttttaattctgaattttctgtaaattgtatttctatatagactctatgctcttcttccaatattatttatttttatttttgaatttttattttttctaattgtattcttatgtggactctaaactcatctttcaacattctttaatttttaatttcgaatttcagttacttctaaattgtattcctatattgactttaaactattcttccaatatttttcttaatttagaattttagttatttgtaaattatatgtttatacggactctaaaatctacttttaattttattatgtttattccaaattttagttagttttaaatttcaatatggactctatactcaacttctaatatatatttttaattccgaatttatatgtttttcttaattgtatttctatatggactctatactctacttctaatattccttgtttttaattccgaatttcagttatttcctaattgtatttctatatggactctagtctcctcttctaatattccttattttttaattccgaatttcaactatttctaaattgtatttctatatggactctagtctccttttctaatattccttatttttttaattccaaatttcagctatttctaaattgtatttctacatggactctgctttttttttctccgattaatgtgagaatttataagccatgagagcgaacgtggaggctcatttttctattcctttaataatataatagatatgatcaacggattagattaatttgtaataccagtatagtgcattgtagtgtggcttaaagaaaatctaaaatgacctgtgtataatggaacctatataacatgttcacttctttttttttcttttttttttgaggagaacgacggcaggagatctgccggaattttattagagggagaaaataaagtgcttacagtccagagaaaatatgagagacttgcaccgaaacaaattaagattttcacggaatttcattagatgctctctgtttgttttttccttttcttctggcaatgaagtatcacggatgatgatgacttgttgctcacaacaatcctattatagtcacgaacaattcgccctgattccaagaaagttcgtcaactcgaaatatggctagaaaagcaacaagcagaactaggagctttgggtattcagaagctgacaaacacaccgcccacacacaggattcggcttcagaatagcccctgctttagtgttcaggccaaggactaggcaggattagttttctcaatgaacaaccaagcaaagctgattaacaataatgtgttcaggaaacctagctgtaatgaatgtgcaaggggaataagaatccatcctaagttgttcttagcctctgatgaggaatttgctatattacagtcaaactgaatggcctacattacagtattacactgaaccaaccctctgctgcttctgtcctaagctggctacgcaaagaaactaaacccgtcatcatcttgtccaccttctcatcatctcctaaaccggaggagcacataatctattaatcttgtccagaatcctcatgagcttcttcttcttcttctcatcatctctggacacaaaagttttgtctctaccaaatccacaaaaaccaacaccttcagctgccgaagaagttgcattttgttctgatgatgatgatcatcatcagctccggttgtgtatcgggtcggagcctcgccggactcgccacttgctcgtctgcgccgcggccgtcgtcgccgcgaaccgctccttcgccgcgtcgacgccgacgacattgttggccggaggcgccggcgccggcgccatagccggagccggagccaggacgagctcggctctcgtcaggccgtgcaccgccgtggcgtggtgcagcgccacaaccacgacgacgacggtgcagaccaagaaaaggtcgagacggcttgtgtgctgcaccatgttggcttctgctgctgctgctcagatggagacaaacaagtctctaccttggctctctctgtagctagaatggtttgtacaatgatcaatcatggtgatgtcttgtctctagatatagcaggggcaggcagtgtcgagtccaaaagcacaaagggacaagtgaagccaagcacagcatattagcatagcatgcctaaggcatgtgcaatggaaagagttcctcaaaacctgaaagtttgagggaggcagattttggcaaagtcatgaattggggggggtacttatctcccaacagacaaaacctaaagttgcaattgtagatttgtaggggataggaggagcaacagtatgctagaaacaaagactgctttagctccttgttgttgttatcttccccttattggccactgtctgcagtaaaacccccaacactaaagcagcaggcacagtggtgagtgaaacaagtgaggcttttttgcttttctatctttttttttgttgttgtttgttgttcttggttgaaacacacttttctctttgaatcttcttccaagctaaggccaccaaagatgggggagcattcaaaacttaaaaggaagtgcaccaagtttcaatagcctctttcctcacaattttctatgtgtgctacttgccatgcatcccaatgctttagttgctctcctagctttggtgcaggaatggaaagaatggtgaatcttaaagcattttcaggatccaacgacggttgtagcttcttggagctgtgtatgtgttggactggtcatggtctaaggaggccgttttattggtaccaaagcgaaaaaagaaagagagaaaacagtagctactgaatccttttaaagtggaggcaggccaccttagcttcaaatttgtaataaacacagcacttagatgcataaattttaaaccagaagaaaatcattataaagagatggaagattatgtaaagattgcttcttgctaagtgggttagggagcccacaaaatcttcctagcaagctgcaaaagaaaaaaggaggggaaattaaaggtaacagaatgaattatcaatggtttgcccttttgtttgaagagattcttaaagtgctaactcaaatacttggtaaagtcactatttgaaatatatgtatacttgctaaagtgcccagaaattgataatgggaggcttttgtccgggacagcaatctacaaaataggattccattagaaaaggagtaatcatattgtgctggttcatgacactaaattaggtctataggaatactctatcagaaagggcacagcaaataaattaacaaacaaatatttacttctaagttaagcaatgcagcatacaaggaattgatacaatgctggaaaaga

SEQ ID NO: 62883 - DNA, 1132 bp, Oryza sativa
agaaaataactacatttagtttgctaccaaattttggtgactatataagaaatcctgccaaaactttggcaaatggcaactataccaaaattttgaaatgtgtaaggtttttttagcatcaaagtgaacaggcccttagtttcaaactatttcttcaaacatccaatttttccatcacatcaaaactttcctacacacacaaatttccaatttttccatcacatcgttccaattttaaccaaacttctaattttggcgtaaactaaggccgagtttagttctaaactttttcttcaaacttccaacttttccatcacatcaaaactttcctacacatataaacttccaacttttccgtcacatcgtttcaaaccaaacttctaattttggcgtgaactaaacacaccctaaacacacccttaggtgtcgtaaaacacgtgaatgttatggaaggatctaatatcaaataaatagaaggggtgaggtttcgaacccaggttgtctagcccaccaccttgtggagctagctggaatacctaggtgtttctccactttaggtgtcgtaatttgtcaccgagttcaaaattaattcctaaaccgtcgtatccaagggtggagctagaacgaaatggggagggggtggcactgcttgctttactctgctttaggtcgagtttaagctgatatgagtgtttgagtttgggttgaagagggcgcatatacggtgaaaatagatgaaatataactaaaaaatttcttgaccgggtttctgggcaccccctcttttcaatgtagctccgcccctggtcgcatccctcaacttccaaaactagaacacctcaaagcgttttcggctaacgtggcgtctaagtggtgtcgacaaagttagaaaaaacataggatgtcccgtcattttccctcttctttccacatcatcggcctcggcaagaactcctgcatcagcagcggacaagggtagtcctatcaacacatcctcctttcggcgaccacacgaacatcagcttcacgagcggcatatccggctgcagcgccgccgaccgggagatcacctgcaccacctctgtcatgctcggccagtccgacgggttaggattgctgcacaccagcccaa

SEQ ID NO: 62884 - DNA, 17398 bp, Oryza sativa
ttttctgtttaatttcacttgagttgtaagatcaagaattaaaataaaggatggcatagtaaaatgtctatgccattaacccaaaacatcctgcaatacccccacaaatgaaggatggagtgaatacccttgccaatttaacaaagcgactaaccactaaaaatgagttagatcttagtttggaactgatgagttgtaagaggttttgcaagaaagtagcactgcaactttctattactactagtatttttgtacatattatcatctcttttaggttgctgaatgctgacattataagatttgttcaggtggcactgaatttgctgtcagagagagaaaaggatgaacttgtgcagctagttgataccatggtttcttactcaattacatacagaaacacaaagttagagcctcaagaaaggataagtggatctatggtgtctcctgatgttccttcactttctcttgatcctgcaatcaatgatattataaacttcaaggttctttttgaaacttctgtcctattttaccctaccgtgctcttctcactgtaaatgacagagcttctcatgttagggatatcaatctgagcatattggtctctctttggccatgaaacaagtcttggtgcatgaggtcagtggcatttctaacttctatgagtggattcctttatttatttctcatgcttagtgcttgctaccttcacaacacctaatttgctttaagtaggagtaacttctaagttctaacctatttgcaggctaaaaatcattgcttctatgcaacacttatctgatagccatctgttacgtacttataattgcttggcaaactatattgaacctggaagtattagcatctcgtgctggtggtaataagctattgaacaaagtgattttaactatacaactttgaattgtacttttctgcaaaagttctaagggccagagctgttgaaatgaaagttacttgccatagtaggataaccatgtcccagcagtagcactggttttgacttctgaattttacaagcacttaaatagcattaacttgtacttggagctttagaacgtgtggatgcagcagaaatcttcttttgtatctatatagattacttccttttcattggaaggctgagcttaagtatcagttctatatttcacttccatgtgtttgctacttgaacttttactattatagttttaatttttattctcaatacagatatctattgccagaagcctttcatattgggaaatttcctattaaaagaagattttattctctgaccaatgtatgttgttgcttttcaggtagagaagcaaaagatcatgaaagatagtgctggcaaattgttgaaccaagccaatgaaggagataagagaaatgaagtttccgtaagtgagaaaaaatctgcattggtttctaccaagagtacctccaagagcaacccgactacacttaagatgcaattaagctcagcatctagtatgagtggtaaagatcctgcacctgcaaagaagcactccaaccacggaattaatttctttgataggtaatttaatactgataatttcattagacatcaagatgcaattattattgcaagacggtgataataaaggcttttttttcctcgttaacacaaaaaatacaggtttagaaaagagagaccagtggatgcaaaagctcgaaatgacgcagggcaacaagtagctacaactctaagagactcgcgtccactgatcttcaaatacaatgaggtttgctccttgagttattcatcatgatgccacaatttggatctatctttaactatctttgtgcgctcattactataaggaatacattggaaacccacatgacctgcacttagtagtgccaaataaacagtaactataaactgctattgtcacatttcctgttattactgaagttcattacgttatcttacttacattgctgttaaatctatatacttacagcactagacaatcatttgattctcgaagtgagtatttttacttgctcagagccccagttatgaacagatcctgctcgattttgtctcagaattaacacgtggttctttttctaatggggacataatgttgcgcataatgctgtggcgtttgagttattcctctgtattccctttttatttctgtccacttccactcaattgtcgttagagtttggactcgtgtttcttgggcaatgtcactaagaagttttttttcatttacagggcttcacaaatgctgtaaaaagaccagtgaaagttcgagatcttctgctctagctaggtctgtttgcccccctgcacttcgttataaagtcaatgtttcgctatatgtttaccccgtgtacatttctgatgattatattaggctattggacggacacgaggaattctctatagtagaaaggcatgtaaaatgactaaaatcgtgagtataaattcctgatatcaagttttacaagcgtcaaaccccatgaacttgcaaatatatctcatggtaaaaacaccaacatggaggagcatgatagccactaacctctactccatcttagaaaaaaccaacttctgtggctgaatttgaacaaatacatatctaaattcatcatagaagtagattttttttttttttggggatggagggtgtatatgcttcctcttcaaaggaaagagagagaaagagaaacagtacggggctgttaggcctagaggcagttgggctgacgttgttaggcggactgggctagcccaagtccaaggccgtatcctagacagcaggactgtagtcggcggagtcagaaaagtcgtcgcctcgacaggcagcatctagcgactggtgagagcaagcatcaatggaagccgccggtgccggcggccggcgcggcacggtgaagcagctcaacgtgggcggcaagctcttcgccttggaggcaagctccctcccgatctccctctctctctcgccttccccaaacccaatcttcgtggaccgcgaccccgcccttctctccgcgatcctctccgccatccgcgccccctccgccgcgcccgccttccccgccggcgtcctcctcgacgaggcccactcctacggcctccaagaccagctcctcgccgccctctcccctccgcccctcctcggcttctccgcctcccgcgcctccacgctctccccgccctccgagcccttccccaccgcgctcgccccgcgccacgatggctcgctctgcctcgcccatggcgccggcctgctcacccactactcccctgcgctggagcacctcaccaccttccggacccatctccaccgcatcacctccctccggcagctgcctcctggcctcgctgttgccgggtccagcctctccccggggctccatgtgtacgacctcctcaaaggtcggcacgtcgcctctgtccaatggtcagatcccaccgaccttcgcgttcaaaaggccaaggtgattgccattgccgcccgtcctgctgccgatgcagctgataagaattcacccatcttagctacattcgagtgcccacaccgggagaattgcatcctggtgtttgaccctgtaactctaaagcccattcaagagattggccggcaaactggcagcgcagctaagtcgtcggcgccaggccgagtagtgcacctgcaggagcttgggctggtatttgcggcatctgtgagctcgggggcatttggttactctgggtacatgaggctgtgggacattcgttctggggatgtggtgtgggaaacaagcgagccagggggagttggaagaagcagccggtttggagatccatttgcagatgtggatgttgacgttaagcaacagatactatacaaggtgtgctcaaagtcaggagatattggagccgctgacttgagatgccttggtaaagacccttgggtttatatgtcgtcaggacctagagggagtggagggggccatggcagtgttctgcattgctacaagtctcaggtgtttgtcagccggaaggatggattggaggtttggtctcgactggaagaacagagcaatggcacagccaacttggcggagcaaacgagagcaaaggaaaacatcaacaacgaaggaataaacgagaactgttttaggagttgctatgtggatacagaagaggatgctgaccgtggtatgatacacatcatggaagggggtggagaccgcttatttgttaccagagaagaaatgcaaggcgtggaggtgtgggagacctcccagctggctggtgctatctctctatctcttagcagtttgcttgtctgaacatgattgacctgtggcaattcaggtggttctattaaacgtgagtgtgcattttctaccatagcatcgcattattcagtactgaaaattcctctcaagtcatgatgcggtaatgttataattcttgcttctgcatctgtattttgtggtgatcaaatcccttggatgttggtaagcttatttcatatcccttttcctaatcccttagcttgaggagctcagcttaatacaagatagtttcaagcaaaccttagcatcctcaatgctatgaggcattgttatgcagcttactcttaattatcctgacggaaagagcatgacatagaactaacttatcattcttaatttcttcttaccttcctaaaaatgcattgataatttgatatagctgatcatatctttctggaagctaatagtagaacatagtaccagctaatggataggttcttttggaagtgtaaattcctccgctgacttgcccttgaattttgcgtaccaatcttttgttgggtcaaatatgcttgagcattttcgtactctatttttatgctggcttgccaaaattcaatgtaccaaaaatctatgatgctggccgagatgcttatattctaaacaatatgtgttgatataaatgaattattattgacggtcctttttgttgtagaattttcacaacattaggattggtattctgattcttatggaggatcttagaacattagaatagagctatcaaatttcttatggagtacattcctgtgtccccagttctacaagaaaaacaaatatgagcctcattttatattttcttttagaggtctagtgtatcctctctttctccactttctctccaatcaagtgacatctagcatcgcaattcttttctatgaaggatcatctcttttaaacagttctcgtggttttgctccatgtctgattcagcaggtcatggcatttgaactttttttttgggtgaagaaacctgaactatgattttatgataaaccttgcctgaatttgaagcttcatttgacgtaacagtatgttacaagttgcaacatcattggtatgttttaaggagcaaaagtgctgttttttttgtgttcagattatgtacagtttagttggtaaagtggatgtgtcatatgtcaagagaacttatctcagataacccttagagtagcacaaggaaagaatcggatgagcatgctcactttatcaatatcaattattgcgttatgtcctctcaaaaaaagttattgcgatctccacaaaaaaagaagtgttatgtgaagaatgatggtgtattttttttttcaaaacgtcgtattgtcttctttggactttggaggcttgttgtctggaagagagattttttgtgcatgatatcaaataggtgtttttttattagcatcagcatacggcaatgggaggcatagattaatcttgattggtcatgttcgaatgttatgtgatgcaccagtactctctttgtaggctagtagccacagtaaaaaaaaacatattgtaatgcattagagcatgatgaacatgttattgcttctatgctgcacttatttgatgttaatttacagctcgttatttgtccacacagcttcacgctatatttgttggaatctactcccccgtttcaaaatataagtgattttgaccggatgtgacacatccaaccaaaatccttcatcatattttgggacaaagggagtatgaggtttgatggctaagggctgtacgcgatgtgtagtctgccgaatgggtttgatgggtaggtgtgacatttagtttcatgggccactagatattgcgttgtatcataaattagcagttggtatgtttactgttctgggcttgttatttgtacttcaattcattccgtactgtacttccagctttattatctttgtattatgcctgtagactttgagtaggaagttaagagttcatcttaagttcccatgactagcatgattcataaataaagttcatatgctctagtcccatgaccacctttttgcgtttcatgatggagtcctggaacacataatctggtgtctccttgcactgtttctatgcatgggctcaagtattccttttggctcagaacatggcgagttgtaccataaagcatgagctaatatttcgtttaggaaaagaaacgcagacaacggtacaatagtcacctccatgacatcgtaatgacagcgaatctcaagagcgctgctgtgtctttgtgcgccggacagccagcatcattcgttccttgtgcaaggcgcagatttggggcgcggcactatgggctgtggctgtgtttagttcagcgcaaaatttggattttggttgaaattggagatgatgtgactgaaaagttgtgtgtgtatgacaggttgatgtgatgtaaagtttggatccaaactttagaaaaggactgagctttgcagcttctcggattccagagaactgatgagtacgttgtgcctggatagatgattatccggtgctggattgtggcttccgatctgttttactacgctgtgttgagacttgaggcacatcggatgttcagaacctccattatggcagatgagcgtgaattgttgacaaggtaagataaggagtaggattcacatcgacatctgacttgtgtgcccacctcaaaatgcatgtattttatgccaaatccagcttgttttgtcgtggggtatgatgaagagcacggaagtcggaggacggagcagcaggcaaggggatctgcacggtcagaccgccgttgcctgcacgttttgcccttgtttgggagcgtaggcaggcacaggcgtatcttgtcccgccctctgtcgctcgcctcagcgcagctgccgcctgctgctgcctggtttatctctttgggagcgtatggcgcatgcttcccagctgacgaggagtgaagtccgttgggcagagtaaaaaaactgctagttttatcctggaccggtcctgtacagcgtgcatcatggatgataatgcggtggcatgagacctgatgaataattgttgagattgggggggggggggggggacataatggtcagggttagagcttatgatcaatgatagcgccctccaaacctacacgtcccagttcagtcattcatcctgctagccccgatcgcctagctggtctctatagatagcacatccaactcggtcattctcacaaaggtcacaatctcactctctcctattcaatgcaactaggcatggcgctggccgctggcagagttgtagggtgcggtcgttttgagcttataggattagattctcctcgttttttattagcacgctttttaaactgctaaacggtatatttcataagaaaactttctataagaaagttgttaaaaaaatcctacaaatttattcataaaaatattatatattaatacttaattaatcaaatgctaatcacatttctcgttttaagtgcggctaaacgttccaccgccacagctgacacgatcgtccccgtagagtggcagcaccacgctgcggtgcgtgctgggggttgctggtgaagtgctgattactgcgtaccaggccaccctgttgctgtcgccggatcgccttttgccctcccgtacttcgtgccaacacaaaagcgcgatacatagcccacgttgcgctcccttttccctccctccctttccgccttcgtcgccctcctccctggctaggcttccttgcttcatctccactcgcccaccggagaattccttcctctctctcgtcgcgcccattgtttgctttgctcacatatgatctgagtcgcggaagactcagtcggtggcaaggatacggggatggcgggcggtggcaggtgcagctcgctgctccgtggcttcgtgtcactcttcttcctcctgttcatccacattggccatgccggttgctgcttctcgacgggatcttccacgcagacgctggaggaagatgacactggacatggggccgacgggaggggcggcggtggcggcggcagcaagaggaggaagatatcgccgctcgcgttctccccgtcggtgtcgtcttctacggtggctgacgagaggtccagagccaggcggaggcaggtgtcgtctctagccaccagcgtccgcttctacctccaccgcatcttctcctactcgtccggagccaagaacggcgctggcgctccagccgcggaggaggaagacgaggcggtgacgacgaccgtgtcgtcgccgctcgcgcagtcgtcgtcgtgcctgcctcagcgccaggcctcgtcgtcggtggtgctgtccacgccgtcgtcgccatgcgcgtcgccgttcctgtccccgctctcgccgcagtctctcagcattactcctgcggtgccgtcgtcgccgcacaacaggcagatccctcaggcgaccaccaggcagtcgtcgttcaggtcgttcgccgcccgcggcgacgtgttcccgtgcaaggtgtgcggcgaggtgctgagcaagccgcagcagctggagctccaccaggcgatgaagcactccctctccgagctctccagcctcgactccagcatgaacatcatccgcatgatcttcctcgccgggtggaagccggccgttatgcccggcgccggcgagccaccgtcggtgcggcgcatcctcaggatccaccacaacccccgcgtgctcacccgcttcgaggagtaccgcgacctcgtccgcgcccgcgccgcccgccgatgcgcgggcgccggcgcggcggcggtggaggagcggtgcgtcgcggacggcaacgagcggctgcggttctactgctccaccatgctctgcaccctgggcgcgggcgtgtgcgggagcccctactgctgcacctgcagcatcctgcgccacgggttcgccgggaagcaggccgacgtggacggcatcgccacctactcctccggccgggccgcgcacgcctctctccccgacgacgtggagcgcgagttcgcgttcctccaggtgcgccgcgccatgctggtgtgccgcgtcgtggccgggcgcgtcggccgcggcgccgcggacgacaaggtggcctacgactccatggttccactactgccaacctcctccttcgctgcagctacccgtggcgacgacgacgtcgagctgctcgtgttcaacccccgtgccgtgctcccatgcttcgtcatcatctacagttgctagttgcggcagcggcacgaggcggccagcctgcatgtcgtactagtgtatagcccttctttttccctcgttaggtacgttgggctgtggtcacggcggcgcgtacagtgagatctcgttctcggttcaattatagcggcaaaatgcatggctcgctgctcgttgatctgtccgaccggttgggttctggccttctggtccttttggctacatcaagctatgagtgtactcgatcggcaatgcatggagctgggtgccactgcacattgcctgcctctggctggatcggatcgagcactcgacacatcatccagcacagtgatggtctcactgacgttgagtattgtcgagtgggttctaccacacgctgcacaatggtcgtaagttatgtagcttggttgccatgttcttatgtacctgctactactgttgttgttggtcctgcgtcaactatcgactgatgaatatggttcaatggtacattgatctttttgtagttttgctctgctctgtcgattggcatgtgtaattgagctctgtttttaattctcgtgggcttcgaacctaccgcgctcgggcagttgggccttactttagtgggcctacgtagacttgttcagcctttatacgtcatgggccgcaatgagcattgatttgggcttgattatccagatgaatttctgagcctgtttggtagagctccaacttctaaatttagcttctggagttaagtctggagtggagttgtagagctgcctaaacccaattccatctctctagttcattatgtgagagagctccacccaactccactcccattttagatggagctgaaattgtttggctgagctccagctccaggagaggtggagctggagctagagctatgccaaacaggtccttttctgttgaatgaaagaaaaccaaactctcctaatttccatgtaatagaaatgatattatatactccctccactttttaatagatgacgccattgactttttctcacatgtttgaccattcgtcttattcaaaaattttatgcaaatgtataagatataaatcacacttaaagtactatgagtgataaaacaactcataacaaaataaattataattacgtaaattttttgaataaaacgaatggtcaaacatgtgagaaaaagtcaacggcgtcatctattaaaaaacggaggtagtaggtcttaacaaaaataacaagaaagctaaaaaaacgcctcccccacttcctttccctcgtgtgatcatctatttttttcccagtatgttttaggtacctctgggtttactggggatagagattcatgttaggcactactgtaggagggagtgagggttgtacctcctattcgatccaaatgtaacttcgggcatttttttaaccagaggtaaatacttctcgagttctaaccagacaactagaagaggatcaagctgtttggagggaacaacgtgcaaactaggcaagtagtgttcgagttgagtgttcaggaagatacaattcgagcatactacatgagatgagtggtacatgaagaatgatgaaggagctttgtagatacgccaccagacgagaatattatcacagaagataacaaggggaccgctccaaccactcccgcaagctagtacctgcaacaagccctaaggaccgcctaaatatacaaatatgcccttagggttccaagctttttgaggacattcctgtaacttcacacgtacctcttgaggttgtataagccagtctaatcctataacgaggccatgtaacatttgggaaaaagcagtggcaacaagagctcgttaatacatctcaagttcacttcacctcaaggataggcatgaaaagaagtatctttcctgtttattcccaatttgtccgtgacgctgagtcacaaaagtactaaacaaccctaaagccaacatgagccaaaacgctactctaattgttttgcaacatctcaaacattgggttacatctccaggaaaagagttcatatagtctctgggcaaccacaatgtgaacataagggttggttttaagcctctaaagtgaactttatacattgtgagtgtaatccttataggtggcatttgcttgagctagccatatgcataaagactacccacaaggaataaaaaaaatatagtacttcttcctctctcatggtagtgttactctctctccctctctcaatagctaattttgggtttgtgggatccaccttaatatccactcttgacatatacattgtggacatgataatatgtttcagtgggtcccaccataatactaaggtaatctatatacattgagcatgccctagagagccaaggcaacaaggagttttgaaggacaacccaaacagcttcattgcaatcttcttggtttgaagctccatccatgttccccataggcttcacttgcaacttacctcagcaaccttgctccctcatgtagacctcagcaacttacctctctttgatttaaggtgttgagcggattactatcgcagattagctagttgatcgtaagaataaattaaatatttgaaaaaaaataaatttaaaagttttaaacatgaggcgtaagtagtagaatatttttttttagaaaacataaattttaatggtggaccaaatagtacatttcaatgatggggtgaattagctgaaaaagacgtgacaaaatccttttctttatagcatgattgatggatagcctttccatccgtgaagaaaacgagcaaacaatataactctctgtttccttcctttttgtttatatccggatcaatctgagcagtttagatttgttgatattgacatttttcatgtccccttgatgtatgaaactgacccgtgatttattgagttttttcagtaacactgctgctaatgggatgggtctaagtgaacaacccctgaacggcaaaataataaaagagacgccggttcaaagtggccaccggacaggtagtcaagtaccgggctcgatcagagaacatcacgtcgtcctaatttgtgttagttagtactcgtgtacaaggaagatccaaactttatttattgatctgggggagaatccagttgagaacttcaaatggtttttgcgtggacgagtctgcgttgttcagcaccgtctcgagaccgttgtcgccggctgacgctgaccgttggcccggccgtcggttgactgttctcggtcgatggtctccgtcaccgagccaccaccgtattccatttccaacacacaaaaacctaaaagcgcgaagacttcggtgtcgccgaggacggacggagggagcggcacgccggcatgttgcgccatcgcacctcccctcgtcgtgcaaaccatgcccccacatgcgccatggccacatctgccatcgctttcttccccgtcatcgtcttgtttatctcgcggagagaaagagaccgagagcgcgggtggcgcacaacgaaacggacacgcgcgggacgggagagagaggtgggagacccacctaccgttgccgtcgccgtggtgccgcgggcgcgggcgcgcgagtacgcttccgcgcagcttcgcgcacggtggcacggtcacaggcgaggcgacggcgacgagacggtgcgcacgactgtttcgctcgtccaccctacagctacaggctacagcggtgcacagtgcactatggtgcgttgtactatgcgtgagcaacgtgcgatgcaccggcaaattcaggcgtgagcgtgagtggtccggtccggtctgtccggctccgcgggccgagcccatcgccgtccccgcgcgaccgacgcgagcgacagactccgccaattcaccggcgctgtggtttgatttgaagttgaatggacttgtttactcgggagtggttggtggaatggtgggggcacgtgggtattctgcgttgctgtggtaccatcgtttttgctaaatttcgattgaacttttcataatcggttttacgattttaaatttaaaatccttacaagcatctaaaatttcagtcgggatctgtttttttcctgtgttgatcgaaacaatcgttaacctggtctcgtccgggccggtatgctgatttgttccacgtctctaacgaggcaaatcacatcagattttgcccacgatttagagactattgatggcaactgctacatcatccgttctaaaacaagtttattttttactcatcctgcaacataccaatacaaacttttaaaaaaataccttcactttatcaaatcttaatgtaattattccctatttttatctatttttaacacattcatcccgtattttcataaactctgatacgataattacttaaaaataaacttattttgggacaaacgtgaggaaataaaaaataaacttattctagatgaagagaacattactactcactccgtttcaggttataagactttctagcattgcccacatttaaatagatattaatgaatcagacatatatgtatgtatagattcattaatatttatatgaatatgaacaatgctaaaaagttttataatatgaaacggaggaagtagtaactagtgagagcatggttgtttcttatcccctcttttattttttgggttaattggatccatgtcataacaaatttgcaactcttaaaaaatatcattaccattcacctatttggtcccatgacattacaactttacatctatttgagatataccactacttaccactacttactacttaccctcttcctctcccctgtctactcattccggcagtggtgcatggcgaggtctgggtcggcggttcccctctcttcctctccatcccctctcacttcgggcagagtaaaatcggcgacctcgataccgccattgacatcctacgtttgtgttcctcgtcactccactatcgaatccacctccatcattgacaagcacgctggccatgcctaggtggctcgccaacctacacttgcttgacgacgacagagtctctaagtggcgcctgaattcaagatgaggttccgttcggcttgaggggaacaataaggtggccaaacgaggttgacctcgaattattccctttccctgatacacacgctagaggaggagatgggttggtagaggggagggaacgcgcgacggtggcgaggggatagggagagatggccgccggagaggtggaggtggatcggtgaccatcgtggttaggctcatttcattgaaaatgagtgagtggagaggggaagggagaagggtaagctgatcaaaatttttaatgaatccaccagatagatatataaaatagtaatatatcaaaaataattgtaaaattcaaataggaatagtaaataacaatgatatattttaaaataggtaagtttataaggggaaatatgtagtggaaacttaaaaaatacaatacagttggatcgaaaaatggacgtccgacatttatccacgtcatcacgatttactcatgagtacttatgatgatgtgaacaaatctcgtacattttattttttattgtaattttaagtttccacgtatttttcccagtttataatggcaccgtctccctctccccatcgaggaagagtaaacccaaaaacccatctcgctagccgccgccggccacaaccattcctcacgacgggaggaagacgaaaaaaaaaaaaatcccactccgtgttggtaaaatccgactaccacttcggcctgtctcaatccaagaattcaagaatcgaactcctttggggtcgcctcgctgaatcttccttatatatacgcgctctcccattcgcgtgtgctccaaatcgtagtggggggaagtggagttgacgagctgtggaaaaaaagcctatcgcaatggagtccatcgccgccgccacgttcacgccctcgcgcctcgccgcccgccccgccactccggcggcggcggcggccccggttagagcgagggcggcggtagcggcaggagggaggaggaggacgagtaggcgcggcggcgtgaggtgctccgcggggaagccagaggcaagcgcggtgatcaacgggagcgcggcggcgcgggcggcggaggaggacaggaggcgcttcttcgaggcggcggagcgtgggagcgggaagggcaacctggtgcccatgtgggagtgcatcgtctccgaccacctcacccccgtgctcgcctaccgctgcctcgtccccgaggacaacatggagacgcccagcttcctcttcgagtccgtcgagcaggggcccgagggcaccaccaacgtcgtacggccttctcccctcccctcccctccatgttcttccaccttccaatctgctcccttatcgattcttatcctttggcaaataacactgcgtgccttgattggttcgaacttcgaagggtcgctatagcatggtgggagcccacccagtgatggaggtcgtggcaaaggagcacaaggtcacaatcatggaccacgagaagggcaaggtgacggagcaggtcgtggatgatcctatgcagatccccaggagcatgatggaaggatggcacccgcagcagatcgatcagctccccgattccttcaccggtgagctaacgaaatcaaacagtaggaagaagaaatggggaatatttgattttgttggttatgaaatgtgaaccatggcatttggtttctttgtttgtgataggtggatgggtcgggttcttttcctatgatacagtccgttatgttgaaaagaagaagctgcccttctccggtgctccccaggacgataggaaccttcctgatgttcaccttgggctttatgatgatgttctcgtcttcgacaatgtcgagaaggtgcttattcttcagtgtcatttcctttatctcattatgggctattttatttgattgcctgggaggaggattatcatagaatcaacctatactttggattttcttcatcaccatcagactatcagtaggagcatctctttcagtaacaaaagaaaaaaaatctctttataaaagaacctagtagtggtggtgaatcttccatcccttagatttggtgggatcttctaaggctggataaatatatatctctgtgaatgtggtttggtttttgtggttcgatgtttgcttgcaaattatatatgcatttttccaacaaaaatataatttttagtcaagaactttagatatattttttgaaatctgttgcaatgcacaatttagctagtaatatataacacactatttcctacactaaatttgaagccaaattgcaaacctgtgcttcttctctttggttgccaacaacagcagaaaccacggagctcatcctgtttgtgacataaaataacttgtagattggtagttccagaatttgaacttgctgcaaatgtgagaccgtgagttacaacttgtggaaaacctatatccatttcaaattctttggttcatgtgtttgctgcagaaagtatatgtcatccattgggtaaatcttgatcggcatgcaaccaccgaggatgcattccaagatggcaagtcccggctgaacctgttgctatctaaagtgcacaattcaaatgtgtaagctaacctgtgcccattccttcaatcctgtgttttgctaattctgctttggtgctcacagcttctatatcttatttcattttcactccagacccaagctttctccaggatttgtaaagttacacactcggcagtttggtacacctttgaacaaatcaaccatgacaagtgatgagtacaagaatgctgttatgcaggctaaggagcatattatggctggtgatattttccagattgttttaagccagaggtttg

SEQ ID NO: 62885 - DNA, 1270 bp, Oryza sativa
attactttctacttggcaggtctccaaacctggatctgtgaaggtggagaaattaatgaacattgaacgctactcccatgtcatgcacatcagttccacggttaggctcttcttctatactgtgaaacaatggttctgtactcattatataccttggcaatgttgcgtcattattatttccttcagcattccagtctgcattgttagttcagacaaatgtctttttatgctaagaaaatctaggatcttaactcagtatgcataacactatcagatgtattacctattgcgacaaaatggatatgtggtttctaagtaatttattggcttgttttataaacagccaacaatttctgcaattttgacgcttctatgtttcaaatgtgtcttgtctaatagacatgaaagtgcaaagcttttagtagcaccacaagtgactgatcttcactgctatcttttctagggttggtacgatacattgtgtaatgagcaatggttacaataatgagttggtttctggatataatctctctctctctctctctcggtttctatgaaaagtatgaattgtgtcttagtactatgtagtgctcttttacgtaagtgtgctggctgagcgcctttgagattcttgtcttctgtacttacactgaaaaacaatgtattgtttgaatgatttacaggtgagtggagagttggatgatcatctccaaagttgggatgccctgcgagccgcgttgcctgttggaacagttagtggagcaccaaaggtatgttgcctacaatctccttatttggatctagtgatgtgctgtccaacctccattccgtcttttttttaagcatgtttgccaaatttattctttgtgtagatcattttggttccacactcatgtcagtagagattgtttgacatatttgcatttttgcaatacaagccatatggttgggacagtgtagcctcttggtagtctatttgaagtcttctactgcatagaattatgctagaactttttcctttttttttctttttttgctctgttgacttcgatcacattgctcatatcctttttgcgtacagtaacaaatacatctcatttacccatcaggacttcatattcctttctggaacaaaccgttgtttaacaaaattccgtctgacataaccaggtgaaagccatggagctgatagacgagctagaggtcacaagacgaggaccatacagtggcggccttggagggatatcatttgacggagacatgcttatcg

SEQ ID NO: 62886 - DNA, 41788 bp, Oryza sativa
  unsure (1)..(41788): unsure at all n locations
gaaatcaattaaaatgtatataactaaaggatctacatgctgacacactttgtggaacctgattttcctgcttgcagttacttaggttactagtaactacagtgtatgcacttgatctcacgatggtgaatggagcaaaagaaaccataccagtatactctgctaatgcagaaagggcaattggacttgtcttgaaccgttcctttttgcaaatgtacttgagcctaagacccaacaaagacatggtcattaacaacatggaccataatatattgtggctacataaaaaaaagtttggtgtagtgagatgtaacaagagtatttttacataagtacctgttgacaacacgactaatcgttggctgaacaaacatatgaaccctgtaaatttaagcaagtccttgtaagaaatgcttagatgatttaacaacggcacagaattacagtaaaaaccacacaagaattattacttagctacttggcgaagttgtctcagagctggagcataaagatcattgcatatacaaattacctgtaaataaatgcattattatttaatcataatgttaaggcgctaaaattatggcaaggaatggctagattgcttacaggtctcatcagttttggtattttgtgacctttctttgaggactttcgtacttgagtatcttcagcactagtgctgctgttagaactgttgttcttttcagcattgatctgcacaaaagagtcaattatcaatgaactacagtaacatatgaattaagctagaattgatgcagcatttatcactagcataatgcagaaccataaaaaaaacaagaagagagggaaagtaagaaaaggtagcaaaacatcatgttgttgaaagtgtggattaggtgctaccatctttaaaataacctcgactgcacctttgccatcaccaagtgctccatcaatttcatcaattacctacacaagacagcagaggtctataggatacagtggaggtaatttatttatctgacagcatgattcaactcaccagacacttgggtttcgaatcagacatgattgagttcatctgaatgacatcaagaattttcggttcaatggatgaagcagaacgatcatcactcgcatttatctgcatgtagtatgatgtaagtagtgtataaatttttaaccaaagataaagggcccaacattctaatactcaattagccaataaaccataactaacaagaggtgatgaggtcagagaaattctgctaagagcatatcattattttctaataaaaattgcaatggtcccagttttccagcttataaaatgtaccaaaataatatgaaacggaagaaatcaattcgtgactagatggtatgtacagaacagtagacaacttggaaggatatcaacagatatgtttgatgcagtaccagataaaaggggtgtatactcctcgttatatatgaccaaacagtcaaacataacagattatacaacactatgttgaagaaccaaaaagaactacacaaaggacatgaaatcacataatcagacctccacaacatggtagccacaatgtttagctgcaacatgggcaagtgttgtcttgccaagcccaggtggaccacatagtagtaacacctgcaacatcgaaatgttatctaattgcactagccagcaacttcttggtagaaatatatcctgcggtcaaacatatcactaaagacatacaaaacaatgctactaagccaccttttgttctggtgcattatcagtcgtgggcctcttgttaaaggagcttgtcaaatcctctgagttgctaccatgtgcattttggagcatgttgtcttgactcataccaggacctcccttactcttggagaagaaatttctgttacttgaattcttttgaatagcagaagaatgtcggcgtaaggcagacaaaacatcatcacctgtagcacgaacgtgggatccaaacacacaggagtcccactgttttagccacagaagtacctgaatggcatgcatccgtacatgtcaagagaaactcaagcacacactggaaacctgacaccaaatagcaaaatctctatggcggaaggagattattgcagtaaaggccttatttataagtatatattttaagagagttgaatagacatttacctccctgtttgtgtgttcatcacttaacagctctgtgaaagaatttggtgagtatttttccacccaaagttgctctgtaactagcggagtcactgggcaactctcaagattttgtgtttctgcactctcctgcaatgccttcataaccattgcaaaatatggatcagtaagatatactgcatttagcttatgacctactgcaatcaacatggtcttgagcggatgaaaaaatgttatggtaaaaaagaaaccatttgtaccatctattcagtataaaataatgttaattatcattacttaaagagtacttcacttttttaaaaaaaaaactattgtcaataatctcatatacacatatacctttgctagagcctcttgctcagcacgacttgtcagcgaatgaaaggattctgagagaagccctgcagaaggacaaaaggcgaaagcaatataatgggctatcaaaaatattagtcgagtgcatgttggttctcaggagatatttgaaagcgcaaaatagaagtacacttagtaactgacccttgtaattgaaatttggtttggaaatgcgagtcctttgtctagttcccccgattcctcccccatccaacccgtctgttgcaaccttcgcataaaccctctcaccattgggcgcggtgacagacatacagtccccccggatgtccgacgcgaaccgcgagattgtcttctcggcgacaacttcaacaacaggaggcggcgagtaccgcagccagtcctcgtccccatccccggaatcctcacgatccacattcctccgcttgctcctctcctccccctgctccggcggaggcggagggggaggccgcttcaaattgccttccgacacttcatcttcacacacatttggccaaccgcatcagcagtcgaaacaaaatactctcgagactaggttaccatctaccgtgagggagactgtgcacgcacctgcaggtttcgagggggcagcggtggtctcctgcggggaacgccgcggctggtccgctccggcggcggcagggaggaacccctcgtcctcggggtcgtcgaagtaggcgtactcctcttcctcctccgggaggagcccgtggctctccatccactcgagctcctccggatctggcatatccatgtccgcctccatcgccgccgccgcctcgccgacgcagcaccgagcagaaggggagggagctaggcggcggcgaacgggcgaagtggcggggaatgggaattggtgattggggtgtttcgcgccttccggcgagtggttttctcggtctccgagggagacgcggggatggtggtaggtctcggcccaacttgttacttggcccaataatgtcttcgaagtccattggattggtgggcttctggataggaataagtccactttaactcccttaaaaattatagatccaatttgattcatatcgctgaaccgtaatgtttggatatcttaaccccctaaactataaaaactggtgtattttacctctctcatctgttttggaagacgatttcgctgatgtggtactgtgacttgatccaacccattgagtcattttgtggggtccactcatcagtgacccactgacccttctcttccttcctttacccctcctagcttcgcccggtagagcatccatccatggcacgtagtgagtgaggcagcggcgagttctttcgatccagctgcatgctcttgctctatttttccctttcctttgtaaatttggcgagttctagtcttctaagatggaggagaccgttgtggaagttggaagcaacgagtggctcgaagagcaccatggcgtcggcagtggccttggcgcacgagctgccggaggcccggctcggcgctagggcgcggctgaggctaggggcgaagctccggaggaggtgtttacacgagctgatgcgcaccatctcatgcttcaagctcacttggtccttctcctcgttggtgagccgcatctgcgtcacctccagcttcaactcctagttctcctaccgcaccgacacgtagttgacctgtggcgacatcgccccgctcccccaccccactccctgccgtcgtgcgactacgtcgcggtggcgatggcggccacacacccgaagaatgagcgttgtgttgtgcccgccgccgccctggattgtgcgatggagctgctcagctgctcgaaggagagcatgtgcaccgctatctgcacaggcagctactcgttctgcgccgtgtgcaaaatcctgtgtcgttgctctgctggcgggtaggctccacatgatgactcagtggattggaccaagtcaaagcgccacatcagcaaaaccgtctttcaaaacagtcgagagagttaaattacatcggagtttatggatcaaaatatctggtatgcagttcagtttcaaagatatgaatcagattaaacctatattaagggagtcgaagtggacttattacgtctcaatattctggcgagattgggctttccagtttgtaccttggatctgacgccgaaagctcatcagctgacagcaatggtgaaacaaagatttgcagtagtcccacttcgccttcgctgctacggcgatgctctgcgaatctgcgaaaaacgcaaccgaccaaacaaagttttccagctcggaccgcatgcgattctttgattgtgtcggggtgtcaaatgaccaaacaaagtgttgattcgttgtggacttgtggactcggagcaacttgttcagttatcgttgtcgttgaaggggaagttgcaaaatccatgttttgtcccttcatattgcttgatacctgctgggaaattcagggtttcaggcacccgtattcacacacagatgttcgcctctatgatcacttctcttctattttgccagactattgctgtgtagttgcagttgcaggattcatatagccaagctcaaccgtgcaagacatccgtgtttaattatcaccgaaaaaaatgcagcagcatcaacgagtacaaaatgctagagcaagttgcaacacagctcgccagtctctttctttattctccactccagatcttgaatcctgattagcaccgctggttttccacccacggaacgatgtggagacgagagaattgcttcgacgacaatagcggagaaaagcgaccgaaagaaaacaagcatccgcggttaagcaaccttgcacgccatttcctgaatataaacccgatctttgtttgtcttgatttctacgaaagctcaatgcaagcctgtcgttggctgagaatttgagaagtggagatgcttgttgcacctaaaatggaagcattccgctgggcccaactgtaccatcctgaccatggtgtctgtctacagcttgtagtagtaggacagcgtaggagccacgagactgcacgatctgctgttccagataaagacgatgatgaatgccagatgctcctttgtcttggaccagctccctgtcgtcaccattcaccaacccatgaggacgggaaaaatcaatcctccgcatttttattctctgcaatcaagtcagcacacgatgggatcacgcccggcgccggcatgtcgatcagtagtctcatgttcccctacgacgggggaccgtggcactagctttcttcttttcttcggtgttcaacacaaggatctccaacttaccacaacttctagatgaaaacgaagtggaattggacggataatagcaacgcctatattctaaaaacacccgaccgagtcgctctcacccgcaccaataatgccacatgcagatgatatcacaccgggaatttctgctgctctcggtctcacgaaagcggtcgggcagagcttttttttttttttagagaaacaaccgtggcggcagtagagaaccatatagatggatctgactatctaagtaaacttaggctgtgtttagttccacgttaaaattgaaagtttaaagaaattaaaacgatgtgacggaaaagttagaagtttgtatttgtagaaaagttcgatgtgatagaaaagttagaatctaaacatggccttaatagaatacataaaacatcacaaggtcatgtgagaaatacgtgactccatgtgcgtcccaaaccaacgggaaaattattactgtgtgcagatgcagttgtagccagttatggccgccgaagaattgagggtttgagaccgtgggagtatgatacacagtgatcgtgacagtaatttacaggtgcctgctttgtcatttgtcagctagcagctttggcatcttaacgcccgccggatcagcgacctacccccattttcttttttcttttaccggacatgcgagtagatctggctaatacgaggtgaaaacagatgctttgcttggataaccttcttaatcacaatagctgagttgcgtcaaactccattccggaaaagaaaatagctccatcatacatccatacgtagccagtaggcggtggcgtgttgccaagacatcatggtttagcgacgggggcaagttgtttgtacttgattatacataattatttttaaattatagtcgtgtgttaatctatgtagataaacgtatacttaagtatgaaatatctacatttagcgatatgtttataagtatccatcatttatttttgatagtaatatatgttaaaagacggtgttatatttgccgagtgagtatgcgtgcgcatatgatccgcgcacaatagacagagagttccacatccatgatccgtcgtgtttgaaaaatgtttgccattaagaaaggatatcacaatttgtttctccactaaagaaagagataggcatcaagtacttcaccttgctcttgctgatcgtatatctcaattatacttagcttaaacggtgggcaatcctcaattgccatctgctggtcatcgtgacaaagaaaaaaaattttatcaataaacatttatatttatattatgtacttggtgatttaaaaggtaatataaaaaataaactaagataaaaaaacttaaaatcaactttaaaattaagtttcggtcgctgcgataaaaaaaaaaggtgaatgataggaggctacaacccttttctttcattggattttgccagattcacggattatttgttatatgcttccaaaagcatttttaagagaatattatactaatgttttgtttaaattacttgttcaaatatattggttaagttcatttatgggatatttaattatatcatactcgtatcaataggcaatggaataacacgtttagtcaagtacataatatcacaggttctttgtgaatgcgattcatggattatttatattaaaaagatagcaagagatggattgggagaccaattttcaccgaacttcggcttacaaagataccacgtctatgtgagggactttgaggcgaatctcggttgatcccaagcctcaccaggtaaccaccgagatcgagcttggttcctaggttgtcttgccttgcggaggtggagcaacgccttcacaaacttcctaggttgtcttgcctgcaagtgctggatacttgcgtataatgtccaaccagctaggatgagaacatataagattaacaaacttgaagacgaaggccaaccaccgatcgccaagtgctcaagccaagtcctggcactcacaaactcagatcctgcaagaaatccactccaatcttagtttcaaaacaaaaaggtgatgcgccttgagccatttcactgtttagctttcatttgtggggttagcaagcctttagataatcatccattggactaatacatgtgttcaacacttaactagctcatttgtactttaattattgctggaggtaggccataagatttttttagctggcatgcatcatcatatggtaatgaagcataatggagcatggcgaagccatgagaagcatagcgagacatggcagagcgaagcgaaatgcaacaaagcagagccaagtaagcctgccaatgggctggattgaaatgggcccaatggattggtttcagctttgggtgtagtttggatggatggaaatggattgaggagtttaatgggctggactggttagggtggaggtggaaacggtttggattggattggtttttggtttctgatttttggatccaaattggattcagtccatggatttctttggatgcactagacagtccagtactctccaaacctagcgtcatcagtcgtccacggctccactccttccaccgccgccgctccctccccttgcttcgcctcctccacctctccgccaccgtccgcgaatccgccgccaagccgtcgccggtcagattccctcccccaccaccattgcttttctttttccctggtttttctcggtctttgatctatcctggttgttttgtttgtatttttttttgggtctcttcctgatcttggtggttgcaagtgcaggtgaagcagaagaagaggaaggtgcgtgcgccgccgggcgttggcgaggatgtcctcctccggtggtccggccgcgtcgccaatctccctgagaagcccaagtaccacgacgtatgtgaacagtgtgattggtgtgatagtttctataagattttgttttttttgttggttttactgaggagttaacttgctcaagattacaatcttcgatgggtttatgtgcaggagttccaagatttcaagaagaagataaggaggtatagtgaatgcaggttcccttcatctcccaatgaaaattatttaacatatcattacaaattgagtcctgatatgattttgagatgcaaattaattctatggtcaatcgaattttagtgtgcaatttttagattgtagcacgtgtacaatgtgtgaaaaaaataattatagaccatgttctttcaactatcttgattttagatttcttcctctatgcagacaattgaacaaactcaataataaatatgtccatacaaatgtcagagagttcaggtactaatagtccaaataataatcaatcttcaagaacacgtaagagagctaaagtatgggaacactttcagcaagaggttgtaatgatagatggtgtccccaagactcaatgcaaatattgtagcttaagattggcagccaccaaaaagtcaggaacaagtcaccttattaatcacatagccgaatcatgtccagctattgatggtgatgctagaatcaacttccttgcaacaattaagaaacagactggggaaggtttcgtgtttgttcccaagagaagccgggagctaatggtcagattcttcattcatgcaggtgccattcaagaaaattgaggatccttattttttggagtgggtggagtccatgcagccaactttcaaagttgtgggggcgtcaaacacttcatgatgatgcctttaacttgtatgagcgaatgagggaagacttgcatgctgaattacataatcttgatttgcacgtatgtctaacatccgatatgtggacttcaattcaaaatataggctacatggttgtcacagcacactatattgatagagagtttaacattaagaagaaaattataagctttaaggaattgaagtatccccacacgggattcaccattgaagaagctataatgagttgcttgacatattggggcattagaagcaaactgtttactataactttagataatgtcagtaataacaattctacatgtcaagagttgataaagaatcacaagaatgcattgatgtttgagggtcagcatttgcatgttagatgttgtgcccatatcctaaatattttggttcaggatggtatgaaaataattaaacctacaatacacaagctacgtgagttgttgaagcatttagattcttcagtatcaagaatgcaagatttcaattctatggcaaactcgaaaaatcttccttcgaagttgagtttttcttttgatacaccgactagatggaattccacctataaaatgattgtagaaggattaatgtacagatctgtcctggatagctatgcaaatcaacatggtgaagttgcacctactgaactagaatggcagaaagttgaatcaatttgtgcttttcttaaagcttttgaagaagccacattatcagcgttagcagataggaaaccaacatcacgtaggttcttgcccttggtgctacaaattcgtcatgcattgaatgaccctgattggcagactagtgatattttaaaggtattggctgcagctatgctctcaaagtttgtcaaatattgggacagtgggtttaactctgcacttgtcattgccacaatgttagatccaagaagaaaaggagattatttgaatttcttttatgagaaaacatctaacagtgtgacagagattgtcgaaaaagtgggttctgctgaagattggttgaaggattattatgaaaaatacgaagggtttgtaagaagaaatgatgaacacatgctttcacattctcgtgaaggcagcagcagtgttggatcacctgttcttgggaaaagaaaactcgaggaagagtttgctttatacaagtctcgaaggaggactgcacggcaaacgaaatcagaatttgccatatatttagaagaagatgttgaggaggatagtgagagtttcgatgttttggactagtggaagagacatgctaaaaaattcccggtattgtcatctatggccggagatttcctagaaatacccctcagcactgtatcttccgaatcagcattcagttgtgggggcaggatacttggtgacacacgaagttcgttaacacctgaaatgcttgaagctctcatttgtgcgaaagattggttaattaaagccaacgatcctttgatcaatattccaggtgctgaaggtataatagtgataaatgattcctccataaatgttctgtgtatttcaatcatgaagtagtgatcataaatccacccgtggattgtgttgaatttggactgagcaactttgtgggttgggttgggtggggttagctcaaggaattcttggtctggattggagtgacaattttgctatagtcactttgggttgggttaacccattggcaggcttagagccaagccaggcggaacattgcgaagcgctctggagtcgggtgaagctgttgagtccaagattgcgatcggcctatggaacagatgacaaaggccaccctaaaatgccttccgagaaaggactgtcccagtaggcgacctatacataacccactaaaaataaaaaatatatctgtaaatatttctatcaaagggattgaaatataaaagcctatgtaagccaaaccctaggattagctgtttgagctataaatttataaatatcccaaaaaaaaaacactgtaagacattggaaaaaataatacatatcttgctgttccttcatcccaacaattactactattattatcaatcatctaaaacccgtaacggcacactttcgtccatgactgatgctgatgaagttctccgtaatgatatgtcatggagttgtttgtttctaactatcaacacgctacacgcagtggcggagctaccacagggtctctggggtctcgagaacccactaccgtactataaccatgggagatcccatgaaaaccccactaaaattttctgtcatacatctattagaagagggggctataattttatatagtttgttcaaaccctccagttaatcttttctggatccatccctggctacacgtggttgtcatgttaggttgtgtggcttgcgaactgtgttttcctcgtgtctcctttggaatggagggaaattaaagcatttgagttcgtatgggttacttatttgaattctaagttcaaaccggtacttcatgcgagaatcacgtcaggaatatgaaaggctcaaagaggggaaaaaaacatgcagcacgaaccgaggcccaccggaccgggcacatgcgcggccactggcaggcgggggctaccgctggctgcgggggctgcgggccagagtctaggctggactggccggacgggaatcgcctccccgtctcgcacctggcaatcagcatcggccggcgaccacacacacgagtacacgacacatccgatccccatccgtcctccgtacgtgccaatgaaatattcggccggtggggcggaggcacgctgtctgcagccagacgcagaccaccggcgagtgcgatccgagtggccgagcccgagagaaaaaccacggccacaccaaacccgccgtgcgggggaagaaaaaaagcacaatattctccctctcggcctctcctcgccgtagtgccccctcggacctcggttgattttttggttcgcgcacgtcaccaccgagagtccaccaccgcggcgcacgggaggaggcccgattcgattccactcgcccgttcgttcgctcgtcctatttttttcttccccccaccacggcaattttttctctcccacggccgccacgccactgccagtcaacagctgcacctgggctcctcctctcctcgtcgccgtcaccgtcgcgcgccgtcgtgttggtggtggtggtggtgtgcgggcgggcgggcgccgctcgcgtccccgtgacgctgcttcccagcgccgctgcctccgccttccacgccgcgtgggcgcgaaggcggggcttgggagttggaggaggaaggatagggggcacggcacgggtggcagtagtgcaaggcaagcaggtccccgtgtataattcgggcggcggcggcggcgggttggatcggggaatcggcgacgcgggccagaggaggaggaggatggggcagcaggcggcggaggcgcagccgctactgctgcagggggaccaggtggacgccgagtggggctgcaggccgcaccgcattgtacttttcgtcgagccgtcgcccttcgcgtcagtgctctctctcctcgtagtcctactagtcagatcatcgtactagcttagatcagatcgagatgtcaaacctgccgctctttcgatctattgaactgcaaagtcaatagtttttgctcgttgctgtttcgcagttacatctctgggtacaagaatcgcttccagaacttcatcaagcatctgcgagagatgggcgatgaggtatatgatctttttacttcatctggctgctggctgcttgtgtgtgtagggcgtgtatataccttggaattgacgtgtgctctttcgaaacagatgttggtggtgaccacgcacaagggagctcccgaggagttccatggagctaaagtcattggttcgtggaggtaatccaatacaaactagaaactacttttaccttccatttagcattcggtctacctgaggagcaccaaacacagaatacaagaattactttcctgaaagcacaaaacttgctctcactgcgaaatagggccttactcgcatgctgaagcaaaaggaaacaatgcaagcgaagtgtcatctagtcaactagcatgctgatttggaacatgtgcttgttgtgaggtgaaattggtgatgttgcacttgttttccaatattttgtctggtcaagtcgtcaagtatatatattttagaggacactagaattcttcttgttgaaatttcttctatctgcatgcacttaattgcctaaatttctatttctcagttttccatgtccgttataccaaaatgttccactctcgctggcgttgagccctaggatattttcggcggtggctaaatttaagccggacataatccatgctacttcacctggagttatggtaatcattaaaaacccaataggtatcattgtcctttctttttgtagtttctcactatatattgtgatttcaggtttttggtgctcgctttatcgcaaagatgctttcagtcccaatggtgatgtcatatcatacccaccttccagcgtgagtttctcttcttaaaatcatgaatacttctgcgatatgagtcctgcatgcataatattgttacgagcagatcttacagcctctaaattagggaccagatatagtactgtagggcaagaccatcatagtccagtgatttccctggcagagatatttactttcgaaattttgggaaaaaaaaacacattactatgtcatgctattggaggattaaaaaaaaacttggatgcatatgcatggaatcaacaggcaaaagtgttgcctccccaatgttgattaaagcatccaaccgaggcacatcattacaacactaattctttctgttgcaaattataatacctggtgttgattcttgagctgaattcttgtcatgactttcaggtatataccaagatacaatttaaattggttacttggacccacatggagtcttataagtaagcataacatcacctctcagtttgttcttcataaaagaaataatctgacagcaaaaatacaactgttctttctcattaaatttgtactgacactcttattttgttttgaaggatgtcttcataggtctgcagatcttactctagttccgtcagtagctattgccgaggactttgaaactgcgaaagtagtatcaggttaaacaattaagataaatctatatttcttcatttcattccttcatccatcataaccgtagtttccttgtctcttcagcaaatagagttcggctttggaacaaaggtgttgattctgaaagtttccatcctaaatttcggaagcatgaaatgcgcattaaattgaggtttgacctatttctttaatattcaatagcagtatgtgaaaaaaaattgtgcatagctaacttattttcctttttctctcttgttagtggtggtgaaccagaaaaaccactcataatacatgtgggtcgtttcgggcgtgaaaagaatttggattttctgaaaaggtaatctttttggcttgtacatatcactgtttgtcagtgtaaaatcaactccaaacaaaatttgaagaatatagatgggggaaaaatggaaagagaaagctcctcaactaacaatggattatttcatagtacatccgtcccaaaatataacaacctagaaccgaatgtgatatttcctagtactatgaatctggacaactacagtgaaaacatctgtggcatgttgttttctctggcatggccattttcattagttgtccctgagttagcataacttgcaatcgtcttagccttttagcttgaatcatgcttgtaatatgacttacatggtcctgtttatgactttaaccaagcagccatttcaaattcgtcacatgtatcatagatcacttatctgtatgtcacatgttcactacatggttgttattttgtcatgtcatcagaactttgcttattttggtgacaatacagggttatggaaaggctcccaggagtaagaattgcttttgttggtgacggaccatacaggtgcattccttaatgttaaatatttttcgttatcaacaagactcatacatgataacatatatattgaaatgacactatttggagcacttcagttttatcttttgcgtatgactggtattatatgcacaactgtaggtgcctagccatctgtttgatccctatagtttcatcttgaatttggagaaacttatgcggcctgtttaatctttggcagggctgagctggaaagaatgtttactggcatgcctgcagtattcactggaatgctccaaggcgaggagctctcacaagcatatgccagtggcgacttgtttgcaatgccttcagaatctgagacacttggtcaagtagtgctggagtccatggcttctggagtcccagttgtcgctgctcgtgctggaggtatacctgatataatacccaaggacaaggagggtaaaaccagtttcttgtttacacccggggatctcgacgagtgtgtgaggaagatcgaacagctcctttcgtcgaaggttctaagagaatccattggaagggctgctagggaggagatggagaagtgtgactggagagcagcctcgaagacaatacgcaatgagcactactgtaccgcaacgttgtactggaggaagaaaatgggcagaactaactaggtttcgcttatcgattcaggaatcgttcaccgccgtctccacctagttactgttaataaccaaagagtttgtacattgtatccaacagcagctcgcgagtttgtgcggctagctgcattcatgtgttcacaaatcacaatcatgggatggccactgaccaaaagcttgtatgcgagtcatgtacattagacagctctttgagattggcgattactatcgaagtgctaactgctaatttagaatactggaggagttgcctgctgtagtgctgtctctagagtgaaagttgaattgtgtgttgttactgtgagctgctactgccaactttctgcctttctggtagctttgctacatttgcgttttgaacattgccatagcgtaaaacctcgagactacggctgtgttcagatccaaactttggatctaaactttcaactttttccatcacatcaaccttacatacacacaacttttcagttacatcgtaccaatttcaacccaaactttcaactttggaaggaactaaacacagcctactgcattttttcatgccgactgcgagcttggcagagtgttgagtctgttccaccagcagaagtgtgatctgtaaccctgtatcggccggcagttaagctgcaggtctaaacagcacatttcacgcatacctatcttatcataatatttatgtatacaggaatattattaacttatataagcacaaaagcgaagatgaagtcaaacagcaagaaatacgtcctgatgtaaatatgtactacttattgtccaactccaccaaaggctgcagtacttaaaaacaaagctacaacttaggaagaaagggtcaaacagcaagaaatacgtcctgttgtaaaaatgtaatgtccaactccgacaaaaggctgcagaacttaaaaacaaagctacaactttatacttcacaagatgaatcaacaaattgaatgagcgcggaaaaatgtggacttaatatggttttccacagaacatatacaactattgcagcaaaactaacactacttaaaacaaagctacaactttccattttacaagatgaatcaacaaattgtatgagtgccccaaaatgcggacttaatgtggttttccacataacatatacaactattgcagcaaaactacactatctctatcaacacaatcccctccgccccaaaaaaaaaggtgatatccatgcaaacagcacaagcaacatgttttcattgacaattgattaacaccacaatattactccctccgccaagaaaaaaggtggttttcatgcactatggcataagaaacatgtaattgtgcacagtcgatgtctcagcaagcaggttttctgtctctgctcattacttgtttgcatttgacttgctgaacaattaaacagaaaggccatggaccgtgacagtagtagaaaatcatcagctgtacgtttggagaattggaccttccatgtactgaatggccctatccattatgctcaccaacaaaatggtaagttttcagaggaattgcagctgcagatgcatctcactacaaaatcagtcctgaagtatgtacgggtaacaacaagtaacaactgcaagtcacatatgagaagcttcaagctattgctgtagacttttggcatttgaagcagcattgttattcatcttgcagcactatcatgacttctccaccttgactgagaatgctgtctagaaatgcaataagtttttctttgtcctgaaactccttgggtgcagaaaaatcactatccaaattaaaccaagtgccattaatgcttcgaattgccacccaatgccggccagtccaaagccctctgaacctcctgacgggtacattgatcatcagaccaaacaatgcatctgcatccagatcgattgaagaagcccctttccgatgatcatgccagattaccttcttctttctagcttctaatgctgtgatgagtacatttacatcatagttcccggtgaatacgttgtggtggggcttaaaaatcaatgacataggagtccagtgctccttatttggatcaatctggacgagatttccagcaatcccatctaactcagctcgggtgaaagattccttttcctgaaccatacaaagcataattgacagttaaaaatcggtacacccatgctgtttctggtaggatcacactaccttttctgatttggtcataaacggttaagcaggcaggaattgaaaaacacttgtttgtaatgctcatgcaatcatatagactccttgcttgcaagtacaaaattactctcagattcacataagcagcaatttcacatgtcgtgaagaaaatcaacaggacataaagatttatctctactaagctatcagctgaaattcatgattgacgagagctttaattatgattgaacaaaagcgtgctagacgaatgtgaaatagatataaatgtgatgcgcggttgatgaattcatggaaaacattgtccaatccgccgaaccgttccaacaaataacactgagagtgaccgacttaagtatgctgtagctttcagatgcgaaagaacactattccagttttcctgcgtccaatatcgtgagatatttcaccagcacacaagttttgatgacatcgattcacatggaaaaaaaaatgcacatcatggacaacagaattggagtacaacgttcaactgctaacaatttcctcactaatatcgattagtgacataagccacgcaaaataaggaaatcatacgaaaaaggaacggaagttatgtgaaactctcgagagaaaaaaaagtagagacggtagatagaacttcttttgtttagaacacaacaggataacaccggaggggagagagacgacagacgagctacctgcataaggttgttgagggcgtggaggagacagaactgcagccgttgcctctcgtgatacaccttgctgcttctgctgctgccgccgccgccgcccatcgcactcgatccctcctcgtcttgttttgcttccgatttgggccccgattccatgcggagatggtgcagggaggagaaggagggttcgggttcgaaggaaagattacagcggcccaagattcctcctctttcttctcgccgccgcccgacggccgccgcgccgctacccccggcaggaacttctgggtcgtccttcccttctttaccaaacgcaacagcacacaggacaggagattcaccgagtcccggactcaggacacgtcgcgtgttgtggtcattgctatttcgcgaatacaatttcgaaaagaattctctccatctcgcttcctataacttttttgctaccgaaaacttatatactaccggtcactgaaattaggaaaaacttcagccgacaaaactataacattgcaaaatcacgagttaaaaacacatgttgaaaaatattatcttatgtgtcattgatacatctgtttagacttcacatattatgatactttactactcgcttatttttatgatggcaatttttaaaaaatttctcaattagaaactccaattagaattgctgaaacaacatcacttttacagctttaccctcttttctagggtagggaactgtttacactaaaattgtctgtgctctaaatattcgtagtttcaaaagtaaacatatataataaagaactctaggtttttaaccataccagcaacctcaaattctcgcttcatcgcataagcatgggtttggttaaatgattggaatcggttgggtcgggataaacctattttttagggtgtttgatttggatgtaagtgagatggaatgttccttgaaaataaatattccccctaaattcgaattagcactatacttagagcatctccaacagatgcctaaacaggtcccaaaaattaaattttaggattttagttcaaaggaaagctccaacagctgcccaaacttgctcccaaaaatcccccacgcccaatccagtcccaaaaccgagtcagatttggggcagccctgggcgttcccaatcgcagcgatcacacgtagatttctttgctcgcgccaatttcttcctcctccctcctctcctcgccgtgccctgctgccgtcgctcagtcccctctcctagctcgcatcagatgccgccaccctgccggtatcgggctttctccgttccattcgtctctgtccagaccggcacctccatccacgccgtcgtggccgttgtcgtccacgccgctagggccatctgtctgcatactatcggcaggtcatcctgatccacccgccgatctgtaagctgctcaagccctagtactgaatgaacctaacggcctgtttggttggagggagtttttaggagggattgggagtttagagggatgaggctattaagagttttgtttggttgggagacatgagaattttggtaggatggagatagggaattgaggaaggaactcccttcttttcaatacctgggtaggggcaggtaattgggagggaattcctcctttactttttctaagcaaatctcagccatccctttttattaatgacataatctccaactaaactccttatcaatttccatcacctctaccaaacaagatattaggattaaaaatcaaattcccatcttaatctcatcatcaattccctcgtgtaaactcccaatccccttccctcgagttaccaaacaagccgtaaagaaagttttgacgatgtgtatcgttgtactttttctagagcaaattgaatctgaatattgtttggtggatgtctatttgctattttgcttgcacacaatgacaaatatggtgttaagttttggttgattgagaaatcattattttgaggttaaattgtcggatgagggcaacactgcacttggttttcagtttgctcaatgtttttcaatttgcaacactacactgcactgcctgtcatgaagcaattgcatactgaagcttcaagagattctgcaagctatcaagtctttgatgctgaataatttggcgttggtagtactgacattgctgaactgaataatctggtttagaatgtagtctgaaaatctaaaccatattatgcgtgtggtacagtcaaaatttcagtaaataataatatgtttatgcctttttacataactcaggaaaaggagagggcatgacctagccttattcttgtgatgatttgtgacaccaaatcagggaaggagagggctagaaatggtaatgtttgttggcaatcataattggacttcagaaattcaatgtatttgttaggaattcacctagatatattcacgggtattatgaattcaagggatttgttttgtagcgatttcagggatccctgtttatggttatactttttttagataatggaagctttattaatctcaataaaactctatcaagtgatacaattattctgagagcacctccggcttctgcacccaaagagtgcacacaaccaacaagaaagaaacaaaagataaactcatcatccaaatagcatggacaaaaagaacttcaggagccctctaaccgtagcctagaacaccacccatgcgccggagtagaaaactccatggccactagctccaattgttgacaagccgcaatgatagtaccccgcaaattgaccttctgaaggatagcccatgagcggagccaatgtgtaataaaaaagataacctgcaaaggagaagatatgttttttctttcaaaaaccacatcatttctgcaaagccaaatagaccaaatagtggtagttgcccctaataagaccaaagatctcaaattgcgtggttgtcttcttatccaatgcccaaacatatgagttgtactattaggtaaactaatattcgaagcaaactggattaaagaccaaactgcgcgggcaaaacgacaatcaaagaacaaatgattaatagtttcatctttgtggcagaaagaacaagacttgtttcctctccaattccttttaataagattatcttttgttaagactactccatgacgtaagtaccataagaagatcttaatctttaggggggctttgatcatccagattcttttgtttatattgggaacatcggtctgcaccaacgaaagataaagagatttaaccaagattctgtcatcagtggttagattccatttaaactcatcttggtcatgagataatataatattagcgatgcgtgagagaaggtgattctacgccactaacttagagcgagtaaggtccctgcgccaagaaagtttatggttatactatgtcctcattttcaatttcaagtaaagcttgtaagcatttgccaattatagtcatcccaagatccatgattgttggagagctcagtttcagcacatatgtttcgtcaaaccagaactttgtcatagtgtaatctttacttgacctagatccacgatatagtgtcataatgcaaggcttactagctgctggcaccctcaccgtgccgcaggctggccgcgcattgcccgggctaccggctcccagctgcaatgccccgatcgcctaaccgtcatgtctctatggtgattgcctgctagcctgctaacgactactccctccgtcccaaaaaaaggcaaatcgtgggttcccgtgccaacgtttgactgtccgtcttatatgaaatttttttataattagtattttcattgttgttagatgataaaacatgattaacactttatgcgtgacttatctttttaatttttttataattttttcaaataagatggacggtcaaacgttggacacggaaatcagggtttgtctttttttgggacggagggagtatgtggccgcgatcggcctgccatgccctgatcttgccaacgatcagcctagtagcgacatactccctccgttttttaatagatgacgccgttgactttttctcacatgttttactattcgtcttatttaaaaaatttatgcaaatgtataagatataaatcacacttaaagtactatgagtgataaaacaactcataacaaaataaattataattatgtaaattttttgaataagacgaatgatcaaacatgtgagaaaaagtcaacgatgtcatctattaaaaaatggaggtagtacaagagaaaccagattgctagaaatagttgaagaggacccaccagcgatgatgtggcataattcaatgcttttgggaactaaaaatagggaagctcgtggacaagggggtgatttttgggctcaaattattttgggatgaccccaatctgagatttttgggagttaaattttaggcatctattggaaatgctcttaacaactagtggaccaattcaacccacttcctctcattgattgtggaccacaccctccgattccttaaaaaaaaatcatcacatccctcacgccaaaatacatacaaatggtccctttgaatcacatgagtggaaaacggaggaataggaaaaacataggattataacagaaatgcaaatgtaaaataaatgattacaaaacacaataaaaacatgtgaatgaccgtttgattgatccacaagaaaaatacatgaatttgaggagagacaaaaactcaaaggaatttttccatgaagttctacctcatgttaaactttctcaaaaacttatatgagaagaaacattccataggaatttcattggatctcatggggtattcaaagagcgaaatcctctaaaatttctataaattccctttgaatcaaatggagccatcccattccaaaacaagggatggacctaagtacctaacatatcccacctcatgccaaatcaaatacatgagtgttgttttgaacacaatctaagatgagaatttgttttcgccgctcattgaaatcatatctattgcgccatcgacaattttgagatcctcccgtttgtcattacttagttggcgctctactgctcatccctatttatcttctgtcattcctctctatcaatagtgcttggtcaacaaatttgccccgaaagacgattaaataaattttatagtgggagaaaacacatgttttttttaaaaaaaaacttcaaaaaaaaatcagcattacaattgtcataagaatgggaaaacctgcaacgtcccaaacaaggccttgcaaaggatcataaggtcttcccagcgctgatgactgatgagtgatgagaacgatgggcgatccaacgagaaatcaagggcagcagcatattccaagggttcgacttaccgccggtaaccgcgtgtttaccgtgattaccggctttatcgcgggggtacggtaatataaataccgcggtaacctccttaaattcaaataaatttaaaaaataatttgaatttttgataaattttgcaccatttcgtacggttttttgcggtaaccgtgcttactgccggggcacggtaaccccgcccccggcggtttgggaaacctgggggcggtttgggaaacctgattccaactcgcaggaactcaagtatactcaacgcagcagtacagcgcgagaaaaccatgttaacagtaaatctatttatacatcgctgtccagtcttctcctatgaagtgtacagactgcgccatctccacaacacgccaagccgtgagatattctgcaatatccctctgttcccttttcatctgaactaaaaacctgaagggaaaaaaaaaaggcccactgtttcacggttgaagaactcgtcgatttaattttgtcaaatctaatctttaaattttaactattcgtgtaggagtaccctccatctctgtcgaattaaaccgtgtttttaacgtaagacgaccaatttaaaaagagtcgaagtggtctgaagtctgaactctgaattttgttgggggaagaaccgaagaggcagtgccgtaaaggcaaaagaaacaagaaacacggcccgagtctagtcgaccacgccccgcgtccgtcttcccccccaaaacttcagcaaaagcaaacgaagtcttctcagattaattctcgcgtcgtgtcagaccacgctgccgcgggggatctgccgggtggcgaggctgcggagatgtcggacgcgctgatcaacggcgtcgccggcgccggcggcgggatcatcgcccagctcctcacctacccgctccaaaccgtacgcgccacctctcctccatccttggattgctagattgtttgggtcaattgcttggttgtttaataacggagggtttgggggtgggtgcgcaggtgaacgcgcggcagcagacggagcgcgacccctccaagccggcgttcaaggacggcgccgtccgccagatgtgcctggtgcttctcctcctcctcctccccaaattcccttctcgtgttcatgcgagctgacgagcaatctaacccgacccgagtctaatgctaccgcgatctctttgttcttctgttcttctgtggtaggtggtgaagcatgaagggtgggagcggctgtacggcggcctcatgccctcgcttgttggcactgcggcctcccaggttgctttcgttttgctgatcgattttcaccagcttccctgccttgttggaggattagctgtaccagcttctgaatcgaatcattgtgtctgtagggtgtctactattacttctaccagatattccggagcagggcggaggccgcggctctccagcgatccaggagaggaatcggcgatggatccgtcgggatgctccaatccctcactgtcgctgcgctttctgggtaatcctattttgcttgtgcgtctgccattggcttatgctgttatgcattgtgttgtctttttctcggtatgatagttgtaagctcattcttgttcttaatggtttacttatgatgaacaaccttcggtgctgttgttttgtttgcgcagatgtgttaatgtacttctcacaaacccaatttgggtaattgttacacgaatgcaagtaagtaatgcacattattgcagtattatttcccaactgactacttttagtgtaataagaaattcagtggcacatcctgaagtataattcattcttgtctgcagactcaccggaaggcaaacaaacagcagagtcctctggatttgacgtgtgttcttgacaaggccctacaagctcccgctgttgaaaacatacctcacaagactatccatgttgtatgtaactttgatcatttctctttcaggatgagatactctattcttgcaattacatgctgctgattactggatccaagactaacagctgttcttatatggaaaaaaggcctcatttagtttttcctaggcctcatcccagttcctaaactgttagctcagctttttttttttgtccctaaactgcggataaaacccatccttcatctctgaaaaccaagtaaaacttgtcctcctaagtacttcatatagtcaatatgcaagtgctaatgattcagactttgtttggggcatggttgattgactccgtttggctgcagattcaggacctttacaaagaagctggatttttgggcttctggaaaggtgtagttccagctcttattatggtaagtcttatgtcgcattttcttttgctaagttatttcttttttacaagttattgtttccatgtttcatctgtcatcaggttagcaaccctgcaatccaattcatgttgtacgagactcttttgaagaagttgaaaaagagacgtgcctctaatttgaagggagctgatggactgactgctcttgaagtaagcttttggcttttggcttttctggtgactgggatcattgtacagatttattaggatataaccaatttgcatcatgctaacttgctgcattggggcctgaatctacccgtaacgctgacttgaaagtttgttcttctagtaacgatgtttcatgtccagtaattatatgttgcatgtcttaacttcatttaccatgatgatttgctgaaaacactagtatttcttatatgctcctaatactactatttctttgttagttagctatgttatagaccgtcttcatctcacgctgtaaaatccttgttcagattttccttcttggtgctgttgccaaactgggtgcgactgttgttacatatcctcttctagttgtgaaggtgattatttgaacaccagttacagcagcagccgtttctgtgcacaattgagcagacatgtcaagttaaaccatgttttttttttctacaggcaagacttcaggtgaagcaaataattgatgatgacaagaggcaccgctacaaaggtacatcgctggcctttattctttaaacttcattttattatttagagtgaattattatttaatgagtgatgttgctccatatcctgtttctgatagtctttacttctcttctggtaataatatttgctgttctctgactttgttaccaaatacgctatgcaaattttattgcttgcaggcacatttgatgcgatcacaaagatgatacgttatgaaggtttgtcagggctttataaaggaatgagcacaaaaatcgtacaaagtgtttttgcttctgctctcctttttatgattaaggaggaactggtgaagggcgctcgattattggtaaccggcaacaccagccttgttaagaagttaccatcgaagccattaagatgatctaggttgtacaagagttagttccctacttataccacaattgtttccataaagcgatggacagagttgccaagcgcccctgttaggagatatcaagttatctgtgagactctgatcgactgtaggctctccaaaaaaaggagattaaagatgtagtacaattaccactgtgattcttgtaggaaccaataatgatggtatatattgggtaggctatctctgttgctcgtgtaaagtatactgttatggaagattgaaacactagaaaataagttggcaatgagaatcgcaagcgctagtcatctgttcagattacttgagtttctttagcttgtttgttagagctaaccgagaagaggatcgcaatcgtgaaaacttcgcaagtgttcagaacaaaagtagaagtagaaaatttggagttcctgtccatttttagcataactgtgtctatggtgcgccccatctgtcaatgtggttctcaggcaactgttctgatacacaagtgctaatgagcaatctgacccgacaaaaaggaaatgaaatttaatttgattatttcaaactcattttggtgaaactaagcctccttctttactaagatgcaaattcttcctaacacattttttaaactgctaaatggtatgtttcatatgaattttttacataaaaatattttaaaatatcaaataaatcaatttcaagtttaaaataatcaaaacttaattaaacataagctaatgggccgttttcattttgctttcctattttatttcatctttattagaaaaaaaacaccatctaatagactaatactgcctcgagggtttttctttaacaatatctaagtttttttaatgaagagatgcttcttctaaaatccaaacacatagtagtgtgtgtatcttactggtctggcgcgaccgactaagctgacactcgcgagagtgtggccggtccggtcgggtgggggtggataaggagatagagaagcggccgctccgcagctgcagcggcaaagcctccccgtcgtccagcccacgcagcgcaccgcagcgagcgaagccgccgcaatggccgcctcctccgtggcctcgactctcctcctctcgctctcctcttcctcctcgcccttcctctcccccacctcggtctccttcctcccatccgccgccgccgccgcctcctcctccccgcgcgtcgccgtcgccgccggcaagcagaaggcggctatctccgtcctccgcgcccttcgcgccgaggcggccaccctcccggttctctccttcaccggggagaaggtcggggaggtcgccctcgacctcaagtcggcgccgccctccaccgcgcgcgccgtcgtgcaccgcgccatcatcaccgaccgccagaacaagcgccgcggcacggcctccacgctcacccgcggcgaggtcaggggaggcggcaggaagccctaccagcagaagaagacggggaaggcgcggcgcgggtcgatgcgcacgccgctccgccccggcggcggcgtcatattcgggcccaagccccgcgactggtccatcaagatcaaccgcaaggagaagcgcctcgccatctccaccgcgctcgccagtgccgccgtggccgacgatgcattcgtcgtggaggagttcgacgaggagttcgccgcgggtcccaagaccagggacttcgtggccgcgcttcagcggtgggggctcgaccccaaggagaaggccatgttcttcgccacggattttgcagacaatgtgcggctcagcggaaggaacattggctccctcaagatgctaacccccaggactctcaacctatacgacatcctcgatgcccgcaagctcttcttcaccccggccgccattaactatctcaactccaggtatggtgccaccgtttttgatgaatatgaggatgataccaatggcgaggatgatggtgaggaggaagcagaggagttgcaagaaggagaagggagcgcagaggaggctgctcaaggtacatagctatgcatgaacaatttccaggtgtctttttattgtttctatggtgggcatgtgcgaaatgactttgagtaactaatgctatccagtgatcctttattttacatgttttagttgatagttaggagagaaaatgctctgctttaatggcatgtacagtagtttttttttttatcttttaactcttagctatgctctgttgtaaatatcatgatcgatgctatacgtatgctgataaagatcctgacatgcgttttaagggtaaaaacaagataacgtggcaaagaaacagaaaatgtagccagttttgtcttatgaataccatcttaattattatggagaaattctttgtggccttgtagacttatggagctaatttttttttcgaaatagttctcttatccttaccagcatgcaaaaggaaaaatgcttaccatgctaatgtacatcgtatggttttttttcctcctgaaagatccaataagtccatgacataattcaatggtctattttagaagcatgcttagagatccacctacccctatgctagctctcagtagacccactgagtctgtattttactcgttattttgcacctccttagggtttttattcagagctcatgagcaactcaacaatttgcgaatagaaaatgacttcacctaatggtggttaaattttcggctgaaggtggattaagtcctaagcactaaactaaaaaataagaagaaatgagactgcatggaatccatgaacaccactgaaccagaactctggggatactggtacactccttataatagtgtcacaatctgctgtgccacacagctacccctatcacctatcacttgaaacattgtcagccattggcactgtcatcattcacttcaaagatgttctgttagaccttagaaccatcttaataaagtagttagctgtgaatatgctggtttaagttgctttagaggtaaaacctagttaaacacatgttttctccatcactcaagcacttccttttcgtaaatactatgcatagctacaggactaagttattattaattgacattcagttctctgttacattttggtgctgcatattataactttctcttattttgagcatttctcaggaacttctttttgtatgactttcagatgaggctgcagagactgaggctgatagcaattcctagggaaggaggtgtagatcgcgtgtttttcgtttgttggtctggtaattgcttccctgatgcagaagctttttggcttacttttgttgtaagtttataatgtttttttttcactgatgcagtatattagatcttcaaactgcacatatattttcaaatacaatgtcgtgtcaaccactgcatatttttcttccaattttatacagaaagtgcttcccaatcttgcttcaaaaaaccagtgttgacctgctggttaccactaattttctactccctccgtttcatattataaatcattttgacttttttttcctagtcaaacttatttaattttgaccaaaatgatagaaaaaataataacatttttaacacaaaacaaacatgttatcaaaaatatattcaaagttacatttaataaaactagtttggtattataaatgttaccattttttttctatatacttagtcaaacgtacagaagtttgactccgaaaaaagtcaaaacgacttataatataaaatggagagagtaacatcttgagtaggggtatgattacaaaatcttgtctccttaaattgttgaattgttccttgttatgactaactttttcgctgggtgagctctaacaagtaacaactaacaagtcttttcagaggacttgctgcattttacaatgtggaaagtagcctagctcaacttggacatggagcactggagcagcatagcccgggttagatgctgatcttgaaactctaagcccagatcagtcgtaaacaacagaccattttgctcaggtttacttgtagatcacctgagggtttagtgaaccaaccctctgcttatgcctaaccataatgattccatcatttttctttcttacctgggtcatgcaagaagagttgttgggccatccttaagtccacccagacaactttggaccagatcatcacctttctaattgttctgacattgcactacaagtggattatgggcttatgggcaaagctgcgtctgtactttagaaaggtgcaagatctggtcttttgctatgtctagtattttatgtcatttttagctggtgctatcggtagaatttacttatagtttgctctgtcttactctgctttcaacaatatctaaagaaatcatttgtgagattgtgactgacataatagtgctgtatctatgaaccgaaaagggaagagtcttgcttaggttgagccagcttctttggcactatcttttaaactttttggtgggcaaaaagctatccatattatactagcccactatgcataaaaggcatacaaattatggggatggacctgagcacataatttcactctcttttttttttcttgagactggccattgattggttctagtttggaatattggatcgattgactataactgtttccgtccctacatgttaggtctgcattatgctccttggaaggaatcattagaaagaaaacttaccactacactaaatgtcactcaccgtattaagttctgtgcaaatatgcagcagaattctattgtgccactggctgctgttgtgcaactgaatttactgggtgggattcttaaactaaaaatataccagatcatctcagagtctccggaagtaacaggaaaaacggttgattcatccttcaggctactgttaggacacgaaaacaccagtggaagaaataagttagcatgatggtataaatcttagacattatcgtcgttgtcggttgcttttcggcgtgttggtctgatctccttcggagctcttttatcatccgtgtcgtaaagtttgcacacgtcgctgtcgattagtccatccacagctttgtggccaatgggccaagttactttgctccgattcatagtgctttgtggttgtttgacccaaaagctttacagtccatcttttcatttatatttatacttattagctaaaatttaaatttttaactttaaatttaaagttgatttaaaggtatttttatcgtagtttattttccagactttgcttttagatcgttaagaacacatctataaaagttgtattcacaaattaatttttgttacaaatatgtcgtttcttttttttcctccaatgtaccaaacgatgggtctattagtttatatgtcttttgactgttgtcgcatttccgtgaaattttcctcggaaaggcatctggtatggttggacccaggcctttatatcctatctcccaatcgaatgtgcatgcaacttatggctctgccgtctatacgtgttctgctcagctgctctccatgctctgcatttgtagtgtggaaaataagaatttagggccctttgaattataggaatgaaaaaatagaggaatagaaaaaacataggattctgacagaaatgtaagtgtaaaacagaggattgcaaaacacaggaataacgtaggaatgaccgtttgattggaccacaggaaaaacacagaaatttgaggagagataaagactcaaacgattttttccatgaggttctacctcttgttaaaattcctccaaaacttatatgggaagaggcattccataggaattttataggattccatagggttcatttctttaatttaaagggcttggtaggaaaaattactataggaacgaaatcctctaaaatttctatgaatttcctttgaatcaaagggtacaagtagtctatacgtgttctgctcagctgctctccatgctctgcatttgtagtgtggaaaataagaatttactaggtacaagtagtttgagggtaattgaaaaggatatatttagattgatatgattttaaaccatactattgaaagtggctatacattaaacaagcctgtagatctagatatatcgatttatacaactagaaatatctagttttacaaaatcttggatccgaaagtgtgttaaataagatgttaggaaattcataggaattttaggcccctttgaatcaaaggatttatatagaaatttcataggatttaaattctataggaaatttttcctatttggccctttgattcaaaggattgaagctttccaaatcctatgaaattcctatagaatggcacattgcatatggattttggaggaaatttagcaagagctccaacctcttggaaaatttcctttgagtctatctctctcatccgattcctacgtttttcctgcactccaatcaaacgaccattcctgtgttttgcaatcatctgttttacacttcaattcctgtcagaatcttgtgtttttcttattcttccgttttttctaccctgcgattcaaaggggcccttagaggattttattcatatatgaatttttcttacaaagccctttgaataaaaggaataatcctatggaatcctatgaaactcctatggaatgcctcctctaatgcaagtttcagaggaattttaacaagaggtagaacctcatggaagaaatcctttgagtctttatctctcctcaaattcctgcgtttttcctgtggtccaatcaaacggtcattcctatatttttcctgtgttttgcaatcctctgttttatacttacattcatgtcagaatcctatgtttttttctattatttcatttttttcattcctatgattcaaaggggcccttagtgaatcctatgttttttctattattttatttttttttattcctatgattcaaagggacccttattgacctagcgagacaacgtatggttctgtaaaataaaaactgtaaacacacagcatgagcagccgagcagggagcggtgtagtgggccaaggcagccaccgtttcttcccatttccccccaagacaaaccaaatgaatcgctagttgctatgcctattagcgatgtctgttatctttatgtctttcgattgactctaattttgatctttgagcaaaagggcatttagctgagtagttacaaagagtctcagtacatcttaggtccagagtttgattttttgtgggagcgaattttccaacatttaacggctttgtgcttttaatggtagacgacgtatctctaggatggatttgccgacccagtcttcgaagatgcttataggggtagggtctgcatgcgtgcgttcatagtggtgtgagtgtgcgtgtgttgtgaatgtctgcgttgtaatatgtaatcgggtagctaagggtcttattccaccatgggtgacatagttacattagaattgctagctaaaaaatcttcgtggttagtcaataataaatgagagttgaggatttgtcccatctttatttcttattctgacttatttttatctttactattttttcaacaaacttataattgtgcgtctcatgacagaagccaaagatacaatccatttttattacctaaaaattagtgataccctaattcaatcaagaccgaaggatcccaaggctcccagctgcccattccagatggacggcacggatgtacgctgatgacatctgcgctttactggttacaaatatagaggatctgcgcccctcgcgtcctgcctggccttttccgtgacgagacgacgcagaacagaccgatcgcccgccagccatgtgaccatctgccgtcgcggtcgcgccggaagcccggaaatcgcacccgcgcgggcacgtcgtcgtagctttccgccgaaagcaccggtcgatccatccatccgcccccaaccaactgccgtttctcgctggctcgctgcctctctctcctcctcggccgctcggcgtcgcgcacgcccggaagcgcgacaccaccacgtatgcacgctgaaccggccactccgcgtccgcgagcgttgatgagctgacacgcgaggagggcgttgccgttcgttaacgacaagatcgattctggatagcgtcatggtctcatggagtcttaaattaaataaaaatgatagcgtcatggcgccgaaaggtgttgcccattgcccattggttgccggcccgagtacagctgcggaatgattgaccgggatcgagctgaactcggctatactctcgtatttgccggtgcggccggttgctatgtgcggataagagcaagtttaatgagcaattctactgtgtttgaggagtcctcataattcctaggtatcaagaggtataaaaaaaatggtacctctgatatctcctcaaggacataaaattactcaagtttaatagtatagccaactactaactccaaatcatcaatagtcaatttaatagccaacttatacaatagttacatataaacatatactacacttttaatagcatagccaactgctgactccaaattatctatagtcaacttaatagccaattcataacaatagttacaattaatactagtcccacatgtcatacgcacatgtatcttggagttcgtgctgcagctggctataaatctgtagcccgctgctattctttcttctcttttatcttctcgaaatgtgtttatagcttgcttatagtctgttgttgtatctgctcttatacaagggacaacctccacacaatctccaataaaaatacaagatgatgtgagagtaaactaatattagagtatttgttacctattaattaataggaagatgatataaatagtttaaattagatgtgtcactcgtcttcactataaaacttgccgttttagacgccgaaatttaatgacgcgctcggtcaaaaaattttattgttggtactgctattcttagggcgtatgctaaataaagaacccccatgcgtgcgcacgtgagtattgtaaatctcttcggatgagagggaaaaacggaagaatatgccaatggtacccactcgttcgagcaatctagaaggataactcaactcacctgccctcgtctctcgggtcatgagaatatgccggtaacaaatggcaacgtgctaatataacttcctccccttcttacccctcggttcctgatgcccaacatatatatatccctccttcctccatatccaaggttagttctacatttcacatctcttcattttctttggctcttcagagttttgtccatctctatcttcagagttcttcagagtttgcttaccatatgatcgtgatcaggtttgtagccagccaaatcttaattcataagaatgcaagatattcatgccttgacatgtgatttctttatttgtctatccttttcaggtatcggaattctctttatttataactacaatgcaatcgctcattttacccgtaacaattaccaagagcttgtttagttgacaatagagatatcaagtcaaataaggttgtttgtgttacacaagataccgatgaattttgtagtgttgcccttctattgggaattcataaatgttgccttgatgagatactacagtaccaataagttttttttaatgcctagaggttaatgaaacgtatagcatatggtccgcaaggctaaccaacagtggatcatcccaaacgaaaaaaaaaaactatgcatgtctctcccacgcgcattatttttcaaggtaacatacatgagccttttatgcacaagtgcatagaattgcaactataagatttttttataatagctttgatatatttaaaattttattacacatgtcctatgctaagtttcaaatgtaagttgaaaaagttggtagataaattcatggcctaataatgatacctacatgaagaggaacacttctacaagcgtcatcaatgttatatctagctatctgcaagttgagggttttcgtcaaagtatggcatcactcaagtcacacctacttaattcaagcatggcgaaccaatgaaataggactaaaaccataaatgctagataaatcatgctagaaactcctatcataatatattgctactaaatcacttattaccatcattagaaagagaatatcattggtactagctattaagagccatgtcagccaagtcacgttctacttgtgacggggcaatgaaggacaagtataaaggtgtgtgtgttgtgtgtgtttggggggttgggggggggggcaatggaccaacatccggtacttttacatgtaaaaactaataaatatttcatattagtgttagctatgtccgatctcattcgagacaacttgttgatacttgctaccccaagtctacatatagattgttgacatgtcagatcaaaactatcattattaaaagctcttctaaatgcaatttgagcttaactcagtttttttcagcctattccttttatccctcatgcctaaaattgtacaatggttagccctactgcaaacgaccttgcacaataaaaaaatcatgcataattgcatattcgagtgtaaattctttttgcatatgtcttttggacagtacacctgatatgtactcactccatttttaagaaagactaatttttaactataaatatggatataaactatctttagatttgtgttaaatggtgtgaagttaaaaataaatgtggcatcctaaatcgatccatacacactattttgtctattggatgtgcacttctgattttttttcttaaaagtttaacttgtctagtactatcgtaaaactatgttgttaaaagttaccattgtatatacattaaataacttgccctcacgtctttacaatgatgcttttgtagctttccctcatttttaagattgaaggtttttatgttggattaattttgccatcggatatcaattgacagcgtattacattgatgcaatttttcttttagctatttcttatcataccctacaggtaattctcaaaatcggagagatttacaaggacacaatagcgatataagtatgactccctcggagctctaattatatagcacaaggatgattcaggactcatccaccatataactataactctctcagggctccaatcatatagcacaaaaaggattcagaactcatccataaacagtgacgatgacccgcaaccactgcgagaaaaccttgaccacggacaacgtcagagattttagccacaggataacaaactcacaggaaatggaaggaaagtgagaaatatctgcagccgccgtcagcctcaggcctcagccgctggcaaacgcaccgcatcagcagcagcagcagcagcagccatcccaagcgagagagctttgctttcgcgagtcgcgcgactccgccaggacaggaaaaaaccggaaaaaaaaaaccccgcaataaaatttccccaacttccgctttttccttgcctctccccaccacaccacaccaccccatctcccatctcaccatccccctttcccaccctcccgtgcgaacacacccgcggcgcggagcccagatcgggatcgcgacggatcggcggcggcggcggcgatgggaggcgaggcgggggagcggcggctggggagggcgatgagcttcgggatcccggacgtggcgctggggctggtgatggggttcgtggaggacccctgggaccgggacgccatctcgctcgtgtgccgccactggtgcagggtcgacgcgctcagccgcaagcacgtcaccgtcgccatggcgtactccaccacgcccgaccggctgttcaggcggttcccctgcctcgagtcgctcaagctcaaggccaagccccgggcggccatgttcaacctcatccccgaggactggggcggctccgcctcgccgtggatccgccagctctcggcctcgttccacttcctcaaggcgctccacctccgcaggatgatcgtgtccgacgacgacctcgacgtcctcgtccgcgccaaggcgcacatgctctcctcgttcaagcttgaccgctgctctggcttctcaacatcctccctcgccctcgtcgcccgcacctgcaagtaattattttttacccttacaaaatattactcgagtgagtcatttaaggttctcctttgttcgcttaaaaagtgttgttgtaaaagggatttgggtatggtttgcttacggaagggaatactacgtcttaggagttctctcttgctttggtcactataaaaacatcttagttctagaattcaactttggagataattgtagctcataggtattaaggaaatggtgtgctttaactgtcacaccctaattttctagtgaggtgcgaggatttagcttagatccaaggctacttagtggaaatggataagtagaaataggttactgcaagagtgcggtggatttctagataattgaccagccatatgttgtcatttgcaggaaacttgaaacgttattcctggaggatagcataattgctgagaaagaaaatgacgaatggattcgggagcttgctaccaacaatagtgtccttgagacactgaatttctttttgacagatctcagggcatccccagcatatcttaccctccttgtgcgcaattgtcgaaggctgaaagttttgaagattagtgagtgcttcatgcttgacctggttgatttgttccgtacagcagaaatattacaagactttgccggtggttcctttgatgatcagggtcaagttgaagagagtagaaattatgaaaactactatttccctccttcattgctccgcttgagtttgctctacatgggaacaaaagagatgcaagtgctatttccatatggtgctgcactcaagaagttggatcttcaattcacattcctttccacagaggatcactgtcagctggtccagcgctgcccaaatctggaaatcttagaggtatttcctggtagattagttgcatgtctttttgttatgtttcttgctttgaggttttataggaatattcaacatgggctgataatcctttttctcatgtcaatccaacaggtgagggatgtcataggggatcgtgggttagaagttgttgcacaaacctgcaagaaattacagagacttcgagtagagagaggagatgatgatcaaggaggtcttgaggatgaacatggtatggttacacaggtggggttgatggctgtagctcaaggctgccctcatttagaatactgggcagtgcatgtcactgacattacaaatgctgctctagaagccatcggtacatacagcagcagtcttaacgatttccggcttgtcctgcttgatagagaagcaaatataacagaatcaccccttgacaatggggtgcgtgctttactgagaggctgcaccaagctccggaggttcgcattttatgtaagacctggggctctatcagatgttggccttgggtacattggtgaatttagtaagacaatccgttacatgttacttgggaatgttggggagtctgaccaaggactgcttcaactctcaacaggatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62887 - DNA, 1289 bp, Oryza sativa
gtcaatggtagtacaggtcccgacgctaattaaccgcgagcacgactactcgaatagattgctttactcacactgcagtggatgtacgattttaatcccgtactccgcggcttgcccaacacatgagcctagtcccaacacatgagactcgccacggcccggcttttcagtcgctctcgcatttcggcacctgctccaaggactatgaacccccattgcaccccagcactccaaaaccctactgccggatggtgaggggagtcctggcgctcccgggaaatgggatatctactactatgaatgaggtgccgccccacgagagcttcctaatccatcaggtctgcccatacacatgaaatgcggtcgtacttttttcgtttcccgtatagcttcttgactcggtccttaactaacctgggtcggcgactaaccatttctagacccacccatattctattcatgccgccctagtcgaaatagttttgttgtattaagttttggttttcgcaaaaggtttgtgtgtggcgggtggcgctcatgtctccaccctcaaatcatcaatcactacatcgagtgatctcacatccataatcatctagcataaatatggagtgtacgtatatctacaatagcattactaagcattgtcaataattgaccgcatataaataaatgactcaggtgttcaaaggtatacaatatgtataaaggtaatcaatatcagggcaagctataattaattgtaggtacacaatttataaatagcattaaatttatttgtaaacaaaaaatttataaatataggatcaatatgttcaaggtagggagcatagtgacttgccttgctatcagttcctaatgtctttgagagatccgcagcagttagataattagaatacccacgatcgaagaataaccagaatattcacgttcgataaacggccaaagaaaccacacacaatcctaaaagaaatgaaatagagtaacattcaatacaactaatggtgccattaaatagatctcgatttttgagagattatggaatttgaacggagtcgatcggagttacggtttgaaatatatggattttcgaagtcaaaaggttttataaaccgaggaggagctgctcctcgggtagggaggtgatttggactttcagagagggctttgggctgtatagagatgcaacataaactttggcgaacgcgagggttgctggtgggttacggctgagatcttggagaagggaggtaatacatactctataggaattgctactccgggtttgg

SEQ ID NO: 62888 - DNA, 1545 bp, Oryza sativa
tagttttcatctgagtacaagccaaccttagatgtcagaccctgcccctatatatatcaggggggggggtttcccggttaaagggaaaaaaaggatagatcttatctctactccggttcagattagcccacaagaaacatatctcctagagttgtttcacaacactcccccttgggcctatccgcgaccaactcatgcctcgtcaaaactcctaccaaaacccagtgggaaaaaggctaggagaaagagtacaacactatggactacacggtccatactgtgggtcatgttctagggtgcgctccccttgaacctagcaaacctcaagtcttctcatcccaattctccagacaagcttatgagaactaacagttgggagagactaggtgatcaatcctctagattatcactcaacttgaattgctactcacctcacctcgcctaaggagttctgtgaggtagccaacttgtatttggtgtcggtcaataaagacatatcttcttatgataggaccttagaaacaagtcaagtgatcatcatcgagtcaatgtccttggcataagacatttcaatgtctcgcaaatgacaatcaacacatagcacatactccccctgacgacaacttttgtcacaaaccatgttccaatagcataaaacatctctcagatgtatgcgtaggcaagaatccttcagatcctcaaaccattagtcttaaaagacttatctcatttcaccactaaaacgagaatagggaacatagagagtaatgccttccatcactatcatgtaccataataccatactgttgtgcaacgcaatctatttcatccttccaaaggattatggggataaataagtcgcaatggcatgcaccacctgggcgtgactctatcaagcactaggcctgatcattgcaacatactccgatggtgtccacaacaattggggatccacaagatcaaacacaagccttccaaagacatgttgtaacgatcagagcaattagctagtctgaaaatttaagcactgtgggcatagtacaaaaaaccggaccggaccgacggttgaaccggaaccagaggtttgggcggcccctgcatctgaatcggagcaaaccgcctgaaccggacggttttcatgtgaaccggtgaaccagggcaaaccggattcgaacacaggttggttggctaagatctccatgcctccaccatccggccatctttcatgtgggatgtacagagaatatgcaaataaaataagacttccggttcagcattcgaaccacgtgaaccggcggttcaagcgctagactggtgacccaaggactcaagcggttcgatctccggtccggttttttcaactatgactgtgggggataacacacagccaacaacaccaagtatacctcaataggtattagacgacaccaccattccaaccatcaggtggagaagatttcaccagtgtacacactctatgtgcctacagaccccatctgtttgatgtcattaggttcctcattgcaatattatcgggtcacaaat

SEQ ID NO: 62889 - DNA, 1755 bp, Oryza sativa
  unsure (1)..(1755): unsure at all n locations
aattcctgcagcccgtgtcgacacatttattcccacttacacatttaaccagatctttgtcatttcccgaaatgatcgatccatggttgttccgtattcctaacaccataatatgcacgcattgctaggaatgtcgtctccacgacgaacatcattatgaggtatatcaccttccaaagatgaattctccacaaggagaatcagaggagtatcctcacatccagtgagaactcttatgctctgactaaggcccacggatcgtgttagcaggcatccccgcagaatatgatcaaatgccataagtcttatgtggatacgatattattcccgggtctatccacatttaccacaattgggagcattactctttttaacaactatccagttgttcctcatatgattttgttggcaaaaattccatgcaccaagcaatcaggagtatgaactaaacatacaagttcaactcatttaatgcgttcactgaaagaaatctccaagcatttcaaaatgtgcatttctcccccccccctaatgcgagatgtcttgcaatagcatacttacaatccccatgtcatggcacaatattaaggcatttcacctcaaacacatgtgttctcccacgaatgtatgctacgttggtgatatatttgggaaatattacggactttaataggagagatttttccattatatgcagtgagcctggacatataccaatatagtggcatgaataccgtattcttcctttctcagaagggttatcctcaacctcctagttaggatatacaagtctgcaaaaaccaccattgctaccaaatgtatatgcaaccaacatgaaaatattttagccatatgcaatctccatggattaatgctcaccgagtgccattcaaacttacaatcgattccggatcgatgtggattagacatcccatgccttatgctttagaaggcatcctatggtggcaaaacacattcctatgcgctcaacaaggagtatgatagcaaagtgcgtggccactagcctgtgttgccaagcagatttttgtggtgcagagttgtattaaagtccaacttgtctaatgcccaagtttgaccccaattactcataccaaattctagaattgggtcactcaggttaagcagcaagttttaggtacgatccacgagcgagttgtcaaaccacattagcttatatcccctagacatagccattgagagataatcaacacctccaacaatggtaatattcactatgaaaccattatgttaagacatatccacaaaaatagtgggatgtgtcggagcaactgtcgttgtcacagcgagctcaacgcatgcaacacgatgaacttttacatggcttacagacgtccattgcgccagtatgcgacaggcatggtcatcaacccatgggcgatcaaccagcacaacctaggagtagtcaccgactacgagtgtgcgataaaacgcaatagtgcatagccaacatttgtctgaaatacaattcggacacagttcagcgtaactgtaacatttgtctgaaatacagtttcactaatagttcttctaaactaaagcattttattaatttcagcatgaagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62890 - DNA, 1177 bp, Oryza sativa
tcaagaaacttgatctccaataactaatggatgtttagtactgtgtacgccatgcatcctatctcttgattaatcttattgaagaaaataatttgctattttgctacctaactagggaatcctatgatttgcaactccaagtctccaatcagagtattttaggattttacaacttgatgtttcactgacatgccaacaccgcaagtcattgaaacattgaatggtaaatcctagagataatatttttggagtagcaaatcctagattccccctttttgctagattaactaaataataactaatcagcaatctctcccgtggaggttctctataactaattcgactccaacgagcacaacaatgcacaatgcagtgcatagtccagttaacagtgactgcttcaaaccattattactgccaaaacatggtacataaaaacttcatgcacaactgaaccatgtctactactaccatagtacatccaaatttcatgcgcatcaactaaaacatggctgctagtttaagtcataagtcccagagcatctaaagttactatcctcttttttaaagaatatcaaggttaacatcttctgtccagaaccattgaaccattcagattatggcaaacgaatagattgatggtggagatgttttaatttaattgcaaaatttaaagcctggtaccctggtccatgcaaagtcaaataagatttaatgaataaatgtggtgtgcctttttacagaaaaaaataaggatgaatagtccttgaattaagttgaatgttaacattgcaactcacttcctccacagacatctttaaaaaaaaatgacagttgactatgttgcatagtccagtcaacaaaacgcaccgtgaatgcaagatgtgagaagggcgttaggtctctgtatttggcacttaatgttacaagctcattccagcagtatggtgatcccaaagatttcaacctgaaggagaacacaaattaactccagtaaatataactgatcatgatcatggtaacaaaataaattatcattcaagattaaatttattacttttttctcttataatcatattaggtttaccttgtatttgtggacaatccaaactgtactccatcaatgtatagtgtacactcaacaaagagcactggagcacttctttcaatcaacagg

SEQ ID NO: 62891 - DNA, 849 bp, Oryza sativa
caaaatagaaatcaacacacctgctgagaattcctaataaaacaaccaatcaattaatatcattcaacaacaaacaagatcacctcacaataacaagctatccaataatttttttcatattataggctgtaaaacaactatgtaaactatgtaaacctgtttgttcagatgaggagtatggcccaatgaaaaccgaacttgctgctcactcctatcttgagacctatttagcatatggatggcttctccacctgatgacctaaaaatacagtaataaaaccaaggcaacgaagaattataccagatatgtattaggtaaagatgattagcaaataaatccttaaggattttttaacctgctagtaaagaaggacatgaagcataggcgtgtgatgatgcccattgaaccgtgctagacggcgggtcgatgatggcagcagccccgttggcggaagtggccggattcatggcgccaaagatgaccagatggtccagatcttcttggcctcggcggctatggtgccgggcgtcgacagttgggggaagagcaagcgcggcgtaggtggcaatgtgggcaagcaccatgggaagaccctcgtggtagccattgatggaaaagagatctgcaagcatgttccctgtcgacatctcaggcgccaccgccgatcctctcccgccacatgctatcaaggtcacttatcgaacgcaccgccgtcgctggtgtccatctctacctcccgtatacaccgtcagctcagcttgtccgcctgatttggctcgataacggcggcttgatcctcactcgcgggcgctgttgatgggggatcggctgtaactctccaccgaagg

SEQ ID NO: 62892 - DNA, 2291 bp, Oryza sativa
cgggctgaggtcgatgttggttccggcggcggagaaggggccaaagtcggctccggcggcggctgatccgagtgggagaagcacgatctgggaagaaggaggtggggaagagcggggcgcggcggtggggaagaaggaggacggccgcggcggctccggctagggcgcggcgtagcggcagcagcggggagaaggaggagcgagcgaggaggatggctgcggcggcagtggggagtcgctcctgcgaggacgctgggaggagtgagcgaggaagagaagcgcgcggtctccgcggctgcgggtggaggagcgatgtcttcgcgcgtggaatcctcggctgtgaaatagtgcggtggaggaagagaagcgcgcggatggacgcgtttagtccggatgacttggcatgtagcattggagggggcaactcctctttttatattagtatagatatatatatagatatatttctctttaagaagttgggtattctcgaggatcaagacaaatgttatatatttctcaataactactaaccagaacagtaggatggcttcacagtgattagtgataatcatccgtattacaagcaaatttagagcctatctcaaaacatcacattacctccaaacaaataaaaaaatatagaaccagacaaaattttccttcgtaaagttcagaagaaagaattgatgcaaatccattgataggggctgtgcaggatcaacggagaatagggacagacgccttccgaagccgccatccttaaggctagcctattaatcgactttggttacctaattcatggaagagcttctcctgatccaagacatatatgatcaggcaaggaggaaacaaaacgttaagatcttcaaactccatggccaatttctgattggcaaatagtgaatgatcaagaaaacaaatggtgatccacaaattgacacaacacaaaaaaatgtaaaataggataaattggtattaccttagggtttagggggaacaggagcagagtacggggagggggcagcaggtggagcagatgccggatcagcttggcctccctggaggcggcaacctcgatgacggaaccaaccggatcgggtcggacttagcaacatgcgtgaggaaccggcgacgcgatggaggtggctataggagcagtggatggcaggcgaaacagtgatgagggcgcgatcggcggggcgaggtcgcgacgacggagaaatcgcgatggagcaaggaatgggtggagaaatcggcggcggtggcggaaggggacgacctcggggatgctgcgacggcggcggcagatggggacgacgtcaactccgatagtgcggcgtcgctggcctgtcgcgaggaggacggaggatgcacacggattgaggaggagcgaggaagcggctgggattcgtgggcagaagtcatcatggcaggcgaggaggcagcgggattcgtggggaggagtcattgcagcggggatttgtgtggcactgcggctgagtcatcgcgtgggagcggaattggtagaatcgctcatcactgatgaatggatggataagatcagatgagatggtggatggacggatgagatgagaggggatgattgttggtatttcttaacgacattaaaagaaatatatgtcccagcaatgacgcagaaatacttctagtatattatggttacagagttcatccgcaagcgcacggatataccattgtagcatttcacccgagagtattccaagtgtatcgtatttattttattccgtaagaagatcatgtagagagaacttgactaataatttatatattacttgtgataatcatattctaagcaggggtcaaaaataatccaagggtagagtgatacacaagcattaactactcattctcgtaatatattatctaagctaagtgggaagaaaagagaaagataatctattcctatacttctaacatacatagtatccatacattctagttaactgatatactagctaataccctctatccgatgccctactgatacttcgagaagccacccctgactaccgagttccttacaacagcctgtcatgaccatacaaccggggctaaatacggagaaataccctccccagggaattacttaggattatataccggcgcggaggaatacccgtactgagctgtcaccatcagcggcccacctctcatccgcaatatataaccccaaataatgatatcccgtaatctagacaccacatctaaactaccagatactactctaatatgggctgcaggaattc

SEQ ID NO: 62893 - DNA, 16540 bp, Oryza sativa
actcctgatttctactctattcctattccaccatctagatattactaaactaagggcccctttgaatcaaaggatttatgtaggaatttcataggattcaaatcctatagaaaattttcctatttggccctttgattcaaatgattgaagctttccaaatcctataaaattcctatagaatggcacattgcatgtggattttggaggaaatttttagcaagagcttcaacctcttggaaaatttcctttgagtctatctctctcatccgattcttgtgttttttctgcgctccaattaaacgaccattcttgtgtttttcctgtgttttgcaattcctggttatttccggtcgtgacatttagcgatgtctgccctgctaaaccaaaggaaggggcttctttggcatatacccatggacaattcagggcatagtgtccttgttctctacaatcatgagaaaaggggacatgctcttctggcattggaagctcattgacctgggtggcaaatgctcgatcaaacacatactgattttggtcttgacttccaaccaatggtagctgtgaactaagcagcatgcttggaatggaccaagggtgtgccctttttaactctcttgaggctagtggtgctagtggtggattgagttgaaaacttgagttactggaggcatacccgctgacattctttcctttttctctgttaaacatctgtgacagggattgaggtgagagaggaaacaagccaggaaagaatagaccagaactagagacaggaccttaaaggaactaactcttcttgttgatgtgttgtttgttttacttattctgcaagtagattaagcaaacaacctagcatggttacatcacaacccaccgatgcaaaccacgcgctacacacacaagcaaaggaaacacacgacaaacgaaacaatagagggtggcttaggttctgcgacgggttctccaagatcttcactgcttcttcacagctggcttcactgcttccttcgcttcgctagcggaccctgtggtcttccggagcttcggcaaacaattggcgacatcttcttcttcgcaaagctgaccatctagtactagtcaaaaatccgaaggaggaagaagagaataaacattttgcaaatagcattacggaaaggaggaaaaaggaactttcacaaatagtttcatttataaaatatgtccttaggttttatccacttggcttatcctacagttgagatggctctgataccagcttgtcgcgactgaaaattttgcatttcccgaacgctagtgtattaatccccgtcccaggaaaagccggggtacaccacacaaacatgatacaaaaggcacatctttattatatcgataatatttacattattacaaaggcacttaaggcctgacaatcaaaattaaacagcagcggactagcgggcctacggctccatcttcacaggcgctcaactggggtataagccaggactccacctaagacttcttctccaaagcttctcttactgaaggggggaaagattgagcaagaatgagtacaaccacagtactcagcaagccacaccggcagatgcatgattaatgcaaggggtacaaggggtaataatataggggttaagttttgcagtaaacagcatttaaaagtcacttagttgcccaaagctattttgtaaacacgatcctagagctatacaatattattaatcaaggccgtagacccacacgaacctgccttaacccaaggcctacgatgattcagaccgaactggcaacccgaccctgagtcccagctcgtcccaagccaacccaggccaaccatttcacattttagttgttaagcaggttttaagaattaaaacactaacttgggtacattgctaggcttgcccataaccgagggcgcggctatttgaatagattatactctgatcagaggtgtacatctttacccacaagacacatcttcctcacgtgtaaccacgtgccacataccaccacggcatacggccaaaagacgtgacatagttctcaacccatcctagccataaacaagagtaccgacccaaccccacctatggccggaacctccgggacaggcaggtaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgagcttaatccttatagtacccgaggtacgactaacaaaacccaaccacgcacctcgagcccagcctaaaactattttgggggttttgaatagagggggaggtgtgtgtccaattccaacataagccaaccattccatagtgtccaaatgatatgagaattcccaaagtctaaagttataaaaccatctaatgttgcctaattaatcagcgaagcatctacctaaattcatactagtggaaccatgaatagagtacccactagttggggttttgtttatcctagggtgaacaaggtaataataacaataacaacaatgataaggtcataacaaagataaataggcatggctaaataaaacagtgataacgcgggaattttaaataaagcgataatgcattaatttaaatcaaaataattttataaactgggattcaatatgctcaaggatgatgtgacttgccttgctcagagataacggccttccgaaccttcggcgacgaccgcaaaccacgcttcgggaacctccggaacgacgaagactacgcgaagcacacaagcaaagctacaagcctataaagaagcaataacaatacataaaaagaaagcacatggttctttaggttataacaaacattaggagacttgaacggttcgattcggagctcgtatgaccaagacatggtcatccgaagtttaatgctgttatatggagatttgcggattattgtaattaggttttacaactataaaacatgtgtaagcgctagcctggaaaagacaggaagactgcgctgttgacatgcggaccccacatgtcaacctaagggaccatggtagaccgagtacacagagacagtccacgggtcgacggaagcggaccccgtgtgtcaaccgaggcaagtggccgacaaacggactccactagacaccacgagggctgcacacttggaaaccacgcggctaccgagcgcgcacacaaacacggccaccacacgcacacacaaacgactaccgacaccggtacatgggtaccggggtcgacaaccgcacaacaggcacaggcgacaccgaaaggacgaggacggagcagcgagggagagggatacttaccaccacgcgacgaggcgtgggaacgacaacgacgaacgggcgcggcggagacggacggtgagggaacgactttggcggcgatccttggacgaaggtgagacgcggccggcgcgaggcttgatgatgcggagacgaggacaaagacgatgacggggctgtagcggctcacttgacggaacgcggacgacgaacgcgaatggcttgacggagggacgaacgccacgacgaccgggaacgacgagaggacgacgatgacgacgaccggggccggcgaggaggcgacgagggcagccagcagtagctgcacagagatgaggacggcgtggaacacgccgctgcgaatccgacgacggaggcggcgccgcgagacgacgagccggcgaggacgaacgaccgaccggaggagtcgtcgatgaggatgaacggagacgatgataacgaacaccggcggggttcggatggaggggaggcgaggccgagggcgaccttgccgctgcgatgccggaggaggagatggcgacgtcggccgatgcacgggcacggcggaaggggttgccgaaggaactccggcgaggtggagggcgagaccggcgtgggcgacggcgttccggcgaaaccgagggcaggccggggtggaggtcgacgcggcgacgccgagggaggagacggcgcggccggcccgcacctgagcggcgcggcaggggcggctggagggtgggtagcggcaatgccaccggttgccggcggggatgcgcctccggtggtttccccgcgaaacggagggctgaccgggggagagaaggtggctgcgaggccgctggtggcgacggcgcgaccggacggcgctcgggcgaggagggagaggcggctggaggccggccggcgccggagagagagaaggagaaggcggggagaggtggtgcggccacggtgatgaaccctgagttccactcgagacactaaaggctattgttggcccgatctttcggtgagttgagataactacgatttgtggaaaagacgttgacgatccgactacaaccgtacaagacgttgtgttgcgccttagcgatcgatacacctctccatgggttgttgatcttgccggtgcagatcaaccttattcctgcaagcaaatcgaagaaacaagcaagaacaagataaaagcaatctgaattgcaaataggagttaaatacgaatgataagttgtggttccgaagaacaagcagacggacggtctagccgacacgcgcgctgcaagcaagtagcaatggctaaacttcaatctatcaaaacccaagaaaccttgaaggggtacctagctatataaataggggtgggaggacgacctaggggtgcctagggtcgtgctccacctggctggggtgcaccccacatgggccccacctgggccgggatcccaaatgaagttacaagcccataggcccattataggtgatgcagcaacttgtgcgtgtgattccggccacacgagatggaattcggagatgaggctggatccgttggaaagagcgctccgagagctgtccatcaagtattcacgggccaaaaacggaggtcgtatgcagattcggcggccatttgaagtcagcagtgtagcaggtggccgaatcggattccggcacttggaggacttgaacttgatatcttgttgttcatccatgatgtgagcaacggatgtatccgtagtagccatggtcacatcatcctccccttcttcacggaaaaccgtcctcggtttttccatatggtgttcttcacatagtccattcaaaataacctgtttcattcaatcaaaacaagagaaactcgaagtagtgtgattagcaataacatgtttctctacatccgaacaaatgaaaactctatgcaccaaatatattcctctatcattatatttgccaatgatatgaaaaatagcattagttggacatggcaaatcagacttagcaaataatttctccttcaaattatcgagctcacaaaaatcatcaaactgaacatagcccaaagtatttaaagaagatagcaatttacgttcctcaacttcattagcaatgtgaacagcatgcttaaaatcagcacacaaagaaactctagaaatatcatgttcattcactagttgtggcatggatataagtgaagcattatcacacaactcttctttatcacaaggaacagcgagtaaatcaacttgtgacaaaggaattccagcatttgattccactaacggttgctctactttagtatgaaaggtggacaaatttacttcgttaacaatgcactcaccatgattaatttcaataccatttactttacctttgatgtcctcttcagatgatggaggtgccttgactttgagtgtgaacaatgggattggcggctctttcatgtctctctcctctattttactttcagcattgcaagcaagttgtaacaaatgagaaagagatgtatatctttgacaatcaagcatgtcctgaatttctttgtttagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatctctgaaatatcgtttcaggtatttccaagattgtggtattttgttatgcctacaaagatgtttccaatcattagaagcatgtttaattaaaacactagaggcacacataaccttttgtttctcagacaagacatgcttttgaaattcactatcaaccgctagctcccaattaatgtaagcacgaggatcatagtttccctcgaaataaggcaatgcagatttgatcttacctagaacatcatcacttacctcataatggtcatgttgatccctcctcatgtctcgacgaagatgtcgatgttgagcacagctatccccaattatcttgcgtatccctgccattgttagtagaaaacaagaaacatacacaaaaatatgcgcgttcctattaactactaggtagtggcagctcaaaaatcacacacactcaagcttttaaccaagctcttacaagatcttaccaatgcaagcggaatggtgacatacaccgactcaaccaagcaccccaatggaggttggatgtatcgatgccttggtgaatacttgctgtacggctgcaatcaaatctgtggagctctgggtaggcttaaatatgtagcaaaggaatagcaaatgctcaaatcagagaatgcaaagttgaataattgttcaaagtcaagcaccgtgctggtcctaggctagaacgtactagagacgcgagcctagacacaaacgatgccacaagatagcactaggaataactcatgcacaactctgatatatgaagttcagctcaaacataacagtattttctcttttctttctttcttctttcttcttttctttcctttccttttcttttctttttttttgggtgcggcttttcttttcttttttttatgcacctttctgcctttttttttctttctttttttttgattttattttacaaaaacagattcaaggacctcaatgtaaggttacagggactcaaacgtaaatataaaaattacagggactcaactgtaaaagtccaaaccaaaattaaaaattatacaacaatggaatgctaaagttatgtcggttccgtttttgcaaacggatcttgaatccgacaccaaaaataaaatttcaccgaagtgtttaaccaatccggacagaaacaaacgtgagggagtgtgagtcgactcacaagtctcggccacaagatgacgcaagggaaggaatcctactcggcttcggtttggaaaggtaccaggtgataaatagaaacagactcggcactaaatagaaaccaaaccagtcaatctaatctaatcttctccttccatctttctcacacgcgcatgcacaggtgcaccatcacggcatgcaccatcacggcacagccaccaaacagaagctatgcaactcaagaactcaaaaactaaccgacataaacttctgaaaactacgaaaatagaaccgtggcagcgagccaattccgttttcgtaggtcccgacgacaacagagacacgggggcggtgacgactgtggtacaaaatgtgaccagaactcgaaactctaaacgaactagacgctaagaccagcaacacgacatgacgatgcaacacaaaattcaacaaagcaaaaactgaaaagaacaatgcaatggcacaatatggctaggtaaaagatacaattttttttttggttggctattttctggttataggtagataaaaaaaaactcaccgagcaacgaaagctctgatatcacctgatgaaccctgagttccactcgagacactcaaggctattgttggcccgatctttcggtgagctgagataactacgatttgtggaaaagacgttgacgatccgactacaaccgtacaagacgttgtgttgcgccttagcgatcgatacacctctccatgggttgttgatcttgccggtgcagatcaaccttattcctacaagcaaatcgaagatacaagcaagaacaagataaaagcaatctgaattgcaaataggagttaaatacgaatgataagttggggttccgaagaacaagcagacagatgtcacgtgccaaaacgactctaaaatatatcctttaaattatgcctataataattaaaatccatgtgaaagcctccaacaattaaaatgtgcaaagttaaaagtcaaataaggcttagaggatttttgtatatttcctaaaagcctaaaatgtgtaaataaattttagtggaattttcagagcacaaataataattattaagaaataaacaaagttgaaaaagttttataaaaagaaaaaccctaaaagtcccccttccttcccttgggccggcccggcgcatctctcctccccccactctctctctcctctccccgcggcccactcggcctctccccgcgcgcgcgccgcttacgggcgggcctgcccgccaccctcgctgacgggtggggcccacccgtcatccccgacctcccgccgctcccgccgcctcgcccgcgccctagcgccgccgccgccgcggatcccgccgcctccagccgtccccgcgtgcaataaagtggggcgaaatacttcccgtgattccctctccctttccccccatttttccctctctctctcgcgttcaaacgggcggatttgcccccgcaaatctcgccggcgccattgatggcggccgacctcccgcgccggtttccttcccctccggccgctctctcccccttccaaccctatttaaaccctccccgcacttccttcgcccgtttccaccctttgccgtgccttctcctcgccggaatcgagctcgcgccatcgcctctctctccgccgtcgccgccgagctccggttcaccgccgtcgtcgccccggaccgcctcccacctcggcgccgcctccttcggcttcaccgcatcctcgccgacctcgtccacctctctgtttcggttgccgaccgccggagcgccgctgtccccgtcgacctgagccgcgccaccgcctccctccgctccggccgcctcctccgtcgccgccgtcgccccggggtgagccgtggaccgtcgcctcctttcccccttccctcccctctctcggccgccgctccgccgcgccggtggtcgccggcggcgatcatcggggcacaggcgcgccgtctcccgccgaccgcgccggcgtggccgccctcgggtgcggctgacgtgtggggcccacggcgccggccggtgtgagcccgggtgcacctggtccaccgtggactgtgaggctgccgcgtgggccccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcagaagatctgctcttcgtggaggttgaagccgacgtttgggaaagcgagcaaggcaagtcacatcatccttgaacatattggttcccattttataacattattttgatttaaattattgcattatcgctttatttaaattcccgcgttatcactgttttatttagccatgcctatttacctttgttatgaccttattattattgttattgatattattaccttgttcaccctagattaaacaaaaccccaactagtggacactctactcatggaaccactagtatgaatttaggtagaagcttcgctggttaattaggcaaaattaggtggttttacaactctagactttgggaatattctcatcacctggacactatggaatggatggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctacggcccggtagtcgagatgtcatggcacagggccggtgtcctactgctaggggctcagtcctgcctacctatcccggaggttccggccgtagttggggttgggtcggtactcttgtctatggctaggatgggttggaaactatgtcacgtcttccgtccgtataccgtggtggtatgtggcacgtggttacacgtgagaaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttaattaataatattgtatatctctaggaccgtgtttacaaagtagctttgagcaactaagtgacttttaatgctgtttactgcaaaccctaaccccctatattatggctcccttgtactcccttgcatttattctgcacttgtgggtgtgtcttgttgagtgcggtggttgtactcagtcttgctcaatttttcccaaacccagaagaggagttcctggaagatgaaggctttggtgtctagctcgtgcctgccgtcaagcgcctgtggtcgtcgccctagtcttccgctgtttcccgtttgtctttgtgtgtgctgggccttcgccgcccatgtaataaattaattatttacgcttccgcttgataaactctgaaatgtatcaacttttggtgtaccttgcctcctgggacaaggaataatacatgcacgtaaggaacgcccgttgggttatttccggtcgtgacaacggacggtctagccgacacgcgcgctgcaagcaagtagcaatggctaaacttcaatctatcaaaacccaagaaaccctgaatgggtacctagctatataaataggggtgggaggatgacctaggggtgcctaaggtcgtgctccacctagctggggcgcaccccacatgggccccacttgggccgggatcccaaatgaagttacaagcccataggcccattataggtgatgcagcaacttgtgtgtgtgattccggccacacgagatggaattcggagatgaggctggatccgttggaaagagcgctccgagagctttccatcaagtattcacgggccaaaaacggaggtcgtatgcagattcggcggccgtttgaagtcagcagtgtagcaggtggccgaatcggattccggcacttggaggactcgaacttgatatcttgttgttcatccatgatgtgagcaacggatgtatccgtagtagccatggtcatatcacacggggaggtgcgggagaaggctaaaacgagagaacggagcgagggggttccagtttataggtgaggggagggagccggccacgggagaggcggggaacggcggcggaattcgtggccggtggccatggaaggcggccgggaatggcgcggctgttccgggcgttagagggcacgaatcaagggggaaattggggggaattgaataggaaggaaaggggattaattccccctaatcaattttggaattcccggtttgaatcgcgtggattttggggaggaatggcgctaggtttccgggagagaaagaggaggtcgggcgggaggaggacaacgacccggcgcgtgggacccatgcgggcgcgccgtcagcgcacgcacgtgcgtggcacgggcaggagggcgccgcttggcttgggcccggaggcggcccaggaggagaggagggagaggcagcccgggagggagagggaggaggagggagctgggctgaggggaaggagggaggggagggtcggcccagaaggaggaggagagtatggagtgggccggaaggggaaggggaggcccaagagagagagagggatggaaaaagagagggaggagggaaggactttgggctgggctcagcccaaaggaggaaggagggtttatttttagctttttctttttagtaaactttgataaatgttgttgttgcttaataattatttccggtgctctgaaaattcaagtaaaatttgagggctccttttagaccaaggagaatttaacaaaaattctccgggccatattcgaatttttcttgtacgtattttagtgtttgccaatttctttttgaattttaattaattctattattccttttagggaatgatttttatttcgggatgaatttatcaggacgtgacaattctcctccactttattgtcattctctgcaaaaggttagtatacctaatactagtggaatattattattctaacagatatatgcattgcaagtatcactagttcttctctattttagtaatattgacggtcgaaactgatcgataacgaccgtcaacaaaacccccaaagcttgaacctttgctcgttccaagtgaaggacagaaggaaacaaagacttggttgttgatcaggagttgctactatgctgcatatctcaaagatacaggtgcagggtatatgtaatctctctcagattaaataatctttgacacggtgacttacccttactcctgattaccacgagacactgcttctccttgccttgggcagttgaaagacagaacaacaattagagcaccaatcatccaatcttcattcaactcttattccagaagttttcaaatgattttgaaaaagaaaaccaagttcctcaaatgattcactcggtctctccaagtgtatcaatttgaattcctcaccagtttttccttttttattcctactctaaggtttgatatgtggagcttggtagggatcaaacatggcatacttgcattcacatttattactaaagcaaaaacttagactaaagcagataactaaacatactcaagatcaagatcgtgcaaaatgtgtgtgtggtgtatgatgaaagtggtacatgaggaaaaataaagaaaaatgcttctcctttgtgcttactttcttctcccaaaaatccttcttttattgattaggagagggcatggctacagttttttttcaacatcatgctcatgcttgatggagcataactttattattattattttttcacaaccatgcctttccctccttctctttttttttcaaaaggattttcatttttaggagaagaaagcacatgaaagtatggagaatttatttttggtggtaatatggaatattgcttagctcccagtgtaggagtttagcatgtgcatatatgtgggtgtatgatcttgatcatagagcatgagaagtatctacacaagttacaagagtttgacaaagttcaatggaatgacaagcaaccaaaatttatatggtttaatcatgatagcacatttttggctttggtaggaatttatatcaaatgaggaactctcaatttatcattttgaaaaacaaacatccggaattcaagtcaaactagtatcaggatcatagcaattcttatttactatctcatatctcgcaataacttagacttagatcagcaagtgcagcccatttaccttaggttcccggataattgttggctactcatatttaacctttgatagaatacttacctatgaacccatatataagagatataaaacagagcaactattcatcatttcaacaaagagaactagcttgtcttacctagcatgactcaaacctatcctttttttttgatattttctattttgcaaatttttatgttgttttcaagttttataagatgcaattggaaagcaaatatgcaattggaaagggaaatatgcaatgtgatacaagttacctcagtggggggggggggagggagggggagaggtgtctccccccaagcttgctttcgctcaggatccttgataaggattgaacccctgaaaacggaagtacgcttgaaggtcatcgtgctgttgcagcatcatgttgttgaagttggcgaactgagcatcagcagattgttgccattcttgcgtttgagctatgtgttccatgaggttgtactggatctcccccatctgcatatcaaggaatggaggcacaccacttgatctggaaggttggttgtccccccattggatgtcatgaggcgcacgccaccggtcctcactggcactcgcccaggttaagactccgatgctgtggcgtagagcttgggtccatccgggtgcatccccagctggtgcccaacctgcttcatacatctgtacgggtgttgaggatgatgaactctctcgttcattccttgtcatgttgcgcgtctccctgtatgctccacctacacgaaattcttctatggtttgcagggaaatggttagttcatggcagttgtacaaatgataccccgcatttggcaacgggatttcatttgtacaaccggggaaaaagtaaatcaaagatccatctactccatgcttcagaatatgcccttgcactagataggtctcatcaatacacggacgagcggctgagataaaagccatttagtcgctaacgacccttagcccttttgctattcgagtaataagagaagtgaactcaacaggagcagagaactttatactttctaaccattgccttatcatacatttcacaggagcaattttgatctttctaaccatggcaaacatgataatcaattcatccctcctaatgggtctaagatcacctctaggaaacaaagtcatagcaatccatttatgcatgagcctaagtgtaggattatggatatcattcgtcataggtttcttgcaaattggagcaccagaaatatcttcccaaaacctatttttctcgaacccagaaattcctttctgaagatatattttacaggaatcgtgaaaaccaagaagtgtacttaagcctttctatgtaagtgtgtactccttatggaaaaagcgaaaggaaattccatcttctatttctttcaaagtgcacagaaattgcaaagtaagcaaacgagaaccaggctcatctaccacagcaaatctttgccaaccaaccactttccaaatagaacgaaattcaacatccatacctatcttttttagcagctccggagagtattctcgtgtgtgagcatactcccggtcgctcaacatgtagtaggcttgtctttcccgatcactgacaaggtcaaggtcggtgtcgtttaggagtcatcgcggagcttcggcgtcttccatcgagacattagctaatgaacgagtactagactcatcatgatgacttgatgaagagctggaccccttgaacagacgagacaatcgcctcctcattctgcacaatggagcaagaacggactaactcggcgggggttaggaataaaaaaaatttcacccgccgattagtttcaccaaagcagcttgtatatatgcaactaagtatttgaatttgagggaaactatcaaagcttgaatgaacttgagagcaaactttggagagggaatgaaaatttgttgaaatggggtggagttccctctcccggccggttggcttaagtagtgcacccacaacggtcaaaaccgacctgtggggcccactagccattgcctcaaagagggaggcagccgaccgttgcctggccggttcggccgaaccaggtgttcggccgaacccctggtgggcccaatcggccccactttcgaccgttggattccaacggtcagtgtagtcgtggcactgcgaatttttgttggaagttttattttggtttgctctgaaaaattcattggaagaatttcctcaaaattcaaaaatcctaaatgcaactttgaaattcaaccatgtgctgatgcaaaaatccaaattgttgaaagcaaaaatgtagatacataccaatttacctgttggcgaaggtcgcgtcatttaaagtccgacgtgcaagaccgtacctccttctgattcagttcgtagattttccacccgtctctggaggtgatggagcgggcgtctttggcttttccctccacaccttccttggctttggtgcggacggcggcttcttctgagccggctgctctaacttcttggcgatatgggtggttttaccggcgtcttccaataacggttcctg

SEQ ID NO: 62894 - DNA, 2074 bp, Oryza sativa
acggatataccaatgtagcacttcccctatggagtattacaagggtatcgaatccaagggaacgtgtatggtcagatcttcctccggttcatccatggacaccaagcaaaggataggcttggatagagaggatttactagtgagaattagtgtctagggaaagcttaactttaatcctaacacaatacttcaggcactggcaacccgctgttcccagatgtcgctctactacgtacccggacaggaaggacttaagtgatctcgagggctgtcaccacctctacacctacctcaacgtactgtgggacacgcatcaattactggataataattacctaaacaccacgtctaagcaattaatatctactttagtgtttataactcaccaaagcaatcactatgttttagttgattatagtgaacaataatcctgtatgctatttagaaactaaccaagagataattctcacaagataaatctaaattactcaagaagaatattatattgaattcagagtaataaacagaataaaagaaataggagaagattaccgacaactccggaattcttccaacttcttctactctactctcttcctattctagtatagaattgttgatgtaaaaacatgaggcctgggagatctgcttaactccagtgcaggtccaaaacttgcctttgggtgtgtgagcatgccagttgatttgatcctgcaatcaacaagagacaaagacaaagaaaccgcggttaaatctataaacgatagccgatcggctagatgccgatgacatatcattgatcttgagccgatgtcatatatgcatcgatcggcagacattaataagtaagaaagaactaaatctacttgatcagctgttgatattaacaatatataatccttatgtcgatatatacttaaatcaagtgattgggatagattggtcgccatgtcgagacagtataaatcacttagaccgaaatatatattaacaacaagattatatatgttcatagcatagccgatcagatagatctagcatgtatcggctaatactccgataccgttttatattgagatattaaagcaagtacaatataccaaacggaaagcttaatatacttaaatacgacgagatcttaacataaagggcggatttaacatgtcaatcaagcacataagataaatatattcaaatcaggtaagatcggctgaaaccccgatgctaccctaattggcaaccaaaggcaggctagagattgagattctaatcacgactcataagatcaaatccaactgatgcagctataagtatgaaaaaaaagacaatatctagacaattaagccgttggatgtgtcatagagtggtggatatcctatataatctaagtcaacatcggtatttaacctagtcggctgtcttctactgacagatcgatgttagccgattgtaggttagatagcgatattgccggagattatataagatatatgataattcaatttatcacataaacaagattagagtatcataaagatggaagcactaatcccgagaatgcaagccgccacaataagttttacctcttgttgaagattgaaaccgatgcagctcaaccccaaagcaagaactcgtcgaaacaaaacaaaagtaaaagggtggctatgcaccgagattgatttgaacgtgtgttagttttattacatggggctcggggtctatttatacccgagattacaaaatatgtccatatcgggcatgactcttatctctaacaaactctaagatactataagtctttgcggcagacatttgcctaaacatatctctaaggaaattacataaaatatcctaattaatagatacaattgccttctcaggactccatccacgcgtggcaatcatcatgaagcacgtcaacctaacccgacaacgtatgccgtgtcatattgttggattcggctcaatcggctaaccctgtccgactcgaactctgccgatcctagtcgctgccgtttcggacttcagccgattctactctgttccccgagcgattccatcttaaattccacct

SEQ ID NO: 62895 - DNA, 2347 bp, Oryza sativa
agagggatgagaaagaaagaggatgtgcgtcggcaggggatgctcaccataggcggaagcagcaggacgacaacaccgttgctcgactcacgtggtggatggatataggcgcaggcggcgggcgactctcgcgaggagattgagaccgacgctacgggagattgacttgggtgcaaggaatcaggcgagagtatgcggcggaagcggcaaaacgcccgcaccgctgctttacttgcgatgatggagatcggcgcgacggcagtggcaggcgacggacgaagggggtctggtgcccgaccgaccgacggatgtggtgagtcgagggaggccaaggccgtaagcggtatgcacgtgtttggtgcggccaatattaattcctcgggtaagtaggccgaccgcgaggcagattatgggcccagctggagagcagctccgattaggactgtaaaaaaaaaaaaagctcggctcacaaactgctcaagctcggcttcaagtttggactcgaattgtaagagcaagtttaatactccctccgttcctttttgagatgtcacacgcacacataataaggttatactcttaatctaagaaaatgacaaaaatacccctggctagattattccggaatggaggaaacgcactggcttcagagagttctctgggttttgtagtacatgagaaaaccctctggttaggcccacaaggggtaagtgcacaaggataccaaaggatagcataatataggctcatttgcaaaagcagcatttagcaaacatttaggagtagtaaaacagtagagtaattaatcatcaattttaatcaacactgaacagcacacccatactgctcaggcccaaccatcctgaacaaccatacacggctgtacagatctactccaaaccaggagctaagcaaattattaccagttatagcatcaataattattgtgagaggtatgagactaatcacgaaaaacattgctcaacctgcccatgaccgcgggcacggctattcgaatagttttactctggccagatgtgtaccactgtacccacaagacacagcctcaacatcatgtctaccatgcgtcgcgatactggaaagtacccgaatagaggctgtgacaataccctctgcacaacacaaatcaccacagtgcaccgttcctggatcataatcaccccctcaatatctagaggcatggactccccaacgacccccacggacttctcgccacttcacagtttggcgccccgcaataaaccatgctatacagaagataaagccgttgcccacgctggcttgtggttggcacgattaatgtctcacaacagtagctcgcgaaccggtccttaattgtcatgagcacgaccttcaaaaccatatgctcacaacccaccattgtcaagttttagttggcaagtaattaattaaccaatcacgattgaccagcgtgagctattattaaatataatcagaagtgatagtgtaacattagttatcccaatcatgtgctaatgtttgtaagcaaagctaagcaattatactaatatatatctagttgaaccaatatataaagtccaactagtcaaattataacctaaggtatcaaagaatagggtaatcaatgcaaattggccataacaaagaaaggttcacaccacccagtgatattcgaaaataaatgcacagttgaaataaatagagaatttaaatataggatcaacatgctcaaaggattgtgtttagggtctgtgtgacttgccttgcaataatcggtcttcaattagtcttcttgaacacttccgacgcactcacgaaccttcgaaacaatggaaacgacaagctaacacgcacaacggagaaaaagactaataaaaaccaaataaacagtacataaaaagtaaacaaatatttagatcttgattttagatgaatttagagacttgaacagcctcattctgacatcatatgaattagttatgaattttaaaagatttaattcaattaaacctattcaaataaattaaataaatttataacacaatttatatataattttaatatataggtctttattttatacaatttttataacttgaatcacattaatccgacttaccatgaattagatatgaattttctaagattaatctgattttagccttaaaccttaaaggatttgcgatttattttagaaaagaaaaaaaaaggctttatgacatcatcgatgacgtcatcaccggcggctcaggctcctttggtcgccggcgaactagggcacggcggcgcgaacagagggcaccaacgcgacgagcacgacgcggggaactcacaaggggcggcg

SEQ ID NO: 62896 - DNA, 7807 bp, Oryza sativa
taggtttgcgcgtcgacggcgctataggaggcggctgcggctaaaactcgggccaaacggaaaagcacgactaggggatgctatttataggcttggattaaggagatcgaactcggaacgagaggaatcgaagcggaaaatcctatgttttagttggagagataaactctaaacgagtttgattcttataaaatacaaggaattggtttccgattctcgggggaaacgaaagagggagataagggaaatatttcccctcaactaattttaagaatacactagagagaaggccggatttggaggagaaaaaccgagccaactcggtctcggttcggctgtcctgaggttgaagacgaacagtaacgagggagaaaagtagactttcagtctgggccggctgagaacaaagaaagaaaagacaaggggatgtagggaggaggggcggctcggcctgggccaacttgggccgagcgcacgcggccggagaagagagagggaaggctgggccgacttttggcccaaagccgaaaaggagatttaaaaaccttttctatttaaatttattcatgaaatgcaattccatttattaaaaatacttccttggctcaaatatatcccataaaaatctaggaactatagaaacaagataagtatttaccaaaattttatctagcccatttttattgatatttattaaactaaacttagatcttttcttttaggcctttaagatcatttataaaaattcaatttataatttaaggatttttaaacaagcaaagcacttatcaaaattacaaatagatcatttcatgattatcttattgattaactaattaatgaaatgttttttgtattactaaaattaataattgagctctgaaaaatctgagaaaattccagagagtataattaatcatggagaatttaataaaaattaaattcatccatgctttatatttaggaaattttatttcccacatttaacttaactcataaattaataaacatttaatataaattcatacaacaatttattaaataatttataaatcgtaagacgaaaatcacacctcgctcccgcgccggcaggtaggcccgtcatgttcgccggcgaggaaggcagggcttccagatccggcaacggcggcctcctcgctggtggattgtcggttgcccggacgagaggggtgcaatgacgagagtggtgcaagccactgcaccctctcctcctctttcatctcatctccacgttagcctctctctcaccctatcctctatgcctgatgcggtcccaggtccgattccctcgattttccaatggcggattcggtcgtggccctcttcggcaatacaacgctgctctccaccctcttcctcccgttctctacgccgctcacctcccctcggtgccagatccagctcaggggctgctggatttggtacgaggaggacacgtgccgaccggtttcaaggaggatggggagagcaagagcagcagcttgggcaccaaagccatgacggcggcaaggcatgggctatggcaaagtatggcgacgacggcagaaaggcacagactatggcaaggtatggtgacgacggctgcaagtaaattgggacattgtgcttcggtttttctcctagatgttcttcattctttccacatgactactgctaaaacattgattctccctattatatgcatatatacatatatgttctagcccctgctctctattcttgatttgctgctcattgtgagtttcacatgattggtaggaaggaaagaaaaaagggagtgcaggctagaatgctagattattcagtactaatgtttaaacatcaccacccagctacagatcaaatcatctccttctgtcatgcatatattgtatatgaatcgagtgtattgatattatgatttggtttgtctcctagatgctcttcttcattctttgagcatgagttttaatagatcatttgtctatacaattagttttacctgtttgcacattagtgttgcagtattaatacgaactgttgccatagtctctctatgtacttttggttgggaacacaagagtgacatatatgcctatcattaatctataataataactgcaatgttgtattttatctttagaattacccattgtctaagcatacaaaatatccatctgtaatttgaattggttagttcttacattttgcatatcaggtttattagtaccatgacttccgtttccataggctttctcaatatttgatacaaccaaaatttgccatattgactacaatgtgctttgaaccaaagaaatatgttgtaggtctgttatgtactgttctatttggttattggaagtaatttatattaccaacttctacgccttttacatttcaccgttttagtttgttggcacctactgaacaatatttttcccatccaaagtattcatgaggttattttctgtttggaggtctggacagtcttctctcgggtgtacatgtggtcgtcagattgctcatcacattattatagttccatgatacatgccggttatttttgttgttatagtgagtgtaaaggtgaagccaattttattttccaaatggaacatgcaagctatgttaaactaagttcttcagctttcttccttggtaataagttcccttctgtgcttcttatcaggtgtgcaaacgggaaatgagtagcgctgtcagcaagaaatagaacacactaaacatggacttgaatctggaagtattacatatgacccggcaaagcttaaattttctgatgacatcaaagattctcggtgaacctgacaatcctgacatattattgcatccagcgttccaatttggccagtccaaaggtaccatttgtttatatctccatttttactagctcactttcctgatatatgtatgatagatcattaggttggcagttcttcctgccttctttgcattttagttctcagtgtattttctctatattcttgatctatacatggactcggaataaggtgttcaccctaaataaggagggaggtcagtacatttttcctaccttaaaaatctgaagtatggttgaacattgtattagatgatattcagataatattgttagtttataacaagccagttggtttatacttaagccacttggttaatgcaaagctatatattctataattcctttatttcttaccaaggaatgcgaatgtgccagtatgttccttccagtgcatttgcctctgtttgattttttattgatttgttgctcccctatttttgcccctatatttatttggatactggagttcattttcaaagagatgaacctcatggtcttcaggcttcagtttagacagataattgtggcgtctttaaagtaacgatgttatattgaggtacaagtcttttagccatcatatctggagtaggctccattatcccgggaattatattgaaacaactacaatggttaaaaatatatatatttcagttcgagattttgatattggccagaatttaatagaccacaaatacacatttttacgatctcttcattatctcagttcaagctctttgtataacaagataattggcagcatgttgagacatgccctaaatatagatggtagtatcaataccagatataaatggctaaaattgttgatatgaatagtccaatgttttcttttttttatctacattttgggcatttagatagtatttactattttagaatgcaatatatatatatgtagcactgtgagcagagacagatcaagagatgcaatgtctgtagtagattcatactcttctcaattgttatcaccaggttgagaaatcaccaactttagtatgtgcttatgggttatgtgttcttgatattaaccatcttatttatgatctccttttattctctgatggtaccaatcaatattattaatggtttgtcttttctgaaagtcctttgtttgtagttaactagataaccaaaaagattggagctgatggcatatgggattccaaaaaatgcccatgctatatatgtggagtctggagatatgttttttttacaggaatctggagatgagtatatattttgttcaccagatgaatgtgtcatgtgccagccgtgtgcaatcattattgaaacggactcaaaatttcagggaaaaatttttgcgaattatttttaagtcatgctcttctcgattcttgcgttggagtgatattgcttttaatcttttcttttattttggacataaactttaattgcaaagttaatcgctcttttaaattttataaaacctttccatttattttctgtaatctctaactttggctctaaattatatttcctttgaatccattcccgaacacctccaacaaataccctttcaattcccgttcaaccatctctagagcacatgaaatatcaatttctctagagttaatacctttttatttagagtttaccacactaccaccaattttagttttatcttccacaaatatttcccctttgaaatatcgtttatctaaattatccattcaagatttcaaagtctattatttagcttgggccaatatttccccgattgacccgactctctgttatatcccattaaccatttttatctttgggactaaaccggtataactccctttttgttggaatttattttggatcacacctctatctaaacctatcccgaaaaacctttaattcctctacatcgatccaaaatattctagggtcaagttcctattttgatcgagccacctgtttgattcctatggcttgatttcctcctcggcacaagaactatactatcacaaataattgagtgattgctcttgtgctaagaaacttatttccaatcccttctattcaaagtccaacttcctttagccacaaatatttcatcaagaatccataccacatattttggaggctaaaatcctaattatttacccccatctatttttgacgtcatcccaaaatttatctaaagttagaagatcaattatttgtgttccttttcctcccatttgattatttcaatcttacattttaaatattaaagaaaatcttttgtgacaatttttatatttggttcttattgaattctataaaattggagcattttgatccttattgaattcttttaaagattggagcatctttatttttattttaaaataaatatctttgattttattttaaaaaatatttcaaactccttttgctttaaaacccttattcaaaagacccccaaatatttctcttttaaatctattaaaaccctccattcaaattttcccttagttttcatctcctttgaaattccatttcaaatccctccacacaaaattcataaaacccctattcattttgggccaaattcccttcaattaacccaatcagcacaagtctacatgtctccttcctccctcttgggctgtcagcccagccgagccgagccaagccggcccatggccgagccgctccctcctcctgtgggcgcacttggcgcacgcacagggcgccgccgtcgccgccgtctcgccacttcccgatgccgcccgccgttttgcgccgccgccgtcgtcttgccttcgaggcgaaggatccgtcaccaacgtcagctgcgacgtcacgccgccgacgtcagccgccgaatcgaaccgccatcaccaaccaatcaacgaacagagctggcgccgtgctccacttctccacgccgccgtcgctgagttctccttatcttcctcctccgcaaccgccttacgccaccgcctctcgccgcctataaaaggacgacgaggtcccctcttcctccacacacaaaccgacttcctcaagctctctttctctctttctctcccatgtccggccattagtaccactggccgatctccctcaccggagcttcgcaagacaaaccctcgcgccaccaactccgcctcgtcgaggtgattccatttttttcctttcccctctccctccaccttaagataaaccgccaccaccaccttctcttatcggccggtctgagcttttgctaccgccgttccggccatctccctctctccctccgccttccaccactttccccgggtgcgcgttgctcgggaacaccatctcccaccggcgttcctacctcccggccaccggagagctggcacctcgctcgccctcccctctgtttcctctcgactgccagacagaagaaaagaagaagaggtagaagaaacatatgacaagcgggccccaccttttataaagtaattccattttcttttatccaattccaatctttgagcatccatatctctccaaccattgatccaattccaaaaattctttgacctaaattcatctaatttcaaaccctctcttttgataccaaattttctatttttaaaattttatttaaatacctttttcttatttatttatttactttctaatgttaaattattttaattaacctttaaaaattattttaaatttatttgatttactttatatccctttaatttttaaatttatcgtttaaaaacctttttaaaaattaaattatcctttaatttctttagatgcccttttctttattttaaaataccattttaaattttatttctttaatctattttaaaacccccttttgaattcaaatttatttgatactttttttttaaaaaaaaccatcccttagccaccaaataactgccttggaactttactccttccatggagacgttcgcgtggtcttacacctcgacgtcaaaccgttggtcgtaaaacccggtatcacctaatcctaaggttgaagtgtcgctcttcgcaccccacgcctcaagccctcaacgcttacagtggtcggagcctcactactccctcaacctccacagtacgccgcacactagtccttgagctatgtgcaaccctagccgctctgttgtcactcatgactgcagagtaacactgttcccctccacacaaatctcctaactcactagtcgttgtgctacttagctgtagcattgactagacgagccgatatttagccgttatgctgcccatctttagcatcggctaactaatccaaatatctagccgtcgtgctactctaccctagcatcgactagaaaccaatccaccaaataaaccccacctatccaaaattatcctttcttcgattttattcaatttccaacctatagaaaccatcacctctcttttcttcttcaagttaaaagtttatttttaacccatttcctttttcctctcacctcgctccaattttatttatttcttggctttatcgtttctttgtagcaatttgcttataggctttatttgctatctttttcgtattcgtacgttagaccgtacaacaagttctatcggcatccaaggagctgacgtggacccagatggctacgctgaagccgcaggaaatcttaaggcgcaaggcaagacataactaaaattttgatcatatagaaaacttgatataatcttcatatttaaatttgatgcatgatatttactgttttaacatctcatgggtagatgttatactttagaataacattgtggtggcttaaaatgatatttaatgcttttaagcattgttatatgagattatggaaagatacactaaacatcattttatgtgatttattattcaaacatctttacaaacttaggaatccggttaaaatgggtatttttgaatgttatatataatgaagtttgttggtgcagggagtttggaaa

SEQ ID NO: 62897 - DNA, 5028 bp, Oryza sativa
cacatgtttgattattcgtcttatttaaaaaatttacgtaattataatttattttgttatgagttgttttatcactcttagtactttttaagtgtgatttatatcttatacatttgcataaaatttttgatgaataagacgaatggtcaaacatgtgagaaaaagtcaacggcgttatctattaaaaaacggagggagaatactctaagagcacgcataaggcaaaaatattcctttccatttctcctaggatcaatcttcatagtcaacacccctttgattatcatcaatcaacagagtccgtttaaaagtaagaatttacataaattacaaaacatttagctaaaagagttgctggtctctatggaagttagcactaacaatagcttttgtttcagataatgtaatgaaacatccctgcttttgctaaaaagttatagccaattattacaaagttcacacaaaagcaaactcacaaagtgagtatgtagcaaaagtaacgaaaccaaaagtagaaacaaactaattaaaaccaaacaaggtaaagactccacaactactgaattctattggtgaatcttcacgcgaaactggcaaagagctgtatgatcgtcgacttaagtttacgacacacatcttttattagcttgataagatcatcatgcctttgtagttgggccaatatattaccctgaaaaaatcctgcaaataagattttgaaggtgatctatcaaaaaaaccatttcgttttactaagctagagagcccaataaataacggaagctccatcaagtataagttccttgattttttttattaacacccacaagccaattcccaaacatatgagatatactatgtggagggtataatataaacgagaactatatagatctccaaagaaatctagcgaaatggcaatccaggaaaagatgataaatcgattcatttttcataaacatctcaaactactatccaattcctcctagccaataactaattccacggaaatgagtccatggagattaaacgaattcttactttgaattagatttttcagcatgtgcttgagtagagggacaatctgcaataacaacacataaatcggtaagaagaaattctattagcacataaacacctcgctatgtcaactgttttggtgtttcaattcatggcctgtaaaggttcttgtagacatgcttgttagacatgtacttcatatcaataagtcggatggagaaattaaagactgagtttctctcaaccatcacacataaaacataaacacattttatgctgattcaattggataggcacacttcaccgttatctaggtcacaaagattggaatatgggaaacatacacttatttatatatactgcatttctaccctgatttattttgcaggaggtgcatgcctgcatggcaacatcattttttcactaaataagatcattttttcaccagcaaatagaagaaaatggaactttgccaaacctagatcgattattgcgactgaaacaatagagaatcagaatactaccatttgtgtcggtgatatgggtccggggctatcagcaccatagggaggaggctgcccctggttgccacgtggccttccccccgaggggggtcaggcctgaggtagggtgacggcgccccctacatgcccgggggtcgggcttccccgtccccctccacgcggtgccgcgtgtgccgcattagataggcgctcccagcgccacctaaccgcatttaaggtggtctgagcgagcgcaccacgctgcattaaatgtggtgcgcgtctgactggtctatgaccggtctgtgaccggtcgaatgattgatgtggcagggttagtgcgtctgctcactggctctatgtcagatggcgtgccgcctaacgcccccgtcacgtcgtgatgatgaaaggctgcttagcctctcatcacagccggagacggtttgcctaacccagtcagggcggggtttccgtttcccggcgcaagtgagggcccaaaaatcctcactcattaaatgtcaaatgacgggtgtgtcccccgtgtcagccggatagattaggcggaccccacgccgcagcagggcgtacaagagacttccaaggcaagcaacgagacatgcatttaatgtgattatcctccctgaataggctcgatgggcccatgttgtaaccccttgagatataaaaggaggtccatgcctacttagggagaagatgagcccttttcattagagcagtctcctgcccctcatcatcaacaccttctactccaacaaggagatcttgtaatctctctctcaatcagcatagcacaggagtagggtattacgcttctcagcggcccgaacctgtataaaccctttttgtctcatcgtcctcgaggagcctgacctcctctacgtcacatagcttcgctcaccaagcccacgaatctcaccctcttcccctggccgaactaaaaggggggcttcactgtcccccgcgtgaggagttcaccttccgacaatttgagaaaattataaaaggccacaaattttcactgctagataacctaacaaaatacgaaggaataaatggtagaataattgaggagagaacagtgtggcctgggcaacgaagtgatatcgtcagcccaaaatccaatatctcctgttctctgcacaaacagagatgtaaaattttccatatgcagagcttagcacgccataaccagtgtccaattctgaggtgggttttgaagcacgacccggtatatcgatgcaaccatttattcatgagacaggatgaaatgattagcataattccaaaacatttagcaagatagtagtccagtagtgtctaaaaatcagggatggaatgatccactaaatgaagtggcgattaatccaaagcaccttagagtccagtaaggtcgaagaagtcctaataccagttctgaaacatagctgatcgctttataatgcagatactgcaaattcaaatgttgtctattagaaaccaaaaaataaattcagttgtgcacctatgcacagccgtggtgcagtctttggtcaaattaaaacggattatcaggttactcaaatcaattcaagaaattttattctagaaaggttcattcagaaaatttatcctaaaaaaggtgaaatgggcttagataagcggtaaaattttccattccaaattgcatcagaaaagtttggagattaacatacagagatatgagtagtgaaaaccaaatcgaagagaagagtaaatacctgcacaactgcacagtgcacaccatatgctcgcatccatcgaatcacggatttttttagagtatcctccaatgaatacgagccattcatctagtttgatccaatggatcatattcatttctattacacccaataattttgacagtagaaattgtaaaggggcaaatttggaaaatatgtatttttaaaattcataatctcctattttttctgtcgtttcatggccttctcaggctgtagatgggccaagtcctaattaattgatccgtaatccatgcgcacgtacagatccaaatttcttggctaatcgttggattatgtgtggcttagttgaagagaataccatgttccaattattccatggactcacgtttgcatacatggtcaggatggaaattagcggcggcgaggagatcaacgcaacggcgagctggccagcggtgccaacgagatgggtcatgggtatcgagcgatgattcatagcctagagagacgagtgatatgttctgcacgaattaaccagatctaataataaaaatgcattacattaaattctaaaatacctatcgtaatcaacggttagatgaaacttctatagttctactacactattaccactagcagtgggaggtacagtaaaagcgcccttaggttgaaagtgtccagtactattgtataggcagagtgaatagaaaaaggcaatagttaagtaaatttgaaattttcctttggacagtagttatacacaagacaatatgctatcggtttagtaagtaacttcatataactatagacattctagtatagatggtactgtacaaaactgactgctaatcagaagctagttataagaatcgtctactaatgaacatatagcagcatccttctctttttactctgttctccagggcactccaaatccaacattgcggatgagtgacattataccctaaatattgatcccacgggttgaagttctcttccaactacatggcaacatgtgtagtgcttttggtagatatatgaataagaccagcatccagagatggcagtttcctttgtaactgatgataacagaagatctgttgcatcaccataaaatacacattatgttgtagaatgcagttaagagccttgtagttatcgaagaaaatatgatgtcaccgtaacagaaaagaacttcaaaactgacatgtacagaccaaatattataaatgtcttgaccaaatattataaatgtttttaacgcctagactgtgcccattgatggatggtctcaaccacttgagggaagaaagcactgatactttcgttgataagaccctggagaaaatgtatagcatcctcgtcgtctagatccaaccggaaattttgctgtagctgattaatgtccacagaaaaaatggaaagacgatgtcacttattctgtaggtgtttaactttagggtaagtccattttacaccccttaactcttcctgtcgtctaaaattcacaccttaacttaaacaccgggcatccaacaaccccaactatcaaaaccattcaatttacacccctagacaaaaccagggtgattttcctgcttatgtggtatcaacataccaatctgggttagcaaaattattaaaaagaataatggccccacatgtcattaaaagtttgagaccctcttcctctactctcaccttcattctccatcttcttgagatttcctcaatccgcctctgtcaatggggctgcaggaatt

SEQ ID NO: 62898 - DNA, 1418 bp, Oryza sativa
ttccacttcccctgtcaccccccgagcttgagcttgcagatcccactcaggaggcttcgatgccattgattgtcttgggtgcgtcgacatagggaactaggggagaggagagatcagagagagaggagaagaatgcctcctaactgacagttgggccctgtattttctttttatacttttcctgactaaattgccatgtcgattgacacgtaggagaaaaccgcttgattttgactcgggtgtaagttgaacagttttgatagttgagggtgttgagtgtctggtttaagagtcaaggggtggattctagacaaaaaaaaaagagctaggggatgtaaaatggacttatcccttaaacactttaacagctacttaccttagaagtccctttgtctgtgatactctcaatatttgatccagtcatcagataaaaaagattcagtatgaggttgctggactttcgtaatatgttgtatgcctcgcaacagtaggacttgaatcttgcatagtattcactaaaatggaagtcacatgcaaagaataaatatctgtgaaatgagcaaaggtgcaaaactatatatacataactaaataaagcatttacctttcagtaccacccatggcctcaaccatttctttgcataatttcatcggtggtgatggtggtgcaaatcgatgtggttgttccccaagcatatacgagaagtcaacatggaaaagtcttccatcgtcttgtaggagaaggttgtcaagatgcctagattagaaaagcagttgttatttattgcttacaaactgcataatgcttgacctccaaaaaaatggaaaaactgcatgttgctttgatgttttgttgtttgtatactccagttgccatataagaccagacaggactgaactacaagatgtgaagtgaaggtgatttattttttttagatataatggatagaaatctagccttttatatctacgagtggatatacagaaccaaaggttataggaatttagattctaagtctcataactgaaaaacaaaaacacaaaatgaaaacattgttatgactagcttccatcttttgctgcctaacgaaccctgccacaccaaaaactgcactgagacgatctagatatgcagttcgaacttgtgcagcccacatccacgttccatccacctttcaccgggtcctatgccaccctgccccaacctcagctggatccaatcgatccagattcatcaatagtgcatttgctcgccgacggcatccagaggaggcagagaagagacccctgcaagtgagattcgggcacggccacctcagatccagcagcatttaggccccagattgagcgccgcgccccatctgtaccagcattgccaaccagcttgtcgttgtcctgtccatggcactcatagcttt

SEQ ID NO: 62899 - DNA, 2463 bp, Oryza sativa
tcccccccaagcttgcttcttgctatggctcatggcggggatcaaatccctggtagcggtgaaacgcttgccagtcagcttgctattgttgcatcatagtgttgaaatttgcgagctgtgcaccaacagactgctgccattcccatgactgtaccacatcatcctccaaggtatgttgcatgttccttgcctgcagttcaagtgtatccgtcccccggatgagttctcccaaatcccttcgagaggagactgagcaatgcatccaagaggatggaggtagaccacttgaactgaaggagcgcgagtatccccagtgcagctcctacggctcatgccaccggctgtcgctggcactctgccaggacgaacctccgccgtcatgttgccggaattgggtccaaccaagggcatgcgcggtcgggtcccaactgtctccatacatctgcactggtggtgaagaggaagacgcctcttggggtgcttttctccccatacgccgtgttatcctgcgtgggacatcacgaggcaactccgcttggagagaaatggttagttctcggcagttatacaaatgaaactccgggttaggtaacggaatttcatttgtatagccgggaaacaaaatcatttggaccatgtttgagtgcgtggccttgaaccagataggcctcatcaacataagagccggtaacaagaatactagatacttgcatattaagcatagtcccaactcttcatgctaaacgagtcaccaaagaaatacactcaacaggaccagacaacttcacattttctaaccattgcttgatcatgggttgaatgggtgaaacgttgattttttttctaaccatggcatacaagaggactagttcgcgctatctggatatcagctctaagaaacgatgtgaaaccaagcaacttatgcaacagcctcaaggtaggattatggatgtcattagttctaggctttctataggatgagagacccgaaatactttgccaaaacatacgcttgttaaaatcaggaaatgcgttcctgaaattaattttgcatgttttgtcaaagcctagatgcaagctaaggtccttccaaaaaaggtgatattccttgcggaataaccggaaagtaacaccatcgcctacctctagcatggcacataaaaactgcacggttcgaaacccgtgcttaaatcctactcaaggcccactacgggtagcgagcaattaacaaatagagacaatgatgaagagaaatgacgcatatacggccggcctgggtcactcatgatgttggtagttcaagtgaattgtcgtagtgtaaggaagattgattggttttctgattactacttggctggcataagaaagaaggcgccccggcaggaattctgtaagcttgacttgcacgcagcgtttgggaatcaaagataaaaaataactctatgggacttgaactattaaggatcgcatcccgtgcatattccacattatagccagcaactgattcagcttccgcttctgggagatcagacggagctcgattagtttctgctagacaaggaataaagaacataaccaatacggggaacaagggaataccggaccatatctgcttttgcgccatgacaatctcactcgaattacagggacctacacatattagtacagtataccggggtccccggccagaaccacacgtgcaagtttccctgcatgtggctcgtccatgcttttatccgaggcgctgcctgcgactctgcatgggagaagagggctgaactgcaaactttcgtgttcacagcattgcattgtctaagggaatagggtgagtaagcagcgcctaccaagctaagctttcgtcgaaaaggcgtcactgcttccttttcggcgcccgccaggaacccggctcgtctacacatgaaatttatcccaacctatagcacgccaaaaagtaatgaagctcagcatctatacctatccttttcagaaggtcgagtcgtatgctcaggtccgagcacaggttcggtctttcagcatatgataggcttgcatttcccggtcgcccacgaggtcgtgaaaggagttgttgtacagcctcggtggaatgtacgcctccttcatggatgcatccgcggaagaaggtgtactcggcttatcgtgtcggcttgtccgtgagcttgatcgtctcttgaatatgcccaaaagtcgtttctttatggctacagcaaagagcaagaatacaagactactcggacgggggttaagcaaatacccgccgataaccttgcaccaaactaaagcaaacttgtatatgcaagtgtctaaactaaatgcagcaaattgtgtgaatttgaggcgagcttgcaaaactttgaataaatttttagagcaaggttttgagagggagtgaaaatgagttaaggtggtgtgacttccttctcccagccgaggggctgcaggaat

SEQ ID NO: 62900 - DNA, 1904 bp, Oryza sativa
tgttgtacagcctcggtggaatgtacgcctccttcatggatgcatccgcggaagaaggtgtactcggcttatcgttccccgggttttggggtttccccgggggggcccttttttgggtttcccccgggttgaaaggcccttattttggaattcgttcctctttgaaaatatgcccaaaagtcgtttctttatggctacagcaaagagcaagaatacaagactactcggacgggggttaagcaaatacccgccgataaccttgcaccaaactaaagcaaacttgtatatgcaagtgtctaaactaaatgcagcaaattgtgtgaatttgaggcgagcttgcaaaactttgaataaatttttagagcaaggttttgagagggagtgaaaatgagttaaggtggtgtgacttccttctcccagccgagctacatatatagtgcatggataacggctaggaatggcatgtgggccccactagccgctaccctgcaaaaatttccagccagccggtgccagccggttcggccgaaccagggattcggccgaacccttggtggacccaaccagccccacctttagctattggattcgaaaaacccggaaatcccccaacaatgtggggtggtgtgctgtgcaaaagttttctaaaaactttattttattttgctcacaaaaatttatttgaagaatttgcctcaaattcagatctcaatgtgtgtttgaaaatccaaacatgctttgatgcaatggaaaataaatatgagataactaccaatttacctgttggcaagggggatgtcgttttaggtccgacgagcacgaccatacctccgacgtatttagctcaatgaggcacccagttccggaggtacaggaacgagtgtcttctccttaacccgccacaccttctttgccttaggtgcgggcagcggcctcttcgtaactgggaacacaggttgaccggcctgtattcccggcttcttggatgccggcttaaggtattgacggttactcgtttcttcctgctccaggaagttcatcatgaaagtattgaggctatccgtccttcggggttttactttgacctccttgtgtttggtccattcttgatctaccccatggagaaatgctccatccttggtctcctcgtggacgatacccattgttattgttcatgagcataacgttctcatgggttttcgggcaatccatcccagagtgaccggtgttgccatagacctcacatgtcgtgtggaagtccagggctttaacggtaccctgcttgttatccttctcattgttgtctagtctcttcataaggagatccaactgggcggcgagcatctccgtcctcttgacggtgtacatgccgcattgacgggtttggagtcgttcctcgctccaacccatatttgagaccatcttctcaattggttggcatctgactattcttgagaagaatgtccctccagcagcagcatccaggtgatcctaggacgagggggttaatcatttgaagaaattctgcaggatgagccactcggccatcccatgatgaggacgggtggtgacgtattcctgcagcctttcccaatcttcaagaatggtttcatccctcgtctgctgaaagctagatattcttccgcgaagagcgttggtcttgcccatcaggaagaatcttgagaggaatgctgttgagcaattgtttcggtattcaccgttgcacggttgatgtagaaccactgttctgctctctcgaggagggagaacggcaacagttggagtctgattcttctgacggtatacgtgctatggctttccacaaattgctgcaaatgagcacttgcatcctccttaggcttgccacagaacgggcaagcctgcgccatcgttaatttagctgg

SEQ ID NO: 62901 - DNA, 1202 bp, Oryza sativa
ttactggatcgagtttgaaattcaattaaccatgcaacggtgattaacactcaattttttgctatgtccaatgtacactgatgtatttaaatagagtattatatcatcggattttctttatttttgaacagttcaaccattttgcctcggcctcatacattatagtgttttgtttttgggtaatataggtgtgggatatgtcatctggtgaagacaacatctatattgttggtggaaccactatatctcttttcaatagcaaaaaccaacttaaaactgggaggctgaggctgagagtatggcccaataaaatggcagatggaagtctctccacctctacccctggcaaggtatataacaagctttattgtctctatatatagatttcagaatgacaaatgtttaactctgtttactaatgttggcatcaggttattttatttatcatgcacttaacacttttttatcaacttaaaggttcccaagaccaagagggaagaaatagagaggttggaaagggttgctaacaagtacatcagagggcagataccacatataggttggctagacaatctcattgcaaatgctgctgataaacttgagaaagagagtgagagaactgaaaatttgcattctagccttattgttgaactatgcagctttgaacacagagttgtctttcaggttgcactatttgactattcagttcttttttgttccaaatttcatggaggtttgctttaataaataatattcttgtctgttatattttaacattatagttaaatatgcatagcgcattggatagcacacatattttgacggaataaattttcattggtattatttgggctgaagaatgctgtattacaaggttttttttttttttttttttttttgcactcaaggatgcattatgtttggtttacttttcaaccttgctctattgctcgtcctggattttgttattgagctagtgcctttattgttcaaaactattgtcactatattaataattctcttgctattctcgattcttgtgtagagccaggatgtttttctttatcttgcatgtcatcatgtcataaaattttctagagtattttactgtcttactattattctttcatgcaggaatatggagcaaagttgcatacatcagtcccttcatccttagtggatatatctaagaataaacttgt

SEQ ID NO: 62902 - DNA, 1758 bp, Oryza sativa
cggagcagagtataccgatagctccggtactcctcccgaattcctcctaggaagctacactcgtcgaggcagaagtcggatgagcgccaaacttctgggcactcctccagagcttcctctcactctctaccttattctaatgtataaaagatacaatagagcctcttgtaattcagctcaaagttgtgtgtgttggaatgagatgaagacctccttacataggctccaaatgacggttaggggcatgggaattgtccaaaacaccctgcaaccgcctctgggaaggaatccaagccgtccacgtggaagcagatggcgaacggccgcagaacgggttcggccgaattggtgggttctgccgaacccaaaaatgtgtcatcccggcctctcctttggccggtaagttgcttaatgggcccccaataacctgcaccatgttttggcccaattttaaatggtttttattgacttatggggcctccaattcgtgtaaacgtgtcctgaatgcgcagaggtgcattttgtcgcatgacggatgtgttttctcctcaaaatacctgcatacacatatttcaccaaaactagtggaaatgattagtaataatacctaccactaagttggataccatgttttatttcattatatgtaggtattgacggtcagatattatgatttaaggaccgtcaacaagtatccgtttccacatcaacgggaaggaagagaagtttgagtttcaaccaaggacagaacaatgctccatggtcaggataaagtacgggccgaacccacagaatattcaagttgttgttggcggttgttaaatgccattctcataccgccaacatctgcataaagtcgagacaataaaacatccaacatagtaataggtgcttaatctcacatattccacaagtgttcgtgtatatttgtatgcagatgataaaccctgaagttgggaggaaaatcagactaaagtgaggagaattatgtatccatacaaggaggggttgtgaacttcattgaaacatcagtaaatcaacccaaaactccgagaaatggatagaggaaggcctaggaagtccaccaaccgaaggccagactaggagggcccagcccaggttcggccgaaccccctggttcggccaaacccttatgatcgccgttgatcccaggttttggcatggacgtcccagatcactccctgatggcggttgcggggcacttcaaacatttccccttcgccaaccgtcatacctacccctatataaagacatcatctcactcacttcaacacacacttccaagcttgagctgaattataagaggctctattgtactatattgtatactagaagaggaagagagtagagtagaagaagttggaagaattccggagttgtcggtaatattctcctatttcttttattatatttattactctgaattcaatataatattcttcttaagtaatttagatttatcttgtgagaattatctctttgttagttcctaaatagcatacgggattattgttcattataatcaactaaaatatagtgattgctttggtgagttataaacactaaagtagatattaattgcttagacgtggtgtttaggtaattattatccagtaattgctgcgtatcatacagtatgttgaggtaggtgtagaggtggtgatagccctcgagatcactgaagtccttcctgtccaggtacatagtagagcgacatctaggaacagcgggttgcca

SEQ ID NO: 62903 - DNA, 757 bp, Oryza sativa
gactacggcaataccctgaactattttagcaagaggaaaccactcgttcctttgccacctccccgggaaaattttttccccccctttaaaatttggggggaaaaaacccttccgggggggttttttccctcgggtacctacgagaaactgtctgggtgttaacatccataatgagcgatgaatggctaagggaggcagagctttcatccgaagtaattcggataaataccgctccccgaatcattccttgctatatggaagggaacgacgtcggtattctctacagtccaattgtcggggccaacctcgtctctgagtcttttgcattcgcttatttaagcgataaggcagtgaccccaacaaacaaatttttcaaacatccgaacggaaatatcattggaggatttgggattgtacaagatgtacctgtctgctttgaagacagggaggcaatcttggatttccacatctttgaaatccaaggctttgacatcctaatcatattgcccattgagcaactcctaatcaacacaccccgattaggtagcctcaaaataacactgggagaaaatgtattctcaattccattctcacgggcaaggatcaccttgaccgaccctctcccagaaattgagtcagcggaagaggttaccgcagttccccttcatgagtctcccgaagcccttttggaagatgagttccccaattttatcaaagaagaagcagatcccggtgagactctcgacctgccaatcat

SEQ ID NO: 62904 - DNA, 1353 bp, Oryza sativa
  unsure (1)..(1353): unsure at all n locations
tgtagatatatggatttgatgtggataaactggatatcagatagtccttcagtaaaaggaacaaaaactcaagattgatgagcccacttaagtcttccagccagtataggtcggcagcttgcttatcacaacatccaccatgcagtgcctaaagttcagcataatccaacaggtgctacctcttttttgatgcctccctagccaaaatggtgtatatatggaagctaggcatgtaacgtctggtttccattatgtgcagaaattccatgcacaagtctttgtatccatccctgagcaatccatcgatgagcactgcctgtacaacgtcatcaggattccaggtcctcatgagcatgttttcaaaagtaatccgggcttcctttcttctgtgtaattggcataaagcacatattaattctttataaccattaaggtggacctcacaaccttgagtagacatatgcttaaatacgcccatagcaaggtcaacgttccggactctcaagagtgagcataataaggaattatatgcctcctgatctgggcataaaccctgactaatcatgcttcctaacaactcatttgcctcaaaccatctcccagctgtacttaagtttgaaactagtgcattctgcacctgaacagataggccaggatccagttctgctaacttagcagacataactgacacagcatcttgatcagtggtttgataaccaaaactgcagtttggaactacatctggcaaggcagcaagtctctggtcagctaataggtactcatttttcaagcctttaatcaaaacaccatatgtccacaatgttggttggcacccagctttatcattcttccaagaaaattaaacgcatgctcaactttccctgacatgatatatgcttcaatcatcttaacataggtaatttcatctggaatgagcccgtgccgctccaattctgcaaacaaattctcagcttcctctaccttgccttcttgacctagagcgcggataagagaactgtaggtaagaagattaggcaaacaaccctgctcaatcatcttgttgaacatttcaagagccaaagatgtggaaccatttttgcacagcccatcaatcattgcagtgtaagtgactacatttggaaatatcccttcttcaatcatcactttacatagttcctctgcaccagaaaaatataattncctgccttttttaaaggtttcaaaggaaacccccaattggggaaaaattttaaaaaggggnaaaaaaacccccgggtttttgctgtatgtctgaacatttggtctgcaaccacttctcttcatatgttccaacaatgatgttgcagtgtccag

SEQ ID NO: 62905 - DNA, 7897 bp, Oryza sativa
tgttgaacatttcaagagccaaagatgtggaaccatttttgcacagcccatcaatcattgcagtgtaagtgactacatttggaaatatcccttcttcaatcatcactttacatagttcctctgcaccagaaaaattattctgcttagtcagaccatgaataagaacgttgtatgtctgaacatttggtctgcaaccacttctcttcatatgttccaacaatgatgttgcagtgtccagtttctcatccttgcagtacccatctatcagtgcagtataggtaacttcattggggcataagccatcatccaccatttcattgaacaatccaaaagccgactccattttgcttatcttgcaaaaaccacatatcagttcggtgtaagaccactcgtcaggtttacatccaccatccctcataaggtctagaatcctaagagcgcttgtagtatttcctgagtcacaatatcctttgatgatggtgttgtatgttacaagattagctgaatgtcctctctgcaacatattgttcatcactaacattgccttcttaggatcaccaagaatgcaatagcccttaatcatttcattgtatgtcacgatgtttggtgaacaaccatttctgcccatcaaatttaaaacaacaaacgcatatttgattctcctgttctcaaccagaatattaatcaaagcattatatgtcactgtattagggaacacaccatctctagacatcctatgaaacagtccaatggccactttcaataaacctgacacacaaagaccactgataagtgccgtgtatgtatacacatttggttcacaccccttatttttcatatcaacgaacaacctccaggcatcttcatagcaccccatgtcacataatgcaataatagggccagtacaagtgtgcgctgtcggcagaataccatgcaatatcatctccctaatcaaatcaaatgcctcgttaaccctcccactatcacataacccattgattaatgtcgagtatgttactgtgtttggctcacagccctccttagccatctggttgaaaacctgcaatgctgaatccaagtcatgtttcctacagtgaccaagaatcatggacgtgtaggtgaacgtgtcagggctcatctcggattcgaacaccttcttcatgattgtctctgcatccgctacattgccatccttgcacaatgcattgattacagcattgtagataagtaaatttggctgtacaccctcgctcagcatgcggtggtacctgtccatgacggcagcagtcattccaagcctgctcagatggatcaacagggcgctatatgcgaagagacccatcctgaggccgctttggctgagcatatccaggaaactcatcgtcctcgccatcgcctccttgctgtggcaggacttgatcaggtggatgcgcgcgcgccccgcggcagcataccggcgcgcgtccacaaggcgcctggcgagcgcggcgaacgtgcccggccggtacgagtgcgagcgctcccgcgacaagaaaagcaggaggtcgaggcctcgcgcggcgatcgggtgcgactccgccacggaagcggcctgcgcgggcgtgagggaggcgagcgcggcgctccggtgccagtccggccgcgccagcgcccgatgggccctcctgatcagggcgtcgtcgcccggatcctgattcctccgcccgctaacgccccccgggtccacgggaagtggccgctcagatcctaggccccgagacgaggaggagaaggcggagacgaggaggacgagcgacctcaggcgggcggcgcgcgggggaggccagagggggcggagacgagagggaggcagcgactggaggggcgctgccatggggaggatgaggaggtggcaggtggcggcgacgaatggcggaggtagaggccgcgcgcgccgtttcgccgccgctccgctcggcgccccgccgccgccgctcccctccgccgcgccgccgtcgtccacggcttccgccccgacgaggagaggtggaagctggggcggcgtcgactgaagacctcgccggcctcgcccgttccccgctcccgctccgctgagagccccgccgccgtcgccgccccgtcgccgtcctcgatccgccgccgccgccctcaatccgccctcgatccgccgccgccgccgtcgccgctcgggccgtcccggcgctcgcgcctcgcgccgcccgaccgctccgtcgccgctcggaccgccggccgccgcccctcacccctggcccgagtggggaaagagagagagagagagcggagaggaagatgagaaaggaaagagagagagagaggagagaggggaggatgaaaaggtaaaagggttaatttgatgagtaaatttgattggtggcacagaaattgtcctagtaccaaaaaaaaatggcacagaaaatttatgctttcatttgaaagcacagctccgttaaaatcttctggtttatagcactcccgtctcctttagatataatggtggaactagggatgaaattgccctcactgtcccacaccagaatacaccgatttcctttccctcgttcccttctctctgtgtgctctctacggcagcggtggcgcctgctcgtgcggcatgaccacttcgtcggctacccgaatatcggccatccacgaataactgcggcggcacgggtgcggcgtccaagcccagcagcgcggagctcgtcccagcgggcactgtctcccatggagtcctcgctgacgccgatgtcgctgtgacgcccaaaatagcaagaacaaaagaaatgcgaaaacaacagtatcgttggttggctttgagcaagcaacagcagtagcagccagccaagccgtgcagtccccatccaacaacaaagtcgtcatcgtcgtggtgcttggcctcctcgagcacccaggcgtaggtgtcaacagctagtactacagaaggcagtgaggaggttcggatccaaaagcatggcgaacgggctccgacgatagcggcgcggtcaaacgagctcgcgaccgtagagacatggttgcgcgggctagatggcagccatggcaacgtggccacacgggatagacggtgccgtggcgtacgggctcgccgccatgccgtcgcgcttggagagaagcgaacaaggcagcagaaggaagatggtgaaacaaaggtccttttagtctttctgcattccgattcctttgactaatggctaaactgacagaagtgctgtaaaatcaaaaaaaattgacggagctgtgctttcaaacggaggcataaattttttgtgttattttctggcactgggtgaatagctgggctatcaatcgaatttcctctattttgattcatgccattgcaaatgtggctattcagaaaaatgtcattataattcgactattcgtaaccgtgccacttcaattttacaaaattaaagccatgccactgtcatcaccttttccatccatcctcttcctttccgtcttcttcctcacgccgctcgggttcgctggcactagtgctagccattactacagatgggcacggagctgatccacgcgcgcgacgccggcagtgcggttaccgttgcgcacgacgtcgatggatgggttcacgccgccgccgcagctacctccatgtcctcgtcatctgcgctcaccttcgacggccacggcgaggagcacaacgcaattcgtggatggacatggacatggacgcccacgccaccgagctgcaactaatcggccatggcctgacggcgacgacctcctcctcctcctgcttcagctccggcggttccggcgacaacggcatggtgattgtgacaaccaccccgaagagcgctgccgcctctggttcgcagaagcgggcacgcacgccgtcgtcgccgtcgcagggagcagagctgctcgagtactccaagaagcagcgcgccaacaacatggagacacagagctcaactgccaaggtactacattacattgcatccatgtcgacgatctatgaacaaaatgttgcagtgttcatcagttggagatgcaagttctccgacgaattgaattgaactgaacgcataattgtgtttgttttggcatatgcagagccagcacgagaggaaggagatgcgtgagaggattagcgagaggaaggagacacgtgtgcccattctactcgacctctagctctgcgccgccaccgccgccgaccgcgccgactccgacgaggcctacgtgtttgaggccaagacggtgcgccacatggagctgctcgtgtagattggaggtggcctcgccaccggccttcggcgtgggccgccgcggcgttgctcgtgacggccagatggtgcggcggtggcgacgacgaccacgagctcctagccctcatcgatgcctccaaggtcagtagtaatggctagcactagcgccggcgagcccgagcgacgtgaggaagaagacagaaaggaagaggatggatggaaaaaggggacggcagtggcatagttataatttcgtaaaattggagtgacactgttacgaatagacgaattgtaatggcatttttctgaatagtcacatttgcaatggcatagatcaaattaacccaaagtaaaaaaggtggtacgggtgggtccaaccacaagcaacttgctacacttgcaatgtgggtgtagtgtcttttggagttcccaagcctacatggcagctgtggcattgcaatttgctaggacgcattgctaccgcccttagggtcggagagacggtggcacccaggtgcgcccggctgatgcttgccacttgccatttgcaagaggtgtaggtcggtcaagtgcagtatctatgatccgttaccatcggacggtcattttttccatctttctcctcccttttgtttttcccccaacttctcttctccattgaccaccaagcgtttgttactagggtttgtaaatttgtcgaaaatcactcaaactttgaacctatatccaactcaaatataaattttgataggattcaatataattctgaacgaaactcataaattcatgtagttcaatggggtcgtattctaaactgttcaaacttgtaaacccaacgtgagccgccaagagttgtgacaccatctcccttgtacactgatgtcatgaggcgataaggtccaaaatggagagaggtggggtagcaaaccatggtgtattgagaggtgagggacaaggtgattttgtggtcagcaaggggtagttgtcgtccaagctacggcgatgtatggtcgtacgttggtggtggtggaacattgtatcgccgcaagggatacaattgaggtcgagggtaccgtggtgcagtgagaggtggtggacatggtgattttgtggtcaacaaggggtggttgtcgcccaatctacagcgatgtatggtcgtacgatggcggtgatggaacgttgcatcaccgtagggaatacgatggaggccgatggtaccgtggttgccatgctgaatgaagaataggtggtggctttagagcgaactggcatggagaaaatactagccaacacttcccggcgacgggcggagtgtcgtccgcgatcggtgtggcagggacaaaatgagcggcgaaggttgtcgtgcctgtggcactgacaagtgccatgaacgacgttattcccatgacttctactacgacatggctttcggcaggggttgatagtgctactactttgcttgccttcgttggtgggaggacatgtaaatgtctatgttgtaactggttttatagtactgattgttgccggcttcacgctttgtggtatgttgagtgttgttggcttctctagcgtgctaggaccgacggtagtgggcagcgtgggagtcgacatggcgggtttgaaaaacgggatggtagacaggagtagcatggttgttagcttccagggtgtggatggtggcatggcaggcaaggaggcattggtaagtaggaaatttgctgtaggggctactgcctgcagtgagagtgctgttgtggcccaaccgtggcctttggtgatggcacatgatggttcccccagtgtgtcaacaggaaggattaaagtccttgcaagcagggcaacgtccacaagatatccgggagtattgcaaggaagtgttgtgttccaaggtggtggagtgatggctcaagaacaaatggcaggtatgggtcgagagattggcattggtagcggcggacgacgagaaaaaaaataaggtgtggcagaaaaacaacataacactaggcaaaatggtctagatttgcaatgtgttcccaaacactgctaaaagttttcacaaaaattgttttgatgtaaaaaatcatattgatctgtgtcgtggttcaaaaattcctgaacaaaaattccaaatttttggagatttttaagaaggatgccaatttagcaaaatctatccatatttgtccaaattatgtccacatttcaaattatttcagaaagatagaaattgccaaatcgatatattgaaccttaatccaggttgtgtcatgtaacaagctaacaaccggttcttatatatagtcagctaattatgagtgaaaaataaacgatatatgtggttgcttatgtaactaagtacgaacaaccaacgcttatatagtcagctaattacaaggagagtgaaaacaagataattggtgaagaagttaatcatgtactccgccactagctaacaaaatcaatgtatggcgagcgccatatctcgccgtaccagaagctccgccactagacactagagatatgggtggtaaggctaaatgttggtattgttatcattgcactacacaaagggccatacccttagcgagtactagttatcgtgcacgtgcaaggcacgttttgtttatatatagagagagagataacaataatgacctaaaaaatagtgcactacaaaaaaatcttgacttctcaaggtaaaaatagaatttcatacaccatagtaaaatgataatttggattattcctataaaatcttttctggtgaatcacactaccttctagccaacaaaggtacatatatattcacaatgtaaaaagtagccattcccatattccacatcaaattatagtatagaaatgaaatccatggggaaaaaaaggcattagcattcttgtcaagattgactgcaaaaaacatcaagatttgaatacaaaagacatgctaaaaactctcttggtaaaaaaagagatgaaatccttacatgatataatctaatttttcgaacattgctcgcaaatcagttgatatattcattgtttaacaaagttgcaaatgcatggcattactttctagtaagtaaaaggaattgcaatttcatgtactacaagatattaagaaattagaggaagctaaagaatgtaaagatgaatggtctctcacaaccagctattttttgttcaagtaaacaggtttggtctatcttcagcaaacaatgaaggtcttccaaatctgtataaagaaggccaaaaaacatgaagaaaataataccctgcgatggcaggaaaaaaatttaatttggttgtcatagttctaatttcctaagaaatctatacatttcagttaaccctattctgatagcagatgagtggctggggtgacatattgatataagtttcctggacaatgatggcaacttggcagggtcatgtatacaaatactcacaactccaataggagttgcacttagggcactctttaattatttgataaaaaggggtaatttagagtccaaatttcttttaacttcatattggtattgcattcaactaagcacaccttccctccttatcaaagtagaaataaaaaattctggaactggataaatatttctagaaca

SEQ ID NO: 62906 - DNA, 2215 bp, Oryza sativa
  unsure (1)..(2215): unsure at all n locations
gctaacgtgctcataggtcgaaacactatcttgccctgagaattttgtgaaatctggaactttgaaccggttaggcaatggaaccctctcgaaccactcagggtttggatgccgatacaagtttctagcgtcctttggcttgagcccaaattgctctctcatcacatctgcaatcatattggcccacggtctctgttgaggcaccccctgcacttgctgtggcacaggctcgaactggttgtactgaggagcgaaccgaggctgagccgaccctccttgctgatactgaacttgcggcgatggaggctgatactgataattcaaattgcccccttgataattctgaaagtttggctgtatattgtgcaccaaatgtttgggaataacttgtggtatcaccgatcgatctggttgcacattatgaaccaaatgctctggaacaacttgatttgcaatgtgctgccttggctgattatcgggcgtcctaaacccaaccgatgcatttagcaaaccttgctgttgaatcggctgagcaacttgctgcctcggtggtgtctgctgaatcgactgctgttgaactgggtcagcagtaggccgagttggtaagaacatagctgcaacttgctcttgagttagccgattcacattttgtccactatgctgtggctgctctctcaccaacaaccgaggattaattaattgccctggtgctgatcatggtgcagcaggtgcaggagccgacactggtgctgtcggttgaactgatggcgcattgggagcaattggctgagcagtcggctgattatttgtgatcaagggccgataatttgggaaaacacctcctggtaaataaactggtcctgtagcctgatactcagctattgagccatcaaccatcgacttcacgatgtttgacaaagtattgactaacactccagattgattaatcaaagcatgtcgcacagtatagtcaatccgatcttggaagttgttaaactgtagctgcgccaggttgccatctgggctaagatcctcaccttgcactccctgagaaccatcacccttatcacctgagccatctgcagcacttttatcacctgattgagccgtaccatctgagacctgttgtacctccccatccttggaagaacttgtcgcagcaacatcagcatctaatttcatcttgtacctctgaacaattgttccttggcgagtctccatgaatgagttcaagaattggttctgtgtttgctacatcatcgcctcaagatccttcttttgttcaggtgtcaatttgtccaaaatgatgagcatgatgttgctctcatgaacttcagacccaccaaacttcgggatcctagttttggaagaaacttctttgccggccaaagacggcgatgctggtggtttctcagccatgagagaatactgttgcggttctgacttctaatggtcccaccaggcgtgccaaaagcgtgttgatgtaaaaacacgaggtctgggagatctgcttaactccagtgcaggtccaaaacttgcctttgggtgtgtgagcgtgccagttgatttgatcctgcgatcaannagngnccnagacaaagaaaccgcggttaaatctataaacgatagccgatcggctagatgccgatgacatatcattgatctttgagccgatgtcatatatgcatcgatcggcagacattaataagtaagaaagaactaaatctacttgatcagctgttgatattaacaatatataatccttatgtcgatatatacttaaatcaagtgattgggataaattggtcgccatgccgagacagtataaatcacttagaccgaaatatatattaacaacaagattatatatgttcataacatagccgatcagatagatctagcatgtatcggctaatactccgataccgttctatattgagatattaaagcaagtagaatataccaaacagaaagcttaatatacttaaatacgacgagatcttaacataaagggtggatttaacatgtcaatcaagcacataagataaatatagtcaaatcagataagatcggctgaaaccccgatgctaccctaattggcaaccaaaggcaggctagagattgagattctaatcacgactcatacgatcaaactcaacagatgcatctataagtatgaaaaaaaagacaatatctagacaatcaagccgttgga

SEQ ID NO: 62907 - DNA, 7012 bp, Oryza sativa
gggtggctatgcaccgagattgatttgaacgtgtgttagttttattacatggggctcggggtctatttatacccgagattacaaaatatgtccatatcgggcatgactcttatctctaacaaactctaagatactataagtctttgcggcagacatttgcccaaacatatctctaaagaaattacataaaatatcctaattaataaatacaattgccttctcaggactccatccatgcgtggcaatcatcatgaagcactatacaattgccttctcaggactccatccatgcgtggaaatcatcatgaagcacgtcaacctaacccgacaacgtatgccgtgtcatattatcggattcggctcaatcggctaaccctgtccaactcgaactctgccgatcctagtcgcagccgattcggacatcagccgattctgctctattcctcgagcgattccatcttaatttccacctcggtctcaactccatctccaatacttagattaccaaatttggtcgttaacaacaatatagtacaatagagcctcttataatttagctcaagcttggaagtgtgtgttgaagtgagtgagatgatgtctttatataggggtaggtatgacggttggcgaaggggaaatgtccgaagtgccccgcaaccgccatcagggcgtgatctgggacgtccatgccaaaacctgggatcaacggcgatcaccagcaggggcggagccagagcaaaatcaaggggggttcctacagctttcttttgtatatagccgcatatctagttggaacactattatggagtactaaatactcgtgtgtctaataactgtaaacatcattatctaattgatagcaatatacaacaagaaaatacataaatatttagaaattgtgtaccttaacaaagaaaccaactaataaatatacacgaagttactaaagtgtcaagcacagacacaaagtcactattcacaaaacatatcagtagatcgtataaaacctattcaagacaagatgaaaattttcaagattgaagaaataaggttgagaagtgaggggaaatctcacttgctctcaattggaggttgtcggtggattgggagagaccagaggcccagagccaaggagagctaatcttggatgaaacgtcggcaccaagttgccgtccaacagctcagaggctccaactcaagcaacaatgtatcatccctgttagacaactagacaagatcacacaatgcaacgattaaacttcaaagggcagaagctcgggctgctcggctcgccctagctaaaaccagtcatcacgggcagagcggcaaaatcaggagtgccgagcagcaggagcacggtgaccttggggcttggggcacagtgtcaattggcgtcggcgatttgaatcaggctgccgccggaacggaggcagccggcgagattgcgagagcgaggaggcgcgtacagcgaacttgattatcctgaagacgaaacgatgtgttgtgctaatgcccgcttgaccgcgtcgtgactcccatgattgtgaggcttccagggcaagcctcgagcagcgcaaaggactccatcgaatgggcctgcctgtgtttgtgtctgctgcttgcctacttgggccttttccattctgggctggacaagaagggggttccttggtttgggctgagggggttcctacatggtgaaactataggggtaacaagtgatttccaagtttgggccgggttcctgggaatccccctcagcttattgggctccgcccctgatcactagggttcggccgaacctgggttgggccctcctggtctggccttcggttggtggacttcctgggccttcctgtttccatttctcggagttttgggttcatttactgatgtttcaatgaagttcacaacccctccttgtatggatacataattctcctcactttagtctgattttcctcccaacttcaaggtttatcatctgcatacaaatatacaccaacacttgtggaatatgtgagattaagcacctattactatgttggatgttttattgtctcgactttatgcagatgttggaggtatgagaatggcatttaacaaccgccaacaaaacccctgtcacgtcccaaaacgactctaaaatatatcccttaaatgatgcctagaataattaaaatccatgtgaaagcctccaacaattaaaatgtgcaaagttaaaagtcaaataaggcttagaggatttttgtaaatttcctaaaagcctaaaatgcgtaaataaattttagtggaattttcagagcacaaataataattattaagaaataaacaaagttaaaatgattttataaaaagaaaaaccctaaaagtcccccttccctcccttgggccggcccggcccatctccctcctcctctctctcctctccccgctgcccactcggcctctccccgcgcgcgcgccgctgacgggcgggcccgcccgccaccctcgctgacgggtggggcccacccgtcatccccttcctcccgccgctcccgccgcctcccccgcgccctagcgccgccgccgctgcaaatcctgccgcctcctgccgtccccgcgtgcaataaagtggggggaataactccccgtgatcccctctccctttccccccatttttccctctctctctctcgcgttcaaacgggcggatttgcccacgcaaatctcgccggcgccattgatggcggccggacctcccgcgccggtttccttccactccggccgctctctcccccttccaaccctatttaaaccctccccgcacctcctccgtccgtttccgcctctcgccgcccttcctcctcgccggattcgagctcgcgacgttgctctctctctccgccgtcgccgccgagctccggtccgccgtcatcgtcgccccggaccgcctcccacctcggcgccgcctccttcgggttcgccgcatcctcgccaaccttgtccacctctctgtttcggtcgccgaccgccggaacgccgtcgaccccgtcgacccgagccgcgccgccgcctccctccgctccggccgcctcctccgtcgccgccatcgccccggggtgagccgtggaccatcgcctcctttcccccttcccacccctctctcggccgccgctccgccgcgccggtggtcgccggcggcgaccatcgggtcgcgagcacgccgtctcccgccgaccgtgccggcatggccgccctcgggcgcgccgagtggctaccgcgtggggcccggccgtcagccgcccgcgccctcgggtgcggctgacgcgtgggacccacggcgccggccggtgtgagcccgggtgcgcccggtccaccgtggaccgtgaggctgccgcgtgggccccactctcgtggaccccgtccgcgcgccccctcccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaacgcccttttattttccattggtcgtgtagacgttgcagcttcggaagatccgctcttcgtggaggttgaagccgacgtttgggaaagtgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgttattgttaatatttccttgttcaccctagaataaacaaaaccccaactagtagacactctactcatggtaccactagtatgattttaggtagatgcttcgctggttaattaggcaacattaggtggttttacaactctagactttgggaatattctcatcacctggacaatatggaatggttggattattgtggaattggattcacacctccccctctattcaaaaccctcaaaatggttttaggctgggcttggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggatgaagtcgggggtcgatggacatctctagggcaaatgaaggctacatgagctgcggcccggtagtcgagatgtcatggcacagggccggtgtcctgctactaggggctcagtcctgcctacctgtcccagaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcatgcctagcaatgtacccaagttagtgttttaattcttaaaacctgcttaacaactaaaatgtggaatagttggcctgggttggcttgggacgagctgggacccagggtcgggttgccagttcggtctgaatcatcgtaggccttgggttaaggcaggttcgtgtgggttcacggccttgtttaataatattgtatagctctagaatcgtgtttacaaaatagcgttgagcaactaagtgtcttttaatgctgtttactgcaaaccctaaccctttatattataacccccttgtactcccttgcatttattctgcacttgtgggtgtgtcttgttgagtacggtggttgtactcagtcttgctcaatttttcccaaacccagaagaggagcccctggaagatgaaggctttggtgtctagctcgtgcctgccgtcaaacgcctatggtcgtcgccctagtcttccgctgtttttcgtttgtcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacaaccccccacacttagccctttgctcgtccctgagtaaaggttagtgtagaataaatttcttcaagatatgaatcaagcatataaatcattcacaaccatacctgcacctgtgaactttatcagtggctatcttaccatcttgagtaattgataaatggaacgatcttgattctagtccttcttgcttctctgttacactcatgggatttttttataaattttcgcaaataagctcttctcctattgacttcctctcttgtctctcaagaatgtatattttctttttggatccttaccaaagcaaaatgtgccataattcattcctattctaaggttaatatgtggagcttggtagggataaactgtgacatacctgcatcatatatattgcaaagccaaaaatatggactcaagaagatcatcatactcctagatcaagggtctttatttatggtggaaaatgaaaaagtaaaatatgttgtggaatggtggaataaagaaatgattatccctttttcctatactttctctccaaattggttctcttggcatgattgtggaaggggcatggctacatttttctttccaactttgctcaatgttttgagagcaagctttatttccttctcttttttttagccatgcctttccctccttttatcattttctttttgccaagaacttttcaaggagaagaaagtataattcaatgtaggagtttatttgaatggatatttttgtggaaagccaactttcagtgtagaagcttggcttaattttatatgtggaaatgaaagtggaattgaccacttgatcatgagagtatgaaggatatctaacatgagtcacacgaatttgacaaagctcaatataatgtcaagcagtcatatgcatgataaggttcatcaatgatatacttgcatatggtcttggtaggcataagatgaagtcaattagaggattgagcttttaaaacaattttattttgaaaacaaattcccaagagtcataacaagagttgcaagaattcctttcatctcgaatcatctctcatatagcaattacttagatgcataaggttccctaaacatggatggttgttcacaaacacaagttcagctgggaataatgaatatacaagatcaatcacatgaagaatttcatgagttggaagttttatctttcatttatgcttgaaccaattgttttctgaattttcagctctagtactataccatggtggagatatacagataaaagacgtgctcacctgcttacctgtaaaaattgggagaggttggggccagtcttggttcggccgaaccactctggtgcccaatccctttgcaattttctgcagagttgagtgctttcaggtgttcagagatttcatcaattttcagagcatatgcacgtcagaagctgggatatctccccacacttattcaaaacctgaatctttattaaacataaaacaaaaacaaaccttggcaaacattggggttaacaccaatgtgccacattattcatagcaagtgcttacatgattggaaaataaaaaccaagcacctactaccattttattcatgggaaaggactaattagcataatacttattttcctttcccagctctacgaatgcacgcttgatttaagcgcacaaaccgagactaagggtgtcgaaattgtttctaatttcagcaagctctacccctagctccgcgttgcaatccctaagctctatgtt

SEQ ID NO: 62908 - DNA, 1585 bp, Oryza sativa
gaatgtactcgcagttgcgagacttagggaaaggtcccatgaagtctatacctcacacatcaaatatctcgatttgcaaattgtatgtgaggggcattgcatcgcgagcagtgattcctccttgcctctggtagcttgtgcatcttctgacgaattcttttgagtcttcgtacattgttggtcagaagaaaccactttgccaaatcttggcctgggtgcggaatgcaccgtattggccaccgtagggtgaggcgtggcatcgttctatgatcttaagtccttcatcagttggcacacatcttcgtagtaagccatcagagcagacccgatataggtatggctcatctcatatatgacggcgactttcatatttcagttttcgtttattttcccctggtggtatgtacttggataccatgtagtttactatgttagcataccacgggttagagtcacgaaccgtcatcagcatgtcgtctctcatgaaatcatttatcggttgttcctgcatgttagtgatctgcagtctagacaaatgatctgctacagaattttctactccctttttatctttagtttctaagtcaaattcttggagcagcaaaatccatcttaagaggcgtggtttagcatctttcttagtgagcaggtatttcaaagcggcatgatcagtataaattatcaccttggctcccactaagtaagatctaaacttaccgatagcaaaaacaaccgcgagcagctctttttcagtagttgcataattcaactgagctccggttagagttttgctagcctaacagattgcatgatgctttttatccttggtttggcccaagactgcaccaacggcgaaatcacttgcatcacacataatctcgaagggcagagtccaatcaggaggttgaatgattggagcaaaaacgagtacctttttgagaatttcgaaagattttaggcacgcatcatcgaactcaaagggcgcatccttggctagtaaattgctcagcagcctagcgattgtagagaagtctttgatgaaccttctataaaagccggcatgtcccaagaagctgcagattcctttgatgttcacaggaggaggaaactgatctataacatctattttagcacgatcaacttcaattcctcgttcggacactcgatgcccaagaactatcccttcacggactatgaagtggcacttttcccaattaagcaccaggtccttttcttggcatcgttgtaagactttgtctaaattttgcagacaatgaccgaaagtctttccatagaccgagaagtcatccatgaagacttccatgatgtcttcgatcatgtccaagaaaatatacatcatacatctttggaaagatgcaggagcgttacatagtccgaaggacatcctacggtatgcataggtgccatacgaacatgtgaacatagtcttgctttggtcctccggatggataggaatttgatgatacccggaatacccatcaatgaaatagaagaaggaatgatttgccagccgttccaacatttcatcaatgaagggtagcgggaaatgatccttttttgtagc

SEQ ID NO: 62909 - DNA, 905 bp, Oryza sativa
ttcctaactggaatttcgtacttactttggatccaagcagtatttggtttctttgtgcgaatcatcaagatcaattgacttcttgtttgagttaggtctatcaaaaccctcattcttaacatccccatagtaacccctatccttccgttttgaagaaggcactattgttggatcatggcatgcattagattcaccaccagcagcagcaacctctcgtctggtgttatgcaggtcaatcagaatcttgcccaacaaacggcgtgcaatctgaagaaaaggacatgagaaacatcataagttgcttctgctcattctgatcaggggaagatcacaagcaaagctacagatgctgctgctggacctcctgacctgagaacatttgcttatgcaccaacaagatctaccaccagccgttttgatcagagtgaaaacacgcgcaaagctatgtgcactgcggacagccctcctgatattagcacattcgaatataaacccatgaaaagcgccgtcagacgttcagatgggagcaagttttcaggtgcagcactaaaagcagctagacgaacctctcggagctgattctcacaaaattgtggatgcacctgccagcttccttatctgagcatgtttggatttgcgtatgccttctgtctgcgttcatgatctgagttcaacagaatcatccagcaacaaatgctctcaataaaagtgcattccattttgcccaaagtgcaagcacggctgaggtagctgccattcactactactagctgcagggcttatcagttcagacttcagagctcatccgtatctgcgcaatcagaagcacacatgttctgaagggaagtgctttatcttctcggtttccagaaccaattatgtggcattttgcgagccaaatgtat

SEQ ID NO: 62910 - DNA, 1364 bp, Oryza sativa
attggggactaaggagctcgtcggggcaagttgagaagctcgttggcgcgagcggaggagaggcggatgcgggtctcggacgagcggctacggtcgcaaaggtggcggcgggcgtggacgagcggcggcggtcgcggagacgaggcgaaccggacgagcggcggcggttggttgcggaggcggatgtcggacactgacgaggcggcaaggcgaggcgtgggcgagcggaggccggtctcggaggcgaggcgaggcgcggacgagcggcggccggtcccggaggcgaggcgaggtgcaaaggagcggcggcggccggtcgcggaggcggaggtcggacacgaacgaggcggcggcggtcgcggatgagcggcggcagtcgcgcggaggaggacggagcggcgctgggggagggagcaggcggatgagggacgagcggccgtggcggcgccgcggcagagccgagcgggaggctgcgggagttgacgccgttctgtccgtcgaagtgggatggattggtccggccgatttcggcggaccatctcgtcacggatctaagaggaatattcctctccagggaccatcccatcccactcacctctcaacaaaacacctctaaaagtgggttcatcccatcccatcccatccttgcaaccaaacacttacttacttttaaactttcaaaaattccgtcacatcaaatatttggacacatgcacagagcattaaatgtggacgaaaaaaaaaacaattgcacagtttacatgtaaattgcgagacgaatcttttgagcctaattatgccatgatttgacaatgtggtgctacagtaaacatttgctaatgacggattaattagacttaatagattcgtctcgcattttataggcggatgattatgtaatttgttttattattagactacgtttaatatttcaaatgtgtgtccgtataaaaaaaattgggcgtgaaactaaacacggccaattttcataaatcaacaagctcaagttgcatcatctgacacgcttctttgtcctggccaatttaagagctaatttccagttcattaagtgcttcgcctgtgactgcaccaaagaaaatcaacaagaaacagcaataattgcatttttcaatcaacaagaacaagtcatgattgtcagtaactagcacaaagaaagacaggcgtttaaagcaagaaacaattactagtatccaggttgctttcgtcgaatatattattattgaagttaaatccagacggactttttctatcataaacgcaaaaccccaatatcatgtaccataaaatgccgcttatggcaagaacacgctgaacacaatttcttggctgcgtatcttctgcca

SEQ ID NO: 62911 - DNA, 4271 bp, Oryza sativa
cgagaacagagctcattacaaacaagtacaagttatctgactatcttggataattttctggcaggtacaaaacaatacagcatgcagaactgaaaacattaataagattactaaattaggatatggagtaagaactgttatttgtgatgtttgctttcacccgtttgtctagattgctgcgttttttaagaatagatttgtacccaaatcttctgcacggcaagttatacatgtgatgtaaggctgccttgttttcacatcaaatccgtaacacggtaaacaccaagcaacaaacaagaacaaataaatcttaattatgtactcagagtatcatataatcatcctgtgtgttcttggttcccacaatatcatgtccataagttgaaaagtttgacacaactaagctttgattgtctaacaattacaagttgatagataacagttgcctaatgaaagtaaaatccagtgatcgaaaaaaaaattgatgcacacaaagttaaaacaaagagaacaattaaatattgaaacctaaactccaaaataactaaatctacttaccttcaaggcacaaaacctgttcggtttaacttcaaagttagatatatgcttcataatggcatctagcagaatccgcattttgtcattgtaaccacctactgagaccttacatagaaagtaaaaatgtttttagttctaattcaaactgtcctaataaagcaacctcatgatgcatgacaattctatcagacagcataacaattttacaatgaattttttttttggctggaacactccttggaaactaaatgagaacaataaagtagttcactgactaaacctggaatccagcagaagtgcgatatattgaatagaataaaccagcaatttgagcatcatacgctgcaaaaggcacaaacattttgtaaatttatgtttgaacttacagttggtgggagtagtaatacccaaatgggttattaatgtacggataaatatgctaatatttacactatttgtgaagtggtgcttaccatatgcattcaagtaatcagctaacaaatcaacaaagagactcgtagaaatgactgcctcgggggaatggcttgttaacggacagtggaaatcaattataatgtgaacctttggagtggagaacagcatgtcaggcttataccacaaccgtgaaagtggtgtctttctcaatattgctggatatttaacctgcaaacatttattttgtaagagatatttactatattcaagattcagcaattcatttagaactgtgctaatgtggggaaaaaacacagatgaggtgatctgaatccaaccttttcatgcgcttctttgagcgataaatcttttggaatgaaaatgttaggctttgggatacagagcttctcagtaggagctttttgaatccattgctgccaaagtagaacaatcactgacaatatgttctagcatattatctctatggattataacaagtgtccacattctaacagtatgtaatgtgcaataagataagaggaaaactctagttcaaaaaatcaagattattcaaaaaggacaaacctgtatcatggaaggagtaacattttcaacagaatacgctgtactataccatggctcaacagaatcagtagatcctttgaactttttagattcccacagtatcctggagacggagagagagaaatattacataaaaggaagaggaaagtcacaatatttagcttcatatggtatttttaagtgccaaactggatatctgtcagcttgtcagaaaataagtgggcaagtaaatataatgactaattttgggcataactttctaaggtcgcatatctggtagaagttgaaaccagtagggataactttctaaggtcgcatatctggaagaagttgaaaccagtagggatggcaaataatgatgcataattcttaaacctattaccactttttacttcagaaaagaacgaattcagaaatgtttgtgtgttgagatacctaaatagtagatactgtaaatagataggaggaacaaacaatgctgccatgtgaactgcataaatgtaccttactctttcagctgacaactcatcaagtatcatatttattctatttggagcatacttggacggtagtgatgctccaaccagccattcttctggtgggaataactgcaagcagtccaaaagatctttcatattgaagatagctaatggactacagatgaaaggtgcatttctccaacatatgtcagtccaacagagaaaatttagacgatagaatagttggtaatcggtgttatcacataatgctttgctggaggtgtatcagtaatgaatagaattgatcatatggaatagcaaacgatacattatgtacttaatgaggtattgagaagtatacccgcatggttgagacagtatctgtcacatagctgattggatggactttgtcctgatagtggaattccgtttcatttatcgccacaagctaacacatccaaaaacatgttaccatcacatttagtttatctatttaaatcatcccaatatgcttaaggcatgcagaaaaagattgatactataaataagtgaagttgatgatgagatgataaattgaaacataatgaggtcttgctaaaagaaagtacgactcatgcaaatgtttctttttttttggagcgtgactcgtatacaaatggttgtagtgtatcattaattgatagagtctattgtccagaattagaaggacatctgtcctgaaccctcataagttttcaaaactaacaggtccaattcaaatggaaaatataccatttgttaaccaaaatttatattcgttatagaattcactgaatgattaaaaccagtaaaatattccccaaaaaagtcaactgacgttgctaaagaaaacttttcctatcaaagatatgcaaagataagaaactcaattatgtggaataactcttgtttgggtaattttggatctctcaaggaaaatatcagaatgtcatacaagtatcagaacttctaaccataaaacatggatttacacattgcgtaagtccatgttcttttcaattacctcatcaaagatccactcatggatcccattttcttttagtagaagaatatatttgaaaaccaagccaatgatgtcttccatgtgttctgaaatcattgcatgtgcacgcaagaggcttaaataataacaacatgtgcttaaaacaaaatagccatgttagttctaattaaagatagaagctgaccatgaccagcatcggtgagcctcatgctaattgaaaaaaaggagtattgagcactgtcactgccctccccggccgacaaattcatagcccatcctaaagtagtcaaaattgagcatatgtcacatgtagaaagaataaactagagtgactatgagtagataaggaaggcaaaagtgtggtacagcaatcaactggtgaatgtacttgcctagttcctttataatatggaagatggatccctcgccttcatgcccaattaagtgactcagataacgggaaggaccttctttgtaaaagtggatgttgggtgtaacgggccatgatatttttaggtaatcgccttcagatatcgggattgctttgataacaagctgcacggcaaatttcatgttatttaccatcaattttttttcccgaaccatcgcatatattttatttttagtgattgttgcaagtattccaacttctccatctaccacaattggtgttgctcaagtttctacctgcatatgctgctctgaaagaggttgacttgggcatttgaagcttctctgatcagtgttttttatgtcactaaacaagcgctcaacaaagctttggatgcaatccaggctctctacccaaaaaaaaaaaaaaacctcagtaacagataagtttgtgtgagaatggactaaccagtaatatttaccctttccataaacaacaaggtgcatcaggtttgctgaataattctcatagaacttcagaagctcctgtctaatgtccaatcccctctcttttggttttgtttctagcgtttcccaactccctgatgaattaaatgacaaattaggaataagaaaacaaccaaacatttaacttgtttcctaaattcaaatagtatttcatgcaaacaagatatgatcaccataagagagtagctaattacgatgcacagcaattgataggacaactgaccattatctgatatgaatttagattttagact

SEQ ID NO: 62912 - DNA, 22114 bp, Oryza sativa
caatttgtgaacacaactgtttgcataccagtactgaatttatgataggggtgatcctttgaagccagatgtttttggagctgcatggggaaaagtggaaaattaggtaatagtgaagcatgtgctatgagattcaaagcaaaggaatggaaagtactgtacatgctattttttactttctttttttattggaggaccattaacgtgtgtatagtctcaccaattgtttatatatatatttatataaggaaacatgccttgtaaataaagaatatatacatattctgtgagtgaaaaggatacataatcctatgctttaatggttgtagcttctgatacagtcatacagatttcacagtgttgcaaggaagaatacatgacacatcaactaccaaatttgaaatgttgcagtacctgatacattctccagccatcagacaacaagtttttcttgtgttctaggacgaaacaaagcaaagttagccaaaatatatgcttattgctactccaaattaaacaactgtgagttttgaagcgatttttatagggttgtagttatgtcatgttaactacccacattataagaagcataatacgatgttagatacaaatagcatcaccaatcaccatgtgcaaagcgaataatcagaacttaccagaatcaacagccttaatctctctaagaacagcatcttgcgacatcaatggcttaataaaaaactgagcaaatctgcacaaccgagccaccaatttgttattttccaataaaaagcatgacaatcttcagaacaaacccccaccatattcaacacagacacacacgcacacacatatacaataaatgaactaaaagcactaccaaaaaaatcttacctgtctaatgcttcttcaaaattggccacattgacatcaaaatagaaatttgttgtctccgaacttgtgtaggcattgcaagagccaccatgctgatatttttcacatcaaacaattgtcaaaaatatagtctaggtatgtgatttccaagcattaaaatattttttgatgttcgagaaattgtgcaaggtgtagctcttaaacaacttgcgacagatgacaagatgaggattaaaatgttattgctaatcaggacactgcccctcctcttaaacgtcaccacgacataatgccacgctggcaagcatgggatttcacttcaacagagcacgatgggatataacctgactttaggggaacaaccaaatattaaatagcagttggtctgcagtttgcacacatacaaaccagtttccctttctcgtcatctcttatattgtctcgttgtttgctacatttctactgatctgacatctaaatatgatgtaggtaaccctgaaactgggctgatctcatacaaatctgatgtggttgtgtcagcatatcatgatattgtgtgaataatactttaccccaaaatacaatgaaatgaaatgaagaccagtgtttctttatatttagagttgattaattgaaagtacctctgtgatatacttcgtgtaatcttgttccccagggtatttctcactggcataaaatagcatatgctctgcaaacaagaccacgacaataaatcaagacaagaaaacagataaaagactttaagtcaatccaggaattttcttaattcctgcaggaactgaactgaattgtgtgagaatactatataattactgtgaaatctatgtgttccaaagaatacttttattccttcttaatacaaagatgtgcccctcgcgtattcccaaaaaaaaaatctatgtgttccaaaggatgcctgaatgattactgaattttaaagtccagggtccgggctaacatttgtcatgctaatcattttctccatagtccattccagtacagtttgctttcatcaaacattttgcctttagatgataaacaaaatatttagaaaactatgcaactctctagggtagaatttcaatttaactttacatggtttcatctgcagtataccttcacataggggtgtaagtgggtcagccgcgaacccacttatagatcaaaataagcgggttcgcgcttattttagcctataagtgggtttcgcgggttagccacttacaccgctaccttcacatacatagggttggtactgtcacgaatgtgcagaaagtacccccccccccaagtacttgcaatgaattggtacagtaccccatgtgtaggtgactaggtgtagcgcaggacttacgataaccagtgagccaatgaattggtgcacccctgcgagtgtagctgactgatcctttatcactaaaaggtggaatttactcaccagtcaaaatcaatgcgttggttctgtacatatatagacaaaggtaaagggacatttttgtgagcaagctgacaaaaatcctactaggcaacaacgtgcaggagcagagcaagataaattatttgaagaatgacccgctctatttcctacagtctggccagctgaccatccgtgaataacattgtgccgactaaacgaaataaaaaggcaatatagaagggcgtctgctcgtacatcctgttaataaaagggcgtctgctcgtacatcagaagccacagcataggccgatcatgtgcgtcccgtacgatcaatcacggatgccctcaatggatcacgctgaagaacagagatgacagttccttcatcagaccatcaatgatctgaaccgtcagctgcatgatccgacggccaaaacaagtctgcatttccttcgcagaaaagaattgtacattcaactttatacctatgaaaacgtcattgacccacaaaagtagcagtggggaaaggtcgccgaggaatgagcatcccgattccatgggagacaattcgagaccccggccggatcccaaaaggggattcatccaccatgcggcgcaagcgaatcgcagagaaagggaagcgccaggtgtcctgtcgaaccgaacacgcaagtacccccccccatactgcctactctgattccccactacacgaatccggtggcggattgcgcacacgaaacgaatcgagaaaatcgaagcgaagtgagcggagacgagggacgagaagggagggagggagcggaagcgaacggtggactgaccgaggaagtgggcgaggccctcgagcccctccgggtcgctgaacgagcccacgccaacctccatacacgccgccgcctgcaacgccgaggaattaggggttagttaaacacacgcacacacgcatacgcaccacaccaccaaatcacgcgagaaatcgccgatgaaccgacgagcattctgcaagcgagagcgatcggggagggagagaccttgtcggtttcggagtcgctgatgaggaggcactcgagcgcgttggggagcaccacccggcggtactcccgcttgtcgctccgcgcgcggatgaactccacattgctctccgccggcgccggtgccgccgccgccgccatgtccgctcgctctccgctctccgcctccacagcctctgctctctcttccgctctccgcgcgatactccagtagttctccggggttagattggaggctaagcaagtggggtcttttgctcctcttatctcatctaatctattaaataaatattgacggagtagtacactagcagtgcagactaggccggggtggattggcttgcgcgggtttggtttggacgacgaattaaaaggacgatgaactcgttcgtgtcaccatcgggcttgtgcttttcgaccgccgaatgacgcgcccgcgcctggacgacggagagggtgacgtgacgtggctttagcggtcttgctcccagtgcggattccacgttagtaatcgcgcaccaggacagtcccaacccatagtgtctataagtaatgcctataattctatgtcagtaagacatcacaatataaactacactctacaatctatggttttttaaagtggaccattaataaatacatcatctctcttctctacctatcatatttattcttcatctattataaagacattattctctcccaatacaaaacttgatagtgtataatgcataggttctcttgttgaagctgtgtcttgcatgagacccagtttcttcctctcttcactctctctcttaattaatataatgccatataagctaaaagttctacgtagcaatgtagttaatgccatagacactatcctaggtggaaggttgggactgcacttagagccttcgtttctcccaaatgcagcacccacaccgtccgttctgtgtagctgcgtgcgttttgacgtggccttcggggaaattcacgcttgacgtgacgcggtcgtctcggctgatcggctctctccgagcgaagagattttctaagcgggcgaacgtgcgaagaagatcgtttattgccagaatgcagatagactttgtgattgggtggagagccgtgtcgagtcgacactcgagtctcgagcgtcatatgcgagtgcttccaagcgagcacgacgtggaggtgaagttttacacgatgaccctgcttcttccgtggttcacaaatcacaaagttcacatcgtaattagcacggtgtgttagctaaatgagaaaatatgtatggcatcgacgttcactccttttcatttttctaaagaaaactgctagcttaccgaatagcgtagacttataggcgaagttttgtcaatgagcaattgctaccgttcgcctttcagcaatttcggatgaagtgcattatgagaaagttgtagacacgtcacagctactactatatccaatgacttgcctcctagcattatatatatatactcttattagtaaacatttttttatgaaagtccacgtagtctagtggttatagtgacttaagtagtacccaaagtcctgagttcaaatctcctatggaacaaatttcagattgggttgtttgtggggctaagttccctatttcaattccctatttcaatggccatatatatccggttggatgtagaggccaggtaaaaaataccctttctttaaaaaaattagtataaacatttatgtttgcaatgcaatacttaggccatgtttagttcacactaaacttcccccaactcccaactttccatcacatcacatccaaaatttttctacacacataaactctcaactttttttcaactttccccaaacatctcccaatttcacaaactaaacacaaccttatgtttaatcccacctccttcgaagaacaatcacacataaactcttaacttttttttcaaactaccaattttccccaaacttctcccaatttcaaaaactaaacataaggtccaatttcagaaactaaacacaaacttatgtttgatcccacctccttcgaagaacaatcggaagtactagtgtgataggcaacacaaaggtcatttctattgttatttttaccttttgacgtcgacaaaggccgtagttgcatacttgcacgcgcctatgttcgcattgctcctctaaaaatatgtccgcattgctgaggtgtaatcgcactgtaactgaaggtgtgtgcttttctcacatatcagaggctgatcataatgtaataaatgaacatatatagctaacgcaaatgttataacgtgaaggattatgttgcaacgcgctaaacacaggtccaacactgtatcaaaactcaaaagtttcattcgcagagtatgcgtagccgaaatagtctactattccattatattctagccggcaccagttgcaaatctgcattttacagtgaattgaacaatgaaagtatagctgtcgaatcctctcaagctttctaaagtatttccaaaacagaaagaaaaaggcaccagtgatacacctcactaatgcaaccgttcttcataaacaattcctaaaaggttcatccgtgttgacgtctaaagaatagcagcctaacttgttctcctcgaggaacagccaatccagggctcaatggcaaaaggttgcagccatcacttgggcaagttaatgaagcccgtatatttgctcactgaacagatgaataactacaaataccaacttagtaccggtacttgatatcatctgcaagggctttggccaggagtataatctcatgaggagaatatttgcaacttgcagctgaataaacaccacaagttgcaatatttagttagttttagactgactctggggcgaggaatcagtaataagctccatctctatatcctgctgttttttgagatattcttgagctgttgatgtgacgatcttaatgaagaagttcacaagcacaagccacaccacagtgttccagaccaatgtaaaagagaaattccactgtgtatcctggatatataacataagtggacaaaaaaatgagccaagaaatgggatacatagagaagaaattaatatttgaaactcaatccacgggaccaatgttttgaactgatgacagtaaaataccaacctccatttttgaggatgatgtggccgatgttggtgttgataaatacttatccttcgcactgtggagctttgcaatcacagatggcaaggaggcagaaaacccaggaatgtgaccaaatatccagattaattccttttccataagatacaagagttgattgttgcacaaggagataataaataatgtctgcaaaagagagaaggcaaaatgcatgtgtcagcagcaacttttgggatcatcgacaagacaattcaagtggaatacagtagtaattaattcagttcaatcaggcttggaagttcaaatactgtagactccctgcaaaagtttactgtggcggcaggaatgaaaagagtgcaacgagaaaaatagcactggcttttaacatactttgtatggcaaaattatatatcctgactagaagcaggaactatttatgcggctaagggagaaaaaggaagttatgaaacagataaacaacagaatttctagaatttgactaatgcatggtctggccttttgtttgagagggcttgcaaaattttggtttattttctgaatgggcaaggttgagatagttttgaaattatgatttcaactgaataggactcaggaaaacatgctgacacataatgcaactaagaacgatttgccctgttaagatcattcacattgatgaaaagcgcacccccccccccaaccccccggcgaaaaaaaaagggccccaaagttacgaaacatataaatataagcattaacagaagattagacagacagcaaacctgaatatgggtcttgatgatggccttcccaatcaaagtagcaaagaagaactcccagaagggaatgccaaattgcccacacattataccagcaaggtcaaacagtgggtttggaacctagtaagcacaaagaaaattcattgtatggtaaattatttatccatcagatgttagtacaaaagaaccaagattctccatatcaccaccatctgttagctatggcattgatacggagaatgtccgcttcaactttttttagcaccattagcatcatgcatgcattgcagcagatcataactaatatactataagtctaaaaatataaaatgcataaaaaataattatcctctctaaaacttgtatacaatatacataattatatgagcaaagatgcaaacacacatgacacacgcctacacatatttgcagttacagaagatccggagttggatgggtgtagaacctaccatcaactccagctccctcttttaaagatgcatgagctatctatgttcagagcagtaggcatgactcgagaaagaggcccaaatgaatagtagcttgcatgtttgctagagaatccttatatgtagtttttgcaagaaaatccttactgctacaaataaattggcatgacaagatgggaaaaggacatagactaaccgaagcaagaatcaagatagtaatgaagttgagatgctgagagtgggaaaggagccagcgttttgttcgattgagagtggatgctattggaccatgttcatccgaagcagcagcatccagctccttcacagcttctggttcacttcctgacaaacgagctgcaacacgacacatcatttacttggtgtggttgaatatgacaaaagagacaggaaccaaattcagaaattaatgcatgggccaacacaatcgatcttctagaatttatcacaacactaaccgaagtttccaccacagccctaatttatggctaaaaaataacaagcaaaatcaagggattcataagatgtcaagatacaaagttaataaaattgtatggttaaattcattattaagcccacaaaaggacaaagtaggcaacctgaactttaaaaatgtggtgacaattgttctcaaacacaaaaggtggtcaaagatgacaaacagaaatggagggagcattattgaagttgaagaactatatacagtaatggtggaccatatattttagttgtgtggtactaaaattgatgagatgcagttatatagtgtgcaaggaaagtcaattcataaaaaaaaataatagaaagcagagtaaatcatgtgtacaattacataggttcaccagtactgagacgtgagaaagtgtaaagcatatagctaagcttctttacttaagaaataagcgttatgccatattaccagctcgtgatataaaataaggagggagctccccaagcgctgtgccaatgccccaaagaacagcttccagctgaacctgagggagtaattcaaagactgggatccggacagaatgagccgatgcttggtacactggtggtccaaaatctgaacacttcttgtccagccatgatggcccttgcttaagctgtatggtatcgtatggagcagttttcaaatcaatccgaccacattgaacagccttaatagtgaagagggcaatatgagggcccagatacagaacaaatgtatgcaaacctgaacctgaatttcaaagatattaatcttagttagtaaaaaaaaggatgagctcattttcatccgaagttcaaaatttccaaatttgaaagtcattaaaccagaagagcatccattgcaacaagcctcaagccaataaaaactaaaaaagcatcacttaatatttgctggtggtatatgcttttacacctctaagcccctaaaagttaaccaaagaaatttccagtagctggtcaaaatgatactacagaattatctggaattctgaatatccacaaattctgctcaaaagaacgctgagatacctttctctagattggaaagtaaaaggctaattgcagcagtagccctgtaattgcgaaactttatcccaatgcattaaatctcaaagtaactttagtgtgtaatttggcgatggtgtgccttttgctcttctagcccaatacgagtttttagaagattttttaaaggttcaatgaagtcatagtacataaatttaatgtgattttgttgttaaaattttcctgatatgatagagtttctaggtaagtaataactaataaaatgaaaacaatcattgttttttttcttatgttcatctcttcctaactaaatcatggttagcatgtgctttagtcactttcaacagtgtataagaaacatcagctaaaaatattatagaactagaaaggatataaaataaagtacagtggcacattatttacttccatatatataatggtatgtcataaatttgacagatgctagtaacacttgcctagtccaattgacgaagccacgcctagtgaaacccaccacaacacaaatctagcataattcaggaactcctgcacatgctgcatcagaaaacaaaatcagtattcaagcacaccacaagaagctaacataataaatcagtgcccttattgtcatgtctactcttatcagcacaagcactgcgatcgtaatcaaattacagtgaagtaacacacctttttatgcagaccatctgtaaccgcaagtaaaattccaggagctagcaccaacacaatgaggacaacaaacaaagcacccttactcaggatatatgttgctaatcttttcaagtattgcaacatagctaacatgaaaaaacgtaatgtcctgaatggatgctttgttagtgtcaaattctccagttccaatttgtgtttctcacggatttctgcaaaacgaaaaaaaaaaggtaaggattgaaaatggaacgccaaacatcgactggtccaatatagcaccttagtctacagctctgataataggcaaacctaactacatcaacatgtataatgtagataatattcaaatgactaagtcctgaaccaaagagatcatacaaagcacagatgttggggtccttaactagagaggatttttactgtcttgccagccattgctcatcagctaaataaaaatcaaagtagtaacacaagaaccctactaggatccctagttatcaagggagattggaactgccatcagcaagtgaaccagtccaatgttaaactgccaagttcattgctccaggatgggagaagattcaggaactggcgcacgcagtgcggcaattttacaagactctaaatggtaaaagtatatacatgcaaccaaacaaaattggagatttgattagctttcctctgatttgagttgtaacatatatactttgcagttcaaccagtagattaatgaatagctattcatcgattcgctgtatcagtaagcaccattacattgaagaatgaacagttgtcaatacattggccacaacaatgacctcaagtattctcttatatatatcctaatttaatgtattgcctcaaatacagacttggtgtagcacattccaaaggaaaccaatatcagttcagaatatactaactttccatagacagcatgcatttcttggtgatgtgcatgcaacatgatatagcatataaaacacagaaataacacctctcaattacatagtacacgtgcacaaccagctaggcgtatagcttaaagctgagacggtataggtccccatcgtttggcttatttcctaataagccaaaacggcttattagaaaataaaaatgaatttataggtaaaacttttataaatgtgttattcgtgacttaaagccaatgttgtaaaagaaactacgttgaaaatatctcaaaatcaatctcaaaattaagcttgaaaatttaaattttggctttttctttggctgattaggccatccgatgggagccatatttttgcggggaaagctgagactttgcacgcattaaacactgagagaacaaaaccatgacgcaacatatacacgctacgtcacagtcagctagctgatccaccactgaatccgatcaaatacactgcgtctcatgcttcggatttataggtattccaaatcccacaaaactaaagcgccattcgaaatcgcactcccatcgtatagttccgatcccaacctcacagagcatcccagtagcagcaagctccgatctaaaaaagcccgcaatgccttgacactaccgccaccgcacgcatcgaaaccgaaggcgaaggcgaggatctcaccggatatgacgccgcccccggccttcgacgagccacgcggcggcgtcgcagccgccgccgcggcgaccttccgacgccccatcgctccctccccacccccgaggcgccgaaaaccctagatctcgctgccgcggctgccgccctgcggtaccgaccccaccatgggccgcccagatcgcggggggggggggggggtcgaagctcctaggtctccggccagtcagccggatcgcacgccggaccgggatgagccgccgtccgcgacgccggcggcgagcttgtggtgggtggtggacgcggcgcggcggttccccgtcgagcggctcgtatttatgtccgccccggccgagacgggaggaggaggcgatgggggagggtggggtgttggaaattttctcttcgattttggaggagcaaagcgaggccgttgttttccgttgtggcagaggttgtgggggaatattactcggactcgcgcgctgaccctgcttgcgggacccacgcctcgcctgtcatggtgggccccaccccaccagtgacacgagctcgggataagagccgtgcgcgtggcggagtactggagcgtgtgtgcgcagcgcaggtgaagtgcgcgcgaggtggaagaagcgatccggagaactaactgcaggtgggcccgctgtgtcagtgtgtgcggcgagtggagtacagtacagttgagtgggaagttgggtcttgggtgtaggagtagtcgtttggcgttgcttgcaaggcgctccaatagatactctacactcctcatcgctacacgagtagagaaaaaatactccaatttgataccctgcggaatataaaaggaaggaagatgctgtaccgatctcgatctcccatggaagattagggtgcttcaccatttttgtaagggctcaccagcctctcaggtcactccaatccatgtccacaagaacatgcgtacgtagtggtagttaatactaccagggccatggctagcgacagtactagtgtgtggccctgcagagatctggagattttatattccaatgtcatgtaatgtgacaagaggggacaaaaaggcagttagcaaatgtccaacgtagctgagaatatcgagcgttttggcggttgttttcagctcttgatgcaaagctggagtatatgtctatcatgaaggaaaggatcgattgtatgctatgctttgtacgaatttattttgtcttggaatttttcacttcgcaccattctgtgcttttctgtgtgcacttgctatagttgagtaagggattgggtttgattataaattcgtcattttgagaacgggacgatggatttaaaagagcaataaaggatcagttggagtgccgaactattgatgactggagaagaaattaagaaaagaagctgtagctcatcgatctagtattgatgagcacatgtgctggagtttggcggcctgttggttgtgttttttccaagtatgcaatgaatgggaactgtctcttccagtattaacatgtgggggccttttagatggacatgcgggggccctggtacgacgatgatttttgatcttctaatcaggagataaatgatttcttcattattatgcttccagaaaataattgtcaattcatgatatacatatggagaaaagggaaaaaggcacaacgcgatgagtttggaacattagcttgtggaagatgttaatagatgtggagaaactcccggaaatcatatatgtgaaatcatatacttgtacaattaaagaaacaacttctatgtgcgaatatgaacaattgtctagattcgcccttataagttattcttttccttagagatagagtacagcaaaatttggtaagtaatattgttggaatttgctagcgatctagtagtaacttttttcatcaaaaacaatattttcatcttattaaatttgaattcgagccaaatattgtaccaattataattgttattgaattagacctagggttcatctttttaatgagtgccggaacccaacctaagctgtgtttagtttccttcaaacttccaatttttccatcacattaaatatttggacacatgcatggagcattaaatgtggacgaaaaaaaccaattgcacggtttgcattgaaattgcgagacgaatcttttgagcctaattatgctatgatttgacaatgtggtgctacagtaaacatttgctaatgatgtattaattaggcttaatagattcgtctcgcagtttacaggcggaatctacaattcgttttgttattagtctatgtttaatacttcaaatgtgtgtccgtatacgtcatttttttttgccaaaacaactaaacacggcactagtggtatgacatttttttaacaaactttcattaaattttagtcaaaacttttactgtttcaatttaaattctcaaaaactatttaaaatttcactcaaaatctacttccgttccacatcgaaacctcaaaatttcgtggttttccacaaccctgattggacctccatgtccacaccaacccaattcaactctgacatccaagcgtaacctaataaaagcccatgctagaatctctgaacggacattgatagcttagctactggttatactaataaaatcacattttgcatatcgtgatgggccttgagttgacactacaccacctgatcgcatcgcatcgcttcaaagaatcccaaaatacaggtccaccctaatcacgcttagttgataaacaaagcgccctgacataagcaaagccccacagtttgatcacgctcgttttttggcgattgcaaactgcggtgctacattcatcctaaattttttactacctccgtcataataaacggttattatcttttaaaaagttatcataataaagtagtaattgttccatcaatcatttcttatttatttttttttcaattttatcctcaaccaccctctcatttttggctatacatcatttttttcccatagcatttctccacagctatgtttgagaaatgaggaataaagaagattaagaagatatgcaaaactagataagctattagtacatagtacctccgttttaggttacaagactttctagcattgcccacattcatatatatgttaatgattctagacatatatgtgtgtctagattcattaatatctatatgaatatggacaatgctagaaagtcttataacctgaaacgaacgaagtaataaattaagtattgattattttttaacttgaaaaggataaatatgatttttaaagcaaattttccatagaatttttttttcaaaaaatacaccatttaataatttgtgaagcgtgaacacaaaaagcaatgatcttttcttctctttgttcaagtctcaaacacaatctaaacatagaaatataattataattattttgaaatagaggtagtatatagctatttttttatcggtgtcttgtcctaaaatagaactatttctctacttaccacatcctctcaaacaatcacaaattatttaagttattatcttcagccactttctcttattaactaatcgtaattttcttcccatcatttaaactagctgggtggcccgcgcaattgcgcggctagcacccaaataaaatcatatatttttttagtatgattttacttaaaatttattaaatagctatctcatgtcttaagagtttgaaagattaaaccttatcatccccgtgtttctaattatatatattttaaaagtcacaccagttgctaccccttatgacatctccttctttatttgcttgctcgatctaccactatttctattcattctccttgaaacctttaaaaattggatcttatagtttttagagtttattgtcacgttgggtttcgtttttataatttctagacgtcccgtcaaacgttgccattatattcctctatggcccgtccactgtctcttttctttattgtcattgagattttaaaaatcgaacataattatcgttttggttcatttttactttctagaaatcccgccaaaccgtcaacggctttgccattgtacttctctacggctcgctcgctgcgtcccttctttattttcattgagattttaaaatcgaacatgattatcattgtttttttttactttttcgaagttcggaacctttaaaaattgaaccttatagtttttagagtttattgtcttgttgggtttcattttttatatttttttagaagtctcgtcaaacgatgccactatgctcctttatggcccgtccgccgcctactctttctttattatcattgtgattctaaaaattgagcataactatcgttggaattcattttttattttctagaagtcacgtcaaacatcagcggctctgaaactatactactatacaccccgcccactgcttctcctttttattgtcattgagattttaaaaattgaatatgattatcaatggggtttttttttactttctagtagtcccggcaatcgcattgctcatttgcttcatggcctgcctatcgtccctccttttaatcgtcattaggattctatttggtgttttattaatagtttttatatgtcgtatcaaccgccaccactctactcctttataggcctgttacttaatttatctcgtcatgtgttttagatggtctttctttcaatagtctttatttttatcacaaattttagttatttataaattgtattcaattaaaatcttatttttctttttctaatttcagaatttatttttttcaaattttaattattatcgtattgtgttcttttagtatttttattttaattttttattttcaatttcagttgtttcaaaattgtattcctacttgaactctcttttaatttttctaaatttgaatattattttattttttattctgaattttaattaatctcgtattgggttattatatggatttttattttaatattgtttatttttaattccaaatttcagctaattttaaattgtattcctacttgaactcttcttttttttgctaatttcggattttatttttttattcccaaatttaattaatctcgtaattgggttcttatatggactctttttttaatattccttattttaattccgattttcagctattttaaaattgtattcctacttggactatccttttattttctaatttttattttattttagttttattttgaattttgattaatcttgtattgggttcttatatggaaacttctttcaatattacttatttttaatttcgaatttcagctattttaaaaaaaatttctacttgggtctctttttttctttctaattttggattttattttatttttattttgaattttgattaattttgtattgggttcttatatagaaacttctttcagtattgcttatttttaattctgaatttcagctatttttagattgtatttctacttggactctccttttcgtttttttctttttctccgattaatgtgggaatttctagcctccacagcgaacgtggtgccttctttcaaagctgtattttattataaattaaattttagttgttaaaaataatatcattggatattcatttaaatttaattttatatgattatgattttttttgctacaatgaaaattttaaagttaaagtttagtttttaagaccgtactaaatttgaacactccttagcgagttggacggagtgatgtatctctaccaatgcataagttttctggtctatttactctttttttcatccataggtaaaaaaatcacattttaattctaattataccggctctaaaatatatatgcacgcattgtgtttgaatcctaatcacctgatctgttgattgatccttagtatccatctaggataaggaaagaatcaaagcaggagtacgtccacctatttggacttgtattctaatacttgatcagtgttgtccgtttgatctagcagttgttttctattcagacttctattatcaaagttaatctacaccatcaaagtctagtcccagtataatctaacggtctagatttttcttttttctccgattaacgtgggaatttctagcccccacagcgaacgtggtgcctcctttcaaagctgttttaataatataatagatagatagatagatggatagatttattttcttaattcctctatcttaactaattaaaaaattcgtaattttccgatcatcacatctttttgtccgcgttttcgtccgtcatcactctatttaccaatcgtgtacgatggaaaaggcataaaatcaaatcaaagatcggtatgaaattcaattgggcagctccataaaaatttaatcgggtaaatctacatgaaaaaaaaatcaatcaatcggagatatacacatcgagaaccctagaaaaaagaaaaaaaggagaggaaaaaatcgcataaatgggcgagcttaatgtcaccgaatccgattgatccgagctcgttgccatagccgtccatcgcactcatgtcgtggctgcgcccgccgggcacggtcacactcgccgccttcccaaccacactggcaccccctccctctaaccccccatcctcaggtgctctcctcctgctcggaggcagaggagagaaagagagaaggatggcccgcaccgtagccccaccatcgaggccgacggggagaggggaagagaggacggtcgtcgtcgccgctgtacccccgtcgagcactcgccgacgcggtgccatgccggcgatacgggagggagagggggagatggagcggcgccgccggtaggggagggagaaggggagtggcgccatcacagcggagggggagaggcgccacctacgctgtcgttttgagagagaggggaggggaaatgatttaaggctagggtttaggttgcagaacttttatataagtacagatcaatcgggattgtcgatcagatcggacggctccaacttcttccgtgtcgagccaccattcccaggccaccacacaattgggccgcttcataggccacgtgtaagcgcacggaatatgttcagtttaggtcccttaaggctgagttattttcttttcacctctctcattttttacgtgcacgcctttcaaactattaaacggtacattttttgcaaaaaatatatagtatatactaaagttgctttaaaaaaaatcatattaatatatttttcaaattatttttagctaatacttaattaattatatattaataaactaccacctcccgaacacattgtccccaaatctgaaattcgtccctaaaccacaacaccatatatgacatgtctatcaactcctaaaaccagtgcaaataagatcctaagacggtttggatggtgatttgagctaatgtggcgttgacatgacatgaaaagtaagaaaaaaaagagtatctaattaaaaataaaaaatatatataatgggatcacgtcaacactcatcgcccctctcttttccctcttctctcccttcctcctctatctcccaaggtagtcgcataacaaactgaaaaaacatagtggctccaggtggaccatacaacaggtgtacggccgcaaacccacacgaagaactcctttctcacgtggctcatgcgtcgcgcgagacctcctttttcacggggccggggacggtgagaagcgtcggcggctcatcatcggctttcatcgcctcgcctcttcgttttcggttgcacgctcgcttgtctggttgttgatcgatcgatgccgtgcgaattaccctgcgtttgcgttcgttcatctgcctgcgttttccacgcctctctctgcaactggtctacacaggcatcatttccacgcttgactaaagaggccggagctagcggcttgtgagacaagtgttcactgcgattctgcgagggcctgtccaggactccaggtgtcctttactcccggtttcttaattgtttcttaaccgcaggaaccggagctttaatccacagctgaacggcacatatagcagaaaccatgcctagtagtaactgtcgattataccaaatttatccatgacattgttactacacagtagtattttaacctgcacgttgatcgagggcataactttacacactgcttctgcatatcgagcaacgcgcgcgagaggggggtcgccgtacgcgagagatttgctactacgacttaccaccagatagagatcggccgcagcgcgcgctgccgcggtcgctcgaggctcatgcgtcgcgtaacgcgtatgattgagcccgccgcaagggagtctggcgtgtcaacgagagagatggagaggagatgcgtcgcccgcggcggccaaaagagaaactatcgatcgaagagcagagcactgtgcgagactttacccaagtgtaaagcaaagccaaaaaggctactagacctttttatctgattcacacatacgcagtttacgacgacgcaccatacattccaccaccaacctgcctctctctcgtcttctcgatgtgcagcagcagcggcagtagcagcggttgttcacatggtcgtcgtcggggctcgtcacggctcctccgctcctgcttcggtataaatgtgaggtgcagacgacgggcgaggaggttcgtcaggaggatggggtggctccggtcgctcctgtccccgctgaggaggctctggtgccacatgaacgccgtgcagcgaaagagtacgtcccaaaatcatccactcctcgatctcgctctgttgtttcctctgattctgcttctgcctgcacttatctgacggtatgtatcaatggctgtttggctgcagagagagggatctacatcctgtacgacgatgtcaagtcgtgcccgtgcgaggacgtgcacgtgctgtggtcgatcctcgtggagtcccacggcctgccgccgccaaccccgatgacgacgccggcgccggcgccggcgctgaggccgacgcggtgagtgaggacaaccgggcagaaacaagcagcgcccgcattaatggcacccgcggctaataaggagatcgaggtcgtcgtggcccatcggagatgaagtggtagaatcattgtgggtgtaccgtgtagataggatttaggacagtgtttggtgctgtcatttgatttggcggccttccgtttcatcggcatctctcttggagcatgttgatcggatgggttggccggcggcagaatgcagctgccgcagtggggggctccggcctgatgagtgtggtgatgggcttcttcctccctggagcgcacccctcttccgccgtgtcgtctctgttgatttggatgcgattgtttcgtccctctttggatgagtggcgaagaagaagatgaacaggagttgaatctcgcgagatttatgcgaaattgacgtcgcaaccaactgtcagcgttctccccattgccgctttctttgcgcgcgcgcacgcaacagagaattgatcgtgttcgtaccgaacgctcgagcaggaaaacgctccattggctttcccctttatttggggagtggattctaatccctcgagggacatcccctcgtatacctttttcttttaaatttaatataaatagttgtgaaaaattttaaaaaaaattaacaatgtagagtataatgatacctactagtccaccaaaattcatgttcaaattcgatctacacatcgagaaaaaaaagacaaatttagatataaacagtacgctactattcatacgctaaatttgtcttttttatatctcgatgtgtgagttgagtttggacttaagattttgtgaagttgtatatatgtgttgtatgaatgttgtcaaattttttcagaatttttcataaccatttaaatgatttttgagcaaacgagggaacatcccctcgagggattagaatagtttccctgtacttgtttctctctgtttcagtacggttctgggccgaacgctctgagcctctgattaggaggatctggcctacccaaccctgcggaaaatgggcctggatcatcggattgggctgcatcagaattcgcttgtagaccatggacgcaagcccccgtaaccagtagacagcgcggcacggcagaggagttgtcatctcaacgccaattcaccatgtgccttgccgcgccgcgccgcgagcgcaatcaattattccgccgctctccagcgacgcaattgcgggccccgggccggcgccaacgaccccatcccgcgccgggcggactccctcccaccacgatgaactgaaccagctggtggcgccgagccgccaagccaaccaatcgattccaggcgcgcgacagcccgcccggccgctcgatcgtcagcttatattaagctagctagccaggccgcctgaaagctgtaacacaacgcaccgcgcgtagctcagcttgtatataagcagcgcaccatctccaatctctcgcacacacacccaccgaaaccagcagaactcgtgtcttgttgcagtctcccccagccctcccttctcc

SEQ ID NO: 62913 - DNA, 19101 bp, Oryza sativa
  unsure (1)..(19101): unsure at all n locations
ctttgggaggttacctattctgttaggctggttgtgatgcagagagagcatatgcgtcgacacatatcacgtatgctttgagatttgttgttgagatgcgtgggtgcaatttgtttcttgatcctggggttgtaattgctcatgtactctcatgtgtataccgaaacgtgattgattaattacatatgcattgattatttttgggtcgcaatttggaagtgcaaatcttcgtcgtgcattcttttacgatcgcaatttggaggaataacgtggacacgtctaaggaggtggttggcagtagttctgctaaactagaaactgccagccagaaaaacaactccagaaccaaattggaggctgatttggatgcgatgagttagttgaaattttttgatagaatgaacgctccgggtagcagacgagcaattcgaaaaattgatggtgaaatgaagcgaaaaccgctcctttcgaaaattaaagcagagaccgagaacaaggattttaattcaattcacgaaagctctgaatatgaacgacgcttttgtacgccagccaagaggatttggcgatcatcatagccatgtgcatgtgacaagagtcactgttggatcttcgaacatctatttaggaaaaaaatcctcctttgttcctgtaaataattaactatgcaagaagacgcaaaaagagtataactagagttagtttacttctaagctaattcattctgacaatcgagctgctactgtaaccagaaggccattgatcatgcatccatacaccatactgataaaaaaaatgatacagactgtttttatctgtcggtaggcacgattgggtgcaccgtgtacagattgtttttcccccatactataataagggttttttattttttttaaaaaaaactagcggaccaggcgggtgcaatggtgcatgggcagaagtcagagcaccattcaggcatccactaatcagaattgaacggtcaattgtgtttgaggtgatcgattcattcccgtaataatttattcagatttgcaacgtggaatgtgtctcaggtgatcaaattatttccccattaaaatttacatgaatcagaaattgacagtggagaaggtgatgatcgatcaacaatgaacaaaattatatatattacttcatgaaatactgtgtacacgagctgaacgaatacatcaatctatcagcttacattatatatatccaacaacaacagacacaattgcaaaagaaaaaaaaaagagaaaaagaaaaacatttatcaattaatgcatataacctccgcggcgagagcgcaaccggtccagaccgaactgacgcgctcgcgagctcagcagaagaggtacccaacggcggcggcggcgagcgtgccgagggcgacggccggggcggcgttcgtcgcggcggcgccggcggaagctccggacgggccaggagccggggcctcggtcgcggtggccacgccgaccaaggacgacgccacgacggcggcggtggcagccgcggcgaggatcctgagcttgagggtggccgccatttcgatcgctagctatgaatcgactggagatgctggcaacggagaattaacgagaaagctagcgagggcttgggggggggggggggtgcttaatttgggatgaaaagaagagcgagaggtgtcgtgtttatatagctgcgatcggggaggcttttaggctgtttttgcgttgcatgtgtgctttgtttaggcagggcagggtcgccttggaataaggaatggattgcttggctgggagttcctttcacaggctggggcattgttaggtttgctatgattagcagcagctggtatagctggggtgattggccggctctgaacgatcagcagttgttgtttctggtttgttaagggaaaactaacatgcgcaggttcaagtgccaactggatgatggccccgcgaaattcgcagatcaacttatttgctattgttaaacaatgaatgaaatgaaatcgcagaaataatatatctaacggccggccggttataatggttgttcgtttcgcagaaaatttgatttgttcgccgaacacgttccgtcttggcacgtggatgatccgcgtgcatgtttgatgtggtccaattctaccatgcatccgtgccggtcgatgcaaattggtgtgttccgaatagcatgttccgatctattagcgcgtgattaattaagtattagctaattttttaaaaaaatagatcaatatgattttttaagcaactttcgtatagaattttttttttgcaaaaaacatatcgtttaacagtttaaaaagtgtgcgcgcggaatacgatagagaggggttgagaacccaaggttccaaacacaaatcaagtttcgtttcagatttcagctcatggttggtcacgcgcgcggtcgaaaacgcctttcgattgtttccctgttatttctatcgtgaacgtgagcagtaatcgagatcgagtcagccaactcgcacgcacagagttgtcctccgagtataataggtaggggtgggcaaaataagaccgaaccgaagaaccgaaccgaaaagatcgagaccaagaaattcggttagtagttcggtcttagccatcaaaagaccgaatttattttgggtatttcggtcattgggctcggttaaccgaattttaaccgagaaaaccaaattgtggcccaataggactagaaggcccaataaacccaataaattgcaaaaccctagaagtccccactacctcagtccctcacctaccagcgctgcctccatccatccccaccccatccatcacgccgccttccgcctcggcgccgcctcccgcctccgccgaccgccatggtcccgagtcccgacgagcgtcgccgtctgcctcggcgctgcctcccgcctctgccgcgtccccgacgagcatcgccgtccgcctccaacctccgccgcggccacaaggactgccgcctccagcctctgccgtgaccacaaggagcgccgccgtccacgtcggcgctgcctctagcctccgccgcggccacgacgagcgctgccatccgtggtgctcctggctagcagtggcgtggcgccgttgcgacagccatagccatggcctcgccaccagctcttgctgcccacctgcgctgtccaagaattcggttagactgagactgaaaccgaaaaaaccgagatcgaatttgccggtcctgagtttatttggatgaaattcgatcctgagttttcaaagaccgaaatgacagaaagatcgaagaccgagaccgaatttttcggtcagaccgaacgcccaccctagtaatagggatcctgactctatttggagaggcctctaaccttcgtaccaactatgtcaagtgttccgcaattccgatcaactgctcggagaaagaggtcgcagtcctcggtgactctctcctctgcccggttgaggcgttatcgtgcaagtatttagttgaggagttatcgtgcaagtatttgggtttgtctctctccatcagaaaaccgcaccacgaggaccttcagcctttggccgacaagattgcacaacgatagccgctgtggagatctgattggatccatccagccgggcgcctagcgcttgtcaaagttatgctgagcgcgatcctggttttatctgctcattgtaatccccccaccccttgaaatgggtgctgaaagccatcaacgagatccggcacggcttcctttggtgtggttgtgcaagcgcacaaggtggccattgccggctaacttggtcctatatctgcgcgcgcactggaatatgaggggttgggcatccacaacctagagctcatggggatagcgctccatactaggtggttcaaagttctgagggagcgtcgtcgtgggttcgacatgattgtgacccttggcgcttggtccatttggaaagaaaggaacaactgtgtgtttaacaactatttccgatcctagcctgaggttgtcgcaggcatggcacaagaggccgccctttggcggcttgcccatccctcaccaccaaagcttcttggttagcgtgcttggtcgtttggttgtcacactgtaaacgcgagaataggcttaagtacttgttttcatttttttcttcctttttctcctcgaccccccttacttctttgtttgccgtctatgtaaattttattccttttaatataataaaggtgcacaattcttttcttttgcgtattcctgaaaaaaaaccatttggcgtagctaggattcaattaggagcagtatcatggcatgatctataagttttgacccaaaggagatcaatgtacagtatcctagataagctgttaaatattatgcacgccatataagcgtgtgctgcaaaattcacaaacgaactccaaggtcgatcgaaatgatcatcagatcatgagtccctgaggaggagcacggcggacggtcggtccgaggtgtcgccgggggcggcggcggcggcggcggcgcccttgcttctcgtcctccggtgttcgggcctcgcggcggcggaggtccggcccctgtcgacgctgacccgggagctggtgctgctcctcatcttctccctgaagaccctgcacgactgcatgtgcgagtgcagctcctgcggcttgaactccttcccgcactgcctgcagaagtgtgttacaacatttcacaagtcagttcttaaacaggttataaacgatcaatggaaaagaaagtgattgttcagaaaaaaaaaaaagcagagtcgtgtggatgctgatagcttgtttggggtttcaaagtagacgtaaatctgcacttgatgggccggcccatgaaatttctattcagactgctcgataacgagagcctttgttatcttgatgggccggcccatgaggtttatagccgtactggtctagcacattgcgcacagcgagcctgaataggtggcaactgcaacaacccaaccgaaaagctgccacgcaaggttcttggacgagcagaagaaatggtcaagaacgagaaacagatggacagcgtacgtgcaggcggtagcaaaatcagttgagaggaaacggggctggctagtcaagagtactcacgagcaacgcggcaaactcgccggcttgtgcgaatcgccgccgtctcgcttcggcttcgccttgtctttcctgcctcttcgcaccttcaccttcttgcccaccctgtcacgccagataatcctatttgagcactgtgtaatcggatgatcgaattgtgtggggtttccgtactcaccggaggccgcagccgtcgatgccggggcacaccggcgtaggaggccagtcgccgccgtcgtcgtcggcgccgtgccgcaggacggggcggagcgcggtgtcgtcggcgtcggccgcgccgcacgtcaggaggttgtggagcagctgcgccaggtgcatcctccgcgcgctgcccaccgccggcggcgtgtggctgctgatcctgccgctcgccgctcctttcaccttctgctccggcgccggcgccggcaccaccaccgccttggagaccactttcaccacctctcgctgctgcttcttccgctcctcgcgaaggcctcgtggcaggtctttcttcaacggcgccgtactacggctcgccggctcgccgggcgagtcctcgtcgaccggcggcagcgtcttcggcgatctctcgtcggaatctggcgccgtcgtcgtcgtcacctcctcgacttgcttctgatcgcacgcgaccttcacttcctgactgtccagtttctttggctcttcagctatcacaaacaaattttgtgaatttgttaatcacgagccatcgtcatcgtcgaacgagaaaaagaagaccagaaaaaaatatcaccgcacctaaagaagacgacttctcctttggcgattcggtggctcgccggacgtcgcagcccttgagcacgtactcgttgtcggagatgggggtgatgaggtcgtcgtccatcatcaggtcctgccatatatacccagccttgtacttcctaatcaagaatcaattataaacattcctaaattgctaaatctatcgggtaagcaagaacatgctaaaaatgatttaggaattaacgcaaaaagaaacaccgaacaatataaccacgcgtgatcatcatcatggacgatgacgataaggcgggcaagattgatgaatcgccttcctgttatgaaattatcggtaccttttgtaggaccaggagaaattgtccgccatgtcctggccgcgcagctccgacagccacctcttaacatctgaaaccaatgacaacacgataaacaccatgaagaagaagaagacgaagaagaagagccgcgtgaatgcgagagatcgatcgaacgaaagggcgaaacgggacgaacttaccgcggaggcgcacgccggcgcggtggtggttgacgcggaagaggtgcgggtggtccgtcctgccgccgcggctcaagaaatacaccacgttgatcctcctcgcctcgccgccgccgccgccaccacccttctgcgatcccccgcctttctccatggagaaagtatgcacgtcctcgtcgacggcgacaaaaggacaagggccaaggaaggcgatgatatcgacaccaccaaagctatcgaaaaccgcgagaaatcaaaacacgcatgcacacgaggttaacctgcagaaattgttatgtgcaagaaaagagagagatgatgtgcgaggccggcaaagacgcacgcgacgattaattcggtgcaaggaccagccaggcacaggccgagctcgcgtggctcaaggtgttagcctgggattggatgctgttagaataaggttgaggttgcctagcttcctcacttctcagccctattgcatttgcaggcctgatagatagttttagcctgtgtgggaatctctcggcgacgggaaggattacaatatgatcattgctcggtgtgttcggatgggggaaaccagtatttatattggtggaggttttttgggtgatcgatgtgatggcccacctcgtagaaaagggaggaataatcgccgatcgagatcgaaagttccttgttttgctccgtttattttaccctcttccatttatgtgatgatgtaaatccttcctgtaatatatgttctttgatccaccgtttcggttttattacctgttaatactataaagcaagctgtttctcctactccattcaatgaaaaggtactatctcgtgccgttttccgttcaaaaaagaaaagaaaacgagctgtttattttccttcttataaaaaaagagggggaataacttatctgtatgtgtggccgcggtcaataataaatagaaaaagatgaaatggagtgagttcgttgtttgcagctggtccttaggggccggccgttatgtacactcgctgttccttgactgagaactcaaaagtatgccaaacctcgtaggttccatcaagaacactgaccctgttgtttcttattactagcagagtccataaagaacaatggcattagcattctgcatttggcagcattattaacactttttcgtgtacttcaatataacttgatcacgaatgattaattgattattcgttatcattaagtaactttttttgcggggatcattaagtaactttacaggtcatgtatgctaaaagggttgtagtgatctgagtagtaccccaaggttctgagttcaaatttcctatggagcgaatttcagattggattgtttgcggggctaagttccctatttcaatggccgtatatatccggttaaatgtagaggccggttaaaaaatatccttctctaaaaaaaaatgctaaaagggttgtatagagcccaaattacaagagcagtattgaactgagaaaggaagacatgactctgctacggattgctgctgtgtcacagtttgagaagaaagactgtaacctggacgtaagcctgccatttgagtgtactacttcaccagcagggaactcgggatggggtccaaccgtccagggatgcttttcggagaaaaaagaaaactgctttggtcccttctcgccggacagtctcctttcttaatccatcgcaagctttggtacggtacgcattcccagcacataagaaatttattggttttttttttactttggatgttttatttttctgaattaatgttcgcctgacgtaccgtgttggttcgtgaatgttgatgccggaagttaattagcatcgctttcaagttcttctcattcttttctttctctctctctctctcttttgagctggaggtcttctcaatttgactgcaaagaaaatatctgctatagcatgaacacgatgaaatgctgccacggtgttcactgcattgactgcctttcagtttctgctcttcttcataaaccgccccaagtcaaccgagactacgcgtcgagagaccaagagagtacgtttatcgggctggcgtgaagcggcagtgtgcacggggtcggagtttaaatctccgacccactctaggatctcagctcgctgttaacgtgatgcattgcggtgattaggccattagatctcatcgctctgatgcactctgcgcggctgcgcgcgcctgtgttgcggtttaatttgcatctatatccaatttgtttagtgcaatatattggaaccttcaatgctgcatctttgcaataatgagaccataaaattctgctccaacaagatcatcgatgcggagtatggtttggagtagtttgttcctgtctctgacatcacatttctattatctccaacaactcttctgtgaattagagagttaaaatctgcatgtcattcagcttatcatatactccaatcctgggtttaaatctgaagacagtgtatgtccagatttaaatctaggattgggttttttttctgaacggagggagtactccattccagagttcgaggcccatgaaaggtgcgtgcatgcgcgggcgacggcgagagcacctcgacgaccagatcgtccacaacattggaatatctgacaggctagctagctgcataccgtcagggatgaatggagccaacagccaaggttgacaaaaccgacagtaaccgtcaaattgctgtacttacttaccgttagggtaccataaaaataaaaccacggtaatctcattaaatttaaacaaattttaaaaataatttaattttttaataaattttatacagtttactgcagttaccacgcggtaatcgtgtttatcgctaaggtgcgataaactcgacaccgacggtaagggaaacctgcttagagcttgggtgcatcctcttctcatgtggatctggctagcgaagggtggacaggacgcggcggcggtccggcgaggcttggcacgagggccaaggtggtgttctttgctgagtaggagtacaaaatagtgggagtgggagtcatcgttttgaactccgaaccccgtggaatatcttatgactattcgatcaagcttgcacgactaagatgagtggaataatttgtggctgcgtagtctttcgacttgacgagaggcctctctgtgtcagcctattgcgctgaattggcccacagaggcccattggaagggtccagagtttaaaactccaagccccattggaatctctgttgtccgttcgattatgcatatgcggtctagatgagcagctgctcgcaacgatggatggagactccctcccagtcgcttcggcgtcgacgacgggcgcttgcccctgtccgaccccttcttcaatcctctgccctgcttgccgccatgctgccggaactctagctaggctaaccggtgccaccgaggcacgagactacctacctctccatggtactttgattgcttcgcaatacaaattactactaccatatttgattgttgtatacaatgctatggtttttaggctgcattcttcagttaagcttccaacctcactctcttatttaccgcacgtacgcttcccaaactactaaatggtgcgtggtttgaaaaaattctatagataagttatattaatctatttttgaagttttttaagctaataattaattaatcacgtactaattcattgctctgtttttcatgtcggaggtgaatggggtcacattcgtagttctttcctgtctctctgacatcacgtcacatggcattgattgaactcttctttgaattggactttagaatcggagtgtttgctattcagcttattggtatattctctataggcatgtttagattccaacttttttctttaaacttttaactttttcgtcacatcaaacttttctacacacataaacttccaactttttcatcatatcgttccaatttcttcaaacttctatatttggcgtggaactaaacacaacctataccgtctctaccttcttcttgattccaaggatcgaagatgcgtgcgtgtgcatccgtgcgctggcgccggtgagatcgtccacagcaatgggaatatgggatatctgacagactagctgctagctgccgccgggggacgaacggcacatcgacctagagtcccagacaccattggcacgtactgcgaactcgggtgcgtcgtcttttgcatctgcatccgccattccgcctagcggggcacgggcaggatgcgccattgccgtgcgtcgtcgtttcaaaccccgacgtcctattgggcctattcgccgcgtgaaccttagtccttgggcctgttgggaggctccatctcggcctatcgcgctgaagcgcccccccccccccccccccaggcccgttggtggggttggagttcaaaactccaaacccctttggaatcttttcccgccgtctgattagatatgtgcggctcagatgagcagcaggtgccgcacagccgcagtgagcccaggaggaggatgcactggtgcatggggtcggagtactccgaccccctctgggatttcagctagcggttaacgtgtcgtgttgcggtgattaggactatgtactctgcgcggcagtgttgcaacaacaacagctggaaccttttatgctgcatcgaacttgccctttgcaacattatggccatgcatgaaattctgctccagtaagttcatcaatgcagatgaagaagagtgagaccttctatggttttagctcgttcttttctctgaggctagctgccacggggacaaatggcacattgacccagacgccatcggcgtactggaagtctggaacttgggcactcgggtgcgtcctctttgcctctggggacgggtattacgcggcggcgctccggcgaggcctggcgcctcattcttgccacccgaatacagggccacgggggttcgttgtttccaactccgagctccctggaatacccgacgaccgttcgatcaagcccgtgcggcctagatgagtggaattattcgcgacgctccgtgatccttgggcctgatgggaggctccgcctcgggctctcggcctatggcgctgaacgggctcgtgaaggcccattgatgggattcggagttgaaaactccgaaccccatcggaatctctgccaaccgttcgattaggaatgtgcaatgccattgcagaagaaattcaggggggcgcaaaatatatattgcagatttgaggaccatgcacagtataacttcactttaccttcgtttattctttatagtcgatcatgcagacatacacatagaaacgtatacgtcctttggttaatcgagcaaccagtgcatgcaatataaatatttccactgcaggtggatcacgcatgcatctgatacttgaagaacctgaacttaacggaggacttgtactgtaatctagctatagaccgatacaattatcaacatttaacaaaaggcaagcacgtgtacagtgtatatctcaactcagactgttcgtcctcgtcaaccagtcgagacgccactgtgaccgtaattaggtcacaaatatgaccgatgggtcgcagcagcactcgtcgatgaggcagcagcagcagagagcagcaaggctgtattattcagacaaattagcaccatgattagcagagagaatgcaaaggacagagacagtattctgacgatcgtatgctcgcatatggctttgtcgttcttaccatccttcgaggaagctcggctccggccgcctcggcggcggagccgcgtactgcggcggcgccatcaccggcggcccattgtagtaccctgcacgcacgcattgcaagcccaaattaatcaagcaagtaaaatcaacgaggagatagatcatgaatgtaactctgcaagtgatcataatgcttattaccttggggtggtggatacgagtagccgtacctacgatcatcnnnnnnnnnnnnnnnnnnnnttctgtttcagatgagtaccctttggtagtttgctcaatggagaactatactgggtgagagtaagaagagagcctgtcctggagctatatttatagaccacggtgcttcaggttgcagctgagtgatgatgcttctcgcggtgtttggagcttccaagttccaacccggccaccatcctgcgtgcgccgctgtcagcagctgatccatcggcgagtgcgtgtgatggatcggagggaaacgaataaagctcgatatatattcgtcacctttttaccttttcggattgttcctgcccttaacttcaaggcacgcaatgcctaatacaaccgtaacaaaagttcaatagtagaagtgttcagaattcagaaaaaaaaaaggccgtaaaagagagaacaatgttgatgccaacgttgaagctggtgaaagtcagaaaccgatggtcgtagggagtggattctaaattctcgagggatcacccctcgttgtttgcatgtcattcattgggagtatgacttacgtatattcatcttacatgtttgtagagtgacttatcacatattaatatatcttgtaaaaaaataaccatttaaataatatgtataaaaggaaaggatgtcctctcgagttaaatattttcccacctctaaatgcaatgtgaacggcgatcctagttaagcacttttatcttgaattcttcatcaaagatgaggcgatgagagattcgaccgcgacgtgacgccgagaatcgtccggcaggccggcgaaggaagctgattgcgagctcgttccaagatctcgaatcgaagcactacaaaccaaggtagctcgctggttctcgcggacactaagcatcgatcggagatcagcagatgctggtcgggttcttgtttctttcacaccgtcgaaaaaagtacagaccagattgatcgaccgccattgtcgtgagctttcggtggccttgctagctaggccaatttgccctccttttgggcaaatggaaatgatccggaggtgcagattgcagaaggcgatgtgctgctttaatttggcgatccggttaaggagagaacgtaaagaactcgctcgagctcaagcgtctgactttccgtctactaacccggttaattagcagaatttttgagagagagaacgaagatcaaacacgttttaaaagggaatcaaattcgagaatcagtactacttgctagaactagaagaccacacgctgtctcacttgttgcaaaatccagaaggattcttgtcttgaggaaaagtcacagtattgcacacataagttgaacggattcccctgcaagaaaaattccaaatacggtcttgtgggcaaaggccatcctggtcggagaaagagaggaatagtgctctgagattcgtgccgggacacgtgtcacgcagggaagtgaagtccttcggataaccgaaggaccggagtcccgtggaactttcttcgcaccggttcgggggcatggaggcggcggcggcggcggaggaggaggaggaggaggcggtgtgggcgtggagttggggcgcgggaacggacgggcagctcgggaacggcggcttccaggaccaccatctcccgcagccgctcctcctgccacctcgctgccgcggtctggtttccttcgtcgccggcggtggcgcccacgctatcgccctcacaagtaagccccggtcccgttcaaagccgccacatttttttttctagtaaacgatcgttgtagtaatgattggttctcgcatttgccggaacttgaactcagttagatacctagattgacaatggatttgtgcacggcgatgtagttttgctcaccatagcaacagatgttcagagacttcagtttgcaccagttctagtgtctagaataatcacttccatccaaacaccactgaagtgttgctgtgttgggcttgatgattaatcagaacagttttctatttcacaaatttaaaacttttcggttttcgctagttcctttgttctgaatatttgaacttagtgccattaagtggagagacatctctctgttgtatacttgtattctaacaaggggctgagtgttttccttttcagttcaaattccgctttccagtaattagtgattggatatgtttcacagatttgttctatccttggccattttttcaaagcattcttgttccattatcaagatatattgctcgctgaagcttgatcatttaccaggaagaaaattctctcattggcaacctaagcatttttgccttctttcctcttgggtgttttgagatgggcttgtaaatctgaatctttttgtgcctatattagtgcaatggcacgcagaaattttgtatgtgccctaaattggcaaccttgtcccatttccgtcagtcctcaagaatttagtctctgcatcagatgccttcacgtgagcaatatgcatcagttctttgaacagctactcaacatttcaggtgatggtgaagtatttacttggggaagaggtacacatggtcagcttggtcatggggacgtggagaacatccctcatccaaagcttgtaaagttctttgagaactacatgataacctgtgtgtctgctggatggaaccattctggatttgctacaggtgtccaattctgaaaccaccttatttccttgtactttcttttgatcctttatgctttatgttcaaaaaatctactttatactctatatcacatatagtctgtgcatttcaggtgtttattttgtttcaaaaataaaaccattactgatgagcttagctgtgatgtttctagttcttattttcagattctggacagcttttcatgtgtggagatggttcatttggacagctcggtgctggtgataaccacccaagaaacttaccttttgaagtggcatactttaccacaaagcatgttgtgaggcttgcacttgggatgcgtcattctcttgtccttttgaaaggtatgcaacatcatgtgttgcgatgttagcttaatttttaagaaattgcatagtacatgaacctacccagatttactctgttacctcttctgaaaccacttgctcagaaatcttccattgtctgggcaatacccaacttttaaatgacccaatcatattccgtaatgcattttctaaagttaaacagcctttgaaagaaacaattaatcaatattttttcttttcaattgaggataggcatcgctatagcagggcaagaccatactgataatttttattgaaagcgaaaatcaagaacaagatgacctatacacagttatacacttctttgaagccaaacataccggcaacttagggttgttgattccttgaagaagggctgagtgagcattctttgatttttttccaactatggcaatatggcatacaaagcattcatgtggatgcagaaccatcccttctgcactagtgattcgggagacgtgggagggtcatcaatccacaaccatataatatttcctatcagtcatctgagaattttaaggccactgctttctctgatgatgtggaatctatgaaggtgtacctttgagccatcctttagcattcttttcagagggatgctgcaccatcattgtgttctaatgatgaatatgcatgagatgttgcaggttttagctcatcagtcatatatctttcctattggacgtcctgagaattatatggacacctcttctacttgatgtattgacaaactaattgttatatatgttacaaacggatgacactgctagtccttgttcttgcagataattctgtctatggatttggctcaacaagacggggacaaattggtagatgcactaggaaccaaaagttctatgatgttccaagaataattgatggttttccagactgtaagatagggaatatatatgccaatggagatcacagtgctgcattggatggtaagccttgtaaatttgttgtgcaaacactcttcttctctttggtacttggacatgattgtactttcattgcatggaacagaatctggtcagttgtacatctggggaagagcattaattggtgaacatgatgatgatcaacctcggccagtctttccttctttgggtatttctcaagtggcattaggatggcatcatgcattagttttatctggtatgtggtgccgttgttccttttcaattgaaatatgttttctggaactgctgtcaaatgagtaagcattccgcagttacagcaggtgaattgtacacaattggcgcttaccgtcatcgtaagcttgatccccatgtgttgccaagtgcagagccagtgcagagactaaatcccgcccaacaagccatagtcatgatggtagccccttttcaattttggttatattatgtcacgtagttgtattaagtttttattaggaaccagtagctggactggaaaatatctttacatatagatgaatactcattctatgtgttagcctagtaattattgcccaaccgttgtgctttctgttaatttcttttgtaataacaatctgcttagttcatacaagattagttgaaataaactcatagcatagggtaaatcggacgtcgaacaatttttttcttcaataagaggttggcattcttttctttgccatttgatctgcatgctgcattttttttccctatcaccatataaaatttgtctttgtgatttgcagaatcatcctcatcatcaacactggtgaaggttccctgtgttgatggagaacaggtggtgcacatagctgctggcactgaacattctgcttcggtaacaggtaagttactcaaaggctgaaaatgagcacataatccctgggtggtacaaactaattgctcttgcatctttttgtcagataaaggaacagtcttcacctggggttggggagagcatggacagcttggtttgggagatacttgtgatcaagtgactccacagagagttaatataggtgataagaggccatgttcttctgcttcagttaacgtctattgtgggagtggatttaccattgcggtgaattctggcttagagtctgattagttagtatcatgctggattcccctttatggctagtacagaagcaaaacatcagatccattcttgtgttgtcattggagtaaaaattaagtgtgcaacatgatttggtcaatttcttttgtgataactttaccaatcccgggctatatttaccttatttggactccacattcgacctctccattatagatgaatttaaaataaattcagtaatcagtatgccataccaatataccatcggaggctattcgtcgtagcgtagaaccatattctggattgaatatatataatactgtagtgacgcatctggttcttcaaagaacaatattctcagatgctgtcttcctaaagatcaaactgctgaccttttgaaagcagactctagagagtagagacacacaaagcagacactactataataagtgtcggctagttacacgcagtagatgactctccagtaaatcaaatggtcttcagtgctccagttcgatcaaaacttacacaatcaaatattctatcagttgtgttaaatacaaaaattctatccttgccttatatatatatatatatatatatatatatatatatatatatatatatatatatatatatatatatataaaggatcagacgtaattgtatttgtccatagccgaaaacaatcatttctggagtttgaacgtggaagcaaaggttcccataattcttggattatgtggcgcgtagcacaaagatttggtcagataatctcgcatgagcctccaaaatcattttttgggatattccagttggatgttcctgctacgtgctacgatctcgacgtcgacgccgacgggaacaccaattggattagatcacgggtcaatttcgcctaatctcagggtgctcttctgatgggagcatttgcctggatattccatggtatgactgaatgttcttcaaaatattcctgcttgggtcttccatttttggttttttttttatttctgaatcatctgaaagggaggatttggagatgtaatactgatttttggggcaaatatttgacagctgaaaatttggtgattgattccctaaacatttctgattagcactttcagacccaaaggacatctgataggtgtacctcaccttttgtgggatgtgatctcgcgcgcgcgcgcgtcactgacaggaattcgtccaagatctggttctgtaaaatgtatttcctccgtttcatattataaaactttctaccattgctcatattcatatatatatatatatatatgttaatgaatttaaatacacatgtatgtctagattcattaacatctatataaatatgggtaatgctagaaaatcttgtaacctgaaacggaggtagtacaacattttgtcacctacttctattattttctattttgcgattaagtgcctgtggttagagaacatcaattataaaagtacacaaatttggacaatttgacccttttcgaaaactaattttacaaatgaaccgcggccaaaacttatttaaaaaatgatccttttgttcagcgccaaatcgtatggcgctgaatttagacacctcagtatcaaatagcacggtgttgaatgcatgttggcacgccgactcagggctgcaggaat

SEQ ID NO: 62914 - DNA, 5061 bp, Oryza sativa
gttattctttttctcccatgttggttgcaggtgtggtgttcccccatggagcagattcttgagaggctgcgggcgttcggggagttcgaggtatggttcggaaaaggtcattctggtcttcaggcagattccagcccgtgtttcttttgttaattagtttgacgtttctccttaagagcaaattttgatatcaaatggagaggaaaaatggagtctttttgtaggatgagaagcattcagagattcaattaggattattgatgcccgcgaactgtctgaagaaacatgctagaggtctatgacaacatcaactgaaaaaagcatatgatccttgtgtctctgtttccatatgcaggagtaaactgtgtaactgaacccattagcaccctattttctgactgctgtacaagttaaggcgtggcgattacatattgcccgggttccacggctcaatcaatccttcattatttggccgggtacccggaaaacaagaatatgtaggaggaacaaacaacaaccatgcaaaacgccattcttgtattatttcctacaaaagtctatgtgtggcctgcacaacttcaagtttggtagtcataaaaactagataaatatctataaaatgttatggaagaagaaccttgtaattatactctctcttctgttatcagttgccaaatacagtcagttgtagctatgaatcctgcagaagatacgtatatgccaccatggtgtattggcatagtaaagtgttttgcttctgatcaatacaacatatgagcatctctggctctttagtaaagcaactacattgtgctgaatgttaataactacatgcatgctttatggatgcagattataatttttggtgacaaaatcattcttgaagatcctattgaaaggtatgcctgatagctgtgaagggagagccttctatgagcttgaattctttagttctcaatttgttgttattggcaaaatagaaaagcaaattatgcaggtcaaaatatctgtacagatgtacagacatgaatgatggatcatgctgtcttacttgaaggataagacctaggataaatatagtcagttcacaaatgattgctgtagcataaccatatttaatccttgatagagtgattatgaatatctgtctaggaaatataactgatatgttttaaaattttgtgctgctaaataaatccattgtccatatgtgatgatgcacctcttagcagatgtcaacttaatattcctagaatactaaagatttccttctatctgatgatatcagactttacatgatattacctctggtcacaaaaaaatgcctttttggacagttacacggtcttcaaaatgcagtattgaccactaatttctattgtaaaatctttgaatacctgatgtattacaacaatactttttgaggcaaatctacgcatatgattttcatacattcaatctagtaatacattgatgttcaactttttaaagtttgacttgaaacatgtccaaaacatctaattatctgcacatatgttttcgtgattggatggagtataatgaggttaattcagtgatttatttttcttcatatattgtgtttactatgaaatcatctttgttctgtttttttgttgacagctggcctctatgtgactgtctgattgccttttactcggctgggtatccactagaaaaggcagagaaatatgctgctttacgcaggttaaatgcttttcctgacacatgaaattttcagagcacatctttgtgctggatctgcaagtatctttagtttcacaacaggcttccctgacatatagaacatttctagtactactagcagctggactaagataattatcaacaataaaattgtggacattgatgacccatgtgttgtttctgtatagttgccctttttggcttcaacatttgcaccacttttaaagttactttgatatagttgctactgaatgtgcccatggctaattaatgtatctaaagcaactctattcataatagcatcacctaagctcttattgatatcactgtttcattcatgtatgtatatatgagtttgcctatgccttttttctgtagctgaagaaaatgaagagaactttagaaatcataagtataggttatcatttgagctagcctttttttaacactggtcagctgcaatttgaacatattattaatgtgtatattatttttcttgggaaatacacaggcagtgttgattatgggcctaagaaattcacatgtttattattagctagatacctatataagttcatcaacttgatgcaataacattatgtaaatatctttatgcaggccatttttggtcaatgagttggatccccaatacctcctccatgatcgcagcaaagtatatgaggtattaatatcggtataataaaaaatgatgcttcgtacatttgagatatccttttttcatgttttgactgagttgcttgttctgtaatagattctttaaagatgtgttatttcttgctagttatcatgggatgcaaattaacctcctttaaactagaagaaataacttctcttgaagaaggtagtagtactcaacagtatataaaccaaaagatggcagcaagatcatctatgaatatctggtaatgaacctttgtttagttcgtttgaaatatctagtttttgcttctgcagtctattgttgaccatgttaatctcaagactctactgtaatatctgttacattctcttttgaaactgccaatacaaacaggcctttttatcctaataaatgcagaagttggtactgatctctctctctctctctctctctctggaaactgataccaatgagataatctcctgtgagcaaatgttcttcttagatatagcatttccagtttgaaaagaaatttcttttaagttcatatgcctacaatatgttcctctgtgtaaatgtgtcctatggaacctgcaaaaggatatgcataattttggatggaaagataagtactgtaaaaaaaactagatgttatgtctgttccttatattatgtgactgatgtggtcctagtctgcaagaacagtatagtttgttttatttgttatatcattatgtatatccaacaaaatgcttggcctataagtattcttgttttgttttcctgacacagcaactattaccgtcaacaaaatttataggatggataagatagtcaacagatggttttatccaactatacttatagagaaacacaaccctccactccagtttgcaaccttttacataatagcttattctcttttcgcaaatgttgatacttcccttttgcctgtttagcaccttaaattgttcggagttcctgttccaacttatgctgttgtcagaagagaataccctaaccaagagttaaagtactttgttgagcaagatgattttattgagatccatggaaagcgattttacaagccttttgtggagaaaccaatcgatggtatgttagtatcagctcttgatagaaaaaatattttcttaatggtttttccttctactagttcatgcctgttcttctgtctcccactagaataccaactatcattttatatctgcggaatacatgtacgccaaaacaaaaaaaaagaaagaaaaagaaaacctgcactaggtctgattgattaagcttctcatggaaggctgcttcctagtatcaactatgagaagtggcaggttacaaaagaaaattgcgagccttccaaaaactggcaaaatccattccgtattgtagggtacaactcaaaacacaaattaatggtacgattgggtggtgataatacatctttaatggacataattaaaacaaaccatgcaaagctaactcattagagcccaccttgcatccactctctaggattaggaaaaactatgtatttggcaaaatatcatgagtcaattgatatttgggcctgaccttgctgtgatatggatctaatttcaatagaatgcatgagtgctttggaaacatatgttgactgtcgaagcatcaacaagccgaagccttggcagtctaaataatgtcaaacactaaacattgcttatcttgctcctaaaatacataaatgagatattcttcatggcatggtatgaaacaaatttacatattagtactgatgggtaagaaacttaaaattgttcattcattcttattattggtttagtagtagacaatttattttagctaaagtatgcattttgttcccctgtggtctgtgccttgtactttcatttattgtggaaaacctatccttaataactgccaattgttctgcaataagttctacatttttttatatgcaaatcatgaatcagtcttatcaatgcatccatgcatattccaatttgtgcggtactgcaaatttaatttgtcagattgtctattttaaacattaactttgccgcattgtaaagaagtgttagaacaaatctttgctgctgctgactaattctgttgtacataggagatgaccataacataatgatatattatcctagctccgctggtggaggaatgaaagaactgttccgcaaggtgggcacttgttaccttcaattcacacacatttcttggtagaaaaattgtaattagtctctttcttgttaagaaaatactaatcatttcttaactgaggaagtacttagcatctagagtagatggtgttagcgctgtcgatagggagctgcttcagttctaatctgctttccttttcattttcttcttccaagcttgttccttgtttagcacagagtgtctataatcctatctatttttcttttacacacacaattatgtgtgatgtctttcttgttgctaagaaaaattacttgataataaacactgtcacagtataactcagtaacctagcagatgatcatctgctttatgttctaacatgctgttttatctattttgtgtcctctctgacgtgcttgcgctgtgtccgcctttgtattactttttttttttacctttgaaggttaatatattcaggccggcctcct

SEQ ID NO: 62915 - DNA, 26375 bp, Oryza sativa
atgtgcattctgatttctgaatctgcttgtcatatcatgttcttccagtcgactttcatctgttcaaaactccccaaattcactcaccagatgtattcttcaaaatatttatgcataggttggcaatcgatctagtgaattttatccagacattaggaaggtgaggcgagatggatcttacatttatgaagaattcatgccaacaggaggaacagatgtcaaggtgacagaacttgcgcctagtgctatttttttttcctcccaacttatactctccagatatgttaaaaaggaactttttacagctttcttcttggtaatgagtaaacataaaataattatattttatacagttgatgcctacatgcattgttgccataacatgcaacatatgccacaagcttcccttttttttatttgggcattaagaaatgcaccatggtaaggacttgaatctctagggataccaaaagggaatcacattctcttggaaatctgggtttgagggaaaattatcttcatcaggacagtttcccaattggtccagggttgctttgtcctataaaagactaaccatcatgttgtaggtttatacagttgggccaggatatgcacatgctgaagcccgcaaatctccagttgtagatggggttgttatgaggaattctgatggaaaagaggtaacctttgttgcctatttgccataggattcaccagtgctatcaatatgcctcagtatttgacactttgatggatatttaacccgtttatgttctttagttaccattctgtgtagatatatagtaacacttgttgtataatttgtatctaacacttgttgtataatttgtatctttcttgaaggtgcgctatcctgttttactaacccctactgagaaacaaattgcaaggaatatttgccaagccttcggacaagcggtacagaattcttttagttattatttaattcctactatgtcggaagcttacactatttcagaacttaggatgtatcttatattgtgtatttatgggctgtcacctgtcaataccactagacataatggatacagttagtgaaaccatcatcgtgttaagtcatctacagcatataagtagaatttgtttccttcaagattaattagcacaaggtcaagtagtgtggaagatcaagaaggtattgagcatccaactccatagtgatctctgttgcttggattctgtggaacgagaattttcaataggatcaatgctgcagtggttcaagtttggttgatcaaggagtgcatgaaatggcaccttgctggagcaaaatgcttttaagagcttatatatgtagcttaaattttcctttgttggtcattcttgaccttattctgctggcgcatctgtactaaatgagttccttgattttctttttttgttttgttttttcctttagggacctgatctctggctgaatatcttgtgattactgagtttgactttttttaactaaaatactttcgatcctctagcttaatgaaatggcatgcaatgctctttcctgccattgagcaaaatggatcaattagatagattggagatgaattggacacacctctattccatgaccagaagccatacatgcagaaaacaaatatacagagagctaatttatatgtgcttagttatatttttattatataatggaattagattaattccggcatttgcttcaacagaatctacagccaattattacaaagaacgaagcacataagactgcggataacaatttgatatatgtcaggattccaaaaccaaaagaccatacaggtagttgtattagctcagtagttgttccttctttgtgtaggtgtgtggttttgatcttctaaggtgtgatttgggggaggcaaggtcttatgtatgtgatgtcaatggctggagttttgtgaaaagctcacacaagtaaatctttctcactctgttggaacaattactgtaacagtttaatgcatttgtagttttctatggtcaaattcctcgttatatcttgtttatttggtgaatgccttcataactccaggtactacgatgatgctgcatgcattctgaggaaaatgtttctcgatgataaagctccacatatttcatccaccattcctgctaatcttccatggaaagtcagtgagccagtccaaccatttgatgctgtaagagatcgagaaaggggaactgttggcatatctaggcaatcagaagagctgcgctgtgtcatagctgttatacgccagtaaggataatcttatgatctctaaattgtatcatcatcaaacttgtttttgacactacaaaaaatgatatgcaagtggggatcgcacgccaaagcaaaaggtgaagctgaaggtaactgaagaaaagcttttaaaattaatgttgaaatacaatggaggaaaggcccatgcagaggtacgaaaactaactcaatttcgatttagatttattcatgagctttatatttttgcttcctgaaaactgatcatgttgtcaaattgtgcaggcaaaacttaaaagtgccttgcagctgcaagatctattagatgcaacaagaatccttgttccacgtgctaggtaatttctggagcctcaaattttctatggttttatggtttatggtttgtgtatgtgcagctggatgtcactagtaacatacaacaaaacaaaatattaatccgtatcaaatatgtcttccaatttattgtttgttctcaagggtttcaaaatatgtgcatttttgctagtttacaaaatgctaaaaatctatgagatcatgtttaatatccccatataatattttaccttttgatgtcagaaattatgtttttatgtaatatgtgtatcttggttagagttctgacttctaacaatacatagtagacatccacacggatcttaattgtgagcatgttctctcccttgtatgttgcattgttgatttgttgctaacaaagaggaaaaaaatttctaacttcaggtctggccgtgaaagtgatagtgatgctgaaattgagcatgcagagaagctacgccaagttagagcagttctagaagaggtaaaatagtgttcaagtattaatagggctatatgtttggcatggcacctaggatgaatatacaagcataagaatggtagttgtacataaaccttgaagagccatgcacaccaactgggttaaccctgtaaaatgaagtgaggattaaagcctaaagtgttggttttggttggacgtactttggagtggcacgaaaaggtgttcactggtgcctggtatttaggtcagctaatttctactacaacgatagcagcatgcttcttgtgatcttgtcagtgcataatgaaagcattcccttcatgttgataactgtatatttcccgtggatctccatcatgcttattgttgttctacctgttcttcaaaaatcatttttccatctataaatgttaaaaaaaacataaaattgttaacagtttgtatatacataaatagcttatgtggttcagcagttactgtttacatatctatggagctccatgcctccattgcagagttcttgtagattttcgtgaagtataatcaaataccacatcactatttacaaaatgttttctgtttaattaaatactacatataagattgtttatttatgtacttgttcttgctgagacaattgtgttgcatgaatagaaatgcgatacaaaggcgctgtctagacatttccttttgtttactgccatatataatctgcatttgtcctcattgtcaattttagttgcaaatacaatagattcttaggcattaagtattagtttccctatggcctgtagggtggacatttttcaggtatttataggaaagtgcagttaaagccatccaattgggtccatattcctaaaagtaacggcaacgggaaggaggagtatccaattgaagcactgatggttctcaagtacggtggagttctaactcatgctgggagaaagcaggttgctttcatttcacctattgaagattttattatctgtcattattataatgagcactgcgttgccaatgaagctcatttagtttgatgtcggtatgattttttggggtttatggatattttatgttaattcaacaatctccaatttcaatgtccaaatattcaacttattagtactatggacataatctaagtaaacatgattaatgatcagtctgttcatttcatttaagttcttatcgtgtcccccctttgtgtctctcagatgcttttgtttgatcatgcaggcagaagagttgggaagatacttcagaaataatatgtatccaagtatgccttatcctaaacttttccgcttcccgtttagaactttctatgtgtggcatcaagctgtgggtctccaacgtgatattttgctgaaactctggttttaactaaattattgtatgaactgcatcactaaacaccacaatagtctaatccatttcagaccttcggtgaagtcttcactaaatgtttatattcagtttcactgtgccactttgggtaccaatttgaaataaaaaacttaactaaacaaaataatcgtagtgaatttttcaataaaatgtaacttggtcaggttcagctatttcagttcagttggtttactgaaatggtatctcaatctttacttttagtgaaattactccagcaatcatttcacaaaatggtttattatccttcacgttgatattttgtgccctacttatgtcctttctttcctttccctttgttaatttggctgccatttctgtctagatgtcagttagatagcctcccattctttagatagcctcccattcttttctctaactgtctgaaaacagcaccatttatttggcttttgtgtctcatgtactattttggtgtgacttcggtttatttaggtgaaggaccaggattgcttcgtctgcacagtacatataggcatgatctgaaaatatacagttcagatgaaggtcgtgtccaggtaaatggcagtatttcctattacaggcttgggttattgaatgtaaaagaaaatgaaaaccagccattttttgggtacatcatgtccatatcagggttaggattttagagtcgggactcaggattgaaccgcctgctctgttcctctgaaaaccagccattttttggcagctatctgaaaaactggtcttttcacatgattacacatgatttgatgcatcacaccttcaagtgggcaaaaacccagtattaagcagaactggtagcagatttctggaccctggtccatataatcaatagtaacgtaatgtaataacttattcttcttcgtagtaattctctaactaccagaaactatttagttccattctggattcactgaaatgtttatgttttttgtacatttatgccttgtgtgacatgccattaaattttttaggcaagggatatttcattaagtaatggaattacatcaggcagggatgcacacagacaacagagaaaataaaggagaaaatccaaagacaacatgaacataatgacatgccatcaaataattttgcatttaatatgtaaaaaaagtaatgattgctggggtttcctgaccttactatcctatgtcatttttcttgtactgggtaacggtcctaacggatggttgcttacattttttttcttgttgttacctaatagatgtctgcagcagcttttgcgaaaggtcttcttgatttggagggggagttaactccaattctggtttgttcctattacggaaatatatccagttgaagacttgacagagctgcaattcattggatttactgtctccaggtttcacttgtcagtaaggactcttctatgcttgatggacttcaggatggctctattgagatagatgaagcgaaggtcgccttcagataccaatgccataactcatacttatgaaaaaaaatatttgtttgaaacttcaaaagtttctgtcataaaatgtcagatctctgcaggctcgtttgcacaatattatcctttcttcaaaaattgcaaatggtgagactatggagttcccatggatggttgatggagctggagtgcctccaaatgctgctaaccttctcacaaatttggtatatgcattagatgtatttatttcctttcccctttgctttctataccgtatacttgtgagttgtttctgcagaaacttgcacatctaaaacaaccaaacgttaagataattacatctataatggtgacaaataagttgcccttatctcaactgtccaatcaggctcaattgaccaaggaaataactgcacaagtgaagctgctttctgacaatgaagatgaagaggctgtgacagatagtgactcaccaagtcatccttatgatcaagcaaaggcactagggaaaacagcaattgatatggaccgcattgcttctggattgccttgtggcagcgagagcttccttttgatgtttgcccgttggaagaaactagagagggatctctacaacgaaagaaaaaagtatgtttccaagcttttaatattcttgttgattaaattctcagaaggagttgcagcttgtgtaaccattgctaaaactctcattatgatgcagacgttttgacactacgcaaatacctgatatatatgactcttgcaagtgggtaaccatgttaccatctccagatgcttctatttctcttcacaaaatagctgggccctggatgcctattatatgattgtatcatgctcttccataagatctttgtcaattgtcaacttcattcgaatttgcttttctgaatgaacatgcaaattagcataccaaattgtgcctcgaaacttggccatgagagggcctgaccttgatttgcccagctgctttccatgctgtttaggccttaggggctgtgacctagggaatcaacaagaatgttcagcgaaacagcccagccgtaggaaaataaatttcttattttcataagaaaaccatgactattggtttcaaaaaaaaaaaaacatgactatcaaagtctcaaatatttcctaaagcttacctgaaagtttgctagtggatcactggaaagttcacaatgttgacgatctcaaagacagataaaatttgcccaaaataacttcattttgctttttttgcaagtgttcatctgctctctcttttttgcaattcaaggcttcttgcaattattttaaaaatcacgtgatgcttttgttcgaaacaaaagcattttctcaagtttcaaaaacatttctttgttccagcatatctcttcacctcatctatttctaacagtatacttgacaggtatgacctccttcataactcacatctcaaacttaatggtttgagtgatctcttcagagtttctcaggtaaattaaatatgtatcgcactcttaaaatgtaccttgcacttaaatgtgtgtagaaccacggatatacagctgctcctgtgtatttgtgaaatatttgcacatgaagacatcatttcatagcactcaggtcctaaatgaaatcctttgatccctgttttacattatgaatacaactagtagagtggtgaatgattattgctttactgttactaaattaacactgagagaactcaatatgctatgcactattagaaacatgtactgctatactacctattactccctccatcccataatataagggattattcccttttgggaaaggttaaggatgaaaagaaaagactacaatacccctattaaatgtgattttggttgtggtgagtgggtagttggaggctaaaataggtagaaatttgaattagagatgatggatgtgacaagtagtatagcaaaatctcttatattgtgggtctagtgagagggataaaatcccttatattatgggatggagggagtacgttactagtaagagtggcgtgcttatgttgaattctgaattttatgattggtcattctaatgctctttttctatccattttctgcctgctatctaactatttataatgtttctttttcattcagtcactagctgatggtgtaattccaaatgagtatggaataaatgcgaagcagaaactcaaaattggttcaaaggtactggtgtgtaaatatatttgaaaactggaaaagaaactgttatgagttgcgtcctgtatattcattgttttcattatgtagtgtttatccgaaaaactaacataaatgagattttgtttctagaaatgaaggatgctaaaggaatttgttgcagaaaatatgtagtacccaattttctcctagaggctagcccttttatttggcactgttttgttttttagtcacaagcaacttatgatgtttctcatgtccttttcttcagattgcacgccgtttgttgggcaagattctgattgacctgcataacaccagacgagaggttgctgctgctggtggtgaatctaatgcatgccatgatccaacaatagtgccttcttcaaaacggaaggataggggttactatggggatgttaagaatgagggttttgatagacctaactcaaacaagaagtcaattgatcttgatgattcgcacaaagaaaccaaatactgcttggatccaaagtaagtacgaaattccagttaggaatcttgactatgaagaatacaattgatattcaaataattttgttgtagatatgccaatgtgatggaacctgaacgacgtgttcgaacaaggctctattttacatcagtaagacaaattacattgagttttcatattccccttgcaaattgttaagtttatgctttcttgatttatggtaatatatcaatataactatagaagtatacagaaatttcaaaaaaaaaaaaccctaaaaactaaggctctaaaaagcatacatcatcatggaaacgacaatttcctatatgacatttctttggagtttttttttaactgaaattctttgtttttgttttcttctccctgataagaatgactaaggattattttgttgtcaggaatcacatatacattctctaatgaatgtacttcgatactgcaattttgatgaatctatggatggagaagaaagtcttgtttgcaaaaatgctctagataatctgtttaaaacaagggaacttgactacatgagttacattgtattgcgtatgttcgagaatacagaggtattaaaaaattatagtgtaatcataagcttttactttactaatactaccggtgagaagtgatattgatcttgtcattggacaactattgcaggtttctttggaagacccaaaaaggtttcgcatagaaatgacatatagtcgtggtgcagatataagttccttacaggtgagtttggtccccttcaaatgaaatgtaagatgtttgttttcaacatttctggttattaactcaacagttcttgaaaaatgtatccatacagagcgaacatggaaaagattcattgctacctgatgatcacactatgaaaattatggagccagaaagattgcaggaagttggatcatatctcaccttggacaaatttgataaaatggttcgtccatttgcaatgccagctgaagatttccccccagctgccccttctcaatctttggcagtccgtttctgcaaggataatggattgcaaggcgcaagattggtaccctatcctgttctttatcatagaatgattctgcccttctattttagagaaaatagcatctaatacttccaatgttttgtcagtgccaaaaaataccaccaaaacattcttctccaatcttataccacagagtgagcctgaaggtttaagaaatgtcacaacattgtatgaaccagctaagagaggggatcaatgctggaactatcgtcactgcacgagtatataacgctaatgaattaaaaattgactagtgccaatggatactccattaatcagatagcgttatgaggctgtctgcttctgcaatcaatcagaaatcattagaagactgcttacgtctgggaacaatcagcttaactagtcatattgacacaatgctatgaataatcatcaacaaaccagtcagatgtcactgtacagccttttcctctttgtatacatgattgatttggctatatctttttaacctttggcgataatgacctaaaatttcttattttattacctcctcctgttatattaactacatattttcctttttgaaatttgacagcaagataagtcagacatggtgagtggtatgccaaaaaggaagacaaaaaagcttcaagaatagcatgttcaacacgcaggccagcaagataagtcagacatggtttgatatttctgttaacaaaagtctcaggtaaatggtttaccaatagaatgttgataaagcacttgccttgaagagaggttaatagtgagtctgcaaaatgctgcatgagtgccaagcactgaagatcatgcagctggaacaattttgtcagttctgagaatgtaacctgatagagctgttttgcagacagtgtaattgcgtaaataataggttacacgtgtatctggataaaattttccgtatatatacaaggtggtcatattatgtgcctttaaaattatagtgtttccgtcttcagaataatttcactagaaaattctgctactttaggcgtttgctaagagcgttatttttagagctttacaggttggagcgttttaatcgaacatgtttaacaaaaagtactcgctgaacattcccggaataataccttgtatatttgtgacatgccagtgtgatatattcgatttacttttgctctatttttactggtatagactgatgtgatacgaagcacaactcccagattccttttttttcacctctttgatcagacggttcttctgccttttatgaaacggtgtcaaatattgaatcgatcaaaacacttttgatctttttttttttgctaaatctttttcaaatgttttcaaagtagccacgaataatagtcgaatgcacttgaatagaaattttgagaagatggtaaggcactgtcaatattaacaatctaacatacataaattctcatgttttgatgataacttccacaatacatgctgaatacaagaaacacctacccatctgaaggtaccttcacacactaaaaaatacccatagcttactcacctaaagaccctagcagtgtacaagaacaaacctgaatggttgtctcacctcctccctaaagaaggctggttattagaagttcagaacagatcatcgtaggcgactatttctctagctttgtaggttccttctggagccgctttcgtgctcgagaacgctgaagattcgcttgcattcctcttcgtcgcatcatgcgtattctcccccactgggttggcttgagctgtacttctcaagtcattcggcgcctcgcttgcctgtacaactaaaacctgcaacccatgaaagaaccagcaatctgagtatcgaagagcaagagtaccaaatggctcaaaacatgtgtagcatgctatagcttcccctgaatctgttagaaattttgttctgtttattttgtgcctgctgcacaaccaaagtgcagatgcatttcgactaaaataaagtgcaaaataagtttattgtttattttttctaaactaaatctgtattctacttggttttaaacgaccgttaacatgaacaaattgtgacagcgaagataccagcacagtctggatgtaaacaagatcaatattgaatataatttactatcttatagacttgtaccagataaaatggttgactgtaaccttggactgaatttaaggtagccagttcatcacggaattgagtaggttttgtagagcccagcaaatgtgtaagttaattgaataactagcacattaattaaatccaaaatgctagaatgaaacagcaaatgcagagtataaaatgagatgaaaaataattaaaaaaagcattcttttcctctcacggatttttgattattgcgggcgcacttcccaaactcccaaacggtatgatttttgcataaactttcttcatcggcatttcttagagaactttttaaagtcaacctttcaactttctaatactaaattctctcgtctgtgccctcaaataattttcataaactctgtttgatccataatccatcatccatcagaactttaaagtcgagataaaaggccggatgtgatgccaatctataaaattctcaaatctagcagcgccttcaaacaattctcagcaaagcttgaccctgtacaggctgtactgcattcctctacacgcacagcaagttgaaatcgagctcatccaactgcagcacgcagatctccttaccttcttggatccgacggtgacgccaccgtcggggtcgagggaggcagcaatggcggccatggcggccgcggcggagcggaaggtgacgtacccggtggccgaggcggcgtctatgcgggtgcgcgcgatggggccgtacgccccgagccgcgacttgagctccatcacgccgcacccgggcggcagccccgcgaccatcactagcaacggctccgaagccgccgccgccgccgccgatggagcctgtaccggcgccggaggagcctccagctcgtcggcctctaactccggcgggccagggccgtggccgtggccgcggccgcggcggcggcgcttcgccggagggtcggggctcgcgcgcccgcgcttgcctctgcggtgacgggtcatgatgatgtccaccgaagtgtactccctggccgggatagtaggggaatctgcacggctgattgcgcggagattcgtgcagtatcttcaattgttatatggagtatatttcaatggataagtaagaaattgaatattaattactccctccgtcccataatataagggattttgagcttttgcttacgaccacctgtcttattaaaaaaatttatgcaaatataaaaaacgaaaagttgtgcttaaaggaaattttttttgaaaataatacgattttaatgaaaaatcgcaaaaatatagatcggttaggcgaaatcgcatgtttagcaccctgtcgaacaaccgtggttcgacagaggtatctgtcgaacaaccgtagttcgacagccacctgtagccgcaacctgtcgaactttgaaagttcgatatgtcctgtagcggcactgttcacgtgaccctatctaactttgtcagttcgacatgttcctgctgatttctgactgttcacgtgaccctatctaactttgtcagcgcgacatgtgcctgctgattcctgtagccgtacttttttatatttttttagaccaactacccagttcgacagatggctgtcgaaccacggttgttcgacagggtgctaaacatgcgatttcgcctaatcgacctatatttttacaatttttcattaaaatcgtattatttccaaaaaaattcgtgtttaaaatactttgaataataaagtaagtcaaaaaaaataaataataattccaaacatttttaaataagacgagtcatcaaagcaaacaaaaactcaaaatcccttatattatgggacggagggaatactttgaaaactatatagtatcgttttttttttcattccatgtttgcattagcttcatttcggttgtaatcccagagtttggccaccgttattttaagactagccactggaattttagattggaaaagaacaccggtccattttgcaactattgtgaagtttgccggtttaaagtgaaaatctgcaaactagataaaaatttgttcccaatatgcaatttactcttattataatctttcagaaagactggtagaatgctggcaagtgcttaaacagccggtttcaaagtctttccaacatcttgatcaatagttgacaagagtaatgctatctgaattctgaaggaatgctcacacttgtataagaatgaacatacagcagtatcttctcaaaaaggaacaatacaacagtatcctcatttgcggcttaaatagcatcgcaaattcgactgctgttcatacaagaacctcattggacaaggcaaaaacgagcacatacatttggctcgcaaaatgccacataattggctctggaaaccgagaagataaagcacttcccttcagaacatgtgtgcttctgattgcgcagatacggatgagctctgaagtctgaactgataagccctgcagctagtagtagtgaatggcagctacctcagccgtgcttgcactttgggcaaaatggaatgcacttttattgagagcatttgttgctggatgattctgttgaactcagatcatgaacgcagacagaaggcatacgcaaatccaaacatgctcagataaggaagctggcaggtgcatccacaattttgtgagaatcagctccgagaggttcgtctagctgcttttagtgctgcacctgaaaacttgctcccatctgaacgtctgacggcgcttttcatgggtttatattcgaatgtgctaatatcaggagggctgtccgcagtgcacatagctttgcgcgtgttttcactctgatcaaaacggctggtggtagatcttgttggtgcataagcaaatgttctcaggtcaggaggtccagcagcagcatctgtagctttgctttgatcttcccctgatcagaatgagcagaagcagttgtaggcctgtatgcaaatgtgctcagatcaggaacgtcagtgctgtttgtagcatcacttgagaatctgctttgtagaggcactctagtagtcttattagccgtacaaccgaatctctgttctggaggtctgagaacagatctgcaattaatgttataaaatatatcaactcattgggacaactgtgtccccctcttaagttctgataagtaaattgtgtgaacttggtgcaattgaaattttctgaagctgcagacctgacaggaagagtgttcttcacatcctttaaaggagcgcgaagaccactggcacgagagcctgcgtatctgaaagatgatatcagcgcagcaaacttatccattgatttctctgcaatgccactgtatttatttacatgggcgacattgcatccaaattttccttcagaatttgtgttgataccgtcgtgggaatcagagtcacagcctgcattagtatcagacattcagaagatttccctcagcaacaaaaaaaaagggaactacgcacactcaaacattggcagaaccttctgttgtttttggaaaaactgaatttcttgtaatcgtcacaagtttatctatagagaaatggaacaaggaaaggtgcacattctcacagagaataagaacagacaactaggtggaactattacctttatcagcaaccggtggactttcatgaggactagtgggttgaaacattccctgcacaaatagtacattcaagaccagatagtagaatgatacagacagttcactgcgatatgatgatagaataacaactcaaaaaaaaattgcttacatcttcaaaattttggggatcactaaattttcttctcttcaatatacctccagagcttctttgttgatctccaggaagagtgtaattaccagtctcgcagttatcttcatcatggcactcatcttctccttgatttgtgcaaactcttttatttactgttttgaaatatgaactcctcacagtaatatttctattggcagagaccacattgcttttttcagcataacgtggtgcagctctggatggctctgtgttgtgtgaatctaaaaatggatctgatatcccaggcaaagtccctagaaaacgaaaataaatgcatacaaaacagaaaccaagattattttcattttaattagatataccagtacatgatttgcagatcaagtcatgcatcaactacaaaaaggtagagctcttaccctctaagaaagagcctgtcggtattgtacttctgttgcagaagttgactttcacctgtatagcagaagtaaaactataagaatgacggaaatacgatattgttgtagaaaggtaggactacgagaacactgaaaataaggcaataaagaaacgtgaaataccttgttgccttcaatgtctgggtcctcagcaggatcactaccaatatcatgagaacactggggtgaaacactggctgaatcatcccgagggatgtcacagcggacacgctcagaactacattgagaggcggtattgattgaatcatctagaggggttcctgagctaaaatgctcagaactacactgataaacttgaatgttatttgatggcaagctagtatcttcaattaaatcaggggtaccagagtcttcaattctgggactgggcaaagacccattaagtacttgttgcttaggtgtaaccttaggtgctctgaacttccgttttgcctcaagcgatgctaagccttctaaaagtcaaggattcatccaatggacagttgaagtattgtttacaaaacaagcaaaataccatgctaagaatcgcacatcaccttagacttcgtaaataagtttatggggaaattattagttcttcatttgatcctaaacatgtttgggaacgagaaagcacaataactgaactatcttatccaaggcattcccataatataagctgcaacaagtagttcatataataaagttgattggtatatatattgttctctcaattaaattaaaatgtgttgagaggatacagaagtaatttgtcaatacgtttctttggacaggtagatcaagctttttctttccatttgaaggagcactggactctctgttcagatgcactttatcaaaagcgagtgcgctactctctgttttgccctgcaagtcacatatacaaataaaacatatataacttcttagtaagacaatccacaaaagataaaattgaatgttggtattcgcatgtcagcaaagcaaatgcttgcatactggtgatctttaataaaacagagtacatcagtaaaaccatgatcacttacaatgtactttcttatttcagtgaggaccctacatttttttcttacaaaatattttatggatttttatctgtttttctctaatgagcttctgtaatgctctgtagcctctgattggatatttcagtgagcttacaaccattttcaagagcccctcgtttgtatttgcatattgatgcttgggtatgtttatacatatgcagtgcacagaatcagagtaggatgaaattacattcaaggaaacaaagcaccaagaaaccaaaacaaccgagggaagatcggtagtacctcaaatggttccttggtaatcggatcgatattcccttgggcaatgcctttagcaacagtctgtggtagccatgtataaaccaattaaggaaaagatccaatgcatgcaagttgagattttcttcaagtaacacaattcggtattactgagaaatggtggcattgaaaggccgttagcttactttctaacgcaacttgtataatggccattagacatgaccaaacaaaagtggaaattcatccttatggacttatggtggataaaacaacaggttatcatatgaatgagctttagcatctattgtacaaatataagtttggcaaggatatgggcccaaaaagtccaagtcttcactactgccatggggaatgcctgacaaatgaacaatatcttccgtcacagggtcataaactctttggaactgaaatgcccagatcgcctttctgaagttttcttcatattgaggtggaacagaaacagcactgtacctcaggtgcttgattacctgaaattatacgcatcatttgctcattatttttttttctaatttgctaagcaagaaagtgattgcacatcgttgccctacaagctcagtagtaactcaaatcatgtcctgcatgtatgacaggctatggattggctaatgacctaagtacaagacggtggcctcataaaagttgaagcaatcaattttgtgttgaggccttgccttctgtagttatgtctaagtagaactgcattctggttctactatccagccttttcttaccatgctttgtaggtcttgaacactatctcaggcatcgttcatgttagttcatgaatcagttctttccaattccaactaggcctaaagttagtatttgatacaacagatacagggtttaccttttcatgacccttgagcttttggataagtgcatgagctcgtttcacacccattccaggcaatgatggaagataatcacagccacttaaaatacacatctctagtagcatttgcatagtgaatccattaagatcaagctccctgcatcgctgcaatcgtgtaatatgaaattcaacaccttgtccaaacttgtccatcttgaaaataatctgcacaatggaataagatgcattttaattagagaagttacaacaaactatgaacactaatctagctgagcagcaaaatactatggggtacgtggaggacaaagataaagcgttttaacactgtgcttactctagaacagccaaatggtatcagatcagaatcctctgtgataacggcatcaacaagtttgttcacagacaagaatgtcatttgtgcatctgcttcataaggcgcaacaatataatcaaccttttcttgcttcaatacctgcattgcaagttttggaacaataatcagttaagacaagccaaatgttcctactcctgactagaactgcttcaaataggtggtaaatatttggtaaaaatacatggaatttgctcctttacctggatcagttcaaaagcaatcctaggtgtaatgtcaacagctttctgataacactcaaaagcagcacgtgaattcccagcagattcatgctccttggcacgctcaagattttcctttcgtgacctacaggatgtcatgcttacttgcttagcatccaatgactcaagaaacatcacatagcaaagaatggctggaggcctttagcttatccactagtctgtactaataatgcgactgctctatatcagcctaaagccacagttgtccataactatagccgtatgtaaaatgtcaaatcacaattttttttaatgttctgtaagggtaatgtagatgttccttggcaactgaaacatgttaggctctttctggagccctaagaaagaacatacctttcacgtttagtctcttgatcacccttcatcggcagatgacctccgtcaaatacaaggattggtttcacgccatggtgccgcaacatgttaaccctatgcatgcaatactcaatatgcctggttcagattcaggaggggaaacacaaggtgtaagttatggtgctcaactacaacggtgataaatgatgataaaaactggagttgcaaatctatggccctccgcattatgagttcacgacatcaaaaatgcagcaatgttagaagatatcccatacagtaaaaagatactactaacaatgctaagctattgttaacgtttattgaactattcatgtctaagctatttccaataaaaattccacaaactaaaatggtgaattctctgaactaaagcggcaccagatgccaagcagcggatctctcccaagtgtgtattttattcaatgcaacctagacatacaagaatctgggcactgaggcggataacaaatttcagtaaatgtactgcccctggaagggggcgaaaacaaatgccgcacatttattaccttaatcctgagagagactgaacaaacaagaaatccccccccccttcctacacccacctaaaaaatgcggaaatctctcatccgaagcaagacgtgccttttacccctcctccgaaatggatttcaccagtcgggaccaagaaaacaaaatcggaagaaacccctggtaggaccagcagctgtcaatacgctcgtggggaagaagtagatttcccggatccgtcgatttaggtctcaccaatcggcgaaatggattaagaaaccctgggttccaagaaaaggggggaggtcaccggagccgaacctggtggtgggtaggcccttgcagaggcggtcgccgcaggagagggcgcccttgtggagccaggagtaggtgtcgacggccaccgtctggcccttgagcgcctccaccccgatgggcgccatgatcgacttcagctgcggcagcaatccctggatccccattgccgcctctctctctctctctctctctctctctctctctcctctctctctcgctctctctctctacttgtaggttttttcttggaaggggagaagtgaagggcgggaagcgaggggttggagggagggagccgagtgaaattggcggacggcctctcgttttttctcttccggcggtccccaccataaatctatccgaaccgtcggtctcgccatccaacggctgtgctacagtgttttgctccgtgcgagtaggccacagcctgagtgggttccagatccgcgattgtgagtgtccaacattagttgggccctaacggggttccttacagctacgtgcggcctgtccgtgttaggccggaacggaattcccatgggcttgcagcccatttaagttgggccgtaacaggatttccgccaacgtgcgggccgttggttttgggccgtaacgggatttccgccaacgtgtgggggaggggggtgggggcggactaattcgagaaaattaatttttcatttgaattttaatacctttaactcaaatttcaaacttttcatctaaaaattgaatactttcatatcaaatttcaaattttcaaatcaaatttcaaaaacttcccgacataaattttagcgataatttataattttcagacccacctataagtgataaaggtggggtgcagtcgactgcaaagatcctgacagccgcctgccccgccactctgaccgccagagacggcgcccaccaaaaccagacagttacatcgtcatcccaatacggaaaaatataccgtgaaaattccacgtgtggtgtaaatccagaaactaccggtagtacaaaagaatggacatataagatttataactttttactaatgctaacgtgaacaaatctcaaaaatcaatttgtatatgctacgatatatggagattgcacgacatttttcccttccaacgtgtaggtgtgagacagtgagagcgacaaaaaagaggctgctccatgagcaatgaactcttgacatttcatttttttttctccttttccctatctgtatgtacagtaagaatgggtcatgctcattcgctcgtgggggggaaccggacgcctgaatgcaccaacaaagaatggaatcacaatgtcacatgtcgggagatcgatatcggttagcccgtctgctatctacgtgagaagccgccaaaaatgagcgcgacggcgaccgctacggcaggtaccaggccgctgtacggcggccgcggcgacgctccgttcacgtcgaactggcccgtgttcacgtactggttcttccccgacgacgtcgtcacgttcaccgacgtcgaacctaccaaaagaaagaaaaacaggcattcgttagttgttcacttgtttgtcacaacgacgacgaagaagaagaatcggaaaacgtgatgaatccatggacaaaatctgaaaattcgggtgagcttacagtcgtagtcagtccagcccatgcgcatgttcgccaagtcatacacaaaaatcttgtccttcaaaactagatctgcgtcaaagtgggaccaaatagttagcaacaaagcatcaacatggagaaatgtgtgcttcaatcatcagcataggactaatagatcgactgttttttttttatggaaattgaagtgttcagggtcaaggaaaaacatatggggtcaaaacgtaggattaatctgtcaaggcctcaatacccttgaaagaacttgcagattaatgtgcatcgatgtgattattgagaatgttgttaatcattgaaatttttcagacatcagtggtgtgatgtgatggttgtctcaagtcttaatagtagttgcgggttagacttagacgtgcaaccataattagctaattcaatcagagctagttaactaacctccgagtatggttatttgttgaccctggttcctttgccaaccaatacaccacaatacattgttgtcctgaaaagcatgatatggtattaatatgggcaggaacaagtcttttcagaaacggttaggcagatatacaactgttaccaaggccagaaaccaaatatattaaaaaaaatgcaggcttacaatagaagcctgctgcaaaagatagttctctggcttcaccgtcattgcaacaccacccataaaatatagtgacacggtaggaaacgacgagtcaacgctggttgaaaagcgaaaatatctgtaagtaatttgacatactgaagaacatgagctgctaatttccttcactgaaacaagaagctaacctgctggaagttacaaagcattggttccccttgctgacaagagagcgcacagatggagagactgcagcagttatctgcaaaaacaaaatatgaggactaacaatcatgtaacaagattaattactatcgtaggcttatcatatatggggaattccagaaaatagaactataagtgggccctatgaagctcaccgcattaacaaatggatcatatgccccatctgcaagatatgctaaagttgttcctgagtccacaattgttccttgtgtatttgatgtcgtaaacaaggaggaatcaattggcagcttctgtccattgacaacgatactttccagattcaaattgtaatgaggcctatatttcattgaaaaataaatcataaactgacgtccatagaaagaaattaggaggaagaatatcaagttactcatgcagcaatattgttagcctctcacgcaaggttaatgaatgtgcatacacttattggttgaaaacttttctacaaacaaaaaatcagcagaattctgaagttatacaataagtaattctagtaagagactcactgtgatgggacgagtggagtatagactaatcctggctcgacaatttcaccaagaacgagaataccaccaccattatctgaacctttcaggcaatgagagaacacctttggggataccccaagagaattcagttgtgagacaacagacagctgatgctgtccaaacccaaaaatcccatcaactgccctgtctgtctttgtcaagtctcctgactgtgagttgctacatctgtttcaaaagaattaacatattcatcagacaatgaataatactgatcatgcgaagcaacaaagttcactgttagggtaatgaaaataaaaaaatgcacagttaaactttacagcaaagtgtcaccaggcttctactgctaaaagatccacataaggctaagcttttgttaacataacaacaaggccattaacaggatgaagcatgcatgccagaggatagtagtctagaagcatgctgaatttcttttgctccagaatggcatggaaagcaaaatataaatataattttattcaggttgaccattaaggatattgacaactttttctggtggcaactgttttcagggatgacaagaactttattcagattgactattaaggatattgaaaggaagtttgcttgcaaaagtaacaagaagactgttggtttaaggacattgggagtttgttgccattaggtccatcatttgtaccaactcaatcagcaaaaagagccaactttgtcacacatgtgcaacaaactgtcaacatgtaaatggaccacatcactaacaaggtttctaatggtatcttactatccttaaagcacagtttagttgtcgattgcagtttaaaattaactaatgtaaaatttagaaagatacagggcttcaagggaactgtacccaaaaacaatagaggctgaagaattggcagtttgctcatttcccatgacagtgtcaaaatacattgtgtcagacacgtaataacctgatgtgccacttccatcaccatacgtgaaagtgtaaccacatgggctgttgtctgaagtctggcagactgcttcgcttgtttgaagggcagctgtacacctatcatctgagcatggtattttggatgatgttgatgaagtgtcaggattgaagaactccaactggatctgaaaaacatataaagtaataatccaatcagaatgaatctcaactgataggtaagtccatctcaagggataacaatgctgttgtatgcatgtcatagagataaggataagagcgcaaagaatgagatgtctcacattgagcccacttgaagatgggcaaccggtgcaagggctgcacgctacccataagatgtcactgccagtgtcaatctggacaaaatattcttttggtgggcttcccaatttcacacgcgtaaaatagagcctgcaaattcaaacactaggaattaggataaagtagttgcaaaaaggtctcctaatttcaaataacaagccaaattgcaaaatgaaaaatggcatcagtcctacaattcttctgattggaacccactaactgcaattgataactctatgtattatccaaggttgagtcacgtcatcttcaaaattatatccatcagctgacaatcccccaacccaacaaaaggacatgtatcctttcagtccttccatccctgctgaacgtcccctttttgctatctgcattggcgagcatgcttccctaatcatgatatgatatcatctttacattagcatgacactaatccaccctgcccatcagtagtaactagttatagtcatgtttgtcatttttaacaaaaccattgttaatacatgtatagatgttatattatatccataattatggaaaaattgcatccctcaaattccctctacaaagtagtatccactactagttgaaggatagttccaaaacggaggttgggcaatcacataacatttctaaatttggaaacaaactgaaacgttcatcctaacaaattcaaggattcacttaaagatgagcatgtttacaaattgccgcccatcagtaaaggtttaaacacatgatactccaatacctcaagggagttcatcaacaccacagattgcagatggtaactaactaactatagcctatggcacaaaaccatgaagtggaattcagcatgatggaaggtgtgatagcatataaagcctacaggtattggtgaaacataattgctccccttttaaggctcgcaaggggcaattaaaaagttccgtctagcagtccataatatatcgctccctattgctaagatatctctaaataaccctgtcactaagcttacaactggtgttgcacaaatttgaattgattacacaaacaaaagttaaatcatagctgagggtgacaaattcctaaccgcagctaagacaaataaatatcttttttttcctaagaggaattgaccttaagtaaaagcaatcgaggaaaatgaaagaaagcaggtattgcggccaagtgaaactgtgacgggcaaccaaatctctgtaaacactcgatccagtagaagcaaggtacgggctaataaatgaattctttcttctttcagaaaggaaaaatgaactctttctttacatatgaatgcatttattttattttaattggagcaagcaaacgcatcactgcatcagaattgggctcccgaatgaacaagcaattgagcatcgacattgaaacaagagaagcaattgaatgcatataaagaaagagcgaagtcagaatcgtcgcatcgaaaaagggacaaaaacgaatctaagaatccgaaagaaaacaagccgccgccatctacgacgaacaattcggccaaaaaaaaaaaaaagaaagccaaaacttcgaacaaaacagaacgagaagatacttttcagaatgcacacaaaaaaacatcagcaagaaaccgtcgagtaagggcataaacacttcatcagggttgaaccttcatccgagaaacagaaagaactgaagcaacaaaagcccacgaacaacccagccatccaccaccctgaaaacgaactaccattgtcgatacgtgagaccaatctaccttagcagaagcaacaacctcagatcaacgccgagacgaacaaacccagaagaagaaaagaactcccaaatttctcgatcacacacaaccacacccatacaaaacacagggaaaagaaagcgagaggcagctcacccacccgaccatgaacgggttggcggagccctccacggggaagtccaccacgccggcgacccctc

SEQ ID NO: 62916 - DNA, 15148 bp, Oryza sativa
acaacctcatcagaagattggccagataagtaggtcaagcaatcagctaatccagctttgctgcctacacggcacctagctagtgcctgttgccttgcgtcgtcgccaacacagatctctcctgcaattgcctaatgccaatgcgacatcctattaaaatctttaatattgtgatagcacaaagcctctggttcattggggtagttgattagattggttaggataaagagttgacaaaaagatccaatcttttgatctctctctgcctttagcacagatgttgtttattgtgtgtggtacagcatgacaaattcccttcagagattccctttaggcctttactagtattgtactgtttgttttataatgatataatgattatgatgatcaagtaaagtactggttcaatgtcattactgttcggttgaactgtatactgtactatttatattgcttggtctaccaattggttttgagttttgacgcattcagataccgtgcttgaacaagctaaggtgtctagcaacaacgagcttgactagttaatcaacatgaatgtctgttcagttcagctgtttactaggaccatcttgtcgcgaggaatctaactggtaataatgaaatgaatcttaagccattcaactcaaaacttggaacagacaacagagtatcactgtccagcagcccctagaatagttgtgcccactaatgttgcttgttgaactttttatgtaaacaaaaaagtgtgttgcttgctcaatctgtcgttctccacttaatttttttccatgaacatattttcaaggcaggtttaaaatactattatctccctcaaatgtaaggcaacttgttctggtccaatatgctgtaaatttgttttgtttttttcttgatgcctctcattttatctacttgttgtcctatcacccacagtcaaaaaagttcgaattttaatatttagttttggagttagtttagaggatttcgttcatcaaaatttactttccagcattagtttttaaacatgaaataaattatatctacgaatatatttttggttgcttaatttattttaacgagctatagatcaaacaatcaatctttatctgaagggaatgtatcatgttgtaccacgcacaataaacaacatttttagtacacaaacacacacacacacactcttaaagagtgattttactgccttgatccttaaggaggtatgggtgttatataagtactgcattcgtcccaaagaaaacttaacctagttcctagtacaatgaatcttgtctgtgatatgggcccggggtatgtgaagcgtgggggagttaccttcccatttagccacgtggccctacagcctggtcctcctcccacacctcggaagttgcggaagcagctaggaggcctcggggtgccaagtcacacccctcgggccctcgcgctgtctcgccccgaggccctcgggcagccgccatgtggcgaggggagcgagcggggaggaggcccatgctgagccgccatcaatgcgcaacaccctaaccgtctaaatgcggtaggggcggacgtgtggtgcggtccgattgacccacgtcaatcgggcgtaaccagactgtgaccggcctgttgccggtcacgtctgatcggacgggcgaccgtgcccccacgttcgcccctgtacccagcggagtggaggcaggtatgccccgtcccatcaaaccatcatctgcagctccctccatgcgagatgaaccgccgaaagcctctactcatttaagagggaatgacagggctgtcccccatgttgagtggggggcggcgttgggtcccactcaaggacggactgctgcttgacttccgggcgaaggcaaggatcgtggtccggtcaaggtaaagtgggtccccctcccgtgaaagagtaggtagaagcggtgcatgtggtatccccttgaactataaaaggaggaccttgcccaccgagaaaagggacgactctcagttagcctaagccccaggggaagaagagggaattcctcctagagcttaggaacctttgtaaccctcaatcttaaatcccacacacaggagtatggtattacgctcgatagtggcccgaacctgtataatcccagcttccacgtgcgatctagaagcactcagggcggatacacgatctcgacacgcgagccttttcccccggccgaactcacaaaagggggatctcacgatctcccgctagagagggtcattcctcgacaaatctggactatcctttgtccagattcattgtatgagtttttttgacagaggaagtattgtataatttggtacctagaatagatagctgctctttcttttacaactattttgtctgcgctgcttttcctcaaaccatatcgtcatctaatataaagcgtattataaggaaaaaaaacacacacactataagactatactccctcaattccaaaatataaggcataaccacctttaacccaaagatcaagaaacaattattatcatctctttgtttgaatcaatccaattaatacaatacatgcacccaatagaattaaacatctagtgagtgtatgatttaaaaaataataatttaggagagaagagatgctaattaattgccatgcatgcatgcatgccttatattatgaaacacctttaaaaagtagttgtgctatatatttttagaatggatggagtatttcagtagataagactaacctcaagttaaacaattagctttgcccttaagtaacctgaggggggacaatggtttggaaaaaggaaagatcccagaaagggagcacccacaagagaaaaaaaaaactaaaacctggccagagatgtagacctatcactaccgccttttaacacaaacaagaacccatcagagcgcctgcagccaatcacccaacaaaaggtgtcccctcacactctcacgctgcataccccacagggagaggggaagaaaaaaaaagaggtaaaaatcaaaaggtacggagaggtatagcagcggtactttggtacggctgtgtgttgcaaagatgtgttacgaattcggagaccggcaaggatcggcagcacatgttcaatgctagatcttgtggtgtagaaggaggagagatgtgtgtatcgtgtactataaaatgcatcacgtgtggtggcatgaatatgtatcatgatgtatacttggagagagattctatgtccttgtgagaagatgctgggatatgatagctttaggggatattaattaacattagagaggtgttagttctcaaattcacacttaaaaatagagtatcattggtaaggtgtcataatttgatatatcgtaattttagatcttaaccctatagaggtattaggagataccaaatttatatttaaaaatagtttaaccgtggtatctcctcgatggcatagatatagtatattaagactcatgctaaatatgatggattatcgtggcttgctcaagctcctaaacaatgagtgtgttcggaaagacgagtttgtggctgcggcggcaataaccatagttcctctactacttgtggcactattgatgttggttgcgccgcaaccgcaaccacgattgctgaacaaacccaatgttttttctaaaaaaaaaataatcaacatttttttagatttttttcatcatttttttggctttctaatatctaacttatttgtttgtgccctcagaaaattattataccctcaatttcatccatcatcagtgagcactttagaactggaccagtgatgtttcaaatgtaggaaagttcaattctcatgataattagaataacttcgatgattatccacgacactgttatggtgcataaaacgatagcaacaggagataaacaaaggtacatgccatacgcgagtggcataacactcacccaatagcccataggttaagatccccagcctagtagcagctctcctaggtcctagctactccacactctacttgcaccctcttcaccctcttttggctcttcaaaaagagttcattcgtgcgcttccctttttgaagttttgtttggacagcaacttgcactccctccctccactagctctcaaaccgaatagccaggaggcccgaactcactgcatccactcgtgaggcaggcaaccgaccaccgacccaacccaaagatttattttaccagaacaagaggttgccactctccgacaataagcacattcatctcagtaaatagtaaaaaaaaaacaaacaaaatttattttggaaatattcttttgaattttgttgggaatgctacgaatcgggatgccgacgtttcagacgaaccctctccgaaaatattgtttcttctccttaaatattttttctactaaactacttatctgaccaaaccattatatccgttgtaattaaatctttatgacaagatatcatatgattatattatgtcaagagaaaaacatgtgtttcaagttgttaaaactcaatgttttatatgtgatagtaatatgtttcaatgcatgtcttgagtgtatttcataaaatttcaaactacctgccaccactctctctccacctttattcatgcatgcatgcatacatttaatgaccttcaaaacgttttttcgctaaaactatttatctaatacgtgatccgatcacaccattatattcgttgcaattaaatttttacaataagataacatatgattatattctgataaaagaaaaacataagtttcagtccgttaacacgcaatgttttatacgtgataatgacatgtttcaatgtatgtctttaccgtatttcacaaaaatgttactaaatgtttcaacgattgatttttttatcatatataactcaatgttttattggtggtcaattataatatttgaccgaccgaatttttttaaaaaaaagatcgggcgcccgattcaaatattcttccgaattttgtcggtcatcaagttcttaccattaccgtatcctatcactatcggtaccgcccggtaatcgtgatagttccaacttcatatatgacagggtcatcgcgtagtcaagtcaattaaataacactcctaccgaacatttttttctgtttccaccagtggagaaacagaagagccctccgagtctgcggaaacggcgcccgcgctttccccgctttccccctcctttcaacggccgtcgcacatggtgaacgcagcagccgggtcggggtcgcgtacgcagccgcattcgcatccgcatcggcagccgcagccgcagccgcagcccggtaaacgcacgggtgggtcgtgggtggaacgccgcggacgtccgcgattcttccgtccacgcggttgcagtacacacactctctctctctctctctccccccggctcccgcggaatgccgcgatacgagtttgggagcgtgcgtggcgtgggcgcggttgcgttcgcgtgcgtgcgtcctggcgggggagatggcggcggggcgatgtagtcgaggcgaggcacggcacgtaaaaggttcgtctagaagcagaagcagctgaaagtcatggtagcccacgcaagagaatcaacaacgtgaggacgagacccgggggctccgttcgctggatgggaatatatcatttcgggtttggtacgacgtgatgcttgatgaggtgatcagggagtaaaataatggatcttcttgaatcttgattgaaaatggttaaaaaaaacaatcgactgagctcctgtctagactctagaggcatcttggtggtgtaaattttggggagaattctaacaggagattaatcgatatacattcgactaaccggtagtgactcaaacgtgggtattcgctcgttttcgaaacagttggggcgagtggttcgcggttcgctatcattgtgtgccatggtccatggatcaccgcacacaccaggtaaagggcaaactctttccgatccaaagacttcgccgtccttgacaacggcccatgtcaggcgagaccatcgcgcacttattattacgagtaacatctcatcctcctcaaaaaaggttttgtaacatgaacatctcagccaccatatcaacgcaatgatgctgagcacacttcatttctgacgctggctgcactgcatttttcttcatggtcctacgtaccgtattagcatgatccttctgccttttagttcaattaggtacagtacacagaatcagtaaccgtgtgatgtacagaaagaagtttggggttaccatgtagacaggcacagaaaatggaacgctaaacatctgtggtttaagggaaaagatacacgctttattgatattttcaagtgtacagatgtgtgaatttaccctcaagctttgaaagccatgatcgctgcggttcaggactgttcaaatctaaaacatcttccaaacctccgagccaaaaaaaaaaaagagaaattaagaaaaagaatgaatggactccaaaattcttttgcacgaatacatgtggcctatccacaacttgatcgagcccccacaaagagcgtactaacatcagtagtaagttgcacttgcttcccctatataccctgtaaaactgcaatcatgaagcacaccaaaactgcaccttaatctccaaatcgcgacaacttccatatctgtagtgtacataggcagaactagcgagtcgccaattgagcttcaccattgaagatcaatcacgtaaaatgttaaggggcgctgtaggtcgagccaagttatgcagtcccaggttcccagctgtggcatacttctgtaagcaacagatatccaatggcgcagatcatgttgtccctcgacagtttagccattcacgcatgtcaatttgtattaacatataggatggggtgaagatcaaggattaaacagtgactatggatcatatcgagccccagatgtgaaagatgagaagaacccagctgctggtccaggaagaatgtcgctgagtttgccaacctgcccatcagagattatggacccccatcttgaagtgttctccccaaatttgctcccaacctgataaatgatgcaacatggagctgagcattgctactgaattagggaaaaaaacgcatcacaaagctgctcaatgaaggactataaagaaacaaatagagtatatatgttttcagtgccacctgctcaatgaaagactataacaaaaatcaaacttctagataaccgataaggatttggttgacttgaaacaaatgttatgcagtagtgataagtgatactaatcaagacatggaaccacctatattcagtccatagttattttttctgtgttaaaatgaagtaaagtcttattttttctgtgttaaattgaagtaaacttttgagtacttcctaccaataccatgcttatgccaaaaaaaaaaagatgttcagccaatcaagaattaatatatagaatccatatttagaaatatccacatgaaaggtctatattttgtttcagtaatctaaaaaaagtaaatgtgaatttctgatttaatgtgatactgcaatccaccatttgattttggtactaggcatgctaaaaacctgccataattgacagtacattgcctatacaagcttatgcagatatgctggagatggaatgaatatattggaagagaaataggcaagggccttatcagatggcttttggctttaagattctctatgaggagggtcaaggagattttgttcttttatttaacattgatcgacctttggttgatatatatcctaatttcatgtactccataggcacaacaaaaaaggacatccatatatgcgggattatttctttacttttagtttttactattttttactatgattactggtcactggtcaaacaagggtaaaggcatatatttgcatagtataaacctattagatatactcaacttagtgtatgcaagggtaaaggaatggaacagatctgattatgaataggatatccatttttcttgtctaggaatttgagtgtttaccttttaattaccaagggttaaatgctcccagctggtagctgcagagccactggtgaattgatagtattttggtgattttctcctcacttgcctcacagtgtaactgtctaaattaaaatcttcgaattttggtatgggttgatccaaggacaaatatattctccaaagagatgaactttttttagatacagaaggtattttattctgaagcacaagatgtgctagatccccaacctctgcccaggggcacacgaccaaaatgcattccatgatgttctagaatttcagcacatgttttttttatgttggaattgatctgggattatcctagccattcttacaagctgctaataggcgttccttttccttctttgcaccgaccacaggtttggaggatggaattaggcaatgtgacacacatgactacagtggaacaagttaatcgtgattgcaggtttggatatggcattggtaaggtgatgcacatgacgtaagtggagcaagttaatcacaattgcaggtttggaggacgccattacttaagcatatttttctgtcataataatatttggcatccatatgtttgtacacctataacatcccaaaattatctacctgaatgttctggtttgccacatgcacaccacagtactattgactatttatgaattatctgaaattcacattttacttgtgtatgctgatggttccctctgcccaatctcaattcaaagggttataagtcattttccttataatctactgctaagttcctacagaatatttgcctttatatgtataaaaaaagtctaaattgttgctgtacagatttcacacacatgatttattcaatagtttgaacatggataatgtgctttgttcaatttcctttttaaaaatctaagatttgcccattggattgtatctcagatttttgcatggtcttagagacttcaactacagtctggaaataatgtaatggtaaattggtaatgtctacatatttacagattgcgtgaactctctgttctatttttccactgacaagtacataaccatatttagatttgcaatatatgctacatgtaataaaaagtgacaatgaccatatctgaaccatatgaactttgcattctaaataagtacattgatcgttccctctgctagatcatacttatcagaaatacatgtcttttttaaaaaaataattattgttataatttactactgtcatacccaactatgctgttgctccaacaaaagaccatgtctgccactgaaccaattactgtatcaagttcatcttgcctgctatctgaagatctacctagccatgtttgctgttgctctaaccaaaatgaggctctacggttgttgtgtggcatacaacttttgtatttgatttgaatttagttttacatggcttgaacttgggctcgcattgcgtaagaacttggttgacaacttactgaaaatagaatttggtcttgcattatgtgcaaacctgtgtaatgtaatgtactgtttctattcagaacataaacatgcatattttccttgtgagttattggtaaggtaccgagttaataattcctgacagcctttagaattgtaatttttttattttggttttgttgctggttgactgccaaatgtttataatttctgtacaaatttcctgggagcaaaaaatagccaaacatatctcatgttgtgtggtccaaaaatcaaaagaaattatgttatgcttttctgccgtgctgatgacaagtactattttttttatacaaaggagatctcaaacctggtatacatgttatgtatggtgtcttaacttgtccttgcaatatgtgtgaaccatagatgtctgaacatttgccagattagtgtttgaacatttcctatattattgtctgagcatttggcacattagtttctggcttgcccttgtggtgtaggagtatctgaattcagaatctgaacttggacaagcatctaaatgatgttcaatgttttaataatgctgtgagctgattaatgttatggattcttgtagctcaagtattataacttcacaaattcaccaaaggatgcagaggttttcctgagtttagtgtctgaccatggtcattgcaatttgtgtaaacaatatactcctattaccattcatggttaggattggatatctgcaagttcatactgaattcatattatataagttcatacttaaccggcttggattgccaggtaagatccatattattgtctgaacgtggatatggaatgcatctgaatttagtgttggacatacccttgccatgtttctgaactcagtgtatgtatgaacatgcccttgcaagaatgtgccttgcacgtgcactattactagtaaactaaaaatatgcagtaggttactcacctgggtaacaaatgacttgagcaatggagcagcacctccaaggctaacattatcatcaaattctgatgccgtagatctttctccatttgaatatgatttccaagggcttctagatgtggaatcatcggatgttgactgtaatgatgatttgtgtgctcttgatgatagagctggggcactacaagtgaaacatatgaacatgagacctattagatctacaaactagtgtaatttttcatcagaaccagccaacgctacttacaaaggtttctttgaaaatcaactttcacaccaggctaaaaaacatcacatatggctgtccaataatatcatctcatcaagtattttaagcatgaatttaaacactatagctgtctaaaactaatgaccttaatggattaattacagaaatatgcattatacgacgataaaatgtatgtgtactcagtctgaagaattatttacctgatcggtaggtatttgaatcttgggacttgggagcacctcataatgtttgaatctgtatttgatttagtcggtaacttttgcacagttccagtatacatgtgattcagttgaaccaagaagccgaaaagaacaacatagcgcttgtaagattgcttctcattctcccacagataaggttcgtacctgtttcaaaataagcaaatgcttcatcatggacaaatatggagcatgggtttttgtctataaagactattgatcatgcattcagctattgaattatgtggtgatatgtataacaaagtaaaacagaggatagtgcttacgtagcccagtctatcggatccaatctctgtgagaacttattgatcagcttgtttataggctctatggtagctgaatctgcctgcaattgtgactgttttctcctgaaggaagtcttagcaatggcgcttggcgaagagtcatgtgttctctgtgtttcagtagttttggtggaagaacttttgcctcctgacagaacatcgccaatgaagcgcaaatcgagcagtatttgcagaacccccttttctgaaaccagagatttaccagactcgattgataccaaaaagctttcatagatatcaataacctgcacgaatttaagtagctgttaggttcagtgattatattggcttttaaatcatacactgaacattttctcctaatcttcatcaatgcaggtagacaaaacagataattgttaataaagcaacacatacaacagctagttcctcggaggttctcaaaattgaaatattgatgacagttggaagggcgaggcattcaggttaataaggtccatgacattatattattagggcacggtattaatttttgtaggcgtgtgcaggtaaactgaagactatagtgcccagcttaatcaatgcttgattataagaaaaacaacaaaagctgaaaagcttgattaacttataactctataattactatcaatcatagtagtaatgaattgtagaacagtcattacattttgccaatagcaactattgcacatataacataaacaaatggttccctcgtagtatctattgttgatcatcattacggtatggtcaaatttatacaaaggcaaaaacacatgaaagtgaactatagctagttgtgtttcatgcagatagcatgataaaacattctttggttcttccattctttgctagaagttccaggccaatgttttagcctataacatgcaccacaattacttctcgtcaccccctcaaagaagaaaaggttgtcatgaaagaacattaccttctgtaacaagtcccatgcaaagttttgcaatatagatttgtccaggatgtgccctccaattttatgaatctccaaacatgcttgataaagaaaggatataatgtacagtgaaggcattgatggaagtgctatttgcatctccaaggggccctcagtggattcctcttgtttgatgactgtgacttcccatccctgacaaggcacatatatcatgtctatgacaatcagcatgccatgtttattttggcattaaaatagcatgatagactagaaatcaacgttgaaacacatagtcagaatttaatatttgaatatagacaaaaatcgaagcacaaaaactagaatcaaaacttggggttagctgcttggtcaaccctagaaaaggtgagccagtaagtatagctctatcgaatatcctataatagataacttcaaaattggcattccaataggcaaaaacaaactctacaggcccacgattttattcaacaagttctttgtaaatcataagggcacttaataaaagagaaatgtcttctagctgctcagtcatgtccaacatgatccaaaattattacagatttcatcattatgttactaatattgctgtatatagcagatgtctttgttacctagcaaacaaaagcatccccgattgatagtatgaataacatggacagaatcagaaacagcagtaagaaatatacttagaatgccttttacccgtaaaggggttggaaagataacaattggaaagataagagggacatggagcgtacccgtaaaggggttgataaggacaatgaatcatctttgttgaggtcatatgagagaagctgtgataattcagtggacaaccatgctatccacaatccatgggctgcaatgcagagtgcctgtaaggtcttgtttagttcatcaagtctgggattggagctatcatcagcaccaaatagggaagcagcagcagcaatagtttgtcttctggggttgtcagaaaattgccttccaggactccttgggcttgactgtgtgtgcctcctgggggtaaaaggcatcgctgtatcaaacgatgctcttgaatgtcttggtgagggcgacgataatctcataaatgctgcaccaccagcctcctttacccactgccttggggatcctaggatcaagggtacatgactcgagtggtatctcaatgcaaacatgaggcggccaatgaagagagatctctccacgataacagatgctgcaagcatattgctctccccttttttggttctcaaggaagcagacaattttccaagctcagcttccaatccattcagtatcccagagatggtcttatagcatttctcttggaggtatggcaccagctccttcaatctgggagcagaattgtgcgagtccacaaaacttaacagatcctcaaggatagtcttgcatttgctgtcaattgcattcctgatgcgactaacttctggcccaaaatatgaggtaaggcagctgtggaaatcattttcatcagcaatcggtttcaaatgtgccaaaattccacctttcttgatcttagactcagagaaccagacaccacctccagttgaaactttccgcaaatacaccatgaaatcaccggcatcctttggatcagcattggcaccaataccatcaattgatttcttaatatttacactatcatccaagctgccgaattccaagtgcacaatgtctttcatccgttgcacaaaggcttcttccatccaatcctcaaaaatgtccttcccttccttcaagatgaggccacggatctgatcccatggtgattcaatctctgatccaaacacactcttcagccattgctccagagtcccttccagtccttccctcccatctaatgcctcccgcacaagtctttgcactgatccaagcccttccccactctcaatggcatcaactagtctttgccctccagcaatcacaccaaaaatctcatcacagcatcccttcagccaatctgtacaagtccttgcaacagcatctggctcaagtagcaccatggtggcctcaagttgatcccagtgttctttccacaaccgtgtctcttccacagggtctggaatgccaccgaacagctgtgaagggggcggcaaatcgagcaccgtcttgaaaaacagtggcaaatcattgagcgcaagcacaaacaactgcccgacatggcccagcgtgacacgcacgatcttggcgacatcgcacagcacggaggagtaggaggtcagatcggaggcaagggtggttagggcttgggagatccaggcgcggcgggaggagaggaagagttggagtgcctgggtcggggtgagcgacggtgcgtcgattgaggcagcggccgcgagcgcgtcggcgtgggcggcgacggagaggcggcggtcggcgaggcgctcgcgagcgcgctgcgcgatctggggccggaacgcctccaccagctgcgcctggtgcgcgagcagcgggaaccgcgcggccgccgcggcgtcgcgggagagcacgccgtgcaccacctgcgcccgcacgtaccgccccgcggcctccaggagcaggccctcgtcgagcccgcccccagatgtgctcgggggtgtcgacgaggtacttggcgcgcgccgccgacgcgtagagccggacccgcccgccggacggggagggcgatgcggcggggggagcctcgggggcggcgcgagcgacgcgagggagtcggagatgcgggagaggttgccggagacggcgtcggaggactgcttgatgaggagtatcgagtccgcggagtcgaggaggtcgcggtagctgcggccgacgagctggcggagctcctcctccttggcggagatctcgcggcgcgtggcgccctccgccgcgcggatctccgggggctgcaggaa

SEQ ID NO: 62917 - DNA, 6522 bp, Oryza sativa
atctcgcggcgcgtggcgccctccgccgcgcggatctccgggatgcgtctcgtgcggaacagctcctcggcgtcggccggcgccgccgccggagactgccgcggcaggcatcgccgcctagaccttggagctcgcggcgagatccagaaaggaagcgatcgggattgaggaggaggtagggaggagactgtgtgtactaggagatgcacgttcgtttgagttgggtagaggaggtgactgagagcggtgggtgcaggtggaccgaggggtcgtcagagggtgggcccagtaagtcagagacccgacaaacagtacaccgggttctgggagtgatcttgtgagataattgttgcgagttgtggcccgtgggtttaggttgtatttaggggttgtttggttgatgcgtaagcttatcataactaagcttaggtaagttgtggcatgtggcaaaagtatggccaagaaatagttaatcacaagtgtggcaatgttagctctagttatctgaatatgacatgtgggacctaagggtaggaaagtgtggcatgacacaattgtggcattaaaacaaacacacgcctagaaactgtggcatgactgaagtgtggcatggcaaagtgaagcaatcaaccaaacacccccttaacgttaaaattggaagtttgattgaaattagaacgatgtaacggaaaagttaaaagtttatgtatgtatgaaagtttttatgtgatgaagaagtttgaagtttgaagaaatattttggaactaaacacggcgttagcaaagttgctaaatgtccatattttcttggcttaaattaaacaaatctagaacaagatgtatcacgtcccatattatatttgtttattttttaggatggaggtacatagttagactgttgtgaatgcttgatgcatagtagtccataggtctatttgaaatattcttgtaatgttgatagtttaagtcactttggttgacaacttaagacttaagcaccttcattgttaagtgatacctctgcatgatcattatctacatactcagtggtagaagaagtagtagtacatggtatccatgcaatacttgcattaggcagttgtgcttgacagccttgactcatgcatggggggtgacaaatagacaaagcatgtcctaaccagaaaaaagcctgattcacttctgactaagcccaggtcaaaactcttattgggcccagtctgaggtctaatcaaccaaacgatgccggccttgtcaagtggggataaaatatgaaatggccatgtgtcttatttacttttttttattatcacaggttatttgctttatacttctaataaaaatatgctttattaaaaatattttatatagtgtatttgtttagaccacttattctaatctatttgtgagtttcatttctaaataaaatataaatgtttcgtgttaatgaagtggacaatccatctgaataatctgcgcaaaaaattgtttcaaacatggcccaccaaacaactaaacaagacccgtatatggcaatgttaactaaacaagtccaatagtttgcatggcaatgtttgccgcatagtatgattgcaagtctgtaaccttgcattgaacgaatattactcctggtcagacaaaataaagatcaattgccgttatatcgtctattgtctatacagtagttctttttttttttagaaaagtttatatgctgtgtttgatacaggagttcccaactcctccctttcgttttccgcacgcacgcttttcaaattagtaaacggtgtgttttttttcaaaaatattatatacgaaagttgcttaaaaaaatcatatatatacaattttttttaaaaaagctaatatttaaataattaggcactaatagatcgctccgttttccgtgtgtgtgatgggttcccaacacccaccaccgaacacacccatatagcagttggtatgcataggataggaaatgcttggtaggtcaaatatcattggtcctttaggctgagttctttccttgaggttcctaactcacctcattctttttcacgcatacatatcccaaagcagtatagaatctgtctactcccttcgtctcgaaaaaaacgaatctagtactggatatgacatattctagtacaacgaatctggacagaggtatgtctagattcattgtattaggatatgtcacatccagtattaggttggtttttcatggacaaagggagtacatgatttttaattaaataagacaatagtacgatgaatcatgaaatcaagcaaatcaaatcatagtataataaaatgctaaaaagggaatgtctgagcttgtaaaatagagataaacaagtgactatggggtaggcatgaaaacggatcggaaacggacggaaactagctttatcatattcgttttcatattttttttcggaatcagaatcggaatcgaaaactcggatacggaaatgaaatcgaatattatcgaatatagatacggagcgaatatgagacggaacgaatacggtaacgaatatttaccggtatataaaaaacccctcaaattgagtttcttgatcaaggaagagatatctcttattattttagttcaacatctccaacatttatatcgtcaattttgtagacggtctcacacccgtatgtgaaaatcgattttcatggctattcctctaagagatccatatgcaaatatgattatcattttctattccccaagaccttttactagatatataacttatttaccctttataaattggagatgttatttattttacttcacatcttcgaaacttgtaatatttgttttatactttaaatgctttcaaatacaaatgttataaactacaaagtagtagatcccgttgagctctataactttgatatggaacacatctccatcagatgtcgtttgaattgtagatctgagattttgtaaaaattaatatggtatattataatgaatatttagacccttaaatgacctcaaataataaaatagtcaataagaaagttgtagatctcatcgagctctacaatgttgatataaagtttgtcttcatctgatttcgtatgaaaaagttatttatatatatatatatacacttattttttctaaaatttgctcaatgtgtgcggatatccgaaaaaaaatacggatagtttccgaccgttttccgattccgacggatagtacccttaccgtattcgttttcgtttccgagaaaaaaaatccgaattcgtttccgaatccgagaatttccggatagttccgaccgaaactgtccgaatccgaaaaaaggtccgggcggacggaaactatccgaaccagtttcaaccctactatggggtgcttagatccagggtataaagttttggcatgtcacattagatatacggatacacatttgaagtatcaaacgttgtctaataacaaaacaaattatagaatccgcatgtaaactatgagacgaatttattaagcctaattaatccgtcattagcgaatgtttgctgtagcaccatatttgtcaaatcatggagcaattaagcttagaagatttgtctcgcaaattagtcgtaatatgggcaattagttattttttagcctatatttaatacttcatgcaggtgttcaaacgttccatatgacagggtgaaaaaatttggggtgggatttaaaccagtgttgtggaagacggtatacggatatcggacggagagggtaccgccaaacgattaatcggaatttggcggaaatataacgttttgaaaatatatgtacatagttgataatagttttccctttttgataaacaaatgcatataactaaatatattccttctatatatccttaaatagaataaccatgtatgacatttaaataagttcataatggatagctgttactgtatatctcaattctcacgtagtaatgggttttgttcataatgcttgaaatgataatcaagagaatgttacatagcatagatgaccgtaatcaaggtcccaaataacatatgtatcggttacctcgaagagcttcatcaaatacaaactccaataacgtgattatcatcaaaatcaaggaacccatgttcaaactttagaggaagtcagttccttgtcattttacatcttgttgccttgtgaaaatttcggaagagcttgtagtcagtagtagtaaagggcacagctaacaaccatcatcacgccgacgattatacggttgattagacggagatggacgatttaatcggtaatgatcggatttatgcgttcgttaccgactaattatgaccgcatcgacgtgatgtgacggtctgatctccgtattcgtattatcggacgtattaacggccattaacaccgttttccacaacactgatttaaacaaggcctatgggggtgtttagatcccatcctaaaattttacacctcatcacattgaacgtttgaacacctgtatgaagtattaaatataggataaaaaataactaattgcacggtttgtgactaatttgcgagacaaattttttaagcctaattgtttcatgatttgacaatgtggtgctacagtaaacatttgctaatgacggattaattagacttaataaattcgtctctcattttatactgatggattatgtaattagttttattattagactacgtttaatatttcaaatgtgtgtccgtataaaaaaaattgggcgtgaaactaaacacggccaattttcataaatcaacaagctcaagttgcatcatctgacacgcttctttgtcctggccaatttaagagctaatttccagttcattaagtgcttcgcctgtgactgcaccaaagaaaatcaacaagaaacagcaataattgcatttttcaatcaacaagaacaagtcatgattgtcagtaactagcacaaagaaagacaggcgtttaaagcaagaaacaattactagtatccaggttgctttcgtcgaatatattattattgaagttaaaatccagacggactttttctatcataaacgcaaaaccccaatatcatgtaccataaaatgccgcttatggcaagaacacgctgaacacaatttcttggctgcgtatcttctgccactaaaatgttgagccaagcttgcaattcactcaatcaacgagcatttgttttgaaagtactgttcactaccaacttgacagaattccaccacaataaaagaaaactaagctgtggaattatctaatagtaccataatagttttgctgtcattttaaaggatgggttgcgcacaaacacagattcagctcaacacaattcacaaacttatttctattgaattgccatgatttgtttaattaactgatatataactttgacaacaatgtacaaaacaactgatatcaatagtcttccatgcatcacactgtcatcaaggcgacaaggcatgcctcctgaatttagctctagaccctaccgaaacaagaaaggtacaaaaacaataattccctagatcttaaaaatggcaagcattgcattcatacatatggtcacatgtaaaaacacaaggtgatgaattgccagtgtagagaagttacctgtaatattcctcagatacctgcaaatctcactggtgcataaggtgaccatgcaaacggagttctgcggctggacatcaagcttggttaatccttgcagcgtcctcttcctcacatcaatagcaaacaccaaatgcaacttgtccatgggactgggactggttctagaaagcaagaaaacaacatcatcatccatgcttatggtggggtttaccattggaagttccttgaacatttccacgatctcgctgaagctcaagttagaacgacatgggttgctggcacccaaggtgatgtctttaacaccaacctcacagtcacggtgccagtgctcgcacgaagaaccaatcaccggcattggcatgctccatgttgtggccttccagtcgtcacggattacctgggatttccttgtgttattgagcacgcaatccacataagaaacaggagtgctggtggtattcatcggctcttttggtgaccacatttccatctcaatatacttgatagagtctctgtttcggctgatggtcacatcccggaaatagctggggtcatattgtatcaggaagagatccctgttgctcctcgctgggcacggcagagggatgtcccggagcgcagggaactcatcgagcacgtcgcagaggaagatgccacgccagaggtccacccaggcgacggtgccaccctcgccgccgaccgtgatggtcttccctgtctcgtggtacagcctgtcgacagaggcaggtatagggataaacttgtctctgatgaactcggtcaccgataaccgcttggaggtccaacctttggaactggaggtggatctgtagaggtggaggtagaaatcccagctaacgggcgcaccgcctttgtacaccgggggggctgcaggaat

SEQ ID NO: 62918 - DNA, 2379 bp, Oryza sativa
aagtagtccaaacctcgtgcgttggcgatgctgtcggggttgacggggacgcagaggaggacgagatcggcgtcggaggcgatgatcttaggcaccacgcggcggaagtcgaggccggggcagtggacgcagaagcgggagagaagcggcgggcgggcggggtggaaggtcgcctggatgcgcaagccggtgctcgtggtgcccacgccggtgctggcgttgggcaggtcagcgatgaggcaccacctgtcgaggaggaccatgccccctgatgagccgtcttcatggccgtcggactctggaaggggaggagccgtggtcctgtagggaacagtcggggcagccatgtccatggacaagcgaaggataacagatccaatcgcagggaggaaccgaatgtgggacggggtttttgacttaaaaaaaactaattttataactcatctgaaaaccacgagacgaatttattaaacctaatttattcatcattaacacttataggtttctataatatttagctattcatcattaacactaattctgatttctatgcaaactatgcaattagtttttttatctatatttaatgctccatgcatatgtccaaagatttgatgtgaccttttaggaaaaaattagcaactaaacaaggacataggagaactaaattattgtgcaacccctcctctaccaagttagtctaagagagattgcataattctaccagaattggagacacaaagatgtagaggtaagactcttcttatttattcattaacttgtgcaatacaatagcacctcctcccctcaatatataggcatagccatgagtgcttttcatatttagtgacggacctaattagtgggtaaccgggctggaccttcatgggccggtggtttccttaaacaaatcaatcagatccaatttaacttttggggacaagagtctagggttcacgaaggacatttttctccacgtcactcgtgtgcggttaccatcaacagcacgtacaacaaagacgctactacatgtggtctcgagtcttcacatgggctaaaaccacaacattgttatagctcacacaataggaataagtttactttgagtgcctaactagtagccgaatcttattcatctcgtttaaccacgatataagatatgttgactttccaactattaaaacatgtacaatttttctcccggtggttctgaacgtggcgactacgtggaggtgtttgacatgatcttcatcctacgtgatacttatgagcgcagtttgagatctaatcaaccaagcgatgccggccttgtcaagtgggaataaattatgaaatggccatgtgtcttatttactttttttattaccatggattatttgctttatacttctaaaaatatgttttattaaaaatattttatcttgtttagaccacttattctaaaccatttgtgagtttcatttctaaataaaatataaatttatcatgttaatgaagtggacaatccatctcaataatctgcgcaaaaaaaatgtttcaaacatggcctaccaaacaactaaacaagacccgtatatggcaatgttaactaaacaagtccaatagtttgcatggcaatgtttgccgcatagtatgattgcaagtctgtaaccttccagtgattgaatattactcccggtcagagaaaataaagatcaattgccgttatatcgtctattttctatacaagggttctttttttttttgagaaaagtttatatagtagttggtatgcataggatagaaaatgcttggtaggtcaagttcattggtcctataggctgagttctttgcttgaggttcccaacccacctcattttttttcatacgtatgcatcccacactactaaatgatactttttttaaaaaaaaaatcctacaagaaagttgttttaaaaaaatatatattaatattttttaaaaatagataatatttaattaatcatacgctaatgagtcgttccgttcttgcgtgcgcgagagattagttcctaacttcaacatcaggtatgcctataaaacaaaaggctacgatagttttataatgttcgggggtggaaacaaatttaatatgatcttttgccatgccattgttttttttaccatttgttataattaccggaaacaagctaataagtcaaaagcaacttccattaaaaatgattaattttaaatttataggaaatcaaggttattagaggaaaaaaattaaacccccacatgagcaccgaatttacaccgtgtcccctcaccctattattcatcaatagcactatacaacccgtccacgtgatttttaattaaataagacaatagtacggtgaatcatgaaatcaagca

SEQ ID NO: 62919 - DNA, 1414 bp, Oryza sativa
accaccaccgccgccgcgtcctccccggccgcgctgccggcggcctcgaccaccgccccggcgtcgtccgtgtcgccggccgccgcggccgccaagcggcctcacctcgccggggacgacgcgccgtggcgggccgcggcgaccggcgccgcggggatccgccccgtcccgcgcatccaccacgcccccgtcctccgcgtcgcgcaggacgattattccgcctacgccctcgccgtcatgaaggtgcgttcccttttctcggttcggtttggttggtgggggaagggggtaattctaattctgggcttgctctgcagcatccggatccgataggggaggggttggccatggaggctatggtggaggcggccgggccggagtgcatcgtgcccgggcagcaggcgccgctgcggctgctgggcctcaaggtacgaaccgatctctcgatcgcagtgtatttttgcaatccaatcgttacgcacatgtgatcgatatagcccttagttaaattgaacgttattagatgttacttgtgaggggatgtatgcctgattttgggttaatcatgtatcttggttggatagttttgttatggttggtaattcggtgcttggtgcctgaggctcgctcaattatgctttatggttggtaattcggtgcgcggtgcctgtgattggtttgagcttttcttgatcattaaatattcattgggctatgcttgttaattgccaggtttagtgggttggttttgtcaatttcgtagtcatacaaattacagaaaacaaaattttatccatgggattagggatagtcgattaaacagttacgcaattgcgcagcaatgatttgtattatatttttcgtgttgtccaatagtgtttcagctttatcttttgtcaaaaaataggaaatacaagggatactaggttaaggttgagcctttgaggctactctgatgctgtggtactattcatttcgtgctctcgtggtattcattatgaaagtttgccattgctaggcataatatagctcaaaactttttcctttgtttaagtagaatatcatgaattgcttaaaagcttgagaataaattatgtaccttgcacattatggtgtttgagtacttcaataaatcatgtcttttcaatctctgtatttacttgcagtaattgatttctgtgcatgtatgcgttgcggtctttgcatgctcactatttggacacagcaccactagattgaattactacaatagtaaatgatatcacaaattgtcaactgaagtgaatgaaaaccccagccaattaacatggctagtatgaaatattgtgaactgtgaaacacccaaatttttcagtcttaaatttatcctttttgtcatttctatgtaggtttggccccttgatatagagatgaa

SEQ ID NO: 62920 - DNA, 5214 bp, Oryza sativa
  unsure (1)..(5214): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggagagagcaaggacggatggcctcttcctgttgaggaccgcgattttgtatgccccagcagtctcgttaccatcagcaggacgaagcatcagaatgttgggcatcgcacggaagctcaccaagtgctcaatgggctgatgggttggaccatcttctccaagaccaatagagtcatgggtcataacatagataactccggcttcacacaaggctgagatcctcatggcagctctcatgtaatcagtgaaaacaaagaaagtagcacagtatggaatgagtcctgggctgtgcagagcaatgccgttgcaaatggcgcccattccatgctccctgactccaaatcggacattgcgctcctcaggcgtatccttctggaagtcaccgaacatcttaagcaatgtcatgttggaggatgcaagatcagcacttcctccaagaagaccaggaacaactttagcaagtgcgtttaagcactgctgtgacagattcctggtggcatctgcagggctctctggagtgtatttctgtacaaatcaagtaatctaccattagaatgtcatcattcacataccagctcaaatgttatgagtagaaatggtaaaagacttacaggaagagcgtcagcccagccagcaggcaactcccctgagacaatgctcttcaaggtcgctgcatcttctgggtacttcttctcatactcggcgaacttagcattccagtcagcctcaaaagcagcaccttgaggcacatggcggctccagtggctgtaacagcccatgcaaataaaccataaggtgagtgctatgaaatttcaacatctcattcagataaccaaaacaacaatagacaaacctcttcacatcctcaggcacaaagaatggctcatagggccatccaaggttctctctggttgcttcaacctctttggtacccaaagcacttccgtggacgctgtatgagttggccttgttgggtgatccaaaaccgattgtggtggtcacctaaaaagagtacattttggctaaatatgataagctctataacaaaacacagcataacagaatgtacaggaatctaaccttgattagtgttggcttgtcagttaccgcctttgcttccttaatggcggcacgaatctcatcatagccatcgtttccattcttaacccagattgtatgccacccaagagcctcaaagcgagcactcacatcctcagtgaatgcaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatacagtagctgcacaaaatccatgaatcatgttaccaaggttgcaccaccataactaaagtgaaaactaaaggtattcatgataaaaaaaaaattacgtgtagtgatcaacaatctcgctgtcgggcttgttgaaacgagcagccaggtgcttctcagcaagggccagcccaactgcatttgcaataccctgaccaagaggtcctacagaacgaaaccaaacaagaaaccgaaacattcagttctgtatgtattcaagcatagaaacttaaaggtgctatgagcttcagttgagatgacagaccagtggtaacttcaactccgggcgtctcgaagttctcgggatggcctggagtcttgcttccccattgcctgaattgcttcaagtcctcctcctgcagcaatatgcggccatagttacagcaagctcgatgaacaaatcagttgaaactgaagtcaaccatattaaacacttcaccgatcactccagaatttacagtgaacaattgctcgacttaatagcatcttccaactaatcttcctaggaagtattacataagattaaattccactaaacagatctctgacgactggaaaaggtgcacacttttactaggaaaaaaacgaagccgccacacaaaaatagcagtcaagatccacactttccactgcttcacctaacaagatccgaaacttgcacgaacctactcccgatttatccgccccaaaccaaccaactcgagaagcgaaagagagatgcaaggagcaaagggatatgggaagcgcttaccaagacggcgtcgtagccggcgaggtggagcagggcgtactggagcatgcagccgtggccggcggagaggatgaagcggtcgcggttgaaccagtaggggttcttggggttgtaccgcatgacctcgtcgtagaggatgtgccccatgggcgcgcaccccatgggcaggccggggtgccccgagttggccttctcgacggcgtcgatggcgaggaaccggatcgtgttcaccgacttctcgagcagcgcccccgtcgccgcctgcccctcgagcgtctcgaccgccgccgcgcgcacgcggttgttgtggcggcggcgcgacgcggacgccgatggcgcgccgcggcgaggcgggagcggggagcggaggccgcggccggcgagcgcgctgaggcggaacccgaggcgctccggcggcgcgggcgctggcgcggcggcacccgcgcgcgcggcgatggtggcgtgcgcggcggcgacggagtgcgcggccatggcgagaggagtggtgtggtggcgaggagaggcggagatggcgaggttgtggggtgggagatgggatgggttatgtatagacttgggggtgcgttttggggggactcgtagccaataaaaaggagggggctatggtgtggacgtggacatggtgcatggaccagcatcctaagccgccatggctggtgagattaggagcactttcttcgccgcaattattgaacctataatctttataaagtagttattgtacttatttgatctttaaattagtttttatattgtagttaacaaatgttactccctccttttatattataaatcctttaaaaaaattttatcaaactttttttaagtttaactaaatatgtagaaaaatatattagtattttcaacacaacaatcatattatcaaaatatatacaacttagatttaataaaactaatttaatatcttagatgttgttaattttttctataaattttgtcgaaattaacaatatttgattaggaaaaaaataaacgacttataatatgaagcagagggggtaacttggatgtttttagataatagataaaacctgacatttgttttaacagaagctatagctacttacttacatagtctatactgaaaagaaagtatagcattatcaacaaatgatgaaaatatgacacaataaaaaaaacttaacaaatgttaacctaggtaagtactccctccgtttcacaatgtaagtcattctagcatttcccacattcatattgatgttaatgaagctagacacgaatctagactgtctagattcgttaacatcaatataaatgtggaaaatgctagagtgacttacattgtgaaacggaggaagtatatgcaacatcttggataaaaaatttatgcatatttggcaaaggtgtgaaaatattcacatagaggagtgatcttactaatttctttatatattttgcttatgtttatagcacactaatctgatgagaattagttcgttttacatgaacattgacctgactgattttgtagctttcacaaaattctacagttaggtttaaaaaagatgctggaaatggtatcaattcttggaataataaagtgcaagtttgtagtatgtatatatgatagaattgttatatatattctgcagctatacatgtggttttgattagatttgcgtgtatggactgggtttatgtggggatgggtgtggtgaggtgggttggtggatgaggatatcagccatgaccgttgatatggcaaacaagatgatcctggccgttggaagagggtaggaaacgattggatattattaaagatattttcgcctatttgttagtggtctggtgagccttttgaaaaaaaaattgttatgggacatatttttttctaagagataaaaataatgtaaagattgtcctggctccttgtgtatgttggggtcgtcgccgtcacagttgttttctggcgtcattccatggttgattgtgatgtttatgttgaaaatttggggtcaaaaaaatcaactttttagatgcagaggtatatgatcctggcatgtaaaattgccattcttttcaaccaaatataaattgcaaaccgctcttttctgtgattcgccaagatggatgatgaaaccgagccacacgagaataaataacaagatagacccagatgggcatagaatctattcagcaggaatctacctttgtggaatattcttatttatatggtttgcttgtttttgtaacagttttgatgttgtttttgcttctgatttatataccttactacattagaagatgctcaagcttagttagttagtttaacctcgtcttttttttttaaaaaaaaaaaaaggagagcttaaattgtacgtacagatgtagattctgacatgggaaattaaaacagtttgaagagatcagtagtcatgtgaccatccctggggttaattgtgtttaattagtcattcactaagccaacatagatatattaggatgcattgatcctggctgctgccacattcaaaagaccaagagcagcacgccatcttgaatttgactctttggttcatgctgggtagcctttcaaagccccaaaagattgggtcgggtctctctttcggctctcgtcggtggctgcttcccacaaagaccgccatcagacgtgaatgaactgcaagtctgcaactacgactccagttgctatccccttaaattactttactactacctttattctaagggccggttcggataattgccaaaatcaatcgtaccaaattttaataatattaggatgaaataaatatgttgcgccaaaattttctactgttactgaaatttggtaacaaactaaacacaaccgtatatttatccattttaccaa

SEQ ID NO: 62921 - DNA, 15317 bp, Oryza sativa
atatattttcgatggatagccttaatgtctgactactctcttcatcgcaacaaatctaatataatacaaatctgaataggagcttatataaatatatagtagtagaatatgtcataatattacagtggtattccatattggatttgttgattatagaacgacgaaagtatgcgttaacttacaaggttgtttacattatgacgaaatgaagagaaggaacgcacctactgcgaagagctcaacaactacttcctccaaatttccactcaccaactgatcaccaccaattcacttgtgcagtgccacctacccaatttcattccagtggcgtggtacgtaggttccgcatgtcagtgtgacaatcgtacggactgccatgtgtattgtgttcaggtaggtgcactggtcgtggtctcaccatctctcctccagtcgtacggcgccacgtaggcagtacacgtagacggccttcttcctcctccctcgagttgagttggttggtgagagtgagacaccgacggaacggaaggagaaccacgccgcttggatttttcttttttaccttttcaaattttaatttaaaaaataaaaccattttaaaaacttatcttcaaatacaaatcttttaaaaacactaacacgtgacacacagcgggcacgtcacccaaacgggcgtgacaatattgttttgccacaccaatccagctggtgtggacaaaatgttcatatattgaaaataaaatttaaaacaatttatattttttatctatatcattataaaaattgaagatgtttttaccggtattttgttactcatttgtgcatgagtcggtttttaagtttgttcgcttttggaaatacatatccgtatttgagtatgtttttaagttcgttcgttttttgaaatacaaaaggaatcgtaaaataaatctattttaaaaaactcgcatgctaacttgagacgatcgaactgctaattgcagctcataattttccaaaaaaaaatatatccaaacgagttcttatagtagatttcaccttaattaaaacatataaatgttcacccggtacaacgcacgagtatttttataagtaaaattaaaagtttaaaataaataaaaatcccgccaccacggcgcgatggtaaaagggggacgcttctaaacgggccgggcacgggacgatcggccccgaacccggcccatctaaccgctgtaggcccaccgcccaccaatccaactccgtactacgtgaagcgctggatccgcaacccgttaagcagtccacacgactcgactcgactcgcgcactcgccgtggtaggtggcaacccttcttcctcctctatttcttcttcttcctcccttctccgcctcaccacaccaaccgcaccaaccccaaccccgcgcgcgctctcccctctcccctcccaccaaccccaccccatcctcccgacctccacgccgccggcaatggcggcgaccatggcgtccaacgccgcggctgcggcggcggtgtccctggaccaggccgtggcggcgtcggcggcgttctcgtcgcggaagcagctgcggctgcccgccgcggcgcgcggggggatgcgggtgcgggtgcgggcgcgggggcggcgggaggcggtggtggtggcgtccgcgtcgtcgtcgtcggtggcagcgccggcggcgaaggcggaggagatcgtgctccagcccatcagggagatctccggggcggttcagctgccagggtccaagtcgctctccaacaggatcctcctcctctccgccctctccgaggtgagacgcggatcccttcctcttgcgtgaattccatttctggagatgagattttagggggtttattaggtgaggtggctgtgtttgtgaaatcctaggaattatctctcaagtcaatctaacgatgagatataactgaggttctggttttaatcacacactcatataaccaatttattgaaacattttggtttggcataagaaactgcttacgaaggtatgatatcctcctacatgtcaggctactaaattttcacgacggtatgatccactcaaaacaagtttcttaacgagtctggtgaggtctgttatgaaatttgtgtaaactaaggcaactttggaggtttcgcactgtaccaatgttatgtttgaacattttgcaagcagtgctttctcccaaaattatgcaattttgaggctcctctacatcattataattccccaatacattgctctttattcttaatagctttgatcgcgaaatttaacattttaattcttgagctgttattttgtagcatcagtttatcatgagccatgtttggtactaaatatacaatcccttgggtttatttgtttccaagcatgtcattaacttatcttaatgtggacaagaaactgatgcctgcttacattgctattatttcaagcgggtattgatcctttgacatgtgattgatcatttttttttctctggttattagggcacaacagtggtggacaacttgctgaacagtgaggatgttcactacatgcttgaggccctgaaagccctcgggctctctgtggaagcagataaagttgcaaaaagagctgtagtcgttggctgtggtggcaagtttcctgttgagaaggatgcgaaagaggaagtgcaactcttcttggggaacgctggaactgcaatgcgaccattgacagcagccgtgactgctgctggtggaaatgcaacgtatgtttttttttttaatgtttatgaaaatatgtatggaattcatggggtatgttttatgacctttttctttaccatcagttatgtgcttgatggagtgccacgaatgagggagagaccgattggtgacttggttgtcgggttgaaacaacttggtgcggatgtcgactgtttccttggcactgaatgcccacctgttcgtgtcaagggaattggaggacttcctggtggcaaggttagttactcctaaactgcatcctttgtacttctgtatgcacctcaattctttgtcaaccttctgcatttataaggaacattctatgatgcaattcgaccttacactgcacagtaacttgaaatgtttcatgcttaatcaatatgccatattcctgccaagctcaagcgagcaatatttgtttgaatttggtaccatatttttgtatatttgggcattcctttttggtcttgatgtcttcttttgaattagcatttaactgaattacactcaacaggttaagctctctggttccatcagcagtcagtacttgagtgccttgctgatggctgctcctttggcccttggggatgtggagatcgaaatcattgacaaactaatctccattccttacgttgaaatgacattgagattgatggagcgttttggtgtgaaggcagagcattctgatagttgggacagattctatattaagggagggcagaagtacaagtaagcttctacctgccttactgagctgaattattcgggtgtttatgattaactccctaaactaaccctttttcttttctttggcattgacagatctcctggaaatgcctatgttgaaggtgatgcctcaagcgcgagctatttcttggctggtgctgcaatcactggaggcactgtgacagttcaaggttgtggtacgaccagtttgcaggtataactgtagtgcctgttttgacattctaccgtttagtcaagtttagtcagtagtcacatattcagaatatagcacaatctgtattatgccactgttaatcaaatacgcttgacctagagagtgctatataccctagcttaatcttcaaactaaacagttctcttgtggcttgctgtgctgttatgttccctgacctacatgttaatattacagggtgatgtcaaatttgctgaggtacttgagatgatgggagcaaaggttacatggactgacaccagtgtaaccgtaactggtccaccacgtgagccttatgggaagaaacacctgaaagctgttgatgtcaacatgaacaaaatgcctgatgttgccatgacccttgccgttgttgcactcttcgctgatggtccaactgctatcagagatggtaaacattaaggcctattatacctgttctatcatactagcaattactgcttagcattgtgacaaaacaaataaccaaactttcttcaaaataacttagaaatataagaaaggttcgttttgtgtggtaaacagtactactgtagtttcagctatgaagtttgctgctggcaattttctgaacggtttcagctaaattgcatgtttgttcatcatacttatccattgtcttccacagtggcttcctggagagtaaaggaaaccgaaaggatggttgcaattcggaccgagctaacaaaggtaaattcattaggtcccgtgtcctttcattcttcaagtagtttgttcataagttgaattctccttcaatgatgtttaaattcatcatcttcttttttggtgttgtgccagctgggagcatcggttgaagaaggtcctgactactgcatcatcaccccaccggagaagctgaacatcacggcaatcgacacctacgatgatcacaggatggccatggccttctccctcgctgcctgcgccgacgtgcccgtgacgatcagggaccctggttgcacccgcaagaccttccccaactacttcgacgttctaagcactttcgtcaggaactgaactgagcttttaaaagagtgaggtctaggttctgttgtctgtctgtccatcatccatgtgttgactgttgagggaactcgtttcttcttttcttcacgagatgagtttttgtgtgcctgtaatactagtttgtagcaaaggctgcgttacataaggtgatgagaattgaggtaaaatgagatctgtacactaaattcattcagactgttttggcataaagaataatttggccttctgcgatttcagaagctataaattgccatctcactaaattctccttggtcctcatggcaatgcaacgacagtgtgaagcactgaagcccgtaatgctctatcaccaccatgtacaacagaaccatatatgtccatatgtacaactcgagtgttgtttgagtggccagcaaactggctgaccaagccacacgagagagaatactataaactcaatcatacataacaagcccaagcaacagaagacagaacacaacaacactcgagtctgggaacagcaacgccgatacactacagcatactgcaacgacacaaaggaattggtaaggaaatggcaccaaaatcttgtagatctttagcgagtcattcatttatagcatatgttggaacagacatgagtcacaagatttatgatagcttagataacagatggtcggaattaaccgccgagagcctatagatgaacaaaaactctgttccaccagtgttctcatgctaaaaactttctgaaataccctaccctgttcaccgaatttctccacctgttggatagcagcattttactggtcgctgatggtcacttcaacctccacacctggctcaatggtgattgaggtgatctgcttgacaacatctgcagagctgacaagatcaatcacccttttgtgcacccgcatctcaaaccgatcccaggtgttggtacctgaaacaatgtttacatcattaacatttccaaccgcccatgggagatgcagaacaaagagggcaactaaaaatattgcattgatgtttctatacaactagagtggaaacaaatacagtttcaacaggtaaataagagcaccacaacttgcaaaagagaaatgctccaactatagtgataaaataattgcaaacaaggggttcacattattacttcaaggctgagcatcagttttaaaaagctcgatttttagacatcaaataaatcagtacaaacataatatatcatcatctgctcaacatgtccagaaatatacaatcattaaaacattcaggtgcaggtttgccatgcaatgtggaaaaaaatagtagtgcatggtacaaagaagtactaagaagcaactaagtcattaacccaaaaaggtcagtatttggacaaataattaccaagcattggataggccaaccatcagttttaaaaagctcgattttgttagtcttcaaagaaagactcagcaaaaacatattttagcatcatttggccagcccatcatagaacaataaccacattaaaaacaatattaattcagacagaacaagcataaggtcctaaaagaagatttcatatcagcaattccataccaagtacaaaatcgtagcaatatactcaaacttatcagcatcgccagtaagtttagcagaaaccatgcaataaccataaaaccatccacactacacttgctattacaaggccaagcatcagttttaaaaagctcggttttagagacttcaacgatataacatctcagtagcatctccttgtaacatcacatgctcggcctacaactaacaactcagctctcatctaaaatgctttaatcaaggcaatgctaactcctaacaaacaacacaattgaagatgatgatgatatgctaagcatcagttttaaaaagctcgatttttttagacatcaaagatcaagatctcagtgatcaactagtatttaacatcatctgctcagcagatcatcatcaacatgacaaatcatagacaactgttctacacaacctaacaaaaccatcaacagacaagccagatcatctcgagaagaaatgtcaccttctccacaaggagacttcctggtggtgatgtggagcaccttggtgggcatccgcacggggcccttcaccttcaagctcttgtccttggctcccttcaccagatcaccgcagactgcccccacgcaacacacatccaatccaacaccaatcatcagatcaaatgtcgcacataaaccccatcaccacaaaacgagaaatcacaaagagggtttacctttctcgaggttcttgacgctcttggaggagagggtgatgcggatcctgtgctgcacctcctgcgagctctcgaagccgatcttgccggacttcatcggcggcgcgtacgccacgtcggcggccgccatggctggcgcggaaggggaggaggtcctcggctagggtttcgcctcgcggatggaggagggggagaggtggcggcgcgagatggggatctaggttttcgcggcgtcgacggaggcggagggtttatgtagaggcgggaggtaggaggtggggttcgagtggccgttggatcgaatggtcggagtgttttctggccgttggatgtgactcgttctgggagaggggaagcattggtgggtcgtgtctatgacagtgggcccagtttgtcttgcaagggatgacagtaggcccagttggaacccctcctcctagcacacacaacgaagcatgtaagtatattgcacgattaattaagcagtattaactatttttttaaaaaagattactataattttttaaaacaactttcgtatagatattttttttaaaaaaaaacacactgtttagcgatttaagaaacgtgcgcgtgaaaaacgaaatatgtggaaagataggataagaactcaagcctgtgtctgctgtttctctgactctctcctatggccgcgtttggatatcctagttgggaacttgacacatgattaattaaatactaatttaaaaaatatttgagaaattgattaatatgatttttaaaagcaactttagtttaaaaatgttttaaaaaaatacatcacttagtaatttgagaagcatatgtggagaaaacgagtattagaagtcgggaaagtaaagtatagaaagcagcctatgtttgcctccttacttgcgaatatggaattatgaacttgcacagcttgttattttacgccaataaaccagtctgaatgcaaattgcatctgaactattgaaatctgaatctgatggaccatacaacaacataaatcgtcagtcgtagccaattgtgtattgcaatatactcagttacaagattagtagtaactgcaaagatggaattggataaactggaggagccattgacccaatcaacattaagaacagcttactgaagcttcacaacaatgtctacctctccatttctcaaacgagcataacctaaacttgtttgcaaaattacatttctttcggcctttcagggcacaattcccatgaactgaagaagtagatcgctatacgcatgagcaaaattacaacagtgttctctatttttcaaatggtatcggtgctctccctggccatgtttcaattttctcgaagtacttcacaggaacaacgccatcgaaaccctctgtcagaatcaccttgttgtctgaaatgtacagcttcattccatctgagaaacagattcagctatcagaaaccagcccctagcaagttgataagagaataaatagattgcttgtggctataaacaaacagcatcataccttgcagtgccatactgacatccaaatatatcaagatgttaacactctgccgcatacctgaagaagatgagacgttagttcatgattgcagtagtggaagaaccaaaagactacatacaggaaagcaccattatcaataatagcttgtcatccacctaagcgggaataacagaaacacactagatttataacagaaactaagcaaacggccatagccttccagagaaaacaagctcaacaatggtgcattttgtacttgcgtaagggtaaagcattaccgctaataactcccccatctgtcggtaagccacttgagaaatgtacatgtaaccttgccattcgttttagcccctgatgcaagattgaatcgaggttcttcctgtatgttccatgcacacaaactgtggataaaagaatcagtacaaaccaaactattattctgtagagagtgcaaaggggaactcaaaaatcacataccagagacttcatctgctgatagaatgggtttcaacaagctctctgaagtaacagtctgcaagaggttttgcagggttgttataaagcagacaagatcaacaagttagatgcaattgagacatctatctaaccagtatatagagtctaacatcacaatttgtggacaatgggaagtctatggcacaaacttggggcgtttgccattgggccctaatgcaaaacaactcactttcaaatattgtttggtcatctttgattacaatggttagttgtaaacactaaaacaattcactcgataggaaaattaacctagccctctagtaaactagatgccttatgcataggagcagttgtgcattatgtaaatttcagctaagacctaaaagagaggcaaaacgtggtgacctcaaataccatgcataccataccattgcaatacacataactgaacatttaggttttttgacctttaaactatgccaaaaaatggcagagctatcagtaaaatcctgtaaaggtgtatgtggtatgctgatgaaacttgtcacttagcaaagctatgcaagcctctaaaccaaaaaaaagaagtgctacagaagagtatatgattacagaatacaagacgctcgatcagagtactagtgttaggcattataaacacacatgaattgtgactcccttttattttgtcctagttcgggtcaataagcaattgagcgacattgttctcgggtagcttgttagcaggggcgaagctatgttgtccgaagggggttcctaggaacccgggtaggaaagtgaaattagttattaataccccctaatgaccatgtgggcacccccctgggctcacgtatgtgtacccctagatcgataattaagctacggagacgtaaagcccactttttttcttaattaatttgatcttgcaaacaaaaaaagttatgttttgaatataggatttgattaatacgaatacaaagttattttctcatgatagatcgttggtgtttgaagtaaagttgtatacatattgttatccaataatgtcagtgctgtataggcgattttttttgggattttttttatatataacaagtggccaatagtagagtgcaaggaatatactaatatccaggctttgccttactgtttaacaaacattagaaaattagatgtagagtcataaatagtactagaaggtaatgtatctagtatttgacatgaatagttcataagtttttttacttcagagctaacatgaaggttggggcaatgtatttcggttttgctggtacaatgcattcacgcatattggttagtacttttaatcgttgtactcctcttttgatacgattaacatcacttattgaattttcttttttaataattgatgggaggcataattatttagtacaatatcacttaaaaattctatatggctttatggtatggacgcatgactaagtggggcacccccctccaattctccctagctccgccactgcttgttagcaacataaaaaatcaacagtaagttatgctacagtgggaaaagaaaaaaaaaactatcttgagcaaaacacaaaatatgtgttttccaacagctaaaacagtgccccatagaatgaaattgcacaaccacacatgcctgtattacttctcttttcgtaagtctgagcttgctggcgataacagaagcgatgcttagtcatcacaaacaatcataaacaagtgatagtgtattttataccagtataattgcatcagtgcagggggttttggtagagaacataccgttactgtgtggccctggttagctcgaatcagcagctcaccatcttcctccaacagaccaaacctctgcttgttatcccgtctaaccgcctaacacgccataattaaagcaacattcacttatattcacatactaataatcatcagttcatcactcacagcacactggtgaatccaaacacaagctggcaagctgaaacaaacacgaaccctaaaccgaagcatacggttgatataactgggtagattgagctagtattacctccttgatttcgtcgacggtgtgggacttgagagggatcttggcgaaggtctgcaggttgagcttgagcaggtcgcggacccgcacgtagccgtcggtcctcatctccaggttcagctccgacgccatgtgccgcaagatccgcgtcctggggagggaggaaggaatccaacaatcagcaagcaagcaaagcaactgcggaaaaggagaatcgcgggagcatgggcgcgttggccttgtatcttacaggaggcggccgagggcgtcgatgcggtcgctcccatcgccgccgcggcctcttccgccgccgcgtcgcccccctcggccgccgccgccgccgcgaggctgcggggaggcgaaggcggcggccttggagtggtaggaggcggcgccgcgggaggaggaggaggaggaggggttcatggggagcgcgagacgcggggacggcgaggaggagaggaagaggaggagggcggcgcggagcggggaggcggcggccttcatagccgtcggtcggaggtggacgacgatgacgacgacccacgcgtgcgggggacgagaccgtgcgcgttgggtgggccggttgggccggaattggcccacctcgaaggtccgtggacgtaccgcatggggaggtgggctgggcacgctggcccatggtgagttgatacatgtgaaagttcctattggctccctcaactaaaaccggatcaattctccgttttgagaatggttttcgctggcatgtcacgttgacgttgtccaccatgctaatgtggcaattacgtggcattctattaagaaaattttagaaagcgttggggcccccatctattttgctgacggccaatctatggagccttggtggactaatgagtgatgttggattaacatctagcgccctagccatcgtcttccatattttgatgatgacgactcaccacgatgacaacttccttagctaaccttagtgccaccaacacttaaattctagtaggctttgtcggattaaagtttcaagggtgagagcaatgaagacgactatagaaggatgggcggggtggtggaaaactggtggagattagcatgcgaggcgccatagacgcgaggatgcttggaggagggtggtaggtgggttaatgatagggagtggcgggtcttgtggttaggaggtggggttgaaggtagtggatccgatgactctctaatagcgtgatccgccaaggacgagggaggagatcacgacgctaggggaaagacgttgagcttgatgatggtgaaaataacaaacggtggatctatggtaggagcgaggtggtagagagggtggttgaccaggattgggcgagagcaaggtggagcaccgtggcggcggcgacaacgacaatttactcggacataggaggaaagataggggttaggattataaagggtacgaatctttaaagcaatcttgaccactaaagtgaatactattaatgggaagatcaatagatcgatgattgccacacacccaaaaatggatgcttatcatgccgttgatggcccgaattggaaagcataacaagaagtgatgcatgacctaggtgtgttaacttccctccgtttatgaatgtaagatggtttggttttgtccgaactcaaatttctctaagtttgacaatatttatagaaaaatcatactagtacaactaaaacatcaaattaattttattaaatccactcaaatatatttttataatatatttgtttagtattaaaaatgtgtttttacatttttaataaacttggttaaagcagcttgacttaggcttagttcaaattggctagtttggtcgagcttttccttggcatgcaaaatgacaaaagctattagcgcatgattaattgagtattagctattagaaacttgataaatggatttatttaatttttaaagaaacttttatataaaaagttttttttaaaaaaagacaccatttagctcatccggaaagcacttagaactcagccttgaagacaaaccaaaacatatcatattttgaaactgagaaagtgaggagcatacatgttgaagttactccaacctccaaattaagatagcaccttggtctattgtcactttatgagatgcaaattggggagattaattgtctacagcaagcagcccgcagcacatcaactcagtagcaactagagtatatatatagcagtagagtagccataatgatgtaatccaggtctgatccaaagttcagaaggcacctagctatcaggacacacaaccatgaatcatacaatatttcgatcaccatcaaaggacgttcaaggttgccatcctcagcacgtccttaagatagacacggccaaagccctcctctccaaactctatgccagcactattctgatacaccaggtactcttgcccctctcgtcgcccaaatccgaccaccaggacacaatgggaacgtgtgactccatcctcgtttttctccctcttgttaggctcgtaggagtaaatctcgcctggcttggtggtcctgaagttgctagatatcttgaatcctgcagccatgaccctagcttttatcccgatctcttcggcaatttccttgaatttaacatcctccttgttaatcatcttccagttatagattttatagcgcatgccctcaaggccaggatcttctgcagcaataccaatttcttgtagcactcttagtgccacatgcattcggctttgacctctacctccacctggttctgttccgagctctcctgcattaagcaatcaagacaagaagtatcttaatgctgcatgcatgcatttgctatttgtaacacagaaatttttgtatacccctaaacttttacctaatcccttctatgtcgctaaattttgctaatcctttttatgcccctgattttttatattatcctctatacttctattccgttaattagttggctgttaagtggccattatattgtttttctaaaataaccatattacctctagtgcactctctccatccaaaaataaaccaatctaggattggattggatatcacatagtacaataaatctggacatgtgttatgtccaaattcgttatactatgtgatgttccatctaattctaaattggtttattttaggatggaagtagtacatcataaagtggtaagcgtcctcactaaataaaatgtttgagtggctgatacatactaaaaataataattgcactgaattcgaaaaggaaactttagatattaaacatttttttgcatggactgacaatagtgaccaaaggtaagtattactactgcctcaaagaaaatgcattcctagcaaattttagacagattagcattcaacacaaattattgccaatctaatgttgtttctaatgattgaaacttactccttattcctaatccaccgtgcatgtacatattttatatatatatacatatatatatatatatatatatatatatatatatatatatatatatatatatatatatatatatatatatatatatatatatggtggtccaatttttcattatttcactaaacgagcatgtacatatcctatctcactataaagttgatgcatatatagtaacttgtaaagcttaacatgctagtatgtcacaccatcacctaatagcaattattatccacaatattttaaacaacatgcaaatgtgccactagcaattattatctagagtattttaaatatcatgcaaacatgatatatcaattacaattttgttgtatttttagaactcaatatgcaaccaatgtcaaatcattatctccacttcattttcacactatttaaacacatacatatatcatttttataatatatttatgcattcattcatatattccgcaacaaaatgcaggggaatcaactagttaaaaggggaaattcagccaatcagtcaatctctcaaattacatgcattaacaggatggcgagatgagggatggaaagatataggagggccggaggtaggatatattcatcaactaattagttagtagggtctcaccttgctagaaacacaacttatttaacaaatttgaaatggtagaaatacattctttttggaggaggtagtacatggttatggcaaaatccatacttttaaaaccgtatatttattcaagaattacttttcaaatttgatgtaaagttttacaattttttgaatttcaatgattttgctaatgtatc

SEQ ID NO: 62922 - DNA, 2850 bp, Oryza sativa
ttggcccaatgtgacataggtgacccacagttggtgggctaggttgcgcactctaatataaaaaacaaacgaacaactcttgatcaattagtggaattggcatgtaagggatcaaaagtttggtcaattagtggaattggcaggtaagggatcaaaagttactggaggatatataatggatctagcttggaaatcttaataagagcatttaatttgttgtaataataatagtagaaacaatcctaaatgaggttgatttatgttttatgtggatggttgatcattatttgcggcagtattacctgaaatcatcttattgtactggctgacgtagtcatcaatggataaagtcacctcaaaatcctccttggggatagataaagcaccacgccttttgtaatgggactcagtagcagccccgagtgagtgaaatatacaagtgtctgcaataaattaacatagaattatttactttgtatatatagcttggggaagtaaagcaaacctattcctagtgtaaggacctgtttagatattatacagattgcgtgtaaattgcgagacgaatcttttaaatctaattacaacatgatttgacaatgtgatgctacactaaacatttgctaatgacggattaattaagtttaataaattcgtctcgcagtttacatgtagattatattgtttgttttgttattaatctacgtttaatatttcaaatgtgtatccgtatatccaatgtggcacgacaaaatttttcacccctgaatctaaacacagcctaaataagtcttactcttttccccctggtcatggaccggtggcagtaaggatttcccacgaagctcccttcctcgctagtttaccttcttactcacctcaatggtgtcgacatgaaagaatgccgaaaagatataaaagaacgatgtttcaaaaaaaattgaccattgactaatgaacacgcctttctttcctacaaagactgctacactagtacatgctgagggcacccacaatggttatctataagctctctacaagagatccatgtcagcatattttcctacttggaagagattaaatgaagagagagagcaaagctatctactaacatggagatagtctatagagaaaaatgaggcaatggattagagagctatagatacccatgtagacataccattgaagtggtttactattaatctagtctattgttgaggtgtacatgttttatagatagcaccttactttaccattgcgggtgctctgataatgctgcagttaaccgttttggtgtaaacacttaggctctgttcgtttcctggagttcccaactcccccatctcattttccgcgcgcacgcttttcaaactgctaaacggtgtgttttttgcaaaaagtttatatacgaaagttgcttaaaaaaattatattgatccatttttgaaaaaaaaatagcaaataattaattaatcacgtgctaatggactgcttcgttttccgtaccggagggatgggttcccaactcaaccaaaagaacagagccttacagtgttgttggagatgtagagacagaaaggttgtgcctttctaagaaaagagaggattgctgtacatatatgcatatggcaaatataccacgtcgttctttcaatttatcaagcagcaaaattattcaaatactcagattttgtaccaaggttgcacacacaataaaatttagttgggaagagatctgattacttccagtgattaacaaactagtaagtgaggtgataaagtagtgtagacaaggctagacaatggaagtatagtaaaagggtcaagcatcatgggctcctcctctgtcctgatttactgagctgtaggtgaatgccccgatgaacaaattaatttatcacgacatagtataccactaaaccatgtaataatcaagaattactgactaactgaacaatctacaagtaagtatggcagttcctggttgaggatttgtttcaaagtacgcactgcatcaataaagcttcgtcttttacgtacacaacacatcagaaatgcaattttatgatgtatattagggtgcaaagttgggcctttttacatacttgatgtccgtatgaggtcgggaacagattgatgagcacgatgaggaattgaggaggaggaggaggattatcttggcgccgcgcgcgttgagtggtgtcaagtgtggagctagtgtgcgtgggagcagagacacgatctgaagaaaccaaatgaatcacgatccgatcgatcctgccctgcctgagctcgtccctgcaaacaccgctggtttcttgaggccggatttgattcaaaacacatacacgcggacggacacagaagagaaaaaaaaaagcttcgttttttacgcgcagaacgcatcaaagacgcattttaatcatgtgctagggtgcaaagttgggttcttttacctacttgatgtccggatgatcaggtcaggagcgcctgctcctgctccgtcgaagcgagccgccgtacaccggcgtacgtgaaggagtggtgaccccgtggtcgaccgaggcggcggcggcgccgatgagctcaccgccgccgcgctgggtggacgcagcacagagagaggtggtctctctctctctctctttctctctctctctctctctttgagtctcaggtggtaaagcaacaagcgagaggaagacgacgacgatatatacgcgaggaggaagaagatggtgagctccaagcaatggtgtccgtcggatgagaaaggaaaggccaagatttcttccttcaggttcaggtggccaccacccacggtcccacccgcacccacacaggccacag

SEQ ID NO: 62923 - DNA, 12204 bp, Oryza sativa
gctagggtattctcccgactgacgcattgtgtttcagtttgcttttgcacttttacgacccaagcttgttcttgttcttgcaaatttgttctgttcccgatgcaaatgcaactgacccgcgcgttctttgtaccggttttctttcttctttcttctccttgtgtagcagttgatagtatttatctcttgtgtgtcgcctcagatggagaagaataagtacatcggagggggatatcttctttcagaagagggtaacttctcttttctttgagtaaagaaacattgcagtttgagtttttctttcagaagggacatgtagcaatttgagttgcatgctcaaaactcaaaagaggggaatgttgcagagttcttttgaatagcccaatgataggctctaactatacttcactgcgagtgacgatattgtgcatctcaagattccaactcctttcagctaaactaggaacaacagtggtgcttgatagctgttgttcatcaatgcagaagcgatttgaggaggacgagtggacaactatgttattgtatcttctgacaagagagtacaacatgtgaaaagtgatatagttgttaaggatgtgaaactgtgaaagaaagtttgggtttgctcagaggctctaggaggaagtcaattgatagatgaagcaaaagaaatggcaaggaagaaggatctagagctagaagcaggtacatctatttcagtttgctttgctctctacttctaatgatttcttattgtccgtgttagatgtttagaaattaagggtggcagtgggtctcagagtatgcaacctgtggaaatgatgaacatcattgagcaaacaagggtaaacttgtaaatgagtacagttaaacaaccccagcataagcatccctgcgactcagatcaagttgaccttggtactgaaatgtcacagaggagcttattgcagacaatgtagatgatgaaattcaccttgaggaagtaaatgatagtactttgaatgagagcagcttcccctggtaagcaagtaagaaaccaaggggggagggtcaccaggggtgggcccaaagttaaaaaggaaaggaaaaaacagaatataactcataatataccatgaacagtctacttgctacgataacattatgaacatgccaagcatttggggatctagagaaagtgtaaagagaaagaacaacagtaggtagggggttagaatttccattttgtccacaatgtactacacaatatctcttctttgttgcctccaatttgggcctacatggctactccccaccaaactcatgctctcttatattacaagacccatcatgtcccgaattcaaattatcattcttttccactcttgctgtttcctctgtattcttagtttcttactctgaacctgtggctgtctttccatggcttccagcactgccatgacaatttcttggagaactgacaggagaaacttgatcactggttagcagggaaccatagtacatgagttctcttcaactctgcttaaaatgtgaatggcaagatttgcttggcattgagatggtgagtttttgtgattttttttaatcattaaagaagacagtatattgagtgtaacttagtagttgtttatggagcagcttagtaaaatggaaatagaaaattccttactgagttagtccagatatgtaataatacgctgcatccgtagggagtaattttagtattgttagaagtgaagatgagcaaagcctggaagtttgttcagatggacttttcttttaaaattctgctgtagagcctaagattgattatagattggcttttaagtaggagacattttacaccgtctaatagcatttaaccattaggatccttgtatgtagcctgaataggattttgatgcgtcctgtctggaaatatcaattttcatttttagtagttacttcctccgtttcatattataagactttctagcattgcccacattcatatatatgttaatgaatctagacatatgtgtgcctagattcattagcatctatatgaacgtggacaatgctagaaaatcttataacctgaaacggaggtagtagatctttggaaagaaccctcttagatcatgcttcttcactaaattgacactataactcaactgcagttgaatccacattttaaatatgaactttcccaaaacacaattgttttgggaaagttttttatttgattttcagtttatgtcagcctgtctcagggaccagtaatatttgatcaatggcaggcacaactgagaaggcttaaataatgtgtttgtgtaaaaagttatattaatcggtttgaaggaaagtataatgaagtaaaacaaaatttgttaagacaaattgatgttttagacaaacattgtgatgttttagttttgtgtgtatcagtcaggaacagagaggttcatgttgagaaatgtttcgcacagctctcagagaagagagaaagaaagggacaaaatgatccaaagtgaaggtttcattgaggccggtaatacaacatatttacaaatagatgtacgtgggtaggatggaaaggggctggtctgaaacttacgaacctaattaatttgcgactttggggccaagagggcttatttcagtacatccttgaagctcccaaagttcagaaaataccatttccgtatgaactaaatagccacttcagataccatgtttctctggttagtaaccagacatttgtattctcttaaactataatctagttaggagaagtttgcagggcaatgagcattgtcagtattgtgggaatgttgaaatattcaaccatctattttcacaggccctctagcaagttcgtctgttcaatttcatttggcatccctaacttcccagcaaatgctcatgacctgggctggaaagtttttaaatcagaaagagaagagtttgcagtggttggggtggcagctgtattgctgtaatgtgtctctttgaaatgcagcctagcctgtagtggtataaaaaaggctcctgtttttctcagtagtcagtacaaaactgtctgatctcacctcagcaattttcatgtttgtcaatgacttgatttttgggcaattatgcagaatgctttgtcagtgctagcactagcaggatgctgctggtagaggttttcagtggtgaactggtacacatggatggagaattggcagtggctctaaacaatgtaaattatttcataattggcagtggcttcagaggtttgggcaataatatagcttcttctgtttcataatgcaggttctgtcctgggctgtgggcctgtgtccaaatcttattactgctgcattctcctgtttttgcatgtacaaaaaaaaaaaaaaaagaatgtgctatgcggttggccaggtggcagttggctgtatctaacatctttagcagacagattagtttctgttttccttttgttacatgctatgtaaaagtcatatggtttttataaagtgaatacctgtttctccatggctagaaatacaaaatgtgatctgcagtttgcttctctaaattttactagcttaccaattgaaattgtggatgaaggttttggtttgctcataagatctaggagggggtcaattgataaagggagcaacttaggacatacgaaagaccatattccttattgagttggtccagatctgcaataaaaataactaccctgtatctgtaggggtgattttagtattgttagaagtgaagatgaacaaagcacataagtttgttcagatagacttctatttttaaattctattatatagcataggattctttatggattggcttttaagtaggagaactttgtccgatcatttaacattaggatccttgtatgtaacctggagaggattttggtgagtccagtctggaaatgtcagtttttttttgtagtagttagatctttggaaataaccctcttggatcatgcttctttgcaaattgacacgagaactcaactacacttgaatccatgtttaaatatgaaaattgtgttttgagaaagttatgtatttgatttcagactggaatatagaggcccatgttgagaaatggttaacacaattctcgaagaagagagaaagtaaaggaacgaaatgatccaagtgaaggtttcattgaggccaataataacattatttacaaatagaaataaatgttcggaagggaaatagttttgcggtggtcggggtggcagctgtattgctgtgatgtgtctttttgaaaatgcagcctagcctgtagtgctaaaaaaaagctcctgttttttttctcagtaaagaaccgtctgatctcacctcagtaatttttcacatttgccattgattgatttttggcaattatgcagaatgatgtgtcaaggcgctggcactagcaggatgctgctggtgactttagaggttttcaatggtgtaactggtagtggtacacatggatgtaagttactatttcataattggcagtggcttcaaagttttgggctataatagtagctgcttctgtttcataatgcaggttgcctcctgggttgtggtcaaatctaattgctgttgtttcatgatgcagtttgctgtgtccaacatctttagcaaactgatcagtttctgttttccttttgtcgcattgctgtgtaaaaagtcatatggtttctataaagtgaagacctgtttggttcactaaattttactactagtgtatccgttattgttgtgggataagatgatcgtgtttgattcacgtgttacagaaatgcaccctgagctgacttcttacattcatgcacaatgtatgaaacactgacaagaagttccacagtttattacaagtatatcacaccagttaacaaagttctctgtctgttttctatgtaggtatcagtatattatggcctacctattttctaaactatcatgccactgaagaactactctggatatattttgctgtttcagcataaatcaaaatatgcatgatccttacagtcgaatgacttaactattatcaagttaaagaaaaatggatttaagactgttttaagaaatttatgtagaacttttttttttcaaaaatcacactgtttaggagctcagaagcgtgccatcatgccatactcatcagctcatgggatgtccaagaaaaaaaacatttcaaataaaacactacaccattacgaccatccattaagaaccaaagccacggtaggcagaaatggacgacgaggtgtaaggttatatgtcaacgcatacatgagaatttacattccgttactctattctaaaatttgaaactcaaaatttatgtttaaataaacttaagataggttaatagtgtagaaatgtaaagatgcagttccaactcatggcttgaaaactggatcaaaaatatcttctggttcatctgaatcatcaagaccctaatccaatcatgataacaattagtcaacaattgagaaattatatttaaatgcataaaatttaataaagaacacagcaaacctcaatcatccttcttatcctactcgccttcacttcctcttcctcatcctgtggaaatggaaattattgtcattcattaacaatgaaacacaaatttttgtttaactgattatcataaaaaagaaggaaaacaaataatcacacctcatcatcatcagattcagattcagtccaattttcagtttcaaatggcataactatgtccttgtgaccgcccacatatgtatcgctatcatttgggtgcttcatatccagatttcgatcgttcttgcaaccatagcagatacctgaatatgtctatttgtcagataattggctatcaagtcaccagttgggaattaaaaaaaagtaaaagatgctatctaccttaatagaattgagcaatcaaatacacacaacacaaataatccaccaactcaagaaacaacatatgtattacataatgatagtatatggaatgaaaaagacaagtgcacaccatacaattggcaaccatcttaaaagtaattgtatcacttgtatcagtaaattcaattagcatggaacagaaaaatgcactaaaaccaatcttttggttgttaataactcatatgtttgtaaaagtggtctcttcaaatagttattaagggtgtgtttggttgagtggatggggttggatgggacatggctgccaggatttccataggctaaccaaaaatgacacatgacatatgaaatttaacattgttccttataataatatatgcccattaacaggagcatttaatttgtgtaaaaaaaacaggagcatttattttagtacaagtagggcataccattatcagcagatttaatcaagcagcaacaagtcactacccaatcttcctccccttgcgaagacatcacttcagcaaaaaataaattgtcaatatcagctccactggtctttgctgtgaaattgaagtgattgaaccacttaattccctcaacaatcaattgatagtgaacaacatcttgaagctcataagcaagatcctacaacaaacaacaacaggataaaatttacaaagtgttttatctccaagacttgtaatccacgcaatcagaaaaagagtgaggatgagaagataagcaaacctcaacaaggtcatgatcatcattatacttgtctaatagcacttgaaccatttgacgtcttctcttatcaacgttttgactagcttgtgatctggaatatttctttctagtaccatcaggccaataaagtgatttttgtatcatcctctccacaggagaaactccatcttgctccttgaacctaattggaatcacacaaactaatgattaggaagatgtacgtctgaagtgaggcatataaagtactatagttgtcaacaaacaaatgatatcacttctcaaattttgaaactacagggttgaattggctattttctaaacaaatttccatgatcataagttaaagtgtaagaagtcttcatcctttatattttacatcccaactccttttttgcttgtggataggaataggttcttcgcatggcaatgctttttttttacaggaaatgttccaatgttttcatttgcaggatctttttactagctgaccataaaacaagcggggtttatgcttacttggtgaactttcttgttatgtttctagttgtgctaacaaactcaatcagaaatgatggattttggagaccataattttttcagtttctgagctatctataagtgactaagtgaggcacttttgttcagtttgtaattcatcttttactcgtttcgtagggctaattgacctaggactgttaaatagtgtatagcaagtgcagtacacaaaaaagggacaaataataagctagaaccaggtttagaaaaaccttacattggacacttcaggctctcaagatgacgattgatagcatcctcagcttcatataagttcagaaatggtccatctagagcaggatatgtgtgaaaagatcctccacgatccatcctaatgtgatatatccatggccagtcagcagggtctcttgtccaaatggttgattcaggagaagtgtgatggcggagccttgatgatggtgagacctcgctagtgccatgtggtgcggatggtaaggaagaggtagtagcagtaaatggatctcctaatgttgtaggttcaggcgactcctccatggttgcaacttctggttcttcaagcgtttgttctaatgaaagctgagtattgccttcaacatgctcctcacacctaaattagaacaagcccaatattacatataattattttttggatattgaatgcataaagacaattctattaatgccattccagaatgacctgaaagtacataatgctacaacaaaactcaaactaaatcaacacaactcctttaggctagctcacacttttaaaccatcaaaagctcaaagatctttattccttaaccccgtacaccggtacacacatcatgatttttcttttcataaaataaacagtgtgttgcttgatgtgccatctttcactgctcaagcactttgatacactgtaaaactagcaggcatggttctgcaacagaaagatttctcagggcaaccatgatgagtgatgtcgcaacaggtaaattgaggagaatagggcatgtaggtaacagcctgacaggttgagttcatgaactgagaacaataagaggatatctagggaggtacaacaagtgtcatggtcagaacagcagtaatcttaccggatgaaaagactgttaattgggatgcaattaattatggagggtgggggacaagcaaaaaaaaaaaacttttttttaagtgcaagtcattggaatgaccagttttgttgtagcacaatcaaaagcttgggatttgaagtgacatttgtattaccaattgaccacaaatcattggagtagcatacactattatatacctaaaagcacattcactgtgctatgccaagtcagggagaaacatgctaatggctggggctaaaaaacaacatactaccctctgccgtcagtagtgaaatcggcatcagaatacatatgtaaattttccagtgagaaaaataattgttttgaaagcaatgccctggtaagatttgagacacctaacatttgcaatcaataattttgcgctctagagctggacctatttcacgatatgcccatttagccacttgattcacagttctcttttttcccccaacaaaagaacccaaatcccccccgtgcattcgtatgaattggctcagtccctgtccccagaccgaaattgactcatccaagagggttgtccgagcagcaaatagatggtgaggaagacgaactgaactggaagcaataatcaagcaactcctccaaggaggaaattttctggttggttcttgagcaacttcaacacaagtaccagttacagttagaaagagagaacagagtgaggtgagaggaggtgatggccgtactgtggaagcaggggcggcggggctggatcacgggactccctctgggggtgatagtggtcatagattgcgcccaagagctcatgcaagcttgggaacggctcgccgggaagactgtatcccaaggcgaaatacccgcgagaattgcgtgagactagtatttgccgatccatgaagggcagttcgacgtgcagagggggcggggccatccgagccctcctagacacgcggcgttgcctccgtggagggtccatggatgggggttggcgccaccgcccaccggccaccggtggtgagggcgtcgccggcgaaccggggaggaggaggaggaagacgacgggtggcggggaatagggtttcgtggggacaaaatagcccaaaccggcctagtggatgatgctgttaagagttatgggcccagagagcccatttggaggatggcccagtagcccacaactattttcctccctaaaatgcagctcactatttcttccttttctttaaaaaaaaagggtcgtgttttgtttcttgggtttcggattttttttagttttttacttgttttaatccattaaggtatcaaagatcatttaacaatagtatatattaggcgacccctaacaaaccgggatcatgcaattaattattttgtgatattagattaagtttgtaactaatgaacccatctaagtttgtgtttacaatcttcgctttaattcggcccatgctgctagaataaattggcacgctcgctgggtaggttgtctatgtaccaacaattaaaactatatatttaataccgactcttaatgatatttttcaattttcatttttccagtataagctgcaccacatattatttacctgaagaaattcgttgtattttggattaaaaaatccttatagtttgcagttttagatatgtttcttgctgaaaatcatatctaaagcacgtaattaagaagattataccattggataaatcagttcataattaacttgttaggtgtataaaaaaactatgtccttctaatatatcgataaccaagcctgttgcatcttcgaaaagaaaatagaaaggaaaaaaataaataaagttgcaacatgctaggtccatgcagagatcgatcgatcgagtacgtaccggtgttccatgacgatgtttttttgcggcagctagccgaggaatatctcgatctcgatcgcagctaatagtcgaggaattaagacgacaattattaattattaatcaattgaaacgttctgctctgcttgatttattatatacagatgcctcgctagaaaccgtgaaggaatcgtaatcgggctatatatatgaatctaataaactgtacgtatataccgtataacgtagagtaattaacgaaccacatgcatgtcgagtccgatatttatcacaaattcacgagcttgactccataaatgaatcggatcgtttcatcaacttgaaaattcatccgaaagattagcagaatatgtaggggagacgggtagtaggccgattgggcctgatattattgtctgggggtccatggtttcctaattaaaagcccgccaaggtattgtgggcctaaaagagttgaaaataagtccaactttcttccctcacctttacgcggagttaaatcgacattcataaaccataatacagatatcttaaccctttaacttacaaaaacaggttaaattaggtcctatgactatacggatgtatggtttcgctaagggacaatttcgttcatacccctactttcatatccaatattgattttaccctcgttttctagggttttcgtttttctcccacttttttctattgaatgaggcgtttacccctgtaagaatggtaaaatctgataaggcgcactgtaagagttactctctccggattgataatacttgccgttttggacaagggcacggtctccaaaaaataacttcgatcattatttttcattgtaatatgtataaaagcaaagtactttataagattaatctatacatgtagtcaccatatttgaaagacaaatatttttaaaatgattcataatcaaatattctaaagtttgatcttatccttatctaaaacgacaagtattatcagtccggagggagtaaatagactatctattggaaaatagtatatttttaatccttaaatcctctttagagaatcttaaaaaagatttaggaaagagatttttaggaatcttagccatgctctgagcaaatcaaaatttaaaaattggccactgaagtaattaaaagccttagtacttactaaacaatctagaaatagaacagaagagttattttgcttgcacaggaccattccaaaaccactatactttccaagatagccattgaaaaaacatcataatcctcctttaacaggtaaagctaaaattcgaagatcaaccagcacaaccactcaaccaggcgaaggcctggaactcaatagtttcacaccacggtataaacgagcaatggacagcgttagtctgatgctgttgagacacagaagtcacgtaccatatagtattatagtaaaatggcaggttgtactacataataaccaaaactccacaaattcctaaataacatgaaaacgcactactacaacacagacacggtagcataaaaatggttctatactcattaggagtacgtactcccgctcccattccacctcaaccaaaaagttcttcctgtaaacctgtttcctctacatcaccaaaaagtttttcatgcaaacctggttcctcaagatcctaaggaaaaggcaacagcaaacaaacatcaatggaccatcacgagagtaactagcaccatattacatgtgtaacaatatacagtatgaaacatttcatatagtacaaatatacctcgtaaagttttcttatcctctgctcctctttttcttcctgtgaaaggagcatcagaagcatgtcagtatgccactggcaatgaagcatagcatatgcctacatgctatagacagaaaaaaaaaagaggggtggaaagatgggcttatcacacatcttcagactcgctcatctcttcggtgtcataaattccacaaagatactcatgtccaccagcatattggttagtatcatttgggtgcttcaaattaacattctgggctgcaggaat

SEQ ID NO: 62924 - DNA, 5416 bp, Oryza sativa
atgagtatagagatattgtgaaccaaccccataaaagttaactgaatacaagggaacaattaccattgtcatcagatttaagtgcacagcaacaagtgacaatataatccttttgtcctaccaaacacatcaattcagcaaagaacagatgaatttgataatccaattcattatctcctttggtcaatgccgtgaaatttaaatggtcaaaccacgtacagctctccataattggttgaaagtgaatgacatctttgagctcgtatgcaagaccctgaaaatagaattaagaatcagaatacaataagaatgatgggatagtaacgctagagatcgggagaacagacccctaaaagactgtgatcgtcattatacatgtctaatatcacccgagccaattggcgcatatcattatgcacatcctgcgttacttgtgatttggagtacctcctcctagttccatcaggaaaataaaggattttgcgtaccatcatgtccacaatagactccccatcccgctcctcaaacctagctcaaatcagaacaacccattattagtataaggtgaagtgaactataggtaaaaaaaataatagggggttgcagatatattgttaggtaatttttagatagcaaaatgtaccaacagtttagcgagttgaggcttaggagtttgtgtaaagagtgtttaatagaagttttaatatacatatgaaacaacaaaacactagcatagtttctggtagtcgacaacagaaaagaggcacacccatttaaaattacgcataactaacttaactagtttcgaggtagataaggtgtgcatggctattggatttagatttatcaatctttaaagcatttccctatttaaattcctaacacagactggtgtttttgccctgttgttaccagtgaattgactaattcttgtggcaaactgacaatcagtcttgttcagcatctaaggcactaggtgcgatataagctatacttaactgtacacactggaatgctgcaagcgaaattaaaatattcttggatgaaaacttgtgcaatcaggtcttactttgcaaattttcttctattccaagtattctcaggtgaaaacaagtgcaatcaagttgcctaaaattgtttcttggcaaattttatccaccttagcatggcattgttctatttgtagatataaaatcgcataccaagcacatggaaataaaaagaggatatgcaggtatcttactttaatggaggatataggatgttaagatggctagtgaaagcgtcttgagcttcatttaagctgagaaatggaccacccatatcaggatacgtgtggaacagcccactacgatccattcgaatgtggtatgacccgcggcggccttcaggaggtttgtgaacccaaatgactgacccaggggatgaggaaaggcagcaccctgatggtacagcgtcaatgttgtcttctggtactgcctgtggggaggaagagggactggaaataattggttctttcaatgctatagcgccaagaagctcccccacggacaaaacatctggttcctgcagtgcctgtgcagattcaggctcagatgcacctctcaaaaggccctcacacctgcagtgaacaagatcaattagtacaacaaagtatcttgcaaagccaatattcgatcaattagtacaataaaagtatcttacaaagtcgatattccagaatgaccattgcacaaatgccaggttaacatactaggaaatattgatctgttttctaaaatgactcgaaaagatatagccttttaccgaattgcggcatcagtttagtagaagtgaacctatgtaatacaccaatttatagtgccgttagttctatttttaactatatataagccgacaaaaggaattcaagtatcctgcctctcccctcccctcccctctaaaccgacaaaaggaatgactttcatcgagtatcctacattcccacccctcccctcccctccccaaatataagaagggtgtgcaatttgtctcgtgattgatcatcacctcattatagaaagtgtctggggaaccatcaatcctcagaaacataaatgataaataataggattgaatccaaatgcaagccctttcatcaaccttgttcatcgacagagaaagatagggaggagggaggagggttgaggtggtgttcgtactgtgtcggcagcggggctggatcacagggcttcgaccggaggtgatagtggtggtcgagtgcggcgtagagttcatcggaggttgggaacggcccgacatcaacatcgcgccccccggaggcgaaatacccacgagaatcgctgtacactcgtacctcctcatcctcacacgggtcccgctcccgccctgctgtcctggacgccatggatggggatggcgccggccgccggccggcggcgggggcgttgccggcggacggtggcgtggcggggactagggcttggtggaatcgaaatggcgcaaggcgaagtggccaacacaagtgactattgggccggaattgggctcggcccatactaaaatttgcatgactggatcgagtcctcttgcatatgatgaggacgatctggtgtcttgctgttccatgagaaatatgcctatcgatcgatttctatttggtttcttaattatgtcgctcgatggagccgcttgattgctacagtgtatttgctaaattaacctaactagcaggagcatggaggagacgaaaaaaataagcagtgtatgcgcttggtttcacggattggggtcgatttatatgaaggtttaacaataatttgagagaaatcaagctagccaccacatgcaaaaactcctacaatgcacttatataaagataggcagatcataattaaatgcagtttgaagatggacttacttaggatgaagatccgggctctggtgatccatgattatactcaatgtacagttttttttttttttgagggatactcaatgtacagttaagacggtatttggctaacaaaattagtttaagcgagcacgggattgggggcgatttatatgcatcttcttcactggacaattaacgtgagggaatcggaatcgttaccgtgttctgaacaaattactgtatgcgtagtactccctccatccttaaaaaggcccaaccgaacctaaaggagcaatccctattttcatatctaattgtgattttacctctgctatttaggtttttttggcccctgcttttttttttgatcgaatgaatcgattacacctgtttttgacggaagcaagtggacccggaatttgttaagggaaagaaatagggattttgcaaatcttgtgttacccttctattccggcaaggtcactccgtgcttactggaatagcattatactcgtatgtcttgctcttggagccatggtgctcaacgcctcaacggcagcgctgggctccggctagatagtactagctcagtgcagtgaagcaactatacgatcgagctagtacactcaagtctgaagccttaaaaggacgtggtgattaattcgtttcaaaattttgttgattattctttcaaatttgttatcttcatcaatgttcgtcaaaattttacaatagtcaaatctctgaaaattgcatatctggtctgtatatctgaagctgaaacaacgaagagaaaaaacaggaagaaagaaggaaatggacggctgagatgagctgataccgtttcgctaatgtagatcgaacgtccttgttttctttcagtaattactgtttaccgtaagatacgtcttaagcgagctaatgaactgagctgggtttgtccctattcgtggcggcagaatctatataagccgatccgatccccctttgcatctatcgaagaatataaaccctagttctacacttgttctttgtcttgcagcgcactttaaattcccctaattctgttatttttcatgcaatttcttcctgtaggatcccaagtaggtagcctctaagccaaaagtcaagttaaggttccaggtgcatttggtccctggttcctggcaacaatccagataaaaaatagtaacattgtataacattatgttaattataaaacagtctagttatattgcaccctccatgttgcaactgacatgacctcaaccaaaaagctcttcccacacacctgggtcatcaagatcctaagaaaaacattagagagcaatcatcaattttgagaagaaaaaaaaagacactatactgtatgcatataataacgctatgtctgaaataaggtcgcgtacctgatacatttttcttagcctttgctcctctgcatcctcgtcctgtcaatcaaggggcagaaaactgtgtcactaacatggttgcatggcataaaatatgttaattataaatccgttccagttgcaactgacatgatctcaatcaaagagctcttcccatacacctggatcatcaagatcctaagaaaaacacgagagagcaatcaacattaattgagaaaaagaacacatactcagccagaaacatgacatatacggatatacctgatacatttttcttaacctctgttcctctgcatcctcatcctgtcaatccagtggcagaaaacatgtcattcacaatgaagcgcagtatatgcattaatgaaaataaggaggaaaagatggatcctctgacctcttcagagtcactcgacacttcagtgtcatatatcccagtgatataacagtggccgccaacatatgaattgacatcatttgggtgcttcatacttctgttcccaaacttgcaggtatagcagttaccttagaaagaaatagatcgtttcgtcaaatgacagacacaccatcagttattcagttaggcagcaattatatatatgaaaatatcttaaattcaagttgagctaatgaaggtaaaaggaaaaaaaatgcaagaagctatgaaaaaacagattattaaacatgaaaaaccaaatgtttctcccaggtttatgagtatatacaaattatgaagtatgaacccaagtccacaaaagttaagacgggtacagcttaccattgtcattagaacttatcaaagagcagcaagtgaccacataatccttttgtccttctagagacattgcttcagcaaagaatagatggtcacgatctagccctttagatcctttagtgtttgcagtgaaatttatatgatcaaaccacctatgactctcaaatattggttcgaagctaacgacctctttaagctcataggaaagatcctacaatgagaaatagaataagatcggcaagtgtgacatcaattagacaccaccaaagcgagaatgatagacataaagcgagagcaagaacaaacctccaaaaaattttgatcatcatgggctgc

SEQ ID NO: 62925 - DNA, 24418 bp, Oryza sativa
tatgactccccaggtcgctcttggaacctaactcagatcagatcagactatatcattagtacaaggcacaatgaatatagtacaatgtgggggttgcaaaggcattgttagagaatgtgtaccagcaatttagttcaatgtttagagaatgtgtaaatgttatctaatagaaagttcaacatgcatatgatttgaaacaacaaaacactagcataatttcgcagttatcaacatagaagaagcacaaaacttcataatttgaaaggtatacgtaagtgccgtggaatcacacttagcctctggcacatcaaagctagctgggaaacaagctatctattcctagataggaactagaataatgtgatccaactggaaccgccattattcactatggatcatataaaaacaggacctaatataaattcagaaatagttcagctcaagtggaggcaggtgaagaagagggctcatcccatgatcaactgctgcaagcgtctaaagaggtgaatgcaactgcagcaaatgaggcgaaggaggagcaccctgtgtctgcttgagaaatgaggtaagctacaggatttgacccacactcttgtagtcttgttacaaagttctataatgcagtttaagtccgaactgcatgtgaaataacgctatgtgaatggttaagttgtataatgcagttttgaccagaaatgctgtaaagacttgtctggatgctgctttgacaaaacagatcacttctatgtatctgtgaggataagaaataaccaaactacaattttgatatgaaccaccatggtttgggaatcaattgcaacattttaacctgaggggaacatataaaatatatgcgtttcagtaatttaaatgggaaaggtttttttctctctttctcaaaaaacaaaaaaaaaactgaggggaacatgcctaaatgatgcttaccaagcaacaactagcttaggccttatcaacttctgaacttcataatatctttttgttgcagtcatttgtgcttaacaacctcttaaaaacatagttacctaaaactgttcgcttgctcaattgctttcatcacttagcaaaatatttctttttatcagccagtgaacagtacaaactacaagttaggtcctacagttacattttgtgattcatgatctgaacaccatccaagcacaggggaaataaacagcgttagctacaatagagtgtaagaaccttactttactggtggataaatcctgttaagatggctgctgatagcatcttgagcttcattcaagctctgaaatggaccacccagatcaggatacatgtggaatgacccactacgatccatccgaatgtggtataccccaaggcggtcttcaggaggttcccgaacccaaatgattgacccaggggaggaaaggcaacggactgatggtgaagagttgatggtgtcttttgatacggcctgcggggaggaagagggactgcaagtgattgattctttcaatgttgtagcatcaagaagctttcccaaggacaaaacatctggttcttgcagtgcatgtgcagattcaggataagagcacctacagtagcaagatcaatgagtcaaacaatttatcttaaaaagttgatattcagtcaaacagtttatcttacaaagctgatattctagaaggatcattgtgcaaatccgaggataacacactaggaaatgtatagtctttaaccaagttacaacatttggtttgtagaaatgcacatatgttacacaccaatttatccgaaaaattgacaatttgacctttttgtaaaacttgtcaaaattgacaaccctccctcccctctcttccctacccttccccagatatcaagttctactgatcaatattctcctagtcctggtttccccttctgggagaagcaatcttcacaaaaaaaagcaatcgattgaatcgaaatccactaactttcacaaacctccacagggaaaatatatgccctcgagatataataagaaacagataagcgaagggaggtgttcgtactgtgaagaaagcggcggcgggactggatcactgggcgtcgtccgggggcgatagtggtggtagagttcatcggaggttgggaatggcccggcatcatcatcgcgccccccggaggagaaatacccacgagaatcgctgtacactcgtacgtcctcatccgtgaagggggatcgggataccccatccgcacatgggtcccgctcccgccctgctctcctggacgccatggatggggatggcgcctccggccggcggtgggggcgtcgccggcggacggtggcgtggcggggactagggcttggtggaatcgaaatggcgcaaggcgaagtggccaacacaacacaggtgatatttttttattttttagacattttatgttttaattttattaataaccatttctaaaagtattttcaaatctaccatgatcaaataactctatcgcattaacaaccacaccacgctcttgttacgccaccactgctcgtgtgaccagccacttaggtggcattaccgaaagattcagttttcgaaaatatttttagaaatagtctattaataaaattagaacatgaaaagatcttaaaaaaataaaaaaaattccacacgtgactaggtgaggacgaggagtgaactattggaccggaaacactccgttccgggattgggctcggcccatggtaaattttgcgtatggaccattgcccctcatgcgtaaggcccataattgtttctcctttttcttaaaaaactacattagtgtttatgactgaatcgcagaaaagaaaaaaaacaacgttagttctgttgggttttcagttgttttattatatccaattaaaattttgatttttctgtttttgagtgtactcttgaacaattcaccaggcgaattgcaagatagcaaaaaaaaaaaaaactcgctagaaaaattaagctagccagatgcgtgcacgatactccctctgttttagataataagacattttgactttgattaaagtcaaactactttaagtttgaataaatttgtagaaaataataataatatttttaactcaatataaatttattatgaaaatatattcaattgttaatttaatgaaactaatttggtattataaatattactacatctgtacataaacttagccaaatttaaaatagtagtcaaaacgtattataaaaaaaaacagaggagtatatcagatggagttatgtaggatgacggcgatatggtctctgcaattacatgggagagatgtctatcgatggtctttaattggtcgttgcttatgtggcttgagccgcttgattgctacagtatatttgctaagggcgttcgcgaaaataaaatttttgaatgtcacattagatgtttaatcggatatcggaaggattttttttgacacaaatgaaaaaactaatctcataactcgcttggaaaccgcgagacaaatattttgagcctaattaattcgtcattagcacatatggattactgtagcacttatgactaatcatggactaattaggcttaaaagattcgtcttgcgattttccccttaactgtgtaattagtttttcttttaatttatatttaatgctacatgtatatgtccaaagattcgatgtgatgtttttgtgaaatttttttggataactaaactaggcctaaattgacctaactagctgcagcatggctgcagatcgtgactaaatgcagtttgaagatggaggacttacttaggatgaagatccgtgctctggtgatccatgataagttgatactctggtgatccgggctcgagccgttttagcagctggagcctggaggagacacaaattaagacggtgtatttcgttaaaaaattagtttaagcgggcacgggccgggattgggggcgatttatatgagaaaattgtaattataggactccaaacagtacgcttcgcagttatatgactccaatcgtcgacttcgctaaaacaaataaggcctcgcaaaaaacaaatcaaaggcatttgcaaatctgttttgtaatcggaatcgacgtgcacatggtacgtacagtttgctcagaacacgcactttcccagcgaagatgtactggagtatataaattgactacaaatcttatgtccgcttaaattaatttttgttattcaaaggccgtcctaattttgtccccacaagatacctacgtttagcggcttgagccatatacttcctccgtctctaaatatatttgacgccgttgactattttaaacatatttaatcatttattttattcaaaaacttttgtgaatataattcaaaaacttgagtagtagtagtatatttagcaataaatcaaatgataggaaaagaattaataattatttaaattttttgaataagacgaacggtcaaatatatttaaaaaagtcaacagcattaaatatttagggacggagggagtatatacttacaagtagtaatatactccatttcctaatagataacatgtttgacttttgattatatttaataattattcgaaaaatttaagatgtttatcatacttaaagtgttcttttattaagtaataaaacaactcatagcaaaataaataataatcatgtaatttgttcttttaataagactagaaaaatgcccgtgcgttgcaacgggtaaatgctattttaattttattattgctatacagtttagctaagataaaattcagtgtgagaattcacttgaatatatatttttaaaaaaatcatgagctccaattaggagtctaacttttacctcaagttagcatgcagagttttttaaaagagatttcttgtacgacttatttgtatttccaaaaacaagcaagcttaaaaactgactcagatatggatctgtatttccaaaagcaaacgaacttaaaaaccgggttaaatacggaatgacgtaccaaagtaccggcaaaaacatcttcaatttttataatagaaaaaatgcccgtgcgttgcaatgggtgaatgctaattttaatcttattattgttatacggcttagctaggatgaaattcactgtgggaattcgcttggatatttttttagaaaatcatgagctgcaattaagaatctgactttcatctcaaattagcatgcaagtttttaaaaggaaattacttatacgacttgttttgtatttccaaaagttaacgaactcaaaatccaattcatacacagatctgtattttcaaaagcaaacgagcttaaaaattggctcaaatacaatacagatgacgtaacaaaatatcggtaaaaatgtcttcaatttttataataacagagatatggtgttggaagcaccatccatgtcataatggattcatggaacaaatggcatcttagtatagttgctctacatatattaaatggatagttgatatatattaacatgcatgggactgatttaggttcactttccatagtttatgcgggaacctgccagaaccaatctggataatcccgtgcctcgccgttcgattccaaccaggtcctccgcatggctcaatgagaaattactgaaaattaatctattgcctccgtgacggtgtgacaccgatacggatgcaacgcggagggagcgaaatgtaaccgtgcgagacttacaatgacggacgaaaatcccagacaaaaacatcttaaatttttataatagataaagataaatggtcaaacgtggtcgatcggatatagcatacacacgactcattctcaatcaaaagcttctcaaaaaacagtatatacaggactagatggaaagcacaaggtttaaggaacgtattacggtttaaattgagaggacacacaagtcacgacgtcgacgtgtgatgattgcaacaagagttagagcgcaggtagtacgcgagaacgaaaccccaacaattcataatcaagatcaaagataactaaataaaactacagctccacaacatggttgcatgacatatgctaattataaatccgttacagttgcaactgacatgatctcaatcaaagagctcttcacatacacctggatcatcaagaccctaagaaaaacacgagagcaattaccaattgagagagaaaaaaaaaagacaccatactgcatgcataataacgttcggtctgaagcatgtcacatacctgatacatttttcttagcctctgctcctctgcatcctcatcctgtcaatccaagggcagaaaaatgtgtcactaacattgtaataatgaatcttaatatatgcatgaatgtcttacaaaaactaaatgggggaaaagatagatcatcagacctcttcagagtcactcgacactatagtgtcatatattcctttgatataacagtgaccaccaacatatgaattgacatcacttgggtgcttcatacttttattcccaatcttgcaggtatagcagttacctgagaaagaaataggttgttcgtgaaatgacagacacacaatcagttaagcaccaattatatgtaaatatcataaattctagttgagctaatgaaggtaaaaaggaaaaaaaatgcaagaaccgatgaaaaacagattaactagacatgcaaaaccgatgcttctcccaggtgcatgagtatatacaaattatgaagtctcccaggtgcatgagtatatacaaattatgaagtatgaatccaagtctataaaagttaagatgggtatagcttaccattgtcatcagaacttatcaaagagcagcaagtgaccacataatctttttctcctttcaaagacatcgcttcagcgaaaaatagatggtcactgtccaacccatttagtcctttagtagtcgcagtgaaattaatatgatcaaaccacctacgactttcaataattggttcatagttaatgacacctttgagctcaaaagcaagatcctgcaataagaaatacaataagatcagaaagtgtggaatcaattagacatcatcacagtgcagaaagaatgagacagacaacgagggcgataacaaacctccaaaagattgtggtcatcgttatacatgtctaatatcaccttagccagttgattcatattattattgacattctgaaatgcttctgctttggaacatttcttcctagtgccatcaggccaataaagtgctttccttataatcatgtccacgtaagattccccagctcgttcctcgaacctaactcaaatcagatcagtccataccattagtataaggcagaatgtagatagtacaatgcaggggttgcaaaggcactggtaagaagtttgttatagagattacattccaataagttaagagtttcaggataagaaaagtttgagtaaatgttgtcaaattgaaatttagcactcatattagttcaaactaaaacagtagtatggttttttgcagttatcaaagaagcacgaaaatgcataattcaaaaggcatgcgtaactgaatttgcttgtttctagatatataagggcatggctatcgtcttgtagtttatcaatctatagaaagtatcatagtttcaaggtttagatcctaaactcatcctggtttttccgtcctatttttacctgcgattagactaagttctgtgtgatcactcgtgtttacctctgacacattaaagctagctgagcagcaatataattgtaaacgctgcaaatgaaattgaaaattcctaggtaaaaactagtgaaatgtagcttatttgtgaacttcgtgttatcttatggtttgcagtcattttgtgcttaacaactccatgcccccatatatacaaagttacctaaaactgctcgtttgctcaactgatctcgtcactatcagctactttaaattacaagttacagcccacaattctgttcatgactcatgccctgaatatcataccaaacacatgggaaataaatggagtagttgcaagctacaacagagtgtaggaaccttacttaactggtggatacagcttgttaatatggctactgataacatcttcagcttcattcaagctctgaaatggaccacccagatcaggatacgtatggaaagaccccaaacgatcctttctaatgtggtatacgccaggtcggccatgaggaggtttctgaacccaaatgattgagccaagggatgaggaaaggcagtgccctgactgcggagcatcaatggtgtcatctggtactgcctgtagggaggaagtgggactggaagcggttgattctttcaatgttgtagcaccaggaaagtcccctaaggatgaaacatctgcaagaccagaggtacctcccacatgatcctcacacctgcagtgaacaagatcagtgagtacaaacaattcatcttatgaaatcaatacttcgttgtacaatgcaggttaatagacccagaaatatatatataactatgattcatggaaatgcatatttttatgagataacctatttgacacttgacagaagacaaccccaaaaatcttgtgaattgtggacacgttggatcgttttgagattcatgcaaccagccctaaccccttgttcctccctccctcagtcctgccgccattctgcggatcgcctgcctcctcctctgccaccggcccagcacgccgccgctggaaagcacaacggcgaggtgcccccacaacctaaccactcgaccagtagatgccttgtccactccggcctacctctaaactcaggaacctcccccctgttccccctctgcccaccaccatcgtcgccggagatcaacgagctcaccagagcaggaggtgatcatgttgcatgaatctcggagcagaccagaaggtcaaaaatctgtaagatcggggcttcgattttctatcaaatggaggtcctcaagccttcttcctctcctcaaagatcaacagtcgcaactcgtctcctccttattagggaatagccatgaccacaagtaattaaaataattcgatttaatcgaaattaaccaatcctagattcctagttccttcaggtattctatctatcaaaacaaaactctctctaagataccaattagaaacagagaaaggatcgagggaggtggaaggggagaggtggtggtcgtactgtgccggcagcagcggcggcggggatggatcgcgtcctgaggcgaaatgcccacgagaatcgctgcacgctcgtgcgtcctcatcggtgaagcggggtcggaacaccgcatccgcacaggggagccgccgtgatctcatggacgtgcggccgcgcgtcggtggaggggcgatggatggatggggttggcctcctccggcggtgggggcgtcgccggcggccggcggacggtggcgtggcggggactagggcttggttcgtcgtggtcgccggcgaacgcgggtgagcgaggtgaggaaggatggctattgggcctagcagaattgggcccactttcctttggactatcccctcgtgtgcaaggcccataattacttctgtttggtttcaagttatttttttcagattttcctttttatgtttttttcccctgattttgagcaaatcctccaggtgaattgtgatgaactgatgataaaacaaaacaatagtagtgtaatagaaaacaaaaaataaaactcgcaagaaaaattaatgcgtggacaaagcaatattgcatatagacaggtggacttacgtagtatgacgatctggccggctgatctgctgctcctcctccatgtcgatgattatttttttctctcgatagtttcacgattggtctaattattggtggagatgaacaaatttagacaggtaaacatggattagcggctaagtgcgagttatgtacgtactacctaaccgaatttttatcgtgttctgaacaaaccgtgcatactacatgtacgctgagtcctacaaatacacagattcgcaaacgcaacatcacgatcagattggtaattggattgcatagatacccaactgagaaacagatcagaagcgagggagaatcggtggagatatgtacgggatgatcaacggagggcggctagatggagaccggctccgtccgatctccggtggggcttcgccggagatgactgatgaggtagacgatgcgtagcggggccgagggcttcgtggggcctcatttggaagaccactgggccaaaattaccggcccattactgttaaaaggccggggattatgggcttcaaaagcaggactccttccgacaaagagcctggaggagcaaaaatatccataattatgaagcaaaatttttatctatgtactccctctgtccaaaaaaccctaggactggaagtgatatattctagtacaacgaatcggtacaaatgtatatccagattcattgtactcagatgtgtcacatccagtactaagttggtttttttatggaacggagagaatactcttagagcaggtacaatagtagcctataagctagctataaacatattttaaggagataagagaagatagagaagagcagttggctacagatttgtagccgatgtgcgtatggcatgtgggatcagatattaataggtaactattgtatgaattagctattaaattgactataaatgatttggagctgatagttggctacactattaaacttgttcttataggagtagcagtttttaaaagtaaatattgaaaaataaaccataataagagaaaccttagattggactttaaattaacttttacaatttaaattgtagttgtggctggtaagctatcaagcaaaccatgtacaccatgtttcaaagtcttctgttagacggattttcattccaagtttagagaggtaaattgatttgcttgcttattcttgttatgccattttcatgttgttaaacctgtctttaagagaaaacaaccaacttgcatttatccctggtttagtttcctaatttttttccaaaaacatcatatcgaatctttggacacatgcatggagcattaaatatagattaaaaaactaattgtacagttaaggggaaatcacgagagggatcttttgagcctaattagtccatgattagccataagtgctatagtaaccccacatatgctaatgacggattaattagtcttaaaagattcatctcgcgattttcaggcgagttataaaaatatttttttcattcatgtctgaaaaccctttccaatagccagtcaaacatccgatgtgacacccaaaaatttttcttttcgcgaagtaaacaggccttaggcaaggcctggtttagttcccaactttttctttaaacttccaacttttccatcacatcaaaactttcctacacacataaacttctaacttttccgtcacatcgggtttgtttggtttagtgccctaccaaagtattgatagcgccaaaatttaggcatgttttggcactaccaatattttggtagggtagtatttaaagtgaatgagtttggattatactaattgaaagccaaattttatattatagttaagaaagttttagaattatgccaaattaactatgggcattaccatttacttgcctccaaaccaaaccattaaattcactatttaagctaccaaaaaattggtagggcacattttagcatcaatccaaaatgacccatcgttttaatttcaattaaacttccaattttagcgtgaactaaacatacccttaagagcaagtttaatagtatagcccactactagctccaattcatctatagccagtctaatagccaattcatacaatagatgcttactatactattaatatatggtcttacctgtcatacacacactgtgtcttggagtctgtgctgcagctggctacagatctgtagcccgctgctcttctctctcatcttttatctcattaaaatatgtttgtagctggctaatagtctgctattgtacctgctctaagcacaattgaaaaatcttggaagtagggaacggcttcttctccctcaccacaaaatgaacattgaacaaaccaagaaaaaaaataatgaaatgacccatttgccctgcattccaaagcactcacattcattgccttttgagcttgacccacaccactctgagggccctttgaatagcagggtagaaaaaacggagaaatagcaaaaacataggattctgacagggattgaagtgtaaaacagaggattgcaaaacacaggaaaaacataggaattgtcgtttgattggagcgcaggaaaaacgcaggaatcggatgaaagagatagacttaaaggaaattttccaagaggttggagctcttgctaaatttcctccaaaatccacatgtaatgtgccattccataggaatttcataggatttaaaagctttaatcctttgaatcaaagggctaaataggaaaatttcctatagaatttgaatcctataaaatttctgcattaaggccccctttgaatcacaggaatgaaaaaacgggagaatgggaaaaacataggattctgataggaatacaagtgtaaaacagaggattgcaaaacacaggaaaaacataggaatgaccgtttgattgagccgcaggaaaaacacaggaatttgaggagaaacacaggaatttgaggagagagaaagactcgaaggattcttaacatgaggtagaacctcatgttaaatttccttcaaaatttgtatgggaagaggtattccataggaattttataggatttcataggattcattcctttgattcaaagggctatataggaaaaattcctataggaattaaatcctttaaaatttctatgaatttcctttaaatcaaatggggcctaaaagggggccatgaatctttcactccactctgctcaaatatagcactccactccctggtcagtgctacttcactctcccacttcgaggctacaagcttttcttgcttgctgcaatggccgcctcctccgcgcagctcatcttcctcctcctcctcgccgttcttgccgccgcctcatcgcgcaacgacgaggaggcccgcgcgctgatggcgctcaaggagagcctggacccggcggggcgggtgctgggctcgtgggcccgctccggcgagccctgcgggggctcgttcgtcggcgtgacgtgcgacagcggcggccgcgtgacggccatctcgctgcagggccgcgggctctccgggaccctccctccggcgatcgccgggctccggcggctcaccgggctgtacctccactacaacggcatcaagggggctatacccagggagattgggagcctctcggagctcaccgacctttacctcgacgtcaaccacctgaccgggccactgcccgtggagattgccgccatggagaatctccaaggtgaggtttctatgctgcgttcttcagttcttgtactatttcgtctccaagattgcatttcttgggttgaaccttcgttttttttgttgggtagatggggtttgcatttgatttatggttctttgttttcttaaagattgttcggtacttcttcttgtttcttgtgatgcttttcaaataaaactggcataaaaatgtcgcttaggagaatggagcagtgaagccttccattttccacggtttcaaaaaccaatgatgtactagtagtctactagttccaactactccttggtttggtatataaatgctccatttttgtattccatttttcgtcagtttgtggcgggattttggcatgaatcggtacttttagttttgggttcatttattaagcatcagtacaatggttgatttttgaaatggggcagtttatctgttatcaaatccgatttgtatgtttctattccgattcttctcttggagcattgcgacagtcacgtgttcatccattttgatttgatttatcctgactgaactgctgcttggtttattagaaccccacttgtctctggtttagatttttgtggtaacttcaggttgaatcttggtacaaaacactttacagtgcattatgaacttctttgatttgatttactactcggctgtttctgtccaatgtttgtgccttttctgtaaataaatccagtaaagaacaagtgacattttgttcttctgctgccttggctccttccttcagatttcagaatctgcacatatatctcatacttgttgattaggccttcgtcgagcatgtgatgcttctgttcatgttttggaagtctacgtaccagtgcctgctgttccctagttgttaaagagtcaaatattattttctgccactagatctgtttcaaagattcaataatatgatacatagacttcgcaatggctcattgagaatcaaaagtatgatatgatgtggtgcagattttttatgtagcatttctttctcttttttgcagttttgcagctgggttacaatcagttgacaggcagcataccaccccagttaggcaagctcaacaagcttgctgttcttgcacttcagtccaaccagctgactggggccattccagcaacactcggcgacctaacacagcttgcacggcttgatttgagcttcaacagtctttttggttccatcccttcaaagattgctgaggttccattgctcgaggtctttgatgttcgcaataattccctttctgggagtgtcccagcaggtaatatacccttttattacctttcttgagtaaaacttttgctatgtttatatttatcactgtaacttgttgtctggatgctaggattgagaagactgaatggtgggttccagtatgtgaacaacaaaggtctttgtggagttggcttcagtttgcttgatctttgtttgtcatcggaggatggcttgaaacctagtaaacccgagccttttggcccagatggtactgtcaagacaaggcaagttcctcaatcagcgaatacggacaatcactgtgagggatctggttgctcgaaatcttcgaatgcatctgtgggagtgcttgttgttggtgtggttgcagtggtgattggcgccgcattctgcggaatatttgcattctcatattaccgccggcaaaagcagaagattggcagctcactggaggtttctgatagcaggctcagcactgaccattaccaacagaaggaagtttgccgaagaagtgcttccccacttatcagtgttgagtactcgaatggatgggaccctttgtctggtggaggcgttgggtcatccggcgaggttggtgatagctttaggttcaaccttgaggaggttgaatgtgcaactcagtacttttctgaggttaatttgctgggtaaaagtggctttgctgcgacatacaagggaattctacgagatggatctgttgtcgctgttaagagtctcaacaagacaagctgcaagcaagaagagtcagatttcttgcgtggcctcaagatgctcaccgtgctgcgacatgagaaccttgttggcttgaggggtttctgctgctccagggggaggggagagtgcttccttgtctatgattacatggttaatggttgcttgtcacagtatctggatgttaaggagggttctggtgctaatgtccttgattggccaacaagagtttccataatcagaggcattgcaaaaggtatttcccactcaagcattatcttttccagctttatcttcatttacctctgactgatatggccattcaagtattgtcggtgtcggtggtgttctaatgcttaatctgatgcacatttgcaggagttgagtacatgcacagtaagaaagctaacaagccatcagtagtgcaccagaacatatcggccgagaagatccttctcgaccaccacttaacgccacgcttgtcggtcccagggctgcacaagctccttgctgatgatgttgtcttctcgaccctgaaggccagcgcagcaatgggataccttgcccctgagtacgccactacgggccgattcactgagaagagtgatgttttcgcatttggtatcgtcgttctccaagtcatcacaggcaggagggctgtctcacagctgaaggtcagcacagttgccaatgaccttgatagcctgatcgatgagaacctcaatggtgtcttctcaagaactgaggcagctaagcttgctgccattgctgcactttgcacaagcgagacggcgagccagcgtccaacaatggaagctgtggttcagcaactcagcaactgccactgaagaactgaagctagctgatgatgggatatcttttggaaaccttcacctgaggtattttgtaagggtagtgaaagggtaatgatccagttgccactgacatgctagtgctgaacattttagtagtactgattaactagtcactctttttctaatgatctcaccatttcatggttagtgtatcactatcctttcaacattagaatgttgaaaactactgatgtgttagatgttgaacctttggttcggttgatcagtatgcaatggatgctgatttgtgaagccatcaggttcagagagaaattcagcatttctaatgtagcagctctggccagctttgtaacggcattacttgcattgaaatgctttaccgtaattcagtttaatgcctttaacaaactcacgaagaatacgtgatcagatgttgaattacggatgagaattttattgaccctgacatgtcattcatcattccgttgtcctataaatctgcatccgctttgtactgtactactactagaggatttctaatttagctgtgatcagctttgtagagaatttgcttgcattgaaatgatgtaccataattcagttaatgcttctaacaaactcacaacgaatgcgtgatcaaatttagaattacggatgcgaattgatatctgggcgttattgaccctagttggcaattcatcattccattgtcctgcaaatctgcatcttgctacatactccctccttcctaaaataaagagaataaaccctcttctgggtatgaatgttgattaaataaagagaataaaccctcttctgggtatgaatgttgatttagtgtctattcagagtgaaatgcaccattaataccttaactcacgaggtgggtgcaatttagtcacccattttgtaaaatgctcaaacaaacaagtcactcatcttgtttcgtgggtgcaaatcacataaaacatgtgtcgtatggagtgttcgcaatgaagttatatgctatgttaatttgtttacaaacatggtcacacgattcataaataatccaatgtgcagtactaccggtagtaaaattcaattaaagatgaattttgttattgatagccaagcataatatggtaatgttcattgaaagcaggagtagtagcatatacatggaaatataagtgttaatatgtaattttaatgcttatcctgtccacattggtaaaaaaatacatgatgctaggtcaatatggactccaatttaaaaacaaacaatccgtgtgaaaatgtatttggtaacatttgcaccatcgaagcaagatgagtaacttgtttgagcaatttgcaagatgagtgactaaattgcacccacatcgcaagttgtgataccaccggtgcattttactcgtctattcatattcatatttagaagtttttttttacggaaggagtggtagtgtttaccttaatgccttgtacttttcaatattggtaatttctggccttgtagaaatttttaagagcagtttttttaaggagtacagtttgacagaattgcaagatattgggagtagcttcaaaatttgaatctctaagcaagaaaaggacagttccacacatttatataccctgctctgcattttctgcacaagaagcatgggaatggcttttttctccttaccaacactaccagactgcccttgccgttggccattggccactgttcttctcctgtgccactgtactgctctgttcctcgtttcccttttctcttcagaagttgaataacctgtcacaaaaaaaaaagagaaacaaaaatcactactagtggtttgacaaaagcatgccaacactgttaatgcacaagtttacagggctaaaatgcaaacttttaaacatggagtacaaaaagccttgaaacatgtactagtactgtactactactcctatgcatcacttgcacatgacttgaaaattcaaataatattctttcttcgacaggggaaaaaaatcaattgtactcctactgaattgtcacaaaaaggcgaaattcagccaagttccaacagcacgagcagcagcagaatctgcccgttcatcggggagcacaacactgcaaagatttgtttaagcaagccaagaacaaaaggactctaaacatttctaaaacaaaaaaagagaaactaaacacaacctaatcaaaggctcaatcaccaaccactcccgcatttaatcacagggccattatgccataatcttgtctgctcagttattaggacaaagacaaccaatctttattgaactgagcagccattaacaatcagcagtccttgtttcttgaaacgagacggtctctcatcagccgcgtgctttgctgcaatgatgtttgcattgagcattgctgcattggcatttgaaatgtgtcccccaaagcttctcttctgtttgcatctcacactgtctcacaaacacactgtagatttgcagcgctcaaacaagacagcacagaagcaatagagtgtggcagcctagagagaagcagtactactcctcctccaggtctacagtgattttggtagaggagctgcgtattctttcgaggctgcaactgcaatggccaatggcaatggcaatccatacttttgtgcgtgtccaaagcggtatttgggatttcaattctctctttgagacttgagagttgagagagtaaagggccacggcgtgcaatctgatctgcctggctgtccgccatttggtggttcagttcagggttcaggctctagccagaattgacttctgccctgtttggtgtttctctctggaatcatgaccactctactgttctggttggtctaaggttgccgttgcattcgtcagtgttagtgaaatcccaacgtgagaatgcagcaccagcaatttgaatctcctcttcggccgagtttagttacaaactttttctttaaactttcaacttttccattacatcaaaactttcctacacacacaaacttccaacttttccgtcacatcgttccaattttaatcaaactttcaattttcgtgtgaattattgtttgaaatattatctggcaagaaaaagaactgatagaaagataggacatgcctgaatgagatgttcaattttgtttacatgctcacaaatcaagttgatgagaagtttcctgctgaatttcttgtcttgcttgctggcgctgaagggatttgcaactttgtcaatctctgagaaagtgtcttcttgggagaaggatggattgatactataataacactagtaaaatggtttctcttgctttgatggttaccagtgaagtgaagcatagggcgaaaatactggagcagtagtactttagtgtcacgtgtgcacatggtccctccattttagtttagcacttctgcctatcactcgcacgctgttgtatgtaagctacagctactatgagtaccacaggtccacagtagcactagcaaaaatatttattgccctgtcaatggtggtcagttttgtcacccacatttgaagcttttttcttaggaaaaaaaatcacgttttaagctatagtttctactactattagttagggtttgtttggttttaaggaaaaacaaaggatgcttcataaatattaatccctatatgttatttgatttgtaggaataagatataggaaaataaaagaaacatttatttcttacatgttgtaaagagaaaacatagaaaagcttccatccactcagagctcttgaaaaaaattcctattttttattcctatgaattgaaatttatccaaaccaaaaagcccttaacatgtttctttttctagtattactaactcacattttccagtttagcaagcagtaatatacgaccttgtcagtactaattcacacaaaacctgtgtattccaaatagtacaccaccagtgtacactactgcatgagttctacatgagacacagtagcctcttccatacaagagatgctgtactctttagtctctactatacagacgtcaaaaactgaaacacctgcatttgttgtccagtggaacaacagtagcaccagtgtttagattttgggaggcaaatcaaatgcagtctcgtttcgcttcacacattggcactttggcagcaacagcaaaggaccaaaaaaagatatagggaatccaaagcattctccctctccgtggtcatgcatggcttcatccatggaccatggtcaaggactccttggtgagctgtggccttcaagggaaatgtccttttgccccagtgctgtgatcactctgcattttgtaccagcggcagcaaaggttcccccagtgtggtccttcggttcaaggtcaaaactcataatatgtgcacaattcctctactactccatagtttttttatttgagggtcataggatctgcataataatagattcaataagactgacattgatttttttttacactttctactattctaattttgaagaaagaggaccacataatcttatttttagcgtgacatgcttgagggaaaaacagtacatgagacctgactgttttgttcgccttccgtcatccgacacagaattactgtttgaaaacaatgcagatttgcagttttgcaatcagataacagtatattacagaaaacaatgtccaggagagaaacaccgtagaggcaagactgaaggagtatcatcatgagtctgatggaccgtctgaaataaacagtttagtatagtactacaggatcatcagtattgctggcaaggcaaactgttgacaagagtaatttattgaaatgagtgtttcagggttgctggcaaggcaaactgttgacaagagtaatttattgaaatgagtgtttcagggtttggtcatgtacagtcacttatttatggtcgatacaagtggagaggacagagaaaacaaaacagtctctgccttcatacatcagacaacatgatcaagtaactgtgtcaattgttaaactgagaacataagcaaaagctgctaaactgaaattgctctgattgcctctgaattctgaaaggtccgtaacggaatcctgtattagttttcggctttaaactctccaaaacttcactggatatttcaagtgaggaactgaacattctgaacttatgatgtcaagcaacagcactttgctgctcaagcatctgtgtccactcaaccggccaccagtctggtttgatcgccttaactctcacatccctattatccttgatggcaaggcttgaattttgcttcagggcttcttcaagtctcagcaggcccataccacggctgccaagagcagtgttaactgtaccgattttcttgccagactccttgtccacgacttctgagcctggagcaacagcctgcttgagttctaaacaacagagttcgaataatgaattaatgagtctcacaaaataaacatgaaacactttgctaaattatttagcacacaatccataccttgcccattttcatcttcaaatattaatggcattaggcgtttcctaatgacaccacgatggtgtgtacgtgcaataagttcctgtccgatatagcagcccttctcaaatgaaattgcattcaagccagcaaaattgtactcaagcggaattgcttcacctgatttaaagcaagacaatttcaattaatgaaactaaacaacttcatatctgattagaaaaaatatcacaaaagttgagcaatgaccaaagtgatgtcatattacccccagaatcaaatattggcaacagaacagacgctctttacgtacttcaacatatgaataaggtcatttgtgcaagtttatcattgtgctacaagggaaccaggaaagctgctgtctgagaataaaagactctatacagtctatgcttctaagctatctcccatggaatacagaatgatggtaaataatccaccactgacaccagccaacaacaataccctcgtgtcatagctatacagatcataacgtcacctgaatccagtcgccttcaagttgttaaccttgtttgcaggatgcacacgctttctgggataatacttgttaaatgcgctaaagtagattatggaacctttgaaagaggttacaggagatactacttggttactatcaagttcatcgacttcaatagataattgaacttggagcagaatggttttgaccaaattggagacagtgaactagaaaactgtaatgcagtcaacagacatttatgcattgtagagacatcttcattgttatcaacatcatctctagacttggaaccataacaaaattaattaaaaaaggtataaatgtgaatccaacctttcgggatctcagttgagccttctgcaactccattctctatccgccagagcaagtaatggcgctcatcggcttctttgtcagactcaactagcggtgctgtggaaaacagaagagatcaagtgttcagatggatcttgctagatattgaatatcatgccacaaacagtaggaaacatcaggaacagattacttacgtatagtattagctggaaagattcctctgtaaccaaggcaatccaatctcgggtctttgaaccactcccaaccatggccattaccttgtgcagctgactcggcagcatggtcaacaccttgcccccatccaatggattgggcctcaggttcttgagtagaaggtccggtatgctccacattgcgtccaaatctttgccaacacaggaattccttactaacattgtctatctcaaccttggatcttaaccgatatctgaatgggcaaaatatcatcaggccataagatacttgaacggataaaatggttattaaggacaagagggatagatcactgattccaccgcaaaactgtaacacaatgtctctttttttggaactaggagagccaagctccccccccatttccattaatagaaatgagaattaccagtttacagaccaaaagaatccaaattcccagcttgcaggacacactacagttcatgacagaaaaagctataacacaatgtgatctcatgtgtcattatattcctcagctacaagaagatcctaattctcacgttctccttcctactggatcttaacaaatcaatcttatccaccacaactttagtccaaggggagctgcttcataggtgagtttgctgccaatggtcctacttgaaagttgaaactaaagtcgctaattagttagttcacgatattcttcagtttggaattagtagccttaagctgaacgcctaaaactttcaatactaaccaactgactccacacgagagcatgaaatgtccaaccaaactgtcatcgaatgttttaccaaatcagtcaaaattccaacatgacaataaatatctaagcaaagtcccaataataattaagccacccatcatgatcacagttaagttcagttttcagacttgagttctcgaactagcaattagattagttaatgaacttgcagggttctttctcaaattaatcctaactgtcaactcacggtctgaatttaatccacaatctctcagaaatggagaatatacactagaagttccgcattggagtaacagctttggggatttcacctcttgaagcaagcgagtagctcgtcgacctcggcggcgtcgacgtccgcgagcacctcgccgggctcgtcctccccctcatcctcctggttccccttgggcctctccccggtcagcggcgcggagcccgtgcggtcgagcagctgcgacggtgggggcgggcggtagaggaagaggtcgtagaggaacctcccctgcggcgtcagcagcgccgcgtacgccggcggcggcgcccgcgcgggcgcgttgggcgtgggcgcgtacctctgctgcgacgacgacgagaggaggaggtcgttggtgaggagcgagcggaggaagcggcccgcctctggccccgcgaagcggaccaccgcgcgggaggcgaggcggcaggccagcacccccggctcgcctccggcggcggcgggtgagctcgcgtgcagcaggcggcgggcgagcggcgtcatggccgccgggattgcgcgttttttgcggggttttggttggtttttttggggggcgaaatcatggggggggggggggggggggg

SEQ ID NO: 62926 - DNA, 13776 bp, Oryza sativa
tggggggggttttgcgtttttgcgggtggatggatgagcgctcggcggcggacggctttgatgatgttggtggcggtggaagcgacgggtgtacgcgtgggggagagacgtggcgggatggctggttgggctcgtggcaggactcaagacgtgttgggtcttgtggattttgtgctcgaagtaggcgatgccgcgagaaggaaagccatgacatgtcatggccggcacggttaagaatagctttggaattctcaagacagggtacagataagcagctagataagcttttggaatgcatctgaaattcactaaaccattttgggaattcactaaactattttgagtagaatatcacggtaaccgtatgattaccgtacagttaccgtaaattttactatggtttcaaaaactgaaaaagttatcgcacatgctgaaaaagttatcgcacatgctaattggctaggctgtgaacactgttgttatatggggttaaattgcgcaagcgcaactgggtttgccgatactggtttcttcaatgatgcacgcctggtttagagactacatcttcagacaaacacgtcaatatgatgcgctgcaatacggggcaggcaccgcgagcatcatcccgtgctgacaatcaactcaaaagtcaaaacacacagcatctgatcacatataggagaaagtattttacatggacccttcggggttccggacaaacacacaagtagagcgaaacgtaggcatttacaagaaccgtgttttcagttttccccatgagcaaaacagcaacgtggtgacagcgtatcatacattcgtgctgctacagatcgaaaggcagcacataccctcgacagcgtttttacagtttccggtacacaatacagattacaccatacagacacacgaggtcgtaggggacactcgggacattcaggaatcaggactattcacctgaacctaattaaattctctggacctgaatcttgctgctttcacaactagcagtttactgattcgatccgtagatgtataagagaaatcctttaggagattggtatgacacgtgatttcggtcgttccccgttccgtctttgatcacggccttgctctcttccaggaagagcccaaccccaagcggattgcctgccacgtccactggtgccacggttacctgtggtgcattcacaaccatgcattagtcgatcagaaaaaaaatgcagacaatgtcaaacgagcataatcatacagatttatttttgaggcaaaagcataatcatacagataggagactacttttgttggatagggaaaaacagcgacaaatgataaaatgtcagcaccacactaagattcaaatagaagagatttcagtttatcagcaagctggtctctagaaaaggttatcgacaagcttaagctggcatcatgttccatcaaactaaccttttgatgttattagctgctaaccacctagaataagcgaaaaagtaaaggttatgttcgcttgtgttcaggaaacccattcatatctatccagtcagaccaggttcgaatactcatcaatgcagaagagcagcaaaagaaacaacactttatcctctcatctggcatcacgaatttcatttaaccttctcaatcatctgaagagttagtatcaaactcagcaaatgttttagtcaacatgttttcatttgtcaagcttcaaatttctattagcaatttcaccaaattggtgaatatgctacttgctgaacactgcgcacaagtcagacgctaaagtttaaggctagattgaacaaacagttattaattcatgctggagatcttcccacaaaaagaggggaaaaacttgagcgctgagaagatcccgtgcaacaatggcagtaacaggtcctaacccattttgtaaaaagtgtgcaaagtacaacatgtctctctgtgttcatttgcatgcatcatgttagtatttgattatctgctaaactattagtacccagagacatttgcactacgactacagtttgagcagcgtacatcatttatccactatggcactatctatccacctattagaaatcaagttcaattaaagaggtgttcatatgaggacactcagtctagtttttctccttgacacatttcagcctaccctctcttgtctaatattcttagttatgctttgatttacactatgctgctccaccaatgaatttgcaatcattaggaaagttttatattagctagtcttcagaaaaacaggatgatatcattcttaacctaaagattgaatgtctgagaacaaacagctcattttttatacaagggcaattttgacccaccgtaagcaaagctaaaaaaaataataaaaaaaatcaagttttatcctaaaaagaaaatgtaatcataaaggttattacaaatctaaaccattcgttacctggttcattattattagatgtaccagcattttggttcaagccagccaagtgatgcctagcattccccttccatgattcctcgaacccagctagttcatctgtatcgcgtgcttgtgtgaaaaatatatccaaaatgcaatcacaatgaagcacccaaagctaaaaacaaaccttcatggagattgtgcaatatctgtgtagtgtccacattgccatccgatttcagcttccttgttagtgaatgtccctaaaatttcaagttcaaagaaaattagtgacggacctaaacaaaactataatgaacttagctttagataagaggaaatctttgatactattgtgctggttcaattaatgagattatagtttatacgatatatttcaacatggcaaggtatctaccttgtcatgaattcctcgagagattctatgagtagcctctttagtcgttgtatcagcttccttgctttcttccacagttatctgcagtaaacataattactgtcacttatgtgtaccaaacagtgaggagtacattagtaggtctctaggatatttgcttactccatcacttcctgtccttcgagtttttgaagcagtgtagtaagctccattgacaccaccataagtcacggaagagctctgatatgtgaatgtacgagcttgtggctgcccttcatttgccctgttgaaatccctccgtggctggagttggcccccttgcatctctataaataagaaaataacaaaaacgacataaacataccattgatacagaatcctagataaactataaaacagaactgattcaaacccaactcctaccatcatctggttcttgaacatacggctcacgatttgcttggcgttgcctccctgagttctctccttcctcctcatcaagctcagtaataataagcttcctgccattacctctgggaggagcttgctcaaggaatccatcattccttatgtctccaaatggtcctcccattggcccaaaaaggctaggaccgtgcatcccgcttccaaatggctgattaaagaacggatcatcgaaaggatccctgcctccaaagacaccagagatcaagctcctctggcgaccaaagccaccgaatccggcatacgggtccctcccaccatagaagtcatctcttccatttcgccctctatccattactaagtgattacgtaagctctgcagggttcagcaattacgctacctcgagtagccggtaacatatgatacagaaatcgttcaaaaattaagacaccattcatttcacaaattaatccgttcaaaggtacaggaaaacgatcgtgtgcacatggtcatatgcaatttcatatttcttacagagctcactgtatctccaattcatttcacaaattaatcccaccgaattccaccatatgatagcaccgcaaccgttgtagaaccaagacttcaatttaggccataggagaaaaacaacacatgaatttcccccaattcgcacttgcagaatgctcatctcaccgattccccccacgaaatacagatgctaccaccgaaaatcacctacaggctccaactacttctaggctacaagctctagcactctctcctcacgtcacgaatcaacgatcctaggaacaacagcaaaaaaaagaaatacaccgaacaagctgattaacatgcatgatttcctagtatttcctaaccgcgcaggcatcaatcaaccaaccttacctgaatctcctcgaggccggagcgcacgcaggatgggtggggggggggggaattgcgcgcgcgctggtggagggagacgggtggggatcagccgccgaggacggggaggaggaggatttgtcctggtttggtggtggtggggagcggcctttatccgtggcgttggcagcctgacgtgacgaggagggaggaagacgaagacaaacgaggcctctcgtctcgcctcgactcgccgggatttcccgaacattctggtggtcgaaggcccacgacgcgatgcgaggaagcgtccagaccagacagggctcacactgggcttggcccaacacagcccatcctggtggcggacgtgtccccgcaaattaaacggagttgataaaaactactcccgtccccccgcattgacctagcaaagtttcctttccccaatcaatcgccaatccccctcctcaatctctcctcctattttctcctctcgccgccgtttcgcctggcaaatctgcatgccaagccgcgatgccatgccatggcaaggccaggatgggtctgaatttgtcgtgtcatatccactcgagtcgcgagttggccggacgccgaggagagtagccgcggatctgactgcatgacgcggtcagcgggcctggattcctacgaaaggagccgcctttgatctataatcggtgagtttcttttggtgcatctagttccctatggtcggatttttgatctagtataaactttctgccttttagttatgcgtgtcctttcttgaataggaggaatatgaaggattaaataccttaacaactgccaaggcaccattgttctctacggtgcagaagcgagcctaaagtgccgctcattttggtttataatcggtgagatcttcacattctatgtccttaaggtttctcaacatgggatatttcatatgatgtgattttattatgttgaattaatctgcaaacttgctgctttgttccattttttgtcctcaacattaatccacaagattagagtttgttggtatgtggaaacaatagtaatgctattctcattttggttgctcacgatcctattaagtcggttctccatttttgcgtaatgcttgctattcaaagtgcactgataggaaacaaattgtattttaaattctttcacaaccctactgcgggcttccgtaggaacaattccttcatgtctaacttctagtgtaactctggggtgatggggtgcgactgcccttcaaacttctggtgtaactctggggtaatgtgggtaacttctggtgttatatgatcttcgattgacaacaaactcctgcggaaaaaggcattactcttagcaaacggtcgataggaagtcagtatgaagaaaacaatagagtaccttaccctttttactgtattaatgatcagatgtttctgtcggtgttagcaggtcttcagatgactgtttctgtcggtgttagcaggttttcagatgactacaaactcttgtggaaaaaaacattagtgttagtagctggctggcaagcactaagtagtcattacaaatacaacaatagagtaatagtaatttgcccgtgctaacgctacggtatatttagtatgtttccccaaaacaaaataattcaaaaatagtatgtttttaaatttttgccaaagggagtagtaaatctagatggagcaactaattgcatcttacagatatgcgcaaaaaaaaggtaaattgtgaatatttgcaaatgtatcaattttgtaacatgaattgtctcatttctttcccaaaaggaaagatctaataatttttttacccacaaattgcacacattacatcttgtcaatctcaaattcctatccataaattttacaatcagaacttcacgtttaacgacctacaaatctctgcccatgtctctctgtcccagatccgcgcataacccatcaacacattttcctagaggatgtggatcactcccacaactcatcacccaagaagtgcacctaggtgacacgcatattgttatcctaggattgttgcagcaacatatttgatagtaacatggtaaatttaatgttatgtgcaacctcatttaacagctcaacttttataatattaacaaaaatcaatattttacggtacattacttattgacatgtttactcatttgtaaaataaatttaaaagcattgtacaatacaatcatgcatttcatcattgcacataatattttaatcagaaaattgcaccagaaagcaacgtacatgacaaagcacaaaaagtcatattattcattattggaccatttgctcaggtgatcaacagcatactaattagctagaaacaacaatagagtaacttacttgtctgacataccatttggtgttaatggtcagatgttcatgatggtgttatatgatcttcgaatgacaacaaaatcctgtggaaaaaggcattaactttagcaaacgctcgataggaagtcagtatgaatacaacaatagagtaccttactgtatttaatgttactgggtattaatgatcaaatgtttctgtcggtgttagcatgtcttcagctgactacaaacttttgtggaaaaaagtattagcgttagtcgccggctggtaagtactaagtagtcagtacaaatacaacaatagagtactactccgtccatttcaggttataagacattttgactttggtcaaagtcaaactgtttcaagtttgactaagtttatagacatattaatatttatagtactaaattagtttcataaaatcaataattgaatatattttcataataaatttgtcttgggttgaaaatgttactatttttttctacaaacataatcaaacttaaaacagtttgacttcgaccaaagtcgaaatgtcttataacctgaaacggagggagtagtaatttgcccgtgctaacgctacggtgataattagtatgttccccaaaacaaaataattcaaaaattgtatgtttttaaatttttgccaaagggagcagtaaatctagatggagcaattaattgcaacttacagatatgcgcaaaaaaggtaaattgtgaatatttgcaaatgtaccaatattataacatgaattgtctcatttctttcccaaaaaggaacatctaataatttttttatccacaaattgcatacattacatctggtcaatctcaaatttctatccgtaaattttacaatcagaacttcacatttaacgacctacaaatctctgcccatgtctctctgtcccagatccccgcataacccatcaacacattttctagaggatgtggatcactcccagaactcatcacccaataagtgcacctaggtttcatgcatattgttatcctaggattgttagtgcacctagttttcacgcatattgttatcctaggattgttgcagcaacatagttgataataacacggtaaatttaatgttatatgcaacctcatttaacggctcaacttttataatattaacaaaaatcaatatttaacggtacattacttattgacatgtttactcatttgtaaaataaatttaaaagcattgtacaatacaatcatgcatttcatcattgcacagaatatcttaatcagaaaattgcaccagaaagcaacgtacatgacaaagcacaaaaaggcatattattcattattggactatttgctcaggtgatcaacagcatactaattagctagaaacaacaatagagtaacttatatgtctggcatagcattgggtgttaatggtcagatgttcatgatggtgttatatgatctttgactgacaaaactcctgcggaaaaagaatttaccttagcaaacggtcgataggaagtttactgggtattggatgaacagatgtttctgtcagtgttagcaggtcttcagctgactacaaactcttgtggaaaaaagtattagcgttagtagctggctgttaagtactaagtagtcagtacaaatacaacaatagagtatgtagagtacgttaccatatttggctgttagattgtgttagctatcaggtgttccaattggtgctagcagattagcgactgtttcctctagtgtctttttaacaggggaactgtgcttgtttgggtattttttagcttgaggtttggctttcttcgcttcactgttggctttcttcgcggccttgctagcctccattgcctttttcgcttgtagttgttgtgctcgaaggcgaagcagattcatcctctctaaattctgtttgcggtgttgtttagcatgtgccttttcttgtacagatggtacccaatcgtcgatcccgcactccttgcagtacacgtactttaatccgtctctgttgtcagccatcctgcagttctgcaatatgtcaaattattgttgcatatctgctggcttctcgtctcacaagtctttaatactcattaatattaagaagttgattacaggttgcaaagatattaggtgccagaatgcttaaggctgtgtttagttcacgccaaaattggaagtttggttgaaattggaatgatgtgatggaaaagttggaagtttatgtgtgtagaaaagttttaatgtgatggaaaagttaaaagtttgaagaaaaactttaaaactaaacacggcctaagtaagcagtccagcaatgcggtatgcgaaattattcacccaagtcataatatagaaagtgacagaatgataagcagttcagcaatgcagtatgtcaaattattatgtcatccaagtcattacaaagaggttacagaatgcagagaaagatagtactaggtgacagattgataagatgttggtggcatatgcgcttataagctagggaattcaggaagcgcataatcgataccacacgttgataggtctgtatcaaatcagatacaggcatcgctgcagcctagtttaatggcatgtaggtagattgtttttttttttttttgacagagaggccacggtggaaaacacatgcgacccttaacaaaagaacatctgggatgcgacaattaagctagggtttgacaattttctaacgaagttgtaataatcccaaagcacgggcaaaatcagatctccacgcgacgccgacgcgaccagaccacgctagagaggcggtggcagcagccgtcgtaatcgaagacgagaggaggttgaactggagaatcatggtgcgggtgcgtggatcaggcgagcgtcgaggcggtggagaagtagggcgcttcgtacgcctcgcggagccgggtctccacctcgtcaaccctttggccggcgagtgcgtcgctggcgctctctctacccgcgtccaatccaatccctcgacgtccgtgtcgagaccaagaccaagaccaaaggtttcttcggcgcccgttcccttctcgataacgctgtctttttgttcgttttttttaactagcaaaaatacccgtgcgttgcaacgggtaaaaaaattctaataataatatacgtttttcatgtataatcatgtcaatgacaatgtttctattttaacgagcggcttgtttttttataaacagtgttttttttcttgcgcgattttctcaaaccatttttcagaaaaggcgcatttctttctaatagttttttcctaccatgttttttttgctttttcacttacgaagaaaaccatatttttctcctttttttgcttttcttttctcgtgtgttttttcttgttttctcccacgtttgtttgcttgtttttttcgaaggatcttttttgcttttttcaaatacaggagaatatatgacaaaataaagccacatagtagatggcaaaaaatcgatggatcctatccgactcaagcgtccatcaatttagcttttttctgacagttttttcagaacgattttttttaatagacggtgtttttttcttgcacggttttttaaaacaattttttagaaatggcgtgttttttcgacagttttttccttgcatgttttttttaaaatattttaccgacaatggaaataatttttctcgcgcgtctttttattttttttattgatgatggagaacctttttagcgtgtttttgcgcttttttctgacttttgcctcacacgttattttaaccgtttttattttctcatgcattttctctttttaaatagttagattagagatagagaagagatatatactggttagaaatcagattttgtttcgccctttccattttttctctcttgcattttttattttatacgaaccagctttttattttttacgaaccattttttcaccattttcttaggaaatcgaacgaacttttttagatgtttttttgcctttataggaatcagacttttattctgtttttaaaggattcgaatctagtttttttttgtcaccactttttttttgccttttatatgaatccgatttttttccgtcggatctacagtttttttggccactcaggaaaaaaaacttttgttgttgttgtttttctttattttcttttttgtgcagcttttcttttttccttttatgcacctatctgtctttgttctctttctcttttattattttttttagcaaaaacaacctcaagtagcttgttgcaagattatagggactcaaatgtaaatataaaaaatacagggactcaaatataaaagtacaaatctaaaaattaaaatcatataaaaatggaatgctctctacatgtagattccgtttttgctaacagatcttcaatccggcacattaatttttttcaccaatctgagtcagacttttttttttttgcttttctttttctttttatgcacctttctgcctttgttctctttctcttttattttttttaacaaaaacgacctcaagtagcttgttgcaagattatagggactcaaatgcaaatataaaaattacagggactcaaatataaaagtacaaatccaaaaattaaaatcatataaaaatggaatgctcttgacatgtagagtccgtttttacaaacagatcttcaatccggcagatcaatttttttcaccaatctgagtcagactttttttttggttgatataggagttggacttatttttttttatcggacaaacatggttttttcgccttttttctgtggatcggactctgtccggttttttttggtttttttcgccttttttttctgtatcggactctgtccgcttttttttggtttttttcgcccttttttctggatcggacttctttttccgttctggttttttattggataaacctggtttctacccggtttttttcacccggtttttttgacggacgatggaagcacctcttattttttaagtagtagagatagagattatagggtagcccctatacgtgttactacgctagatcgatccactaggaaggttcaatcccgctggtgagggatttattagttatcttatctggcgatctgctcttccgattctagatcagtaaaggtttctcggacctgacaagatcccatcatactggatgctagctttggtttctggattctctattgttgaagtttttagctgatgctattttggcatgtttccttgtatatggtgcgtaatgcatggccgaatggtcactggcagcgtattgtgcatgacagattgacaggttactgattcctactttaggcccctgcgtgcttgatccatcgtgtaggttcaatcctagccaggttgtttgaaatatttgtgaagtatcggtgctagattgtcttttaagccttgttcgtttaatccctctcgtgagaattgagagggatttgaatgggatttattcttcaatccccaccaattcctctgtcttcgggattaaacgtacaaggtctgtcttcggattaaatgaacaagaacttaagggaagtggtacatctaatgagctttaagtctgttgatgtctccatgacagtaaaagactgttccgtacttattgtatataaaactaaccctgagaaattaggtttacgaaaaagcatcattgactacatgaatgacttatttgagcagtgaatgttggtttttcttttccccattttctgagagattgttttggtaggctgtccatggtagcccaattaatcacgcattgtaactatgtgattgtctagatctagtgcttttcaatgaagtgaaatattattttcattgatggaacttactgtcatttcttgctttttttcgttacttgatggaacttcaatcttcttttcttctgcaggattagtctttgttcagctgatctgcgcaatccaataccgagtcgtgaaggaacatgctgatgatgcattctatgaattgcagaatccccaacagcaaattcaggcctatgcctttgatggtaaactattaacattgagcaattaaatagttgcccatatcaaattattgactcaaagcttaatcactttcccctcgaacttagtggtcctggccctagttccaagaatgaatcttgatgacctttttgagtaaaagaatgatgtggtgaagactgtacttgaggagcttgaaaaggtaactcaagtgcctgtttttactgagtccagctctctaggattaagttgatcggctgattatgcaaactccagtaaggcaaatcattgtttttccttgtttgcatgtattgcattctgccatggtcccagggacgaagctagcatcaaaacaagggggtgcactaccattgaaaatctaaaaaatttcagtacaacactgtacattctagtgtttttaagtgagaaattagaaatttggggggttcatgtgcaccccccaagcatagtgtagcttcggcactgcatggtccatcattccatgtaccgttgtcatcctgtcaggattctaaatctagtcaaacacatttttgtgttagctgaagtattattctctctttttttttctcttgtgcacctatttgcatgttgaaagagttggaatctttgtttggtatacattttaagcatgttatttcgttacccacaattcatactattcttccaagattggtttacatgcttatgtggaattctagtcccagaatactgtttgatggaacttggctgtatcaaaaggaaatctggcattgggctgtctgcatcgcttatctttcgttggaaacttacgtgcttaccaaattttaaactctgtgattgcttcttcctcaagtgttggatattccattcatgataaccaatgctctctctgttcgttctaagttccattcctaatgtgtagttttgtcctcaaacatttttttatcttagtacttgttagtgataagcagtttattatttgtaccgttatatattatatgccatctttgtaaaaaaagactgttctgtagtctatacatcgaacatattcttatggttgatatcatccctgatacttctgtacgcagagcaatgaatgacataaatgcaggtattattccctttcaagtatatatggtacttctttcagtctgtgcaacctgcatgatgtttattagtctatttaatgttgtaatgttttctgaagtaataatctgtcagacttc

SEQ ID NO: 62927 - DNA, 10075 bp, Oryza sativa
  unsure (1)..(10075): unsure at all n locations
gcccacaacatgggtaaggttgtttgtttggggggtgggtgtgtttttgtgtgtgtgtgtgtgtgtgtgtgttttcgtgtttgggggggngggggggggttctggctctgcatagcacattttagaaccattgtcaagtatgtagcctactgcaacttgcataggaccaaagggtgatgtttctgtgtagagaagttagatggcgatgagtcaatgacttgaattagaaatgctctaggtgaaagggaaaggaacagatctagaactacaattggaattaggccaatcaagtacagaccactgaaactgaagacttgaggggctaatctttgctaattaattattcagtcttagaatcatggctaggatcatatataacctaactaattaatctgaactagaaaacaagctgaactaactattcttaggtagctagtttgcttttgccaactctggacgcttgtgcggtttctcctgttgtcctgcatgatgctagactattgatcattgctgattgctcatacagtcgcactggtatattgctgtagtagaccacatatatattataatgtttcatgttcagttacctttcatgttatctccatgtgtgctcataactagttaactcctgtcacagcccaaagtcttcagcttgcaagtgtctacaaaggggaagcagaaaagattcttctggtgaagaaatcagaagcagaggcaaaaatacctttctggtgatggcattgctaaacagaggcaggctgatggcctgagacagtaccacagcaaaagaagtcatggacctaatcatggtcacgcagtactttgacaccataaaagaacttggggatggctcgaagaacacaacggtgttcatacctcaaggcccaggccatgtcaaggatatcagcgagcaaatccggaatggtatgatggaagcgtcaagcaacaatgtgtaaattgtagcgattcacagaacaaggttggggatggttcagatgggaggagcctgttgtttataatgaatatattaccttttgtttatagcctgttgtcaagcaacactagcaccttttgtttgcacacctacctggatgatagaatatgtagttttggaataacaaataatgtttggaaggtataaaaggaacaggatatatattaagttaaggaaactgcatcgatttatacacattaaaagcctgtgcttgattattttgagcatacgcttcttcggtaaagaggaatcaaacgattcaagtggaagtatcaataagattggcaaaatttctctaaacattaaagtatcaataagattggcacctatgtacgtgcaggaatcatccaatacgggcggcaccatgtaccatcagccgattcagcaacgcctttgaaaggatccctcacttcttccgtcctcttcccaagctcatacacgcgcagccgacgatcccccgggttcatccagtagatgctgttgggcagcaacccatggcggcgagccctgcaccacccagctgctcccatgtcgttcctcctgccgccgacgaggatggcgcggtcgccgatgctcccaatcctgacgtgcttccgcttctccaggtccaccctgtacacggccacgtcggcgacgacaccgccaccgctttcgaagatgaacaccaggtggagcttgccgtcgacgtcgacggagaagatggaggccacgaacatgtccgtcgtggtgaacgggctggccggcttcatccgcacggtggtgaacaccggctccggcgagagctcgagcacgccgtacgctgtcgacctgatgaagtggtacaacttgccgccgcacgacgtgatgcagtggatggaccgcttcatccgctgccggccttcgatgtccatcttccgtgtcccgatgtcgtactcgtgcctcacccatgccgccggcgacgacgacgaggagccgacgtggcagaacaatatgaagcagcttcccggcggctcgaccatgaccaccgtgaagccgccgccgccgtcgtcgtcggtgggcttgccggatagcgcgcagaaggagtcggccggcggcggcgtcgtcgtcgtctgcccgaacgacggcaggacgatcctgcggcggccggcggcgtgcgggttccacaggaaggtggcgagagtggtcgggtcccaggtgagcacccagccgtgcgaggtcacccagctccgcttgtcccgcagctcctcgaactcgcagggccggtgcacgccgtcggcgacactgtacagcgtcgtggggcgacgttgctcgccgccatcttcgccgtagtcgaagacgaggcacggcaacgcctccggctgctggcggcttgtcgacgccgccatgttgccaacggcgttttacttacgtacggacacaattcaacgcacggttgactttaaatagattgccgtcttggcggcctatgagagttggtctcggacaccgggccggtttgcatatgcgttacacacacctcaagatgttacccttaatcttaattaattgtaaaattcctattaggattcttgaaaactacccacctggctaatcatcatccgtttcgatctatccatcaagttatttcgtaagcatgtgtcactcaaaattttatagaattaaaacaatgccatcatcgtcatattttccatctccttctccatccgccagtggggcccacacgtcagattccttttttccttctttcttcccaggtagagtagagggaagagagtattggggtgccggtgctccggtggctaggaggaggcaacgcaagcagccgaatgtgttcccgagcttggctcactcgaagaaggtgccggccggtacagggagatggtcagaacggcgggtggaagggcttggccctggtggcaaagaaggtgatggtggtggcaggatggggtggctaaaagagaggggaaactaggggaatatgttctcgtcggcgaggcaaagccgtggtgcgaggggagccgttgagggagatcgaccaatggcaaggtggtggccggacttgaggagcgcgcgtggaaggagctcgtggcaggggcgaagcccagtagaagcccgtgggtgcagatgaacccccccaaaaaatatcttttagttattacctccatatctcggccctatatgcacccccctcagcccaatatagtgcacccacagcccaaacaacagttcagttaacatggtaagcccatgagcaggccagtagggtggaagccagatcgatgttttctcctctcgacttctcgtatcgtgtgccgcgccgccgccagtcttgatgactccgccttgcgtctgtttggcttccacaccgctgctctcaatcagccaatcccagtcagcacttgcccatctcggcatctcgccgtcgccggtcgccctcttctcagttggcgactggctgcacatgcgttgcgcaccgccgcggctagtctcactaatcgtccagccgcaggaaggcaggaagccgacagctaggcaaccaggagctagcgtcacaagccaacaacgacatcagtccatctccaccaactgatcagcacacaaccacactgtgcgttagtagagccaaggtaagaaacatgcttcatctatttctttttcaatcaatttaatttattagatacgaagccctaaaatttttattggttgttaatttttacattgtaggactaggaggccagtaggcttcaatttggggtccttcagaatcggagtaagattgcagattggaggaaaaaattgagaatttgaattgaaggtgcaatttggatgtaagtcatgtcaattttcattctatttctttagttgaatgaatgataaaatctctacacatttacatcttcatgaatcatcttttgctcatgggtcagtagccatttatcaattttattagtggttttcttcattttaaaaaaacaatgtttgccacttctttattttattgatgcatttatgtctttattgttgatgtcaaaaatttatcgatcagcggttgcattgaaaatttagcttgaagttatatatatattgatatacttgtggtacaattatgaaccccctccatttcgctatagcttcgcccctggctcgtggtagccgtcggaggtgttgggggacagcagcgtgtaggggagcctcgccgggcccgtgcaattcctgaggcgcgggtcccggttcatctccgcgatgcgcgccttgatcccgacaaggcggtcgccgaattgccggaatgcctccttcgctgtgtccaaagtccactccggcgtgtcgcgctggccgaggtacacctcgtcgtcggagtgcttggacagtatctcgatcagcgagatgccgcggagcgtgcgccgctggccggcgatggtgcggagctccacgtactcctccgtgtcatcatggtgctgcacgacttgagcagcgccgccacggtggtcatctccggccaccatgcccggtccttggtgtggaccactcgtcctccccagccgtcctcttcaccatgcattgacatgcggccggcacgggatggagcacgagggcacggccgcacgggatggctgtgcgcatgcattgcagagtgagatgcagagagggagacgggagaaaggaagaagatggaaagggaagttatggatggaaaaagtgacgatagtggcacaattctaattttataaaattctagtggcatcgttacgaataaatgaattgtaatggtatttttttaataggtaaatttgcaatggcatggatttaattaacccataatcaaaaggacgtgagtccagcaacactatattccgtacttgggatttgattgatgatcttatgattccacagctaattagggtttaatcgatggcggtttgatgaccttctgattcaatgtttatttgtttcgaaatagagatacaaactgaaggattattttctttttcacaaacatgcaaaagctttgcgtgtttaaggattattttgcttctggtagaaacattgttcagtttgttcattcaatgattcaatcatagatcgaactgatactctgacagaagtaatgtacgctttgactgaagaagtgttatcatcatctacgccttgctctgaccaccaactggcacagccatactactagtcgctttgattttttcttgtaaggtttgttcattcatcttatttaaaaagttaatgtagatataaaaacaaagaagtcatacttacaatattttttgataataaagcaaatcaaaaaaaataataattccataattttttgaataagacgaaagctcaaaagttgaaaaaaaaactcaaaacgataagtattctagaacggaggtattattattattattattattattattattattattattattattattattattattattattatcatcgccgccttcgtcgtcgtcatcatcttcttcttcttaaaatatcccaaagaagttttagatatcgaattaccttacctagtgatatttgacatgtattgtccttatcggttggttgaaccgacaaatgcagaaggtgaagacactaggtccaagtggtcaaggacatctcaattgataagcttcgcatttatttagtttacaacaacagatgaatcaaaattataccttattgggtacaacagaagattacatgtacaatttttttaagatggtgcataatatatttcttatattagtcttcttattggtgaccgacacaagtaatatgtccttatattttctttattattgcccttgtgccgaacagataacagtgatgagctatttaggtcaaaatcgtttttttttgggagaggggaggggggaggagggaatatttgttatcgacgacgacagcaacgccgacacccgggcgccactggccgcgacgacgacgaccttcgcgacgcggcgatggctccctcctctcctcctcgatggcgaccgacgcgctgccggctccctcctcgccgctggctggtctcggggaggggaggggaggggaggggaggggaggcaacgcgcgacgaccgacggcgccgacacaacgatgactgccgcgaggatgacgactgctgtgaccacgatgcgacgacgacgagacgatgcctgtgggggcggcgacggacgaaggaggaggccggcggtggcgatgcgtttttttaatttgctaaaatgctttttacaggcgggtgactctaccgtttgcgaagatgttgccccctgcgaaaatgatttttgcagacgatagcttaccgacggtccttttctccgcctgcgaaaactatttttgccgcctggaaaaatattttttctagtagagtcagctagcgtttgtacggtcttatcttttcgtttatacttatacttatcggccaaaatatgaatttttaaccttaaatttggagttgattttatggtttttggatcgttaagaatacgtatataaaagttttgtttacgaattattttttatttataaatatactgtttagcttattccacgaataaacgaaacgatgggaccgttatttgcaggccgtagcgtagaacaccagcctcatacgcataaagccttccatcatttacgtatgtggtgttgtacaggagggatcatccaaaacgcctgacacgatttacgatcaccagcaattcctttgcagggatcccttatttcttccgttggagcaccaggtggagctcgccgttgacgtcgacggggaagacggagtacaccagcaagtccgccgtcgcgaacaggtgggtcggcctcacccgcacggcggtgaacaccggccgatggtgatccggcgagaactcgagcacgccgtacgacgacccgcccggcttgatgaggtagtacagcttgccgccgcacggcgtgaagctgcagatcgtccgctgccctccgatgtcgtactcgtgcttcgcccacgacgccagcgaggcggcggcgacgccggcgtggcagcatgggcggagctaccatgattcccgggtattcccggaaatacccaacttttttatcgaaaaacaagtatatttctaatatatacatatgtacacatattagtgcacctaaatcctcaattattcgatccaaacatagccctatacacatgtacatatattagtacacctaaatcctcaattcttcgatccaaacacagcccaaccggcctatatgacccatcagacatcagttgatccacttagccaccactcttccagacggccccctctcgctctccctccatgacccatccctccctggctcggctccctcgcgccgctccccatttccaaaccctaggcggcggcgcggcgaggcggcaactggcggcgagaactggaccgcgctaccacggagggggaggctattgccgcggcgggcagcgggtggcgcccgccactccgccaagctcaggcagtcaggccggttgggtggccggcagccgcgaggggtagaagcggccaacggctcaacgcttagacgggaatacccaactttaaaatcctggctccgccactgcgtggcagtaccacagcacgttgctgcccctctcgaccatgaccaccgtgaacccgccggcgccggttggctcgccggttgatatcgcgcagcaggccttgatggccggcggcgcctgcccgaacgacggcagcgcgacgctcgtgacctcgccggcggcggcggcggcttgcgggttccacaggaaggtggcgagggttgccgggtcccaggtcagcacccagctgccatgcgaggtcgcccagctccgcttggtgcggagaagctcgtcgtcgacgtcgcaggggcggtgcacgccgttggcgacgttgtacagcgtcgtcgtgggtcgccctccatcggcgtcgtcgtacgagacgaggaacagagacggcgccgccggccgccggcttgtcgacggcgacatatatggtaggccgagatcactaaacacaattgtcaattgtggcggcggctgatcgacacgatccgattaagaggatcggaggttgatcgtgtcgatcttaagtaggatttcacaccatagtcgatgtcggacaacaaattaaatttgttatcgattcagattcgtgtacttagcagattcagagaggtgacagaacccatgctactctgaatatgtcacgagctggctgattcatctgaggctagtaataaccaccttttgataatttgaaaaaaaactggatttttcaattttctagcatttagtttagtttttttattctagattcttaaaagagagaatcgcttatatgccactgaaaatttgtctgataccttatatgccactgaaaattggctcttctcttatatgtcattagtctaaatttgcgcaccctctcatgccactcccgttagttgactgtgggttgaccattaactcagaaggacaaatacgtcttttttactttagagttaacggtcaacacacagtcaactaatggtagtggcatgaaagagtgcacaaatttggaccaatgaaatatagggaaagagccaaattttagtggcatataaggaatcagaccaattttcaatggcatataagggattctcttattcttaaaatctagataaaaggcttggggttcttccggcggcttacacgcacataaatgatccaaaatgatcctcgtggcagttttcacgaggactttgaaagactcccgcaatttcctcgtgttggtgccttggcggcgatatcacacacgtgcaagcactattgtcatacgggctcaattcgcctccccttcaaacgtaggcacatgtacgtggtactaggactacaaagcccgagtctgatttcctcgtcgccataaaatatataatttgattcatgacgagattattggaatccattaatccatgatcataaatagaaaactttgggcaaaattaaacaatgcgaatggagtggagaaatttttacccccaatggagagtgaggggatgcatctgagttgggtattaggagtggggtgctttcctgtacttggcttagtctttatcgaggtgggcccccctacacggcatgaccgagctgcagggggccctatatggcacgaccccgttgcgttcgaggtggtccagggattatacccgcccgtacagtatacaacggtagcataccatctatacaagaaatacaaatcccaatattctattaaagcaagacagattgaacaatacaacacaaatcttcgtgaatgatccaacggtgatgcctgtaggggatgtccccttagaggacgataacactttcgccaactgcggtaactgttctatatatgttacattggtaagaagaataaataatattgtgggggaaaatatgttgtccacattcagtagatttgacacttctactcacttggtatataatataaattagactatgaaaaaaaggttgtaattaactaattattgtgagtactccagtcattgatgacaacattgtccaaagtttccaactgttcatagcaattttctctatttctttgggaatttttggttcatagcaaatggtgaaacgttaaactccgagtccgagtccgcgaccacgtacacgaacgtaacaagttttgcctacataagacaaaccccgatgcatatgcgtgtccatcgcgaatcatctctcatctgtcgcgcttctgatccgttttgaccgtgtcagatagctgtgtgcgtagcgtgcacatggcgacgtcgacaccgccgccgctgccgtgcctcgtcgtcgacaacggcgaaacggcggcgacgttgtacggcgtctccgacggcgagcaccggccgtgcgaggccgaggagctgcgccgcaaccggtgctgggccacctcgcacggctgggtgctgtgctgcgacccggcgaccctgtccaccttcctgtggaacccgaccggaggcgacgacgacggcggcggcggcggcggcaagatcgcgctgccgccgttcacgcagccgccgccgccgcccaattcccagtgcgcgctgtcacgcgagcccacggac

SEQ ID NO: 62928 - DNA, 4244 bp, Oryza sativa
cacaccgccaccgactacggcgtgctggacttctcgccggcgccggtgttcggcacggtgccgatgagggcggtggacatggcggagaaggtggcggcgggggaggccatggccaaggcgtccgtccacacgctcgagatcggcggcgagctctacatggcgtacatcttcttccacggcgacgacggcagccgcgtcgtcgaagtcggcgtctaccggatggacttccggaggcgcagggcggtgagggtgcgcagcgtcggcgaccgcgccatcatcgccggctccaacatcggcgggtggtgccccgccggcggcgagacggggctgcgacccaactgcgtctactggacgagcccgtacgataaatgcttgcacgtgtgtgatattggcgccaacgccaggaaattgcgagagccttttaaaggactcgcgaagctgccgcatagatcgttttggatcatccctgtgcataagtgaactattccctccgtctaaaaatataaagaattttagacagatgagacattttctaatactatgatacgaatctgaacagatgtctcatcagttcaaaatctcttatattttagaacggaaaaagtatatatgtataattagttttccttttatttcttttattaagataatataatctattccggcctacttgaaataaaccatagcaaattattacaatgatttgtggctcaaatgattgtgaattattaaatttcatagctcggttaaaaaaaaaactatacaaactcgacagatacgatacacattgaacttacatctataactagcctataaagtcgcacattcgcacctctataaccattttccacatcgccataaataactcgatttcacgacgaattatcggaatcgattgatccatgagtgtaatcgtcaccatgtcattgttgtagtgttcataaatatacaaatttgggcaaaacaactgtcgcaactgttctacgttttacatctgaaagaagaataaataatgtgggcaaaatatgttgtctacatacatgttttaagtacatttgacacttcttctcacttggtatatatactagactatgaaaaaatcgtgtaattattgtgagtagtccagtcattgatgacatccaacgtttctaactgttcgtagcaatgggtttctgcaatatgaagcagcatacatgtttgtgttaaaaggcactcgaattattattattattttgaaacaaagatactccaaattgaaccaacagagtggagaaaggaaattataagagtagacatgcagtacgagcaggtaccttaccaaaaggtgacaagtttgtttcatcggttgatttgcaaactaagtgcgaagtttagacgtcattggcaccacctgcagttagcatcttcagcttctgcatttttgaattcaaacaatgagtacaattggtcaaatatcgcctggcaattccacatttaaaactaatgtaacagtataatccaagaaacttctatttgccgcaacaggattgcatgataatggtaaaagaaagaaattcgaatacattattgtgttgtacaggatgggtttaccgaaataaattgtggagggtcatctatgctagaagatcccaggacaatttcgcgcttcagtttcatagtaagcttgtgcaccgtccgcagctgatccatttaagtgtaagaattgatgaccacataaacagaatgggatttgagttattaaatagtttgcagtaaatggcttacttccgatctagtggctccaccaatcatgaagacaaaaattcggttgcctagcctcttgaagtcattagatccatgtctcaagaccgaggagtcactgccaatccagtttgtgatgataagaaagcaggtaaaaggtatgaagctgatataacacttttactagaaaaacttttatatggataagtggttcaaatagaaaattatatttgttgaataccttgattgactatcatcagagtttcgagacttagcccaggttggtgtccgccgcgatctcctggacatgggttgtgcttgtgctggtttagtcgcggctgcactttgtgtagatccttgttcagtggaactgggttcactcatggatgggtattcattcaaaggtaatgcacctttgctcagtttctcaatcaactcctgttagagaatgaatgcaagtccttaatttaaacaacgaataagaaccattattttaagtacgatttgtatataaccactcaacaaaagtattatccaacaggcatcaccaaaaatcattgccactatgtttgttattatccagttcagtttattacgaaccggattttattaacagaatgtgaaccacattcttgaagttcccatatttagaaatttgctatatgttggtttcagaaaaggtgaataatagaatttcataagaaaatattcttaattgtactaagcacacagaaataaattagccaaggagatatttgatgcaggaagtttagaagtaaactagtagtaatagttataccacatgcctctataagtgggaaaaaacgtgataatgcccaggtttcatcgccatcctgccgttctgtcctcgcagcattttttttctggtatataagtcaagcacacatgttagttcaagggaagaaggtagaaataatttagctcaaatcatgacctcaccttttgtgcatcaaatttgagagagaagccgccaggccgtgatgccttttttgtatctgaaccaaccaagtatcttaaactatttatggcatccatctcatcatgtggcagttttgctagctgcataaatgaaagtttgttcaaaatgtcatatgtttatataatcaactgcatgcaattgtaccccccaaaaccaactaatagaaccctctgtgtcacattttctttagtaaacactccgaatagcactatagaagcactcaaggaaaccattgaacaatgataatagtcaacctggtaatctatacttccacgcttataacaagcaaaatccgaaactgtgtttatgtatgattatgtcatgggtaattgggctgagaggctgaggccagtggtcatcccaacaccctctgggtagcacgctactgtagtagttcgttaggtaagattagattgagtccattcttaggggttaagtcgtcccatctatataaggatggattgtatcctatgcaattatgaattaagtgataaatcagattaatccaatctaatccctctcaatgtcctaccaacctaaatctacctctcacccctagcagcagcagccgcttccacgcatctatccacccgacggtgtttatcccgtcatgtcctcgggttgtgacagattaatgtaataattgcactaataagtaatgtaaaacttgataggaaatacctgcatcaacttttcccctttgtcaccttcaaacttctctggatatacaattgcatatataataagcaaccacaatttgttttctgggctcatatcctgaacaatagaaagttcagtaagcattgaataaaaactgacaaataattagcagtaagactgctttcattctctctttcttaacaaacctgctttgacctgaggatactgatcacctccttggctgctgcatctccaaaaactagatcctgctccacctgcccaatgtcacggagaccatactctctgataaacttgttgatttttccagcaatctgaataaaagttcaatagtgagtattacattttttattattttgatgataagatagaagttgtaaaaaaaatcataaatcaaggatgaacatataagtatgtattaaggtgacaacagtcaacatgtttttctaaacaatagctgcttcttttcacatttacttgatagttcctagaaatcccgaacttatttgtaagggtaaacaaaataacataaagcacgcacaggaaatactatggaaataatcatctacctctatatggagggtcaatttctcaacttgttcaccgtattgtggcaaagcttgaacgatcttctgcagatcctttgtagaaatttcaccaccatctctaattgagaaagggaatcataagcatgcaatatgaaagaacttagaacaatgcactttctgtactttggctagcaaacaactgatcgatcaacatttgatgtaaccttgacatcaaactacaaaccacagcttactttgttgagaaaatcccttatata

SEQ ID NO: 62929 - DNA, 3454 bp, Oryza sativa
atgcattatttatcccaaaaaaatatttttagataatgaaataaaaaaaatacgtatttattttttaaaaaaaaggtcataaaaatgaggagcattcatataaagataggtataccaatgttcacaacatttttttttatgaatgctcctgataaaaaaatccattgtcctattaaaatttcaaataaaaattttaattttttacatttattttattttcaaaatttatgtcaaaattttctgcactaattatttagtctcattagttttataaaatgcacacgatgtgcactcaaacaaaattttcaattatttttgaagcttatatttaaacctaaagcatcaagggcaaaaaagacatttgcaaccaaacgtaacagtaaaatgatggaaaatgtaacggtaggggcatggaagggatcaaattgaaatttcaggggtacagaagggatcgggtaaattttaggggtatgaaagggattgagtgagttttcaggggtacacagggaatttactctactttgtttccttcgaattgtaaggattccagtaatacttgtctatcagagttacagttcatatccaaactaaatcagtcgttcaaaaaataatgccatatgccagtaacttagtaaagatgtagatcaaattgtgtttacactgcaacaaattctgttgcagataagtacctagcataatggatatccaagagctgatacaaaacatgactgccatcagtaaactagaacggtaaacgacaccaatggagtagcattgttcaaatggcatattgtattcgactctattaaaacatttacagttgtgttcctctaaaccgaggaagatcatgcaccttgaatgaagttgagctgctttattctttgaaacaaagttattcatcttatcatacaacctctcactagcctgccatttcaattagtgttagaaagcagagaccaaattgtacttaaaacaatcttaaacaacagtacaacacataactcacatcagctatgtgaatgtggcgaagctcaacccagagaggatcatgatcctccaataaagcctcctttctctcaggttctgatcccgctttcgacaccttccaacagaaattaaacataagaatagggcaagtgaacagatcatgttcattattataatacgatatcacatttacctcatatatgtatttttggccatccatttcaagtagatcatggcacattgcatcataggtccattcatgaataacaggtgctatctttgcagacatacggaaattattgtaagcagtaggaaagatactgaatttcttcaatatacttctacactgacaagttattgaaacataagttatccttcagcacctgatctataggcctgtcgacaatgagcagttcacatgtctccttctggggaaattcaggtattgttgatttatattttgacacaatatcccaaacagcagtcgctaaccattttggaaccatgtcaaattttggtgttgtcattggatctgtgccctttggggcacgataccgcacacaaggaaattcctgttataacttgaatcagattgtgtttgacaaaaaagaggaataatgatgctatatatatttcattgatagatttaaagactggaagaatacataagaacgatatgagatactcaaaactgctggtgtccagtagatcattgtatatgtataccttttaaaatatttagttcagaaatattcacaaggggaaggtatagtctgccacaacaacacacagccacaagagattgctaagacaatatcacccacttaagtcagttaccaggctattaatgaagttctgtgaagtgcattaacatgacatattctttgcatttttcaaggaatttaatatgtactttttacggcctggtgattcaaggaaggagatcttcagggttggcacttttggctggagaaatgggaatgaaaaactgacaagcaagaacatatgtcatcaaacattttggaaccatgtcgatcaggaaaaaatacatgctacacatgctgaattggaaagacagttaagaaatatttcggtaatgtgatgaaattagtactagtggacaggaaatagataataataataacaaatgaagtatgttaacatgccttcaacgaagcaaatgtggtagcaatgcgagtagccatagtgcttatagtgtcattgaactttttcgagttgtgctgagcactatataaatcagtgaatgccatgtcatggtcagttgtgaatccctgcagatatgccacatagagaaatcattacattaatcttgagaattcggatttctattttttttaaaaaaaaaagaacagaccaccctaatatcaaatgaaagaaccagccaacagcatgcgaatacatccacagtccatccaacatgtgtagcatggtagcaggcatcatttgctatgttttcaccttcggtaatatcacgaatatttcaaaactggaaatgaattcatttgattgatgcaaatgaaccgttttaattttccttcacggtgcaaatgcagttctaaattgtccaaacttcttatcaatcaatgctagttttatgtttgcgtccagttgcttcttataattgccatatgtttatcatacttgacagtaacaaactaaaatcagaactaaatagattcttagccagcaatgaagaaaaaatatgcataactagtagatcatatagatcgaaggctatgaatacctgcatgtcaattgcaaagaactccaaattcatctggaattaacaatatcggcattagaaaatccatctgtaaaaatcaaagaaataaaaggtacaaactacaggataattaacctctcttagtgcaccaatacgtggtatcacactgctgtcgttctttatgtaagagaccagctccttaggaatcggtgaactaaagaatatgtatgccctataaaatcaagtgagatattaacatgtgagtcaaaattttgttgcatttgaagcttttgtaattggcattccgggttacaaattgaaaattcggtttgacatacttcctgtacagtggacatctcccagacatgtcagatagaagcattatgacactgcaggttgcgaggctcacatatcagagaagattcaagacaatataacttcaaccgttgattatgcggcgttaattaattaactagcagaaaaatcgtctaaggaaaaaaggttgcaccaaaaggaaatgcagtgttacagctttggcttgagatgcatatatgccttcagtatcatactatagactacacactgactacaacctaaaagaaatatcataatcacaaaatgaatcaaagacgagatcattactccacgcatatggtacttgcgatcaattttgctgctgcagaatcataaaacgaaagcaagtggtcaatggcgatcgaataa

SEQ ID NO: 62930 - DNA, 15947 bp, Oryza sativa
  unsure (1)..(15947): unsure at all n locations
ttaggaaaaaaaatatgaattaacagaaatgtgaatagatggagccaaaaaagaaagggtaaaaggaatgcatttcttttgtactaccttccatgagctattggtctccttatctttgtccggatgcagcaagtccttgagtatacctgtgagaagagcagcaagcgatcgattcgcgcggcatcagcgatcagatgatacagacatagatagacacgaggatcagagaagaggtggggggtgggaggagcgagcttacgatcccggcagatgttgcggaagatcttggggtcgtcgcacggggcgccgaagtccgaccccgacatcgacatccctcccccacgcgtagttgatcccctctacctccactcctctcctccntntcnntntnnccccccccccccccccccccccggtttcctctcacccgatttagctggaatgcacctttgtggaggagggagacggagcgtggggggcctctccgcaggaggaaccggggggccgcgattcccgcggggatcgaagagagggcacgaccgcacgacgccatgggagcacgcggcctgcgctgccgctgccatggtggcggtggcgcagagagagagagagagagagttgctgcttcgtcgcatgcacgtcccgccgctcgcggctgccgttgcacttgcagctataattcgtgacatcacgtcgcactcgtcagttttagttttctttttttttagccaattatcctactactaaaattttgatagtttaggatttaacttagtgcggacaaaaaattgatagcaaaccaaagtaccaaacattcctttgatgctactgttaaagctaaaaaaatggtactactttatccttaaaaaaaagcaaatcctagctacaaacctcaatacacatatataactaggtttgagttttttatagaacagagcagataataggtcgtatagcggattaagttatggagacgacttcttgtgagctagagctacaggatttaagaacccaaatgccacaactttactgcagaatgacgcaaaggattcccggtgtctaaccatcagcatttcagtaactcaccagttttttgcagttgagatattgccatgcataaatcggtgcaacttttaactcacaaaaggaagacatgtgattttcttttacataaaattcagacaatattattatgccaaaactcgaactctatctaccactgcatacaactccagggcgcgcgtgcaaacaacacatgctactagcattcattcgtactattcactataaacaggacctcccatctgaaccacccccaaccttggttccgcattcgataccgatttacacgttgctgcaggacgcttccatcataccattccggatttgctcgctgatatccctgacatggcctgggccatgaggtatgaacaccgtggtgttcttcgagccatccccaagttctttgatggtgtcgaagtactgcgtgaccatgatgagatccatgacttcttttgctgaggtgcctgaaaccgagtgcgagaagttcaggatgttctctctcaggccatcagttatcgcctgccgctgtctagcaatgccgacaccggaaaggtgttttgcctctgcctctgcttctgctttcttcaccagaagaatcttctccgcctctcctttgtagacacttgcaagctgaagcctttgtgctgttataagaatttaatagttgagtgagcacacatgcacaaaacagaaattgtcttaacatcagacgttgctataattgtggtgtggtttgtacaatatgtaactatgagcaatgaaccaggacagagtcagtacaagacagttggcataatttaagttcagattgagatagataggttgcaagacctaaaatagagggtagactcattcgtaggttgaattaagcaagcatgaataaactaatcctattcctttcaatattgcaatggtctttccctgatcatatattttacatatgtttcttccccaacctattccctgctttcactgttttaactcaagtcatcgtcattcaactttcttccaacattacaagaaacagaaaatgaagcatgagtagaaaagataacataaaagcattagataactataagaactgtgataggttttgacttcgagaaaacattgcggcatccaataaaccgagaaaaggtcctccggactgtacactatgaaagaagtacgacatatagggcaccatacctgcatttatttcattcattgctctgcgtacagcagcatcagggatgatgtcaaccatgagaatgtgctcaatgctgtaaccataatctcccatcacctggaagcatctaggatttatcaaattgcaagacgacagaaactacagtacgagaagaccatcgaagaaaaagatgaacagaccatggacattgtgattcttttggggggaagagaaactatatagtatacaagaaattgcttatcactgacaataagaggcaacagaattttcatgacaaaactagactttagcaatgaaacttggataaacaatgatagcattggataaccagaaacaattttatttttatcatatttattaccaatcacctgtggaagaaagaaacacgggtgtccaaaagttagtaaacactttagtttcctgagcagaactcattgcagcatacaacacaatatcaaagttctttgtgatgcaagttgtacaaacaacaacgttccaccaagtagtatcctggaactatcccttgtcccaataaataagtatgttaaaacttaaaaccaatactttttttaaaaaaaaatgaactgacagaaaccaaacggcatgtttagaatgaaccaaagaaaattcccaactctcgaaacatgcaaaaggaacaaaggggaaaaataacaaaaagaatactgcaacaaccacaaaacagatgggtgacggcagttagaatcctggcagaattgtttaaacacatgaagtgtttaccatgaaacaatagaagcaagcaatacatgtagaaacctaaaatattgattagatgtatactggaattttcacaactaaaagatcaagttaattggcatacggttaccttttctagctcctgaagtacagctttcgccacatcattcttttgctcaaaaagatcatcaagattcattctcggaactatagctcggaccactgatttcaaggaaaaagtggttagatttttgagtcagtaatttgctatgagcaacagctgaattgttcaatattaataattttaccatcaaagacgtaggcctgaatttgctgttggggattctgcaactcatagaatgcatcatcagcatgttccttaacaacccgatattggattgtgcagataagctgaacaaagacattatcctgcaggggaaaagcacatcatccaatgtttcatcaagcaaagaaacaaccaagtgctagcattaagtaaaattgtcattccatagcaaatatttcatttcatttgtaagcgctatatagcaagagcatcacaaggatataacatgttattaattgcgtttccattgctgtcctggcaaagcatctcccaataaaaggaaaaaggaaaaatctgcatatcactgatcctcaaataatgttgctcgacaacttcatctcatgaaccaactaaatttacagagtaacagtaattcccttggttcacttagcatgacatcgttaagcatcacccagcagacacaatgaaatatgcccaattagcattgactaattactttttttccaccatcacgcacacccatcacaagcataccagctctgttactcccatcagtaattaggacaaaatggaccctgtctggttcaacaattagatactaatctggcgcaccgagagaactgatcgaatacatactttgaaccaaatccccaatcagtgggctcaggtggagaattacgaataattccatggtctgcctagtattgaaccttaacattggataatggccatgggggctacactagaaatccaaaacaaacagaagaaactcgcgaggtagcgtgaccgagaagggaaaccttggtcttggtctcgacgcggacgtcgagcgactggacgcgggtggagagcgtcccggcgacgaactcgccggcgaacgggttgaagaagtggaggcccggctcggcgaggcggaggaagcggccccacttctccaccaccgcgacgctcgcctggtccacgcacccgcacagcaggaagaaggcgctcaccatggctctcacctcaacctcaacctctcctcgtcggcctcgatcgcggcggcggatttggattttggacgcgacgggtggggaattcggcggcggatttggacgcccctcttcttcgtgttctttttgcccttttgacgaggaaacgaacacgatgatgacgtgtcagtgtccgcgtggacttttaggaaaggtaagcggtttagtgatgtttcacggtgaaaaggggccttatgaggcccattgtagaattttctcgaggggatcacggcccgttttaattttccagcattgggccggtatccgggaggatcgaatgtttcggcctaatacagaaacactgtagctatgtgctcatatcctatatatacttatatagtttaaaaagtcatgaaaaatatcaacggtgaacaatcacccctaaggccccaaaccttgttccacaaacggtagcgccgcttgtggcggagctcctcgacctaatattttaatcgccaagaattgatcacgtctagggccaagcagggctgagttaatgtgttcttaacaaaactctttatatcttcaactttttacaatattttgaataagattttaataggaatttggtcctaagcctagggcccaagccctaattgtcccacccttgtctccgcccctgtctaataccattagttttactatattgaatttatgcagtgatgagaagaatacccatatcaataggcattgagagaggaggaaatggatatttgatatatgtttcacatggtttctcttttctattgaatcagaaaatgaatgctctaatgggtgcggtctttagcagcaaaattctatattttgagaatgtattttcctaaaagttacttcatgtggtgtcttatagctaaaatcgtaaagtccaaatatcctataataaaaattgtcttttcagaatgaaccatttttttaaaaaaaaaacaaagaatgaaccatcttgctataagctactattttaattctaagattcacaaacgtaacatggagcatgcatgagggtgctacatttaaggaaaaagtaaaatactatgatttccttcaaaggagtaaattaaagtgttgcatgttgcttgttgtcagtacaagatcaggcaaaaacagttgttgcagtctgaatatttcagccaggcaacatggctgaaatagcttcattttcatatcaaaagtttaccgactgccttgctgtaagattcttggattgagtgtgatggtatgccatatttggttgcaggtaaaaccacatttttaaagaggggtcttattggagaacttgagaagaaatactgaaatgttatgcaaattgtcatttcagctttcagcaaccattagcgtggatgttcatccattccactaaatttaccaccaattgtgataagatgcgcttctactgctggggcactggtggacaagttcgatggtgataagtttaacttgtgttacatgaatgtatacgatagcacatttgcctaacacatctagtagaaaaatgcaaggttccagcttcaaccagcttccacaccagcttcctcctcagttttccacacaattcgtgttgcaaatttagggatgggtctcttgaatccgcctggcttatctaggccctaaaaaataaaaacaaggagcactcaatcaacaatgaaccgagcaacatgtgtacaggtggaagtagatcttgttgtgttattaccttgtacatacgtcttagcatatcttcctcatccttgacctgtaaaagagaagatcaggctattaactgttgagtacttagagcaatacaacaatgatagatgcttgtcagaaataaattgtcatacactgagttcctcatcattattgcgcgcataggaattgaccccaaaaggtaaatatccatccaaatgaccaccactgtatgcatcattgttagggtgcttcatgccaacataaccattattcctacagccatagcaatgaccttcaaaaatggggatatttgtcagttttaacagccaaagtaactgggcagatggttaccatgctgataagtgatcaatggtaaataaggcatgtcttcagtacaaggataatgaatcacatcctatagaaattttcaattatatcgaaaagaaacagtactccctattagtgtgagctagacagactatttcaaacgtgaacactgaggtagtgttttgatacaagttgctgaaggggcacatgcactacagcatatatcctaagccaaaaggcatgcacaacttaccaatttgctgttacatacaattttttaagcagaaagttatataggataagaaatttgaactaaaattgtgcagaagatatattaccgttagcactaggtttaattatgcagcaacagctgaccacccattcatattctccttgcatatgtgatatttcagcaaagaataggttctccacaccacacccatcagctcttttcaccttcgcagtgaaattcaaatggtggtactgcctttgatcctcataaattactccatgttgcaaaaaatccttaagttcatacgcaaaatcctaaaacaaaacgcatggatcagataaacaaatgttaaaatagtaagacataagatatagataatatatatttgtgtgtgtggagagagaaagaacatacccccaaaagattatgatcctcattatacttctccactaaagcttggatcaaatggcacttgtctttttcaaaatacccagctgacttgcaacgtttccgcttgccgtcaggccagtacatcgcttgccgtatcatcttctccattagagggagcctatcaagctcctcacccctaattagatcaatgaagatcatgtatgattagtatgctgtactttctcaaagttgtcgatacaatgtgctataaagttgtttgcacatgttaccaagtctggtgttcctcaattagttcacgtagaaagataaatttaacacagcacatgataaaacaatggagagtgatagttgtttccatgcctagattatatactctcaaagcatcattaaatttcagatttctaactcacttggaacatgggacactgttttgagcaattaattagactaacatgcagcaattcagaatataacatcagaaattatggaagcccggtatttttgtaaacgagaactagtcatcttttctataactagggtctgggtcatccattatattctgatttttttctcaaatactattatattctgattcaagctctcaaaagttttttgttgtcaaatcaattcaactgattttgaagtgtatatgtgtgtcctaattattactatgatcctaaatcaacctgaagctccatgagatgaaacatgcaccgaaatataaaaggcagttactgtctgccctaaataaatacatccaagtatccaaccacaagagtttgcaacaaataaacagataacaagataaaacaaagttaagaagcctcacatttctggaatccgcaggtcatgaagatgttggtttatagcatcatcaacttctgacagactctgatatggcccacaacccacatcgggatacatgtggaaacaccccccaggatccatcctgatgtagaatacaaaataccaaccacgaggtctcctgaccaaaatggatgacccaggagatgaccacaggcagcactgtgatggcgtcgaagtttcagtgtcgtcatgctgcacagtaagtggagaggaagaggaagaggtgtgtgcagttatcggttctttcgatgctgtattactgagcaaccccacagagaaggaaacatctggttctcgcagcacttgtgcagacgaaggctcagcagaatttaccaacctgtagcaaacaagctcaatgagtaagagaaataattttattctggaaggatctcaatcaaaacatatttattcattctaaataaatattgcagaaggatcattttgcagtggccaagttagcaggggtcaaaaactatatagactttaccaatttgttacattaatccctagaaatcacatatgaatacaccggttatgtttgtgctagcaaacagcgcttttcccccctgtcctgcctctccactcccaagaatctagtgtcacaaactgctacttccactaatccatcgcaagtcttacagaagacgtatactgtctatcagtcttataaaatacactgttctatcctcccgaacgacactaagggtgtgtttgaggggaaggggattgaggagattggaaagatacgcaaaacgaggtgagccattagctcatgattaattaagtattaactattttaaatttcaaaaatggattaatatggttttttaaagcaactttcctatagaaattttttgcaaaaaacgcaccgtttagtagtttgaaaagcgtgcgcgcggaaaacgagactcaatctccccaaacaccctggaacgaacggtgcctaaggctgtgtttgagaaaggggagatagagaagattgggaagatacgcaaaacgaggtgcatgattaatcaagtattaattattttaaatttcaaaaatagactaatatgattttttaaagcaactttcttatagaattttttttgcaaaaaacgcaccgtttaatagtttggaagcgtgcacgcggaaaacgatgtgcaatctatctccaatctcccagaacgaacgctgcctaaatcacacatagaaaatcgaagtacttaaatcacaaatagcgtcgagagataacaatacgtggagactagcagtaaaatcaatacacgcatagcaaaagcgaactaaatcgcgggaaaaggaaggagcgagagagagagaggagaggggatgcacatacggtgggcgcggcggcggcgaggctcgacggaagttccgcccgtagcgaaggaggtcaagggcacctgctgtggttgaggacgactccggaagcagccgggcagccggcgacggcggccgccggacggccagcggccaccgccgccgggcgctcctgcgcccgcggtggattggcaccgcttgttggcagagcatcgggttctgcgtcgccggggaatcggaggaattcgattggaggttcggaatttgggttcgatgtgggatcttgcgatttttagggctaaaatcctccaatccggttgggagcggaattgaggttggggaggacctccatgctttatatctctccctacaatgcgattgctagttgcgaccaattcgaatctcaaagcacgtcggtttgtcttcccgactccggaacggaacgaacccgcttgacttgtctcgcgattatggccttgtttaggggtcggcttcgtgaaagcttgacaaagaacaggctcggcttggtttggcttggcttgattaatgaaacgaggtaaaatagccgctcggttcggctcgtttcgaagctcgagctagcttggtttagatacaagcagcgagacgatggatggcgtcgacgccataggggagggacgcggtggaccggcggcactgggacggagccggcaggccggcgatgccgtagatgagggaggtggtggaccggcggcgctggccgctggggatggaagcggcaccgtaggggagcaaggccgcggcgtagccacgcaggggacggagatggtggcctgacggcgcagggatggaggcgacgccgtaggggagggaggcggcggaccggcggtgtagcggagggaagaggtaccgcaggggaggaaggagatgacgcagtgcagcgcctcgacgtcctccctcctcagtttctcatgcggtcgcggcacgacttcacgttgaaggaggcgagcggactcgttgaaaggcgtcggtggcggactcgcgtggtgggaaggggagaagatagcacctacgagtggggtgggtgggagattaggaaaataatagttagggactaaggctgagtttgagtgggaggagattgagaagattgggaagatacgcaaaacgaggtgagctattagagtatgattagttgagtattaattattttaaatttcaaaaatggattaatatgatttttaaagcaactttcgtatagaaactttttgcaaaaaacacaccgtttagtagttcgggaaacgtgagcgcgggaaacgagacaaactcactcacaatctcctcctgccgaacgctcccttagtgttttttatgggccttgggccacaccagcgacaataatgggccaggccatttttatgcaaaagcttgacaagttgaacgagccagcttgggctcggctcgatttagaaacgagctgcgcatacggcttgagctcggctcgtttaggtttcaagctgagccgagctttgcgagctcgagctaaacccgagcctgctcacgagtccaagcattttgtccacccctaccgaccgcacgatcacgatccaacagatttcatggactcaacgcgggctaggagaattattctccaaaccctcctgccccagcatcaccgcactctttctaaccgcatgacttttgaccgcgcattctcgatcgaacggttcctgttaaccaaactggggtttggggaataattctccgaacccctggcgcctccaatccttgggactatctgctcggcgcttggcatccatgaactcacgtgaggttcatgagttcatcgtgaagcccgcgattcattttgttctttgcagcggacgtttggcctttgattcaaattaacactgaataattcggtgttcaaacgacaattgtacgtacaaggagattagtggagaattatattgtgagtcatttggatgtgtgtgctctcctgcaggcttgcgtcttctgctttgcatgcccggcatcaagcaattgttctcaattcaggttggcatcgatcagaggtggcgaaagcgaacaactagttttgtggctttgtgccgatgggttgcagtaagaattttgcacctcaacgtcacattgaaattggataaagtgtactacatgtatacagccaccgccccaaattgagtgcctcagtttccatgatcacacacacgagacattcttagctagagttgacaattgacaatagggcctagtgacttgagaccccatgggttaaaaaacctatcaacaaagtaaaatacaatccaatacttatacacatcggtctactaatagacataaaccctacacatcggatgatcacccgcacaccgtttaactcgttggtaaaattacctgcaagcctagctctgaacaatgagtggcctaacaaactaaaccgtaggtataaaatccatgtgattttgaaaacgttttttcagttgatccttttattagtgaaagttgggggttatcctttcacgtcttttttttaaatttctttctttttttactttgagacttgttggttgtgtgcccatagacaaaggctgaaggcgtcgtccatttctattatctaaaaagacacgggcggaggtagagtatgggaggagggtgcccataaactcggtcaagaaatttttttatttataacttatcgatttttaccatgtgtacacctctcccaatacaaactgaaaagcacgcatcaacttaaacttgatctaaagtagagtaaattaaacaagagacaccctcttctatttcgttctagctccgcctaaaaaaggtataaaattgtctaccccgcaatccttacattttgcgcccccccactttaacacttcgcacatgcacgcagtgagagcaacaacgtgcaatgtttgtgtgttttaaaaaaaaaaggtagcgagccagaaatcacaatagcactgcgctgtcgtgcatgatgtggcccacacgcatagtgcgacagcaacttactgtaattgtgaatcagggcaagacgtgggttgtcatgttgtcgtctcactgacacgcgcgaggcgaccgcatctcccttcccgccatctcatcgtcgtcccgcaggaggatgtcaagaaatgaaagaatgaattagtgttggctttctactaagtagatattggaaaaataaaggttttctaatatgttgaattatttttttactaagtgaaaagatgtaatctttgatgcatgggacgtacatttatttcatagttatgagtcataagctcgtagctctttgagttgaccataactacaatcaaatgtttatcggggtcttagaaaacaagcatattatagccaaatcaataaaagaaaagaagtgcaatagaaagagacctttaaacacgttgaatagtatcaacatagattaaaatatataaaaatattaggatcccttatttttaaggcactttttgtcgtgaaccctcatcaatattcttctgcttttcgatatactactttgatcaaatataattattattgtaccatatttaagttatcgtagggtgtacatattttcgatatatttcatagatgttaagacaaaagtaatccgatcgagaagtgagagtagtccatgtgtgccttggcggctcgatgaggcacaagatgcgaatgctcccgaccgtccccgtcgcgtcgcgcgacgagagccgcccgttcggcgcggccgcaactggttcaggcgttttccgccgccccgcctggattccgacttgctctagcctgactgacgtctgcacaagcgcccacgtgttgcctcccgctgttccctctgcatatgcggcgcaggcgcgcggcgcatccgtgccacgtctgcgcacagccacacatcagagcaagtttaatagtatagccaactactagctccaattcatctatagtcaatctaatagctcattcatacaatagttacatattacactattaatacctggtcccacatgtcatacacacgctgcgtcttagagtccgtgctacagctggctacaaatctgtaacccgctgcccttctctctcctcatttatctccttaaaatatgttttcagctggcttatagcctgctattgtacctgctctcaatggtcaatctctcttcttcctctctcctctcctccttctactgctactgctactgttaatctgtgatgacctgaactacgtacaactgggttaatctcaatcaaaatatatactccctctaaaggttgcaaagcgttttaactttagttaaaattaaactgttttatatttaactaaatttatagataaatatagtaatatttataatactaaattagttccatcaaatcaataattaaatatattttcataataaatttgtcttgagttaaaaatattattttctttaattaaatttaaaacaatttgagtttgatcaaagttgaaacggaggagggagtagtttgcactaatttgacacgaacacttatttcacacgtggattgtgcgtttatgctttgattttgcagtgatatttgatatatccggaagctatggctgctgtggctgtaaacgtcacgcgtgcctaacaatctgctgctttttacccgccaagtatcttgttcctccacgctatatatcttacccccatatcctcctccccgtctctgtccgtactcaccaccaccaacgctgtgcaccgcacaagcaagcacacgtacgccacagagcacacacagccaaggcgagagagcggccatggcgccgagcgccgtgcaggcgatgtcgtcgagccacggcgccgcggcggcgatggtggcggcggggcagaggcggcggctgacgcggctgctgctgaacgtgacggtggagcagagcctgtggcccgtccacgtcgtgatcggcgcggactgcaccgtggccgacctcgtccgcgccgccgtcgacgcgtacgtgcgcgagggccgccgcccgccgctcccttccgccggcggcggcggcgacgcggcggccgggttcgagctgcatttctccaagtactcgctcgaaagtgcgtctttctattgccttttctcttatttttcaagctccattttcgtattgtcatcgtgacagagtggtttcttcagagcacgaggccatggagtcggcttgaaaatttcgattcattcatggattaagcttgagaatttcgatttgttctgacctgttggagcaaattcatcgcggactgattcgattcttggcaggtctaaggccggaggagaagctggtggatctgggctctcgtaacttcttcctttgcgcacggagaacacctgctgcttaattttcaatctgctttcgtttttgttaagcatctgctttctgctctgctgcttaggacttgtttagttccaaattttttttttgtcaaacttccaattttccatcacatcgaacattttatacacacgcaacttttctatcacatcgtatcaatttcaaccaagcttctaaattttaaaatttcagtgtgaactaaacacgaccttaattgattcaagcgagcagagcatgcaactgatcacctgctcgtcacgagctgctgcatcacgagctcgtgatcatacgtgttgtgcttgacatgccgtcggctagctcatcgcgacgtcgcctctactgttcatctttgatggatcttcagagccgtggagagactgaacttgtacttttttttttccttttctcttcttttctgaagatcatgtttgtactgctagctgttggagtgcaggaaaaacataataataccctgtttagatgggactaaaacttttaagtccctatcacatcggatgtttaaacactaattataaatattaaacgtagactattaataaaacacatatataatcttggactaattcgcgagacgaatctattgagcctaattaatccatgattagcctatgtgatgctacagtaaacattccctaattatagattaattaggcttaaaaaatttgtctcacaaattagctttcaattatgtaattagttttgtaagtattctatattaatctctaaattagtctctaaatacagagactaaagttaagtccctggattcacacaccacctaagttgcggtagaactaggcaacatgcactgtctctctcttgattccccagaacgatcgaggctgaaactgaaactgttcgccttttttttttacgactcacaccagacgtgcaatgttcatattaatagaataggaaaaaaaataaaattataactgtgggaggccgtaatcaggaaaaaaaaaaccacccaagtaccgacagcatcaatacatatacccgggagaagactagtaccgaatcagttgccgctaagcatgaccagccgccgctaggccatcatggaactacaaccgagatcgtctaaaacttaaccctaacaaccgacactaaacaccaccactctatccacctctctttgggattgagagagagaaagagggggtgagagaagatgtaaccgctctcccctaagtcccacatggccaacttagtaagttacatatgttcacctcgtacgtacgcactggctgcgtttttgtgcttcctcgtgttgctgaaactaaaactgaaacaacacctcgtgctaaatacattccaaaattattgaaaggcctcactctttaagatatatgctcgtaatacatgtatccaattttaaaagtgacatttcaaagcaacggtcttatttgaattaaagcccgagc

SEQ ID NO: 62931 - DNA, 18197 bp, Oryza sativa
  unsure (1)..(18197): unsure at all n locations
cccgtacgtacgtaccagcgcaaatataatctgtcgcgtacgtacgctagatcgatcgatcgatcgtgccaaccaccacaaactctctaaaccaaactcgaatccatccacgcgaattcacgtacgtacgtaacgcgccaccgcgaaaccatatggcgtcgtggccggaggaggaggaggagatgtacatgatcgtcctcggccacggcgacgtcctccacggcggcggcggcggcgagacgaagcggatgtgggcgacatcgcaggacggctgggtgatcacctacgacgcggagaccctcgccaccgccctgtgcaggtgcagcagcaacggcggcggcggcggcgccgggcggcgcaagatggtcgtcgtcctgccgtcgttcgggcggacgccgccggcggacggttcgagctgcacgctctccggcgatcccaccgacggcggcgggttcacggtggtcatcatcgagccgccggagggctccgcgctgtggtactgccacgtcggctcctcatcggcggcgccggcgaagtgggacaaggtcgagtacgacgtggagaccctgttgagttagtctaagcttttttaagaacggatatatcattgcattgatgattgagtgattgatccagctttatatgaaagcaaagaaacataatactgtaatagtctgtttaaaaagatcgtccatcgtacatatcagacgcgttttggacgatcccatgtactacatcaagtaactagtttttgatgcattatgtcattttttggtttagtgcgagatcattgttattcttggatgtatatagtccgctagtacgattcatagcatccgtggcaggcaacagttggctagctatcaacgaaacttctgcacggacccaacacatatcttcctcgtcttgcttctatctgaaagaagctgtgtcgtaggagtaggctttgcttcttgcgctgccgcacgcacgtggaagtggaacacgggagctggtgatacgtgttgtttcatggctttctttgtcgtctctctttgattgattcgatcaggtaggcgccgtacgtagggttctgaacagactgaaaacctgaaactgaactgaattattgtgaccttttcttttcgaagtaactccctcgatccgtctcttaaaatataacaatatagttgttcctgatttgtcaggctcagaggtcagagcagtctacaatataactagtaagctgaagctgctcatgatcatgcaagtgtagtatatacttatcaaacactcgaacaggaatagggtaatggtgccatttactttaattttagctgtgaatggtgtgtttagttcacgttaaaattagatgtttggttaaaatttaatttcagcattcacagggtaatggtgccattcactttaattatattacatttcgtggaggggacgcgatctgtgaatgctgaatgctcaaacagtcttaacatataagagaaacgatgaatgcagaatgcgtgtaaaacgtctgaaactctcaatatagtttcctggaaacaagaacattcagtgaacggcaagaaaaaacaccactccaggcttccagcttatccaattccatttgacagagtcaaccaaacagcccaccttgccactgattggcagattcgatcatactaaggttcatgttacacaaaaaaattatgtattacagctcgcctctatttagttcaggtactagtattgtcaccgttttccaccaaaaacttgctaacattgcttaatgttaggtgctaaaaatctttgccgcatcttgacaaatttaagagaatttttgttacactttgctgagttgttgacaaatcttcacttgatttagcttatcaaccatacgtaaaattagggtaaatcattagcacataaataattaagtattaattattacaaactttaaaaataggtttatttgacttttgaaaataacttgtatatagaaagtatttaaagaaacgtaccgccatttaacattttaaaatgtatgataataatgaaaaatgcgtaagttgtagtttgaagttaaaagaaaagaaatttgcatactccctccgtatcgtaataaagcaatctattactatgaatctggacatgctccctatatagatttatagtattatgatacgttttatttggtattaggttactactccctccgtttcgttttatttgacgtcgttgactttttatcacacgtttgaccgttcgtcttattcaaaaacttttgtaaaatatgtaaaactatacgtatgcataaaagtatatttaacaatgaatcaaatgataggaaaagaattaataattatttaaattttttgaataagacgagcggtcaaacatgtgctaaaaagtcaacggtgtcaaataaaacaaaacggagagagtatattataagatggatggagtacttattagacgtggtaaactgtggctgcaagccaaaagagaccctaagagaatcagagccgtttattttgtgacaagcttctaagagaatctgcatcttgtgggccgcgtccatcgcactggtccactcgcctctcccctcccccctccattccgctccgatttaccgcctcgccggccgccgcagtaggcggcgctacggttatttcggttagggttccggcgaggccaacgcccaccccccacctccacctccacctcccccagagcgagccgccgccgcctgtggagggccagggagagatggttttcgtgtggctcaccgcgttcttcctcgtcgtggcgctcatcgtgctcgtcatctaccaggtgagggagggagggagatagctagctaccccccgcctcctcggtatctccgcccgtctccgggtctgacccgtacgggatttcgtttggatggagagggctgcggatttgtggatcgattgaggagaaattctcgaatgattttggggggttagagcgactcatgattccaaattgctggggtttggtgggtattcttggtcagtcgagaagggctgaggaattcctttgcttttatatgttgcgtgttctagcgcgatactgttcaatgtgcgatcaccgtggtcgatatccctttgttcttgtttgggtgtagtaaattatggtttagtaacttacaattttggttacattattcatccctttggctgtggaatttggtttagagaatcatttcctgatgttttagttctacccttttcttttgttttgcagctgatgtgcttggcagatctggagtttgactatatcaatccattcgattcatcctcccggataaataaagtggttattccagaattcgtattgcaagcagctctaagtgtattattcctcctatcggggcattgggcaatgttcttactttctgccccgatggtgtactataactatacgctgtaagtgctgctgtcttctatccgcctttcagtctttaaaacattttatagtgcaaaatggaccaaatgaaaagtccgggactgctgtcttctttgtcctaagttattattttgccatgactagtataaacagatgaactgaaagttagaaatggtacagtcattcatgtctattatgtgagaaccaaaacaataatttgaaaatggaaatgggtgttcaaggttgagataccttttataaagctgtttaggctgtttgttcagaaaattttagattaaaatggtcagtgaagttcttggtctccttcagaaaacaagttttgtactttacacataatatggtatatgacctacttttgcattgccctgatttctgacttttgatataccttaatactgcacacgtctggatctttattagtgtaacttactagacatccttctaatatcttactgtattttcttatctgcattcaggaagcactaagttctgatatgtgtgtcaggcatgcttgttttggaccatgattttactttatttgataactctgaatttctatgtagcttttttgtgcctcttgttgtactaagttttatagggtaagtggtcttatgatcgataatataggtgtataacttcttatatcttatatttgaacaaatgaagggataatgctggctcctgcatgcagtatctacaagaatgcctgaaaactgaaaagtagttcctacaaacatctgcaaaaccatcatatttcatagtcctatagaaagcacaatctatatacccttcctaactttgtgaatatcttttcttagccaacccttttcctctttgacgaaaaacagcaggagaggcagaggctcctactgtgctatatatattagattagataaaagaaagttatttacaaaaaaaaaaaacaaagaagaagagggaatttacaaagcagatgctatgctaaattcttagacgacctgtatattgatgcttgggaccccatgtactagtatggtgagattattcagtctcgtgctgtttaatgtttgtcccagatgaattaattccttcccacccacccggacccatgttcgttgcatgttttccatgctatggtgttgcttgtggttgatgatgtagtgatgaaatcacgaaatttgactgttattggtgtgttcgtgataaaaaacaacaacatgggactgagagaactagggtggatctaatagcatacagtcagatttaaccatgtcagggagctactgagaaactaaatattgtaattttcctgtaagcatattggtgtagtatgtgacatcatggttaaagattcttgcctgattttaggttggttttgaattgaggtcttagaagttagaatcacttagaaggtaatgggtaaatatggttttagaaggcagcatattgctcaacttttgttgttaactattatttgattatccaggaatgcaaatctttaattccaaccaatcaacatatatgttatcatgttcaatatcggatgtaaacagcatgcgctattaatggaacagatgtgaacatgctggtgtcagagtatcagcactatagcgagatatggctgtatcacaaaagtgcaaatttcaagggcttgaactttgtcagtgtattgtatatttccattagaactgtagtcagatcatcccttgtcacttagttttttccttttgaagaaagaaacatgactgaaacatgagttaaggttcccagaactgtcaccattctatagagctaggtttagcagtttttttcagaaagaaacatgagtgataaacttgagctaaggttccctgaactgtcaccactctataggtctaggttttctgttgatgattttatacttgtctgctacttaaaagaaatcaaaaacagtttgtcgacttgactgggaacatttttatggtctttgcatgctgcaggtaccagcgacgacaacatcttgtagatgtaacagaaatatttaatcatcttggccgggagaagaaacgccgcctttttaagatagttggtctcattattctcctattcttgtccttgttttggtaaacaagcaacaaacaaccatttgatatttactgcaagtcagcaacaaacagagtagattataactaccaattgtttgcatgttttgccttcaggatgatctggactgtattattggaggaggatgagtagaatgaaaaaaaaaacactatggtagctcatattggcgttccaagttccaaccattagttaggtattactacaacattatcctcattgcatgctgaacaccctgttgcagtcctattaatcgataccaaaattgttttcgtcaaatgcaggtcatctggagaagcaagacaagtgaaaaacattgtgccccaaaagtattgttggcttgtggagctgttttttctccgatttatagtgaagctcctattattgtcgcatgtaacatgtaaattaggagctactgggcatcagttctcgtgggggcaaagggattaacttcgtcgttgtgcgtgcgttgtcttgccttgcactgcagaacggccttgattttatgttgattttgtgtggtttgatttttgtttagcaagatcatttcctctaaacttgatgttctcatcttttgttgtcggtctgaaatgcaaacacgaagggaaatgccaggtgctatcagccccagagctgagcatgtgtccaatgctcttatccgaacttgctcctgaaattttgtgtgaacttcgtgctatcccctttccgattgagtgctggatcctgacccttagtggtacgacttctttttttgccaaattttgatcaaatttactgcttcaaatttgtattcttgaaaactaggatctgcttcaaaattcactcgggatctacttccatcccacgtcaaaacctcaaaatttcacagtttttgatcgatttttgtcgaaaacttgaaccctgaagctatctatccactacatcaacagattagccttttcattactaaacggtgatctctcggtgctataaaaccaaaaataatctcactctcagcttggcaacaccaattccatttcacttccaactctgagcttcacagcacaagtcagcacaacgaattcaacttgttgagtggggaaaaaaatactttatgatgaaaaatcaagcgatttgctcttttattgatcttacatattggtgctcaagtgtgtcaacacagtagtaagcaaacaatctggccattaacgaaaaagcgagggtaactaagcaatttctgggactgtcaagaagtactaattttattgcccttgtagactcgtgtaaaaacgcagtagtagattgatggcaccatggtccataggcacaagatcaccgcaaggtgccaaggtttagtacggctccacaggggctctgaatttttctccagcgtaaactgcagcatcgcccagctcttcttctatcctgagcagctgcaaccacaagcaagcaacgacacaaattgtatatatcaccaaaacaatagtgttgtgtggaacctcttcattgaattttctgggaaaaaaagtctaaaataattctctggaaaaaaaaaatgatgctccttccaggacaagcaaacagactcccgctgaaacataatactacctagtgacaagtttgcaaatcgccgttctttgcccagtgttctatcatagattcctgcttaaactatcaagccatgctaaatgaaatgtaatttaattcacacacataatcacttccactatagattacaaaatcacacagcaaaaggagtattttaatggtcttgtcggatgaattactagtagtggctagtgagtaaggctccatgaaaacaagcagagattcaaagtgtatttggctgcaaaggaggtagtaatgactaatttgggtttgaggcaagaggcttacctggttgtatttagccagacgctctgaccgacagggagctcctgtcttaatttgaccctgaaacaaaattgtgggatatgatgttattaccattgaaggtactcagaacaatcaaattcaagtttaaccaaaacccataccgtagacagaccaactgagaggtcagcaatgaaggtatcctctgtctcaccactgaaaagatgacaaaaatagttaaatgaaacaaatcctacaaacaatgaaaacagctgaaagagttacaacttgcaactcttacctcctatggcttgccatcactccccatccagcacgcttggacattctaacagcctcaatgctctcagtaactgagcctatttgattcacctgacagcataaacagatggtataatcaatattgcactacattcaatgtcctagcaaaagaactagcaactctgaacagcatacaataccttcaagagaagagcattgcaagtcttttcactaattgccttggcaaccctctgtaaaaggcaagtattgcattgttaaaacataaacttcgagagaactaactgagattagtagcaattaattaattaactaactgtaacttactgtgggattagtaacaagaaggtcatccccaacaatctgcacttgctgtccaatctcatcagtaagcttggcataggtagcccagtcatcctgatcgaatggatcttcgatcgacacaatagggtactcagaaacaaaggacttgtacacatctttcaggctgtcacctgaaattttgtgtgaaccgtcgttgttctggtcaagaaatttaagacatgttaatacacactgagttttatttcttattgtagtttcatggaacaacacaaagaactatgtgcagataaagatttgacaagaagttgcaggccgatcttacatcctccttgaagttaagatcgtaagtcttgtccttttcactgtaaaattcagaagctgcaacatccattcctatgaccacctgccatataaacgaaatcaatagatattgatgaatcataatgatcacgcaaatacaatcaaagagatgcttgaattatgagctaaattaagagaaaaaagggaattactttgcctgtgtagccagccttagctattgcggccttcaacagttcgaggccctctttgttttcctgcacatgaatatttcagttcatgtatgcaacaaaaatgaaaagtaactgcaaatattgcttcactaagatccaaggggtcgcacaattttggacacatgagactgaccagtgggccccgactaccatcctcgttagatccacgtatccggcccagattaatgttttgtccatagtccatactacttcggctggaacgagattccggtatcgtggtttaggggtataaatcagattcggccaatagttaagggagccaaagtgaacttattcctccggtgtgatggtgcggcccatattagttggacctgaatgggatcagtggtgtttatgcggcccataccactaggcccagaacagggtgcggtcctggctcatattagttgggctggtttgtgtacatccggccgaaattagccgtagacggcccaagtacgtacggtccaactcgctgtactactactctaataaagtattctgaacggaaccaataccaccaccttatttaaaacatttgaaaactcttgtcaaaacttttaaataaagctacttagttttactaatacagatgttgtttagttgatagtatctgaatagtttagctttactcatattctcagaacatcttaagtgacgttaactgcttatgtttacgatcagttctacacttctactacttcataatgagaaacccgtcagatttgcctaaaaaatactgggacattctaagaagttttattgacttgaaagccgtgcagagatttatggaggattacctgaatgttaggagcaaagccaccttcatcccccacatttgtggcatcttggccatactttttcttgattatactctgtataaagaagttcagataacacattctgaagtttcagatacaaaatgaaaaggttgatttttttttttcaccttcaagtggtggtacacctcaactcccatcttcatggcctccttgaaagaggatgcaccagtagggaggatcatgaactcctgtacagcagctaaatgagcagagaatatgactgaatcatgcatcgacatggtcttgttattcaagcaatattttacctgcatggcaagtttgtttccagcatgggatcctccattgatcacattgaaagcgggtacaggcagcacgagagtcttgtttccagcaagatttgcaatgtgctgcaatttcttgatgttttagcataggttctgaagtttcagaagaacaaagttatataccgatgcagttgtttaacagacctggtaaaggggaatcttcttcaccatggctcctgctttgcacacagcaagtgaaacagcaagaatagcatttgctccaagctgtcattgtttttaccacatcaaaggaagtcagcgcaaagagtacagtgtctgatgcaattagatccaaaagcattgttactacacaagtaatggagtaataccttttgtttgcaccagccccagttgttggaggttccatcaagctgttgaaccatgaagttatcaatgtcaacttgctcagtgggatcctgcaacaaaaaacaccattagttaagaaagctatcctttttttttctttgttgtgtgtgtgtgtgtgtgtgtgtatgatatcaataaaatcatgtagtatgggatgcatacctttccgatgagtgctggcccaataatagtgtttacattgctcacagcctgccaaaagaggacattatcaccattagacatggaggacttacttgattggcatacataggtgccatcagttgttagaaaatggtagaaaacacctaacaatcagtttttccaacaaaagttcaatgattttctcgcacttgcaaattgaaaaatgcaggtccaaatagttcctttgaaccaattttgtgacccacacaagagatagacaaacatatgacggttatcttcgtacacgctgccttacttaaacataaattacagagactttggattgttaactgttcagctgaaatatgatctgctcaatcaaaatgcaatataaacgaacaagttatttatagattgtaaaatagtcctaacattcgagggaaagccaataagctaaccttgagtacacctttgccaagatagtcggatcctccatctcttaactccaaggcctcatatattcctacagtcaaagcaggaaacagaaaaatctaatgaattttaagtacacctttgccaaggtaaacgacaaatctaagatcagcgtaaaaaaacacatgaactaagatctttaagaaggaaaccatcagcgcttgaataacgtgctaatattgtcatctctataagtttataacaaactgaagatatttcaactttcttaaaaaaacaaaaactgaagaggtttctcttgtttcagttacggtccacattgcaagtgctttgggcgatgagctaatgaatttcaatacacagccttgacagacagagatgatcgtgttactattactgtttgagtgttttcaaaaatcatcaatcccctgtcccatctaaataactatgcaaacatctctttccacgcacacaccaattcattactgccatgcccaagaattattgggaccaaccattcgatgatatcgaagatacgcgtttcttggaaatcgaagatcaaatggtattaacatataacgaattatcactacaaaaaaaaacacccattgttcttcagaatggaagagccagtgcctcagccatctgcttaccggtggaagcaccgctcggcacggcgcccctcgcgaagctgccatcgctgagtcccacgtccacctgcgcacagcgcaaaccccagatttgaacacaaacagaaaacttctcagcgcttcaaaatcaagaaccggatagatacaaaaacagaaccgaatcgacgcaacaaaatttgaaattccaattccaggggatcgaatgaatgtctcgcgtatacctccaccgtggggttcccgcggctgtcgaagatctgcctcgccttcacggactggatcgtcaccgccatctcgctgccgccgccttatctctctctctcttcttcttcgccgctcgagttcgcgttcgttttgtggcttccacctgaagagtcgaactgagacgagcagcggcggctatttcaagaggagaggaagctaggatggcgtggggccacttggcgcgcggagattttttttctctgtagggcccacatgtcagtgtctcttgatgtacggagtggtagctttgattttcttggaggagggggaagaaatccgatgatttcctggagctcacatcatttgatttcttcccaagctaatctacgagtattaggctgcaaatcattcggcaaattataactattagtatttgtccatgtgtgtgcacgaatttagcaggtacgagaaggaggcgaagtggcatttgatcgtccaaaccaagatgacgattttgacaacgaataatgctgatagaaatttaaaagaaaaatgctagctaggttgttccaatcggcaagagaattctgtccaggaagcaggaacagatcatccagagagcttaagttaattaatctcccctcctttggacaaatgcgcctttgctttgtctagaaatactgcacacctggcactgtttgtttagtaattaagttgctgtatccgtgcttcacgaagcaaacgatatcagagttgaaaaaatatgtgtgagtgtgtgcgtggtatgagcgcttgtgtttttttaccttttcaaataaaaagaaaaaataaaaatttagaaggtattgtaataaactaataatactcgatcgtaccgttccatgcatgtatattgggttgattctcaactcaaaggcaagaatcaaagctgacagatgccaatgaaacaacataacaacttagggtcaaaactttgtcaaaaatgctgctcaggtcaaccgcaattctttcgtcctcggtcacttttattctattgacgtaaccgaggtcattctcatgtgatcgtccatttcaaggttggttcagacaaagttcggacaaaaaaaaatgaaacaaatgcaatactttctgttacatcaacaaacagcaccattataaacgaaaattctttttttgaacgattttgactttgcatttgtaatttcgtttgatctttttttggtaaaaatcaagatgggctttgggccttcgataacctatgccatgtcagttaaagaccaggacaacaacaccacgtaagcatcacgtagcacgaaaacgccatccaaaccgttaagggactcattttgcaatggtttcataagtttttggatctttgaatccgattttgaggttgagggacgtgaacaaaaaaaactcaaaagggacccaatcggacaaactggatggcctgtggcaaccgtgacgggagacttgtttcggcccaatcggctggaaatttcgagaaagagcccaaacaattcacgggccttatcggcccactcgcatcaaaggatagagccacgcttacaatttctcgtaattttgggggttcatctgaataaaacacaaagcagaagaagaattggggagattgcaggggcttggatgtaagatttcctcacactcccctcccctcccctcgcggcatctgctcgacggccggcgaccaccgctcgccgccggcgatggcgtcacgtaagcacctcgctggttcccctccctctctctctctccgtaccacggttggactcactcccctaactctgcctgctcttgctcccggcggcagtcttactcgagcagcaggagaagctgcggcggcacgtcgacgagtggcggttccggtgccgcgcggccgtcgccgagatcgggccccgctccgcgtccacctcggtgtcctccgcctcggtcaggctccgggtggcccccaccgaccccggcgtcggtgtgggcgccgcgtccctcttgaccgccgcggcggcggccgaggacaacgtcgacgtctccaagttcgttgccgtgctctcccactcgtgccttgagatatcccgcctctctgatgctgtaagcgcgctaaagttgatccgtttatctcgaatttaaatgtgacgtgttactcaattttaagcttgtgtaggattacttcttgtcgattatgttccatgatctttgatttttgctattcaattatgggactcacttttggagtaattttgtagtcaatttagtatcagtggcgatactaggatgcaaagtcaattcaaatgcgtcaaatgagaaatgttactttctgaaatgattgcaagtgcttaatgaaatatccactatctaaatgatgtcaaatgcaagccataaatgatgggtgattgctgctttattaccttttccttttgaaatgttattgttacaatgttgaacacatgcaaggaatgcaagcgataaatacagtatgtgattgctaccttattttccatttcttttctaggcgtcaagtaatctctatcggcaactgctcctctttgggcacactgcagagggaccaaatgaggcacttctggagggggagccacaaaagacatttgcacactcaattccattgttacttgaggtgtatgaaatcatcaatgggctggtgatgatccttgggaacctgctccggcagctggacgcaatctgctcagtccgtgacaagaatgtgcgtccattgaactcatttaagggtttagatttgacaaccgtatttggatcacttggcgaggggcttatggtgttccttttggtagatgaaattttgaggcacaatggcaataccaggagttacctatctctattctcaaggtattaatggtctctagtttattaggttcatttggtctgggtcattctacacatgcagcctgggagtattaattacatatgtaacactgaaagcacatcttttagtttctcggtggggatataatttttcaatggacaatatgttcaaagaaccatccataacttaccaacactgataagtggtgtcttttaacattcattaaacacttataattggtgtcttgaaagttaaaatacggagtattaattgttataaaacaggtaaaatttcttaagatatctagataaagattgactccaaagtgtttcagttatgtgtcaatggatagcttaaaaaaattgttgtggatcttggtgagctatcattgaagtattttcttaatgctatagccaaagtcttctacttttgcttggtccattgagaaaatataatatcaaatgatatgctatccacccatgcaactcattatcatcatgcatcaatatgttcagaaaattgacctttggtttcctcataggatgctggacaaggtgaaatctgaggtcgatgtatttagtatgtcattcgaggatgtagatttccttgatcaagttgtacacaacttacagaaactttttgacattggcttcttccaagtgagtgttgctgcatcaccttcatgttctttcattattttcttttataaacatatagcttaaattattcttatgttcatgtcactgtatttttatttctatgtcagcggttggtgcaagaagattcacctttgtgctcttcaataaccctcgttagatctaataagaaactgttagacacattttattctttcttctctgagagcagttctgagatcattcaacgcatcggtgagcagcgtgcaattttttttagttcagtacatttacttgtatgtttcaaatgcctgttagttatgttatccaataggaccaatattgatttttacacttcaggttctttgaaggaactccccattgatcgaaggactatactccatcttctaggcctttttttgttcttcacaacgacaactggtacttgatgaatgttcttggttattaataccattatatatgttcttttctagtcctcttgcatgcatttcttattttgccttctccgtgaaataattcttcttgtcttagatactgtatacactattatttgtacattccttttgcctttctattcagcttaattttttaaccaataattcaagtcaacctatcattgtgcctcataataagattgctaagatttacaatgttctgaaatttcatattttgttaggtgaagctcctgataagaaatcaatgaacctgttagtggagatatttcagttggttccagtggtctatgttgaaggtggaaagcgtattgtgctatctgacttaattaggtttcattgctctccatcactttctttgttgccacccattaaggaagcttgtgaagcttttggtatcatgaagaatagctatctggcacggttaaatgaaatgcattcaaggtaggactatttggtcatctttacatatcaatcttaacaggatccctttcgctcgacattcttagccactacaattactattttctttacctgtggaatatttaaatattgaagctgtatgtctcattgacttacataagtatattttgggagataatcatcagagagggaacatttggatgggttacatgccttgcctattttgctcttctgccaggaccaatttagcattagcctgtcatctcaacatgacatccttccaaatggccctttctgctaagtgttcagtataatttcgggcacttcagttttactgtaagtgttgtttgtcatgtgcagggatattcaagccataaatgattcgttatcatgctggtctgtttcattccagtcagccattcatccatcggtaaaatttttttacatttctgggaactgtactagattatgtgttttgatctttcatggtttcagtcgcagatgctgactgaagagtgggttcgacatctccagaaacaaattttgcaggtcatattctaacttttattctgctttgtgttttgactctttcctaatgctgtcatgtaaatccattgagaccgctaaatttccaaaatacagaggatagaagaactttgctgcccttgttgacctgcaaaatggtttcttactttcatcaagttctttgtgttttatgtggcttaattagtatttctgaggcatgattgttgagcatgaatgccttttgatcctttacgaagaatataattttgctgttctgtaagttgataagagttaacactttgggtgagtgggccaaaactgcttcccatttacatacatatcgattgttgcgatgtaagataacagacactttcctgatgagttaagtagcccatgtttatttttgcttgctcttcggtgcagggagtagtgcttgcagatagaatacatatgcttgtcctatcaatgcttgacttgcatatgcatcttgaggtacctacacttctcacttttccttttgcactctttatattttgccttgtcagtctttactgattaccatgtggatcctgtgacctatccatttaaattttattaccctgctttgaatcacgcaataccaatttgggctcattgtttcttcaattgttacttggagctgtcatcaatttataattttatttttgtatgtagctaagttgattgtccaacttgataacatttgaggaagacacggttctattagagaacattgtgagagcccaatgggaaaataaaaaagaggaggagagctctaatcctagcctaccactagaatataacaaatagccttgacacatacatactattacactataacctttatactaccaacagagaacttagtatttgtaattatttgttcgagcattactttttcagagactttaacatctgtaccactacctcctttttgtactacgtagtattttttttttatgaattatatggactaatttctgtgatgatcattgcctcgttggaaggttccactgagaagggagaaagccaagtctctttgccaaatgattgtgtcattgaaggtagtagaaagctaccaacatatccttggaatttttttttcctgaacaaggcttttccttgaaatatcaagtggctctgttatttaacatcgtactaactctcttgtattaggccataggagacttgttccacatgaaagggtctagcttagtgcgcagtcttcctcacataatcaacatcattcaatctgatattgaacaactcataatatcattgaaggtccattcaccaactgcctgaactatacaatttttttatttgtttttacagtgctgattgtccttattgctttgcttgtgttaagcagactaaattacaaaatgaaatagccaaggggagtcaggcagtcaagacaggatttcttagttcattgatacgtggtatgtgaagcaattctttttatgtgttctgtgaaaaagaatcatacaatactattttcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62932 - DNA, 6414 bp, Oryza sativa
tatacccataggtgtccctgtccaagtaaaactagggaaactaatatgcatacaattcgagtagtgcttgtcgtttcatgtagaactctattcatccttccttttgtggaactcctcctatatccgaaggttgtttccgtataagacatggtatgtggtgggtcttgccgagatttagtcaactactattaggtacgtggtatccataatcctgacaccgtatgaattagattatacatatatacttctataaatcaagtacgtatcacaacaatattcaggctttgatatggacggaaacagatcaacaaatattagggggacgaaagctacagcagcaggttaagaaacgttaaaaaaagatttccgtaaaaaaaagaaagaaaaagatttctgtaccaaaaaaacaagcgctaaaaattttaggaattgctaactagcagcctccgataaaaaaaggtgcaaaaatcgggtttccgccttccgtaaaaaaggaaaaaaatagtgcgaacaaaatattttgtccgattcttaaaaaaaatcccgtcctccgtgccaaaaaaaaaacaagcgcgaaattttttttctatccgattaaaaaaaagtgtgttcctgttttccttaaaaaggaaaaaaagtagtgagaaaaaaagatttttgtcctatccttaaaaaaaatagtacgtataaaccggtcctcccgaaaaacctccgtgcccgaaaaaaaaacaagcgcgaacaaaggttcccgttttccttaaaaaaagaaaaaaatagagagaaaaaaggttaatggaagaaaaagtttttgtgaaaagttaaaaaaaaatctgattccataaaaaccgatgcttttccaaaaattcctccaaaaaaaagaggttgatgggaaaaaaactaagagtccataaaaaaaatccaatacgagattagtaaaatttaggaacaaaaaagttaaaaaaatcaaaattagaaaaaaagaaaagaaaacaagagttaagtagaatacaatttaaaattaaatataatcagtatagaaataagagtacatatcagaacccaatagtagatgaattaaaataaaaaaataaagtagatgaattaaattcggaataaaaataaaataaaatctaaaattaggcaaatgaaaaagatagttaaagtaggaatacaattttgaaacggctgatgaaaataaaaaataaaaagaacaaaagaacacaataagaaaaataaaataaattctaaaattggtgataaaaagtaaagactattgaaagaaaagaccatctaaaacacatgacgagattaattaagtaacaggcttacagtggagcagagtggtggctgttgatgtgacatctaaaaactattaataaatcaccagataaaatcctaatgacgattaaaaggaaggacgacgggcatgtcgtgaagtaatcggtcaaggcggttggcgggacttctagaaagtaaaaaaataaaccccaatgaaaatcatatttgatttttaaaatctcaattaaaaaaaagagaggcagcgggtgggtcgtataggagtacaatggcagagccgctgatggttggtgggtcttctagaaagtaaaaaaatgaattccacgatagttatgttcgattttacaatcccaatgagaataaagagtatgcggcggacgggtcgtagaggagtatagtggcaccgtttgacaggatttctataaattataagaaaaaataaaacccaacgagacaataaactctaaaaaatataaggtctaatttttaaaggtttgggcttctaaaaagtaagaaaaataaaccccaatgataatcatgtttgattttaaaatctcaatgacaataaagaagggcggcagcggacaagccgcagaggagtacagtgacaaagttgctgacgttttggcggaattctagaatgtaaaaaaataaacctaaacaataattatgtttgatttttaaaataatactccctctatcccattttaaatgcagccatagttttccgcacgtaattttgactgtctatcttatttgacatttttctaaaaaaaaattaaaaacattagtcacgagtaaagtactattcatgttttatcatcttataacaacaaaaatactaattataaaaaattcaaataagacggacgatcaaaattgggcgcgaaaacttatggttgtaattaaaatgggacggagggagtaatgacaataaagagaacatgcagtggacggtcatagaggaatataattgaagcgtttgacaggacttctaaaaattacaaaaaagaaacctaactggaaaataaactctaaaaactataattttttaatccaatttttaaaggtttgaaggagaatgaatagaaacaatggtggatcgagcaaacaaataaagaataatatgatagaagtaaacggtagcaactggtgtgacttttaaaagttataaaattataaacacgaggacgataagatttggtctttcaaaatcttaagacaacgaggtaactatttaagaaattttaagtaaaatcatgttaaaaaatataattttatatgggtgctagccgcgcaattgcgtgggccacccgctagtttgtataataataaggttaatggtagaagagatgaagtagtactaattaagctgactgaaattaaacgctgcatgcggcaaatcctcccgattaataaaaacaactcgtgatcagccaatgtgaaggctgagaaaatcattatacgacatcatcagaggccactacgtaccgtaccctacccgcgaaatgacaggttcgtgctcgtgcaggtagtaataataatctaaccaaattaaagagataaaaccaaacaaaaatatctcgaccgatcgccgccaccactactacgactacctccttcccagtggatgcgcagatcgatccaatggctgactacctgggtgcgcaacgatcgaattacgcgaaaacgacgacgaaatcgtcgtgaaatctcacgtttccggcgcatgcatccatgttctgcccttgccctggccgccgccgggcgggcggctaacctcacctcgcgtcgcaagacgcgagtggctccactcacccacccacaccgccacacgcacgcgcctttcctttcgcgtgaaaaggtagcagcagcaagccactcaccttgtcacgtgatcccgtcgtccgtcccggtcacctcgcgacgcgatgccatgcgggtccacctgtcagcgacggacgaaaaggcctacggctgtgtatgatttatctactactattagctagaatatttttaaaatagattaatatgattttttaaatatttttttatagattttttttaaaaaaacacagtgtttaaccgtttaaaaaacacaggagatgtgaagtcggaaaactaagcttaagaccagataagtggggcgggcacggatcgatggagaaagtgcatcggatggtgtttgtatgcatgggaccatttctggtacgcatccaccgtaacaaactagcaacacacttatatatattaataaacttgcacagatgtaaactgaaaaatcgttgaaaatgttttgcatctgctgcctttttttttatctccagcccaaatttgaaaatctgaaaagtagcgcactcacacacacacacacacgatgtttcgtctggacgcagtggagacagattgttagttatcgtcttcatcaacgtgacaacatcgatcgatcgtccacatggttgttttctgctcgatgacacattggccacgttacgtgcgtacctaactacggccacacaatactgcatctggaccgtgcatattatacacttcttttttttttccttgtagaggaagatgtgaactggaactctttttttttaggggaagaaattaaaatcttagatgttgaatttgctgatgcaagcgtctcaatgagtgagacttgactgtggggtgagtaggaagcagttgaatctcgtggtcgatcgatcgtgtcgctacagcaagcagctgtgcatatgactatctccaatttttttttaaagtagataaatattaataagtatagtttttttttatatgaaaggctagctcgatccaggatttggtgacatggactcggataacgggataagataaggtcgccgccgagtatctccatcgatcgactgtcatcagtcagaagaccgaaataaattttggttttgacaaattttcgttgctcaatttcgaatatactactacttgtagtgaacagcgatgcacctaatggacttttcctcgcatgcaacgactttgaatgaaggtctgaaggacagagagatatatgatcgattgatcatttgatcattgagttagctaatccatcactgtttgttacaaaaatgcatggcttttagttcatgctcgcccttgataactcaaaagagacggagaattaaggaaaggtccatcatatcaaacccccaattcgatcttgatcatggatacggggtatattatatatacaggtggaaaatgaaaaggagctatactaaccaagcctctctgtgcaatttcgagctgtccctaataattgcgagacagaggattatttgcctaacgatggatcgatatgatcgaaccactcaatattgtttcccggacacaccttttggcgagacgcatcatcatcatggagtccaggaaaccaaatcaaccgtaaacaaaaaacaaggcgtgcataattaattagtcactagtaaattaattagattgaaacaagctagcagatgcgtacctcgccaattaagaatcccagcaagtggaataataagcatttatcatatggtataatggtaatgtgacccttatcatcataattctaagtagtagtagtagtacttctcctgttgaccaacaactctactgatggagtgatgtggagttgctgtgttttgtcctttggtggctggattttgaggccaagaaaatgcagatggatggatacatggtaacaccagggataatagtacagttcaggtatagtgactacggtcataacctaacataacaatgatggtcactcaggtgttaaattgggagaggacgattgcatttgtacctgaagctgaaaggaaggcttttggagtggtacacgtaacacgtactcgcggtggttcagagatgttgttgcaaaataagggaagagagatacatgggagatgatgatcgattggggaacaaaagttggtggctttttctcggggtgttagttaccaagttagttgctcgtgtgggtctcatggacgatctctcgatctccttggaggtttcctcctgctggtaaatcccctcgtcgattcggacagaacggtttgattattttactgtgttttcggtaggagtagaagagctcgctcgtgacgcatggttgaccgatagctccgtctggtactgcgtcgcatctatacaaaatacggtacactcattggttggtacttatggttcttggagagaattttgttgtatgtgacaaacagagacatgtctgttttcgttgatctgggttgggaatccatctcttacgcccagaaaacggaacgtcccgttaacacgtgattaattaagtattaactatttttttaaaaaaggatcaatatgattttttttaaagcaacttccgtgtagaaacttttttaaaaatacaccgtttaatcatttgaaaagcatgcgcgtgaaaaacgaatgaggtgagctcggaaaactaggcaaagaactcaggccgcggcgtgacagaggcaagcgaagatttcagttggactaagagcaagtttaatagtatagccaattgttggctccaaaccatttataggctgtgtttggatgcctccctttcccaacccctccccatcgttttccgcgcgcatgtttttgaaactgttaaacggtgtgttttttacaaaaagtttctatacgaaagttgcttaaaaaatcaaattaatccatttttttaaaaaaaattagcaaatacttaattaatcacatactaatgggtcgctccgttttctgtgcgcggtgtttgggttgggatctgcctccggcgaacacagccatagtcaacttaatagctaattcgtacaatagttacctataaatatatactacacaattaatatctggtcccgcctattatacaggcgtgcatcttggagtccgtgttgtagcagggtataaatctgtagccgctgcttttccctctcttcttttatctcttagaattgtgtttatagctggtttatagtttgctattgtacctactctaatcatggttgaagtgaaaacacggcgtataacattaacaaatacatggaggcatggagtgagcgtcgttattagagccgtggttgcgacgca

SEQ ID NO: 62933 - DNA, 2618 bp, Oryza sativa
ttcacgcgatgcggccctcctcctcaccgcgcggcgccgctgtcgcgctgcgccgacacacgcccccgcgcgctcacccgcacgcacgcaccaacgcgatgcgtgtgcgccatgtcgctcacgcgcaacagcggctggctcgcgcgtcgcggcggtggttgtgtttttcttttctttttgggctaaggtgatcgatgccgatggggtggatttggatgggctccatgtggtggtggggggagatcaggagatgagatgctgcctcggccacgtgagttaacgagggtgtgcactgcacggacaggacacgacacgaccatgcgtttgtcaatgatcgcatttgcccggagctaggggctcacgcgcgcgcccggattgcctaacaaaaatacgtgtatttgtatatcgtcgtcgtcggtgtagatgtaaacgaaggaccgtgccacggaccgtagcataactagcacagctaggagaagattagctcacgtatatccatacacataataatgctagttgatactgctgctgctgctactaaatgcaagctcccagggtccccaactagcaaccaccactggtacgagtacgtctttcggaccgacacacgcgctgctcatgacaaaatcactgcatgcgagcgttctgttgatcaaatactgtcatggcatcatatgtttggacatgaacaacttccggtagctatagtttctctcagtaatttaaaatagttgaaatttggtaactatataagaaatcctgccaaaatttgataactatataagaaatcatgccaaaattttggtacagttgtcaaaatttcgacaatgccaaaatttggtaatgttttttttggcatcaaagtaaacatgtcactaattaaaaatcaaaaactgagttttctcagtttcctcatattcttactggtcgcttctcgaaatctaaaattcttaaaaaatgggcgccgccttaattgtactactaccatgtttgaactgttgtaattcggatgtaacaaaacggcatcgtactagcatgtgttaatctaaagttaatctcggatgggtcgttttcaatcagcagggcagatactgttctcatctcgcagttttctttttctgtaactgtgtactactagtacgagtacccaacgtatacgtacgttttaacagatgatttttttgggagtttctcctgtggattatacagtatagaaatgtgcgctttgcttgatgacagtgaggcccggggcccctgaaactcccccaaaaatcccagttatctatatatacccggaaggaaccacagtccctgcctgccatcatcataattcgcagggcaaccaccgctgggcacgcacgctgcctgctggagagcaccacccaatggaaactgattgatcctgcctctgccatggtgagctcgagcttgagctgagagccatcttcttgtacagctcgtcgtcagctttggtgttgttttgtgtagtgtagtagtggagtacagggtcacagtagcagtagtagttgccgagttccttctttgtttgctcccactctccctggatcttttttttaaatttgtttttttatttgttccctttttttttcaccggcttctatcttttcccactgctgctcgtagtggcatctgctgcttctttgtgcggcggcaaatgcgaaagctgccaactttgcgctcggttggttgttgttccttctccaacttagctagctggagtactcttttgcagctctccccaatcccccctccaactccaacctcctataaaatcagcggctcgtggttttctctctttcctgggtagattggattagaggaaggtgttgctctcaagtgactgatcagttgcttagattcagattcgtagtgcttgcttgcttgctccctgttcgttctgagttctgaccgtgcgtgtgtgtgtatggttggtttcttgattagttgttcttgctttggtttgagttgccgaggtggatgaatccggctaatgtgggagcaattattggggttttgtggcaggtgaggtactggtatgcaggagctcggtgggattaatcgattcttgaagaagagcagctcggcgctgcggttgttgctgtgcccaatctagcggcggcgccaggaaggaagaaaagctgcgaaaatctttggttggtcagtggaggtagcagcgagagtaggaggccatgccggagtcttggagagacgcggaggcgaacgcgtcgtcgtcggcctccgtcgccgcggcggactcgagcccggggaatggcaagggcggtggcggcggcggcggcgccgcggtggcgaggggagagcgggcggcgtcggcgtcggcgtcggcgcgggtgccgttccacaagctgttcgcgttcgcggacaagacggacgcggcgctgatggcgctggggacgctgggcgcggtggcgaacggcgccgcgctgccgttcatgacggtgctcttcggcaacctcatcgacgccttcggcggcgcgatgggcatccacgacgtcgtcaaccgggtgtccatggtctccctcgagttcatctacctcgcctcgcctccgccgtcgcctccttcgtccgtaagtgctgga

SEQ ID NO: 62934 - DNA, 14952 bp, Oryza sativa
  unsure (1)..(14952): unsure at all n locations
tacgccgagtcgtcggtggtggtggagcagaccatcggatccatcagaacagtaagcatcaccagcagcaaagtgatcgatgaaaaggagcacacaatagacacaggattgttgtgccactatcatatagctgaaagaacccccactaatgcggcaatgtttgacgcctcaggttgcatctttcaccggggagaagcaggcagtggagaagtacaacaagtccctgaaaagcgcctacaaatcaggcgttcgggagggcctcgcagccgggcttggcatgggcacggtcatggtgctcctcttctgcggctactcgctggggatatggtatggtgccaagctcatcttgctcaagggatataccggcgccaaggtcatgaatgtcatctttgcagtgctaacaggatctctgtaagtcttatttcgggttatttttgtgcatatatagtttcagtaatatttatgcttgatttttaccaattgcttggaaaagcactacctttgtgttgtgtcctcaatgcttgaagtttctgcttcggttcccagtttcattttttagaaatatagttaagtcatgattccaaccttcaaggcatgctcctaaattacagcagttggtaggtgggaaaggattagaccgacgattagaatgtttagtacacacatgtacttcaaagttccaaattcctctttttgggatggggataagggaagttacaacagctaaagttttgtgattatgatgatttcgacgtgttaggctacaagcacaaactaaggtgcatgcctcttttttttttggtgatggtgatagcacttatcatgggtaaatagcttaacggattttgggtgtttggcacattggcaagtgatttggtagattcacctcccttttgttccaagttttgtactacctaactaccaactcccaccagcagcctcaggtagcatccaggatgcttttcatggtcaacaaaatagatgatgctaatgaaattgaagaatttactccaatttataaaataaatgaaataggtttttgctgtgaaaaattattggttcgtacactgtttttttagtctttttgtacctttttgcttccattttagtgatggtagccagtttgtacttcagttaaattgaccaagcaaactgattataataccagatgctgacttattttgttatcatatttaacagagcactagggcaggcatcaccaagcatgaaagcttttgcaggtgggcaggctgctgcatacaaaatgttcgagacaataaacagaaaaccagagatcgatgcatacagcaccacaggaatgaagcccgatgacattcgaggggatattgagtttagggacgtatatttctcctatccaactaggcctgatgagcaaatattcagaggtttctccctttccatacccagtggcacaacagttgcattggtcggtcagagtgggagtggtaaatcaacggttatcagcctaatcgaaaggttttacgaccctcagcttggtgatgttctcatagatggtgtgaatctcaaggaattccagcttaggtggatcagaagtaaaattggccttgtcagccaagaaccagtcctatttgctgctagcataaaggaaaacatagcttatggcaaagacaatgcaacggatcaagaaattagagctgcagctgagcttgcgaatgcctctaaattcatagataaaatgcctcaggttagaagtctactctatatgcaagttttgtgtttccagtattcagaatttttagatcattgggcataacatactgagatttcttccttctccttgccaatatttacagggccttgatacttcagttggtgaacatgggactcagctttctggtgggcagaagcaaagaattgccatagcaagagcaattctaaaagatccaaggatcctactgctagatgaagctacaagcgctctggatgctgagtctgagaggattgtgcaggaggctcttgacagggtcatgactaacagaacaactgtcatagttgcacaccgcttgagtacagttagaaatgctgacaccatcgctgtcattcatcaaggaacattagtggaaaaaggtaaaattcccaaaaggctcatatcaatgatcaaaatcatccattttatgagctctcagttgcccattgcatctttccttaaacatttaacatttttggtcaggtccacaccatgagcttctgaaggatcctgaaggagcttacagccaactgataaagctgcaggaagcaaaccggcaggacaagtctgaccgaaagggtgactctggagctcgttcaggcaaacaattgtcaataaatcagtctgctagccgcagccggaggtcatcccgtgataacagccaccattcattctctgtaccatttggtatgcccctagggattgacatccaggatggttcctctgataatctatgtgatgggatgccacaggatgtgcctctaagtcgtcttgcgtctctgaacaagccagaaattccagtgctcatactaggttccattgcatctgtcatcagcggagtaatcttcccaatctttgctatactgctgtcaaatgtgatcaaagcattctatgaacccccacatctgctgaggaaagattcgcagttctggtcatccatgttcttggtgtttggcgcagtatactttttgtcacttccagttagttcgtaccttttctctatagctgggtgcaggttgatcaaaaggataagattgatgacatttgagaaggtggtaaatatggagatcgaatggtttgatcacccagaaaactcaagtggagcaattggtgcaaggctatcagctgatgcagctaaagttagggggcttgtgggtgatgcacttcaattagttgtacaaaacacaacaaccttgattgctggtttagtcattgcctttgtatcaaactgggagttatcactcatcatcttagctttaataccactcattggtctaaatggatggatccagatgaaattcattcagggtttcagtgcagatgcaaaggtttgtcctctactgaaatgtttgttttgctggattattacttccgcaaaacctgacttctttacttgtttatgcagatgatgtatgaggaggcaagtcaagtggcaaatgatgcagtaagcagtataagaaccgtagtctccttctcagcagaagaaaaggttatggatttgtacaagaagaaatgtgaaggccccctaaggacagggattagaacagggattataagtggaattggctttggtgtttcatttttcttgctatttggtgtatatgcagctagcttttatgctggtgctcggcttgttgaggaaaacaagacaacttttcctaaagttttcagggtaagtattctgtactccggcagtggtaggagaatttaaacttcagctacttcatatataaacttttaacatcgctcacatatttttgaaatgaagaactcaatttttctgccatctgaatgcaggtttttcttgctcttgctatggcagcgattggggtgtcgcaatcaagtacccttacatcagattcttccaaagcaaaatcagctgtgtcttcgatatttgcaattgtggatcgtaaatctaggatagacccaagtgaggatgcaggggtaactgtcgaaacactgcacggcaatattgagttccagcatgttagcttcagatatccaaccaggccagatgttgagatattccgagacttgtgcttgacaattcattctgggaaggtacgaaaccatccatacaagaacctctttacattcaaaatgtttatgcttgctaaagctaactatccaaatcatttttatcagaccgttgcacttgttggggagagtggtagtggcaaatcaacagcaatttcattgcttcagaggttttatgatcctgacgtaggacatatactgctagatggtgtggacattcagaagtttcagctaaagtggctgaggcaacaaatgggtctggtgagtcaagaacctgccctcttcaacgacacagtacgagcaaatattgcttatgggaaggagggagaagcaacagaatcagaaatcattgaagcagccaaattggcaaatgcccacaagttcattagttcctcgcatcaggtttctttctaggtttctttcttttcattggtgtttgactattgtgattaaatgctagaaacatttttctcaatagattggttttacctgaaaatttgtagggttatggcacaacagttggagagcggggagctcagttgtctggaggccaaaagcagcgtatcgcgatcgctcgtgcgattgtgaagatcccaagatccttcnnnnnnnnnnnnnnnnnnnnnnnnnnnnnnctgaatccgaaagggtggttcaagacgcgctggacagagtgatggtcaaccggacaaccgtgatcgttgctcaccgtttgtctacaatacaaaatgcggatttgatcgcagtcgtcaagaatggagtgatcatcgagaagggaaagcacgataccttgatgaacatcaaggatggcgcctacgcctccctcgtcgcccttcattcagcagcttcttcatagccgccggtagtaaggctcctgcaagtgtctgctgaacatatattaacagaactggcacacacactgcaataattctgcaggtgctagtctttgttcctcttttgatggcatacataactgcttatagccaagagggaaaggctatacagatagtaaggaccaaatgtaaatgcaacaagttggtccttaacatatatattaattcatatatatatatgtaacacggatcatagatacccaaatagatgatgattatgattacctctcatgtgtttgctcttattttcccttggagattttattttctaccatgcaaggaactaccgaagggggaactgttcaagaaaggatgaacacatcagaaagatgcaccctggaactcaaatctcatcctgccaggctgccatgttaaattgttaatcagtcaccctcctctgacaagatgaaagaaactcgatggaaatttttatagacagaaatactgaaacaacaaacctgatgcatggaagagcagagttaaacaagactccgcagaagcatgatttttcttggcgatctccttgaaggttgcaagatcagatccaaaaaaacagcaggtgttttttggtgaccaagaaacaccaactctgttcggcacaatcgtcaatggccatggccaccatggcaatcgaaaacctactggcttctctgaatttatcaggttttgtcactgtcatgtactagtatactggtgtgtggccggggttgattcgtgcaagtaactttcaggacctaacccctctacttccgaatgacaacaaaaaaaggcccaatttcaaagcgaactgttgttgctgagagcacaccttgcaacctttgctcgttgtgaaaaagcacatataggagtgtacttcccttctagaatctggttaggaaaattactaccaaatccgatggagtatagtcgagaggcctgagatggatctaggtatctaaacgattcagacaacccagcggaatagtaaaacgagatcccacaataaccaagacctaatctcacgatatattagacggtgggagaagagcaattgggggagcctcttcagttgaaactccgaactggaagctttcccgccacatcaaacaggaggacacaggggaaaagcaacaagaggaggaggaagaagaagaagaacacagaccaacgcgacggcgtggcggaggaggcatcaccatggaatcgatcgatctcatctcaccaacgctacccgtcggcgatctccggccggcgagggcgacggcgcgcgcgccggcgtgatcgatcgatctccgcgtcggccatcatggatttgccccccgatgaccctccccaccctccctcggttgctacccctggggttgaaaaattgttgtcgtgcgtgcgcccatggattggatgagcgaagaagaagacgaccatgggggaatgtgccaaagcccgttgacattttgcgttcaaccgcggctgtttactgaggcggttgctgtcgattactagttttttttcttgtcaacaaggattttttttttttggggtcagtgagctgtgttgacaaatttgttggccggccaacttggttgtatatttttattggattggattgggctcttaataaaaaccctactagatcagttggcgggtatatttatattttgggcttcctccctctagtagcactgaaacaaatcgtttttaaacttgtgaagaaaatttaggagagtactcgctcaaatgactatcgttgtacatttacactgaactggaaaaagaacgcaagccatggaaggatgtgaaaaggcgagcgaaaaaaattgacaaaaatagtttatatttaaaacgaattataattagaaccgaagtagaattgccatggtgaaatagcacagttcctctaaatttagttgtgtaaaaacctgaaaaacgaaggtaggctctctttataaaggcaacgcaaaatatatctatacaagtaattccacatgagatatggcctattgatctggacataaaattcatgtgtaaaagtgaacttactttgaaactacttcctctgtttcagattataagatgtttttgactttagttaaagtcaaactactttatgtttaactaagtttgtataaaaattagtaacattttcaatccaaaacaaatttattataaaaatatattcaattattgatttgattaaactaatttaatattataaatattattatatttatctataaacttagtcaaactttaaaccgtttaactttgacccaagtcaaaacgtctcataacctgaaacggaggcagcattactcttacaaaggtgtcctcaataatatataccacagtcgtgcagtcagatctacaacagctgcaaagctctctggaagtccgggttcagattattcttacatttttttttacagctcaaaaatgaagggggaacagactttcagttcagatttcagaatgtattctatatcaactgaacatgaaggtgccaatcgcccgaggaggcaaggagaactgccacttgccacaactaagatttcagtcacaatgccttccattgggccggagagctggctagctggaatgctggatgtcaactcctcatgccagagtttcttcctgcattcaacaatcgataggcacatgaaagttagtactactgactacagtgtgattagccataatagtttgtttcaaccacttgcatatatgtcaatggctagagtaagggttagttgtgagaagaatcacagagaacgtgatagttgctatcagaaactgcaccagaatacacaatgcagtgccaccacaaactcacaaagtaaactgcatttatacaagcaaagtttttaccaagctcacggctatttgaaattttgcatgaggataaaaaaagagtactcaaacaggtcgtcttttgtcattgaagttgtagtaaagacagtaagatgaataaaactattcttgccaaaaaaaaaaaagaagaagaaaaagaagaatagaactaggaaatgcatagaaaccagagtgtaatacccaagatgatctgaatgagaagctggtttagtttggcatgaaaatttgtggccttgccccgttctagtgagaatcttttcattatcacagcgaacaataaaattctatatttctctgcaacattatccatgatgcacagaaaatgaatgtacatgtttctaacttgagtagaagacgagattttaaaaatcaatgaatcataaagtttgtcacatgcgccttgctccttccatagaaacactagacttaagattttaaaccatagaattcagaaagttttgtcatgtgcgatgttgaagaactctggtggggaatttccaacgaatccttccatagggaatgtatcatgtatgggcctggtcagtggtcacacacacacatatcttcatagatgcgcagcccaacaaacacaatgtaaccttaatccttccataaaagcattcatcaactttctaatgttaattattccctttgcgaaccagaacaaagcaacaatcaaaagcagaaaaagttttaagcgctccatgccgtgagcactactgatgagaggacaaaagcttccaagaatgctttgagcaaatctccatattcctcgtggcaactggcagccttatcatcaggcacaaccatatgcttttggaccgaaaactgaacacccagaccctgtattgctagtggaagtccagggcatctttccatcacaagtacagaatcactgttacttccaaattgtttaatactccctccgtttcgaaatgtttggcgccgttgactttttatcacatgtttgactgcttgtcttattcaaaaaatttaagtaattattaattcttttcctatcatttgatttattgttaaatatatttttatgtaggtatataattttacatatttcataaaagttttttaataagacgaatgatcaaacatgtgctaaaaagtcaacagtgtcaaatatttcgaaacggagggagtagtaggtagtaaaacagcaacagatcgattgtgtaatacagtataatgaggcaaatagttctagatacgggtgagtggccttccaccgtttcgcatcggacatctgtcatcgtattcgtggtgctatgccaacaatctctgatctcatagaagtatgcaacagaaacatctctaacgtaaagtatgatttcgaactttcaatcgtgcaaaagaaatctatatgctgacaaaccgtcatatgttctatacttgtccggtgcgacagagtccatcgatataaaaacaaattgtctctcatgtaaattgcggagtgtgagctgtgaatactgtggttccaaggtaagcctttctatggtagcaatttggcaattactataggatgtggattttcatccctcaagggggcatcccctcgttgtttgcatgtcatctaaatagttattaaaaaattttaaaaaaattgataacatagattaatacgaaatatatcactccacaaacatgaaagtccaaattcaacttctataagttgcaacaaaaataacaaattaaactgaaaatagttatggtatattcacaactgtatttgttatttttgttacaacttgtagaagttgaatttaaacttgcgtgtttgtagagtgatatatttcatattaatctatgttgccaatttttttcatattttttgatgactatttaggtgacatgcacgaaaaggggatatcccctcgagggatgatttcactttcccattgctatataaacataggttagtgaaatgaagatcttgaagtcttggtacacatatgatatgcccattgaatttcttaaatatatggacaaaaccaaatagaacattgcaaactatatttcaagtacttaaatgcaaattgcactactttaattgcaattattgattgtttcagttaataatttggtacttcgcaatccaacagctttgtataatcggcggttgagccatcactgaagaaacatgtcccagcaaaggcttagaggctaccacatcaagcatatcaagaaagaacacgcgatgtgttccaggtgttccagacaaacaatttgtttttaccaaattacacagtaataatccatcaaaattcagaactaaattaaccccaaataaaaaaaacagcagctaaacagaatgtttcagcgagatgatcagttcagtgtaccttctcaggaggccgtaactttctgcaggtgaagccgtcggcgacgagcttggcgaccgcgtccctgagcgcctcgtattcctcccggacgttgtacacctggtgcgagatcctcacgtaccccgtcaccggatcgccattgccgtccttgaccatctccggcggcgcatccgccgccgccgccttggagttgtagtagagcggcacctccaccttgaactgcttcctcagcatcgtcctcaggccgacggcgtcgtcctcgctcccgacgcccagcgagccgggcagccccaccatgagcatgctcccgcacatctccggcggcgtgccgaggaacgtgccccacgcggcggcgagcatcgtgcccatctcgaccaccttgtcgtggttccggcggcgtatcccctccacgccgccgtcgaagcgattgacgaagtcgacgacgtccgggaccacgagctgcgcgctgtagtcgcgcaccccgatccaggcgctctccatggggaggccgttgccgtactcgctggagacgacggggtggtggagcttggaggagacggggtcgtccttgcgcgtgtggatgaaggcgacggcggaggggcagaagaaccacttgtggaggttgctggcgtagaagtcggcgccgatgtcgcgcacgtcgacggggacctgccccacggcgtgcgccgcgtcgacgaacaccttgtcgacgccctcctcgcggcagatggcgacgagctccttgaccgggatgaggacggtgggcatggcggtgatgtggtcgatgacggctaggcggacgcgcggcgaccgccgtccctggccaccgcgagcgccgcgcggaactcggcgacgatggcgtccggggaggagacggggaacgggaggggcacctcgacgacggtggcgcccgcgcgggccacgtacgcgtggatggagttcttgatggagcagtaggtgtagaggaacatgagcacgacgtccccgcgcgcgaagtccccctcggcgaagctccaggcgacgtgctgcatgatgatggcggcggccgtggtgacgttgtcgacgagggagacctcggaggcgtccccggcgccgacggccgcggcgaccgcggcgcgggagcgggcgagcccgggctggaggtggtggaagtagaacgcgtcgggctgcgacaggaacaggcgctgccaccgcgcccgcgccgccagcaccgacgccgggcagcagccgaaggtgccgttgttcaggcgcgccacggcgcggtcgtggtgcgcgaactcggcccggacctcggcgtccgtgatcgccgccgcgcccgcgcccgcgcggggccgcttcgccgagggcggggacgcggcgccgtcgacgtcggcgtcgacgccgttcgcggccgcgtcgccgccggactgaagcgaggccatcggaggttagaggagatgttgacttgcaagcttggagccgtcagaggtgtcgggtatgggttgggccgttgggggcgttatctttgatgggattagtatgcaattatgccgtatgtggatgaaaaatcacggttgtctgatcaataataaaccaaacaagcgaaacaaatttttgtaccgttgggcaaaatgtatctgaaaatggttccgttggagcatgaccaatatgagaggagctgttttctttttttgaaaatattttgattgactcaaagttgttgaagcaagaatcacaaaagaagaaagattttattcacttgacaccggaccattagctttctccgtagctaagattcttttggattaaggctgcgttctaaatactagtacatcaaaagagaaacacgtccgtgtcgctcggccggctctgcaaggacggcggcgggcagagctccgttcttcccccaagggcactattcagacaggggtttctaaggcgacctaaaaagaagaggtggcggcgccgtccagatctgtgctctccctagccagatccggtgaggggtagcgacgcagttttgaacagcggtggaaggtgacacagatgggaaagagggtgccgaggcagccgctcgtgcagctggatccggcaactcctacttgcgtgggtcgacgcggcagcggggaagagggtgcagagcaaaggtggctccttcagctgggtcaaggctggagggagtggtggtggagggcgctggcggtggggaagagggcgtggaggaggcgacttgtgcggctgtacctagcgtccccatagccaaatccggtcgccctcattccatcccgagggcgcacggttcgcttgtcggtggcattagagggctagcaagtgtggcgacagaggcttggggtgctggccagcggtgacgaccccgatgatgatctaggggggaagctgtgccggcatggaggagcattgctggcggagggaggctagcgaggcgcatagagtatgcggcacgaaggcccgtggctggcgagcacggcgcggaggcgacgaggccggcgcgttggatggagtggtgtggcagcgagcctaccgtggtaggagcatggcatggctagggcggtgcggcggtgaggctactgcggtgggaggacgaaggcgatggtcatgcgatcaggtggcccgttaggagacacgagcaacctggtcaaggcaacagcagcaccatgaggtaggcgttgaaggctttggtgagttcctttctaagtgtcaatcctcttgccgccacaagatggccacgttggacggggtagcgtgagagagaggtgatccattcttctctcttaccctcttcctctcagacccacccacatgtgatcttattcttatgactctttctctagtagttatggcagtgaccctatcaacaatcgacatacacttccttctagtggcagagccgaacaccatgaagcctaggaggagtataagacgaggattctctattgaccgtaaaatgtttttttttggtctatgaacaataatgcttgttaactggcactccctaacttagaggtggctcttcatcacatttaaggtccattacagtttgctattgtaactacacataatactagtcattcatttttcaacccaatggctcaaatcgattgcaacactgctatttatgtttttatacaatgttttgctatattacattgccatagtatctatgcgaatcttacctcttctcccttgatcctatattcctatggcacaatagcaaccgtatgggatctaaattgctccaccaatgtctcattttctacttttatctaccatggtctcatctttctaagggctttcacagtgtaacctccacacttgaacaacatggaatatcacataagatgacgctcctttaaaacaactcattccatagtgcaaactagttttaatgggtctcactcctaaccgtattcacttttcatctccctctctctctctcctctctgccaccccacggacggaggatccgggaagcgaggcgtggattcttcttcgccacctctacagcgcacctcgtctctgctcgccattgtcagccacatccacaccggcgccccctcttcgtcggcgccgctctctatcccccttcccctacatcaagacgacccacaccgtcgacaccaccgaaaaccacttcgtgcattgctcccgtgttgactaggtgttgaggacgagctcatggtagagattggggtggtgggcctacgagctccatggcggcggtgcgaatcaagcgacatcgacggtatcaacggcacggaggggggaagatgatgagctttgcagggtgaagagggtgacgcaacgaggagctttgcggtgcggagaaggtgatgacgccgagacttgtagcgtggagaggaggaggacgacaagaatccacaccggtgagcgtgaatgcaggtgcccccaatctggaccagcgagcttctgaggaccgtcgtcaccctcctcattttgcctgaagtggtcttggtggccgtcccctcctcccgagcggcattgcggcttgggccaacgagctccgtggtggccttgatttgcttgccgaagtctacaaggcgccactcccatcttcttgtccttcctccttttgcctattttagaccaccccttgtgcttcactctccagaggaactcgtggttcaagcaagaatgaaaatccttggagaaccactgattccccctcctctgtcctccacggcagcagacatctaacgtggtgcatcgaatccacacaacagctagatgcacttagaatgacctaatagagcccccatcgtacattctttgccctattttagtaataaagcagccacatcacatcacctgttttagtaagagcacgtcatgtctccttgcatatttgcacaacacacctttaattttgcaaaactgcggatgggtgcatttgtttttttttttcattgtgtaaattgcatagaggtacaacggaattgctctatgcaggtaatgtggattcattaccgacgtgcctgttaacgtggaaaaaatttatcacgcttgacacctttttagataaaaatacaatcatctaagtatctaaccaagttatttcacttgaatgcttaattttgatgacattattgtcaattatatcattttttatgcactccgtactcaaagattgtactatactcaattatacccatcctccaacttcttacacatatatgcttaatttttaaatttttatcctatctacttgtaagtttatatatgcacaatagaaattttacacgtttacaagttgaacataacttttgctgctatttcagacatcactccgtataaaaaactagtgattcgaaaagcttacgtatcgatgtatgaattgcggaacatcggcgcagtacgagaggggctaaaattgttcctagtggatatattatggcaagtggaaagtaattaaacaggaagctgtcgatgaagacgagcataaacttcaaattagttgctttagtgacgtaggagatggcgattagtgcgcacagccgtgctcccaacaaataacaatgattaagttttgattaggacaacaattcattcattgagtaatactaagaatttaggggca

SEQ ID NO: 62935 - DNA, 2681 bp, Oryza sativa
  unsure (1)..(2681): unsure at all n locations
tgacaggtctaatggcatttttgcaattttctagtggcagttttgcaataacgattcaaagtagtggtaaatttgcaattgccccaagaatttaagtttgttattaggtcgagcggcagataagaagtcgtcttgtattgcaatttatttgagctgcgagtcgtggtttcatgatagtcgtgttgaactcagtttttatctgcccgctgccgtgcggacaatgagcgcccaccaatccaccgtaactgataactcttcgtcccattttaaatacagccataaatttttatatctaactttggttatccgtcttatttaaaatttttctataattaatatttttattattttatatgataaaatatgaataatactttatgcatgacttatgtttgttaatttttttagaaagtttttaaataagataaataattaaagttagataggaaaacttatgactgcatttaaaatgggatggatgaaatacttaataattactaattacagcatcacaaacaacggcttccttacgtggcacacgtaagccgttgcttgctttcttcgacctcccaagtagggctggacggaaaactcgaagctcgttagctcgctcggctcgtagcaggctcggctcgactcgactcggctcattaggataacgagccgagccgagccaagattttagctcgttagtataacgagccgagccgagctaactcgcgagctgctcgcgagctgaacgagctgcgctttctggactgcaggccgcatccacctgtgtccgcaggccacaacccagtagcccaaaagcccccccagcccacacgcacatataggagaaaaaaaaaccctaagcctcttgcccttctcacttcctcagtcctcagagtctcacgcgcggccgcacaggcacctggccgccgcaagctcgcggctagggttactgcaacagcgccagcacgcgacgcggcgcgccggcgccgtgaccagcgcctctccgtccgtgagtccacgagcaggtcccgttccgatcctcactcggtcactcatctttcctttttcctctagatagatctacatttgctgattgccgaactgctactgaactgctgactactatgctccaggtccaagccctcagtcggggtcgcagccatggagggtgagaataatgcatcgccgcatcctccaagtttggagtcgaggagtaagcttcgtggacgacgaggaacaagcactcggtcttcatcgaatcccactgtgtccttggaagtggtggtatgttatctaatttaaaattgctagttcgtacagtatagacttgaatgttgatttaattattgctatccagagtgctgtccagattatttagttacttccatgtagatgtagataatgaatttatccccaaaaatgaagaatgtcacacttaattttaatgcaatggcaacgattcagctatacattaatacatgtatatttccttatgcagccattggagaaagtttcagaagatgaagacgatgataacagcttcaaccatagggatgatatgtctgaaagcctacctacagttgatggtggaagtggaagccagaagggtgatgatgagtttgatgatggtggatcaaaggctaagaaggcaaagacaggagggaaaaaagctggtgtcacagtgtctcccaagtgcaagatagcaagaggcaaaagagctgagtgctggaaacattttaaggttatcaatgtcccatccaagaaggagagaggtgtcatggtggcaaaggcaaagtgtaagttctgccatagaagctatgtgtatcatccaggtggtgctacaacaactctgaaccggcacctggctggttgcacacaatatcagaacaagttgacaaaggctaaagctcaaggtacactaaactttggtccagaagatgacaactctcttattgttaatcctactgagtataatcatgagcacactagagaactgattgccaagatgataattgctcatgagtattcatttcggatggtagaacataaatggtttaatatcttgatgaaatggatgaatggtaactacgagtttattggtaggaagtctataaaaaatgaatgcatgagggtttatgaatctgaaaaaaatcaactcaagaagagtttgaaagaggcagaatcaataagtttaaccactgatttatggacgtctaatcaaaaccttcagtacatgtgtttggtggcacattatatagatgagaattgggttatgcaatgccgtgtcttgaactttatcgaggtggatcctccccacactggaattgtcatagctcaggctgtttttgaatgtatggtagaatggaaaatagaagacaaggtcacaacaataactcttgataatgctacaaacaatgatactgctgttacaaatttgaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62936 - DNA, 17847 bp, Oryza sativa
  unsure (1)..(17847): unsure at all n locations
aattcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatagctgccccgctggcttttttatatagtcaaggtgctgtttgggtttatcaagcaattgattggatacaatatcattgctttttgccacgtaagtgtgcatttttattgaccaatattatggcttaggctgattatatattatggtcatttttcaggcggttggtaaatcctttatgagtttacttactcggatgttataccatatatgccatatatttccaggtgtggtgaaaccatgtgtcttttagggacttaagcacatctgttaaagcagtgtgcgcatggcgtatgcccaatactttggaaatttctttattcacagcattcaagcttctttataattgttttgttatgtgaactttcaaagatgttgtcaactttaggttgtacgcatcatattttgccaagcagtcggtatatcacttgaatcatattattcggggattcacaccgcatatgctatatattggtatcaagtcacttggttgactataattatcaaaaaccactcggttggttggattatttattccttgactatatgtttggtttgttcgattaaccacatagtcgggggttacacctattaggtgcatctagtcgatgcacctgactatatttttcagccctccacagtcttcagatttggtaaaagtactcgggagaccatggcgaagatgattgaagcactcggctttggagtaatctagttcgagagaaggttatctttccgactgtgaaggtctcaggggctactgtggagattatgggtaccccatacccacacggcatggttatccgactagttataggggataacttatatctatgtaatatgtaacagatcatgacttgggtgttacgtttccttgtatattacggaacggcctaaagtcctgatttaggaaaccgataccgtattggttaaggtttctatcttgtaatcctgccccccatcctatataaggtgggcaggaggccctctagggggcagatatgagacaacctgatcgtcagatcaatacacactcggcggattcaaatccccaaacaggagtagggtattacctctcattgagagggcctgaacctgtctaaatcctttgtctctgcatccatccacttttaggtctcgtgcgctacccccttttattattgccgaaatcatgtttcgacatacggcttaccatccacaaactgatggccagacagaacgggtgaatcaatgtttagaaacttacttgcgttattttactcactcttgcccctctaaatggtccacttggttatacttggctgagtattggtacaacaccagttagcattccacccttggcaaaaccccttttgaggtcttatatggccacactccaaatcagttaggcatcactgtcaattcctgtgaacttccaaatgtgcagcaatggttgtctgatagaggattaatgatgcaactcctgcagcaacatctgaacagagcacaacaaattatgacggctcaagctgataaaaaacgcagtcccaggacttttgctgtgggggattgggtttatttgaagttacagccgtatgttcagacttctgtggctgccagggccaatcacaaattgagcttcaaatattttggtccttatgaggtgctgcacaaggtgagggcagttgcttatcatttagcattgcctgctgggagctctattcatccggtctttcacgtgtcacaacttaaatcagctcggggttttaagggattctcttctgcacatcttcatgttcaacttgagcagaagcaagttcctgtggctgttctggatacccgggtgcgtaagtcaggtaatgctgtcattcaacaagctttaattcattggtctgattgtccagttgaggaagcaacttgggaggacttggaggatcttcattcccattttcctcgagctttggcttgagggcaagccaattttcaaggaagggggaatgtcaggatgtctgcagtggtgatccgggcgatggcaacagctccaaggaggaggatgctggcgggaggggaagaagacataagaaagctaatactagagtatctgggccggagtgggccgtgtaagcgtgcgtgtgcgtaagggcccaaggccttgtctgtaagcaagagcaggtgagagagagagaaagagagctaaatacagaagcaaactctgtttgttcatctatcaaattagtaaaatctggaggtgattggcggcggcggcggcgacggaggaatttgtaggaatccccgtcgatctatctgttcttgagtatttggttccatttctctgttggattcttaacaggggaccacctgccgggagccctacctgctgcggttttcggctctcttcgccgagctcaccgacgacatcgtgccggtggcgacggagtgctggatgagcatgttccacggcacgacggcgaggggttgcaaggcgatggacccgttctacttcttcatgaacctgttcccggagtacaccgtcacgttcctcgacaagctgccggccgagctcacctgcggcggcagcggcggcaagtccagccacgacgtggccaaccatgtccagaagctcatagcttccacgctctcctacgagtgcaccagcctcaccaggagggacaagtaccaacactggtggagaaatgctttttagtcccggttcgtaacccccctgtagtcccggttgacgaattcgggactaaagatcgctatctttagtcctggttcaaataaccgggactaaaaatcaatcttttgtcccggttggtgttaacaaccgggactaaagatggttgttaacaccaaccgggactaaagatattttttctttttttttctgcttttaatattgaatattgatttcacaccatcccctcccatatccaaatcatcacatattacagaacatctccaaatcatcaaacaaatcatctccaaatacatcacaaactgttaaaaaaattacctcacaaggttctaaaaaatacatcacagattcacatctcacacaaaaatacatcacagattcacattaaaaaaaaaatccggccggcggccactgccgcctcccctcctcccatccgcgccagccagccggcaccgcgccgatcgccgccgagcggccacccaccgcagccgccgcctccgcgcggcccccggcgcagccgcgtggccccccgcgccgccgcgccggccgcccaccgccgccgccgcgcaggccgcctccgcgccgtcccccgtatcgccgcctccgcgccggccgcctgcactgtggtgaaggaaaaaaggaaggagaggaggggagttagagataaggaaagagataagaagttagagaggaaaaaaagagatagaggaaggagtttgttgtgtggacggaaaaagaggatcggtactatggattatacagtgtgttttgatttttattcccggttagtaacaccaaccgggactaaaaataggtttttagtcccgattggtgttactaaccgggactaaagatcatagggccctgacacggcctgacatggaatcaaccgggactaaaaatcatctttagtcctggttggtaactccaaccgggactaaagatgatttttagtctcggttggtaacaacaaccgggagtaaagatcttcctcttattaaccgggactaaaaatcatttttagtcctggtttttaatggaaccgagattattgtagatttgggttgaccgaccaaagatgatttctctaccagtgaaagcactcgccggcaacgacggcattgtcgccgtcaagacagcgaaggccaagtaatcagctcagtgatcagcctatctgccgatctcctcttgcaagaacagtaaaaatttataggaataaaaggggagtgtttgcatgtcaattatatagttatgaaattttttttaaaaaaaattggaaagatgtattaacatgttcaacttctgcatttcgcaacgaaaaaataaataaactacaactagttaacgtatatttacagtcaaatttgttttttcgttgtgagatgtacaagttgaattttaacttacatgtttgtggagtgatacaacacatattaatatatcttctcaaattttttaatcatttgagtgacatgtaagagcgatcaaaatagtttcttgaacaaaagtatatatgaaaacatggaatcaaacgataggagtaagaataaaatatgtatttattatgattattagtcgattagtagtctgaaactacgatgtacatacgttgcaactcttccggcagaagccaggggattcactggtgccgaccatgtaaccggggttcttggcacactctccagcagcagcccagctggagcagagagcatgttgatcctcgcatttgtccgaggatctccggccattttcgtcgtaggatctcacatggatccatttcgtcgccgaccacttctcgccttgtatgacagggcagcttccgtgcaggctgcctgggtcgaacgtcgcgttggggtagaggctgaagaacagcaccgcactgcctttggtaggtttcactgccaaacaaaatccaaacattgttacaagcggacaaaaagcaaaactgcatgacgagcccaacagttgcgagttcaaactcttatcttcgaaattgcacattattacatttgaacaaaccaaaatttgtaaatataattttggtttgcgagtgtcaaccatacctgcgaagccctgttctgcgcagtcggaccatgtctcgtctttaggctgtgataacctagcctgtggggagaagataaattgtaatgaaattttgcagcaaaatcaaacgaggccagaaggtgtaaaatacctctgcatcggggaagacggtctctccacccatcttgacattggacaggtacatgagcacagtagcaatccgatgacctccacgagctgaggcttgccgtccgcgaatgtaatcaaagtgtggctcgtatttctcaccttgcccataacgtagcatttgcatagattcaccgttttctgaccgttcaagaatcacaaaacgggcaaagcaatagaaggtgatgcactctgaagaacatttggagcaaggtccaattaagcagttttccagtgttctgtgcccttgcaccatacctgctggaaacatggtccaagcagcaatcctctcctctattcttgcaacgacttcatccttcagataaataaaacattagagggtcagaagcaatttttattatccacacgcgtgctgacaaatcactgcaatcagaaaattcagtataggtatatgcaacgtgcatagaacattggctattttagccctttaggaatacatgaaactcgattaattcctgcgtattcacatggtaaaagaaaaatcctataatccaaatgtggactttgacctcattttggaatgaagaattttggaagaattgcaccgatgatcagtccaaaacccctgtgaaattcttacgtttcaaatgaatccttgctcaacaaagacttgaaaattgaaattgtttggatgcttatgtgatccggacaagcgacattgcttattttccagccttaaagcgaccctcgctcgtagcctcacctgtttcctgatgaggaacatgccggagctggtcctcgtcttgctcatcacgctctcccccgacttgccgtttaccaccgtcgacctctccatcctaccctgcttcgccttcgcaattcacacacgcacacaaaaatagaaaaaataacaactcaatgaacgcacgtatcagatttcccaagaggggatttgatttgagcgcaacctaccagcgcgatgaggtgttcgcactccacatccgacaggaacccctcgtacaggaacaccctgccacctcacagaatggagagatcaacggaaagccgccggctcgccgccgcacctgagcccagagattcgcggcggtcgattaatttacctggggctccacgagacatcgactgtgcgggaggcgtcgaatcgcccgccttccccgccaccgccggtggcggacgtctcgccggtgacggagaggagaagcagtaggacgacgaggaggacgagacgagccatgcccgtgcgacggcggcggcggcagagacgagcgccgccggcctagctcccttgggcggcggaggggggtcggagacgatgaggttgatctgtggggccgacgcgccagtgagagtgagagggtgtttataccgtggggcccacgtgtcgagtgcgtcgtcgacgcgtgctccggaagctccgaaatggcggcgctctgtcagtagggcccagtggaccgaacaattgggcttgactttttttctctttcgaaaaaacggatagttgggcttggaccttaaaccctctcaacttagagttgaccttaaacttagatttgataacaccccgtcaacttgaaacggagttgctagaaatatggcgccatatgctacagtcgatttttttcagccacttacacagtagttacacctcatttacactccacttacatatgtaattagtatgtaattttcgaatttacatatgtaattttagtacttacatatgtaattttgagacttacattgtaaatacactaaaattacatatgtaatttaggaacttacaatgtaaatacatgccgactattttttgatgaaaaatatgacgtaataaatatagctacaaccacttgaaaaatagtacaactcctagaagaagggtgtagctgtatctatggcgccatatttttcatcaaaaattcccagagaagagtactcacaactcacacaatgacacaaacctaaatttcttgtaagaatagtacaaatttataggaagagaagtatatatgagagtgtagctcaattagatatgtttcttgtggtggaaccaattcacttggttttaggtttcaaacttaatatgagtgctcgattatttatttttttagtggtatcttcgtcaatattaagatatatcggtccgatcttttgaaagcgatcatattggtagggtgcgtgcgttgtgaacgttcatttttgtactgtattttttttgaaaaataattacttgtttattgtgattattagtcaattagtagtatgaaactactttgtacatacgttgcaactcttccggcagaagccagggggggagtcactggtgccgaccatgtaaccggggttcttggcacactctcctgcggcagcccagctggagcagagaacatgttcatcctcgcacttgccggcggatctccggcgatagctgtaggatctcacatgaatccacttcgtcgccgaccaccttctcgccttctatgacagggcagcttccgtgcaggctgtctgtgtccaacgtcgcgttggggtggagactgaagaacagcacagcactgcctttggcaggtttcactgccaaacaaaatccaagcattgttgcaagtgaataaatcaaaagtgcataatgagcccagctgttgccatggagggtactgtctgtgtatgccgagctaccagtttattcaagaaatcgcataaagaccgcaagaaatgatctctgctggagttgctcgtagcgaatgcattgcaatttgtaacagattttttgtctgccttggcaagtgtcaaccatacctgcgaagccctgttctgcgcagtcggaccatgtctcgtctttaggctgtgacaacctagcctgtgggagaagagaatctgtagtagttgcaatcatttcattctagtaacaaaatcaaacaatggtaaaaaggtgtaaattacacccaccgctccaggaaaaactaacttccgagaatgaatctggacaaacgctaatctaaattcatttcaaaaggtgtttttttgggtggagagagtacctctcaatcagggaagatggtctcaccacccatcttgacattggacaggtacatgagcacagtggcaacccggtcaccttcacgagttgagccttgccgtccgctaatgtaatcaaagtgtggctcgtatttctcaccttgcccgtaacgtagtatttgcatcgattcaccgttttctgacagtttgagaatcgcaaaattggcaaaacaatagaagatgatgcactctgcagaacatcgggagcaaggtccaattaagcagttttacagtgctcagtgcacctgcaccatacctgttggaagcatggtccaagccgcaatcctctcctctattcttgcaacaacttcatccttcagataaataaaaaaatttgaggggtcagaagcaattttaactacgacagatcacagatgtgctggcaaatcactgcaagtctgtaagcagaaaattcagtaggcatgcgccatgcagagaattttccggttactacgattcagaaaagagaaaatcatatgatccaaatggggaccttgggatcacttggaaagaaggaactagggatcaattttatgtagaattaatcacaccaatgctactgaaagttttaaacatatttcatctagacccacgaacttacaaagctcatatcgatgtctctaagcttggattattgtatcatcgcggtccaaaacacgtttaaccatgatcttatctacatggcataccacatgaaaaacattcttttatatgaattggactgatcgctctaaaactcctataaaattcttacgtctcaaaaggaatcctggctttacaaagacttggattatttggatgcttatgtaggacaagcgacatcgcgacaaggacatggattttccagctttacaccaaccctggtagcctcacctgcttcttgtcgaggaacatgccggagctggtcctcaccttgctcgtcacgctctcccccgactcgccgtccaccaccgtcgacttctccatcttaccctgcttcgccttcgcgattcacacacacacaagacgcaccaactcagtgaacacaccaacacagatttcccaagaatagaggatttgatttgatcccaacttacgagcgagatgaggtggtcgcactccgcatccgacaggaacccctcgtacaggaacgctctgccaacccccacgcaacagagagatcaaccgcaagtcgccgccgccagagattcgcggcggttgattcattatttacctggggcgccacgagacatcgacggcgcgggaggcgtcgaatcgccgtcctcctcccccgccgccgccgccggcggcggtggcgtacgagtcgccggcgacgaagaggaggaggagaggtagtacggcgaggaggacgagacgagccatgcccgtgcgacggcggcggagacgatcgagcccccacttcggcgacggaggataatgatggatggtcggagacgacgagatgattttgtggggccgcttcgtcagtgagagtgagagcgagagggtgtttataaacgtgggacccatgtgtcgagtgtgacgtcgacgcgtgtttcggaagattcgaaatggcggcgccgggtaggacggtaggagcgtacggtacatgacgctggttgggccttggtttttggttgagctgggggcactggcccgcgtgggccagtgggcctagcggaccgaacagttgatgggctttgagtttatcgtttgagaacggagtaagttcactctgggtccctttgtcgcccagtccaacctcgcctatgtgattgtcattcttctatttgtttcattgtgcaaatgttaatgtactaacctagttatttgtatttttaaataaaacaccttcgaaggtcgatggatgatggtgttatttataagaatggattatggtttagatattaatacatattatattataaatacaacaaatagcaacttggaataagtagtataaacaatgttgtcatataaagttcgttttctgagtaatcatatttttaaattcgtggtaaggatggtccgcgaatgatactatccaaaaataataaatagtttgccacggataatattttatggcaatacccttaatgccacatgcgagttatattcaatgtaagtaaccaatgagaacatcagttggcaacttggcataagagaaatatatgaatgcacatgctatttttcaatgaaaaggtgacctaatctattgaaaacctaaaaaaacttatttacacgggagctttaaagaaaaggagaaattccatatttccattgaagcactatcagtcaataaagcatcaaccggatgccaaaacgtgtcctgaaaaaggcaattctcgatttaacactaatcatcattatcctaataaccatagagaagcataacaatattccaaagccaaacaaagcgagacttaggctgcgttagaacaaaagggagtttgtttgtttcgttttccgcgcgtacgcttttcaaactactaaatggtgtgttttttataaaaattttctatataaaagttgttttaaaaatcatattaatccatttttgaagtttaaaatagttaatacccaattaatcatacgctaatggctcaactcgttttgtgtatattcccaatcttctcaatcacctctctctctctcaaaaacagccttatagtactaaaagaaaattaaaaaaaataaaagtacgaatctcgaggcagccgggtgatccctctccatccgttgcggctgccacccgcggatgccgttaaaccctaactccctccactcccccctatttctagggttttaagcctcacccaaaccgcctcagccgctcccctctccccttcgacaacagcagcgccgccgccgccgcaggagccgcatcgccgggggttcgccggagggagggagtagccatggatcggtaccagcgggtggagaagccgcggcccgaggccgccgtcatcagcgagaacgaaatccgcatcaccacccagggcctcatccgcaactacgtcacctacgccacctccctcctccaggtacagcgagccccctccccccagccgccgctcttcctgcttcgctcccgcgatgcccccctcttgcgggtgccccgcgcctagtagcgggttctccggttagatcttgctgtaccttgtaagaaaaaaaggtagtagtagtaatttttgggatgaggcgaatgcccgttggtgtggtgcactctacggcttggaatatatttggggaagcatgagttaggcgcgtgagtaagacgaggtgtggatttggtgcattgtgtgctgctgctgagttgctgattggaatcttggtgataagggttgtgttgagctcacaaagttcctgcctctgttagtttcgatgtgcaaaaacatgaaagatattaaagatgagttcttttttgttgcgtcaatgcctaaaggaacagcatatggggattatattggtgccgtgcaatgcattgtttttcaacagttaggtagcagggctgtgacctttgtactcacatagcaatgagtgatgagggagctgtttttctgcacggctatagtaggcacatgggatttctcttgctgtggcttgagttaaatttttgagatactcttgttattaatgtgccatgtgccaagtgccaattgacgacaagaactctctgatactaccgtttatgcatgcccgatttaagttgagcgcaatatacaagttttatgtttaatatgcaaactagcgcaacttttaatgcctctttaaagagctggttgttcctataattctgatattgaatatagtggattgtcacacgggtattatccttcaatcacgatttagtgccaaagtttagctctcatcgtaaaaaaaatgatttcctaattcagctcctgcacctgcgctccacaccgatttcaaattatagaagagcaaactaggaaacagttccctgtcctttctttctgcaggcacatcaaactgtatccctgctggccctttgccaccctgtgataagtgtatttgcattttgcccgattggatcctcctcttcaacccccagtctccaagttgactgttttgtttccttctcagccctatgcccatgctagctctattgctgtcaccgaggatctgctgcacgacgagactgatgtttgtggctgacataccttgaccaatgtatctcctgtttttatggactggggggttcacagcatttttattaaaatatgaatgcagaagatgcattcttgtaatccatatttctttttagcagtgtctatattcatcaggtagtccacatgattgttctatttataaccacttaaccagtacaaatctgagctgttatgtaacaactgctggaaatataacccattttgacaacattttgcagtatcactattcacttattttcgtgtgaagtgttatgccatttgtactgaggcatctaccaattgtcaccgtttatgtactctggtatgtgcatgctatgaatcttataacctgtttgtagcaggaaaagcgcgtgaaagaaatagtgttgaaggctatgggacaggctatcagcaagacagtggctattgctgagatcataaaggttagcctattgttatctctcttgctttaggtaccaatatttgaactgttgagcaattaactcacatctaactggcaactgcagaaacggatccctgggttgcatcaagatacatcaattagttcagtcagtattactgatgtatgggaacccattgaggaaggccttgtaccgttaagtttctgagaacaatttcatctgtcagtatattcttggactacactttttctttatgttatttattagtgttatcttgtgcagattggagatgactcgtcatgtttcaatgatatcaatttccctgtcaccgaaggagcttaacaagagttcagctgggtttgtttgatttgctcttatctcctcagtgttcaattcaaataatcacactaccatagttctgaatgaatgtagcaacattttatcgtccttttgaaggtatcaagctcccttgcatgcagagccaattaagccacaaagataccaacaaacccagcaatatcaacaacaacagcaccagtctaggccaagccaagttcaaacaggtgaatatcttttcactaatagaagtattttcgtaccattataagccggattgctaacttgttccttttgtattggagattcatatgggcgcggccgtggtagaggcagaggaagaggaaggggttggggtggtaggggaggctatggtggagggtatggtggatatgataacaaccaaggaggttatggtggatatggacaccagggtggatatggacaccaaggggggtatggcaaccagggaggatatggccacaatcaaggtggttatggagggtatggttacaaccaaggtggatatggaggatatggtaagtaatatgatgatatgctagaaatgtttattatgagataatctctcaatcaggaatttggtgtcctgaaattgtttgcaatcatttatagtaaccatttatcttttcagaaaatggtggctggaactacaaccggaacagaggtggtggtggtggcgggggccgtggaagaggcaactggggatatggtggtatgtactatttaataattgacaccttattttattcatgaccaagtaagctgttctgtgttcatgcctctcatatgtcagaggtactagtgttcttctgaactagctattatgttttacattgttttaatcggaatctgataattatttacatgctggtttactaagaataaagtcttcacaatttacttcttgtaccgtaagttcaaatccaccttcttggctcccatatatttgaacggagtaacaatttttaacacacgctgaacttaaaatagcaacagtgtctgtcatgtaacacaattacatgaaggtacttgaaatgagtggaaaatgatataatatgttgagccttttctaaattatccaggggcatttcatttccaaagttatctgctttaccttcactttagtggtatctgtttttgtttgtaccaaagaataggagacgtttcgtcatcttgcagcggcataaaacatccaattgtggaaactgttatttcaggtccaggaggatatgaacgttcaggtccggcatatgaacgtggtggcagaggtggaggtagcccaggcggcagaggctatgcccggggccgtggacgaatgggcggtggccgtgggcgaggcaaccaaaactattagatcgactttagttggatgtgccagcccggtcgttgggtgctgtatgaagaacaaaaactgtggatgcgttctccataggacggaaccctagctgtttctttgtgatcaatcgactagtcttcccagcttttcgctataatcatcaatggtgtctgccattgcttcgattctgtgggattttgacaagaatgttaagttttaccttggacatattttcctgtatttaagagtgcatttttgaatagcttgtctatcttcctccagcttctgagtttcgtgtttgatgtgaagctccttggagtgcaccagtcagactcttctcaaccggaagaaaatgaattctgcatttgttcatggaaaagcagaacagaatttccgttgaattattaagtttgttgcaggagtacttcacgatcaaaatcattaggtcatcatctaaagaaaatcaatagttcctcaacatgtcccttcaaacatttctcaagatgggtttggacggggttgtttgcagttctacgtcactgtgtttgattgacatttaaaaatggttatcatgcggtataatttctatctgaataaaaaatcaccccatttgatgcacatactatttttaggagtaacactacaggctttatccaatagttaaattctatagaaaataaaagataatccatatttacatctctactattataaaaattgaaatgtttttgctggtagtttggtacgtcatccatgtatgagtcggtttttaagttcgttcgcttttgaagtatgagtcggtttttaaattcgttcgcttttgaagtatgagtcggtttttaagttcgttcgcttttagaaaaacagacatgcatttgagtcaggttttaagttcgttcgcttttgttttggaaaaacatacatgcatttgagtcaggttttaaagtcgttcacttttcaaaatacaggaggagtcatatgagaaatctctttaaagaaacttgcatgctaagttgagatgatttgacatttaattgcagctcatgattttctagaaaaatatatatcaagtgaattctcacaataaaactattatgaagattgaagatgtttttgccggtacattggtacgccatccgtgtttgagtcggcttttaagttcgttcgcttttggaaatacagatctgtatttgagtcgggttttaagttcgtttgttttttggaaatataggagcagtcgtataaaaaaaatctctactattataaaaattgaagatgtttttatcggtactttggtacgtcatccgtgtatgagtcagtttttaatttcgttcgtttttgaaaatacatatccgtatttgagtcgatttttaagttcgtttgcttttggaaatacataaaagacttctaattgcagctcatgattttctaaaaaaaaaaatttatccaagcgaatttctacagtaaatttcctctcaactaaaccatataacaataataaaattaaaatagcctttatccgttgtaatgcacgggtattttttctagtgaatataaaaataaaagatcacatgattaaatattgaacaaaaaagaaaagaaaaatcactacaactctaagaataaggattatactatcaaactaagaactgctcactgttgagataaagatgaaactcatgtagataaggatgaagatgaagattaattgttttacacaaaacaatgtggtattaacgtatgattaattaagttttaattattataaacttgaaaaaaatatttatctgatattttagagcaacttccatataaaaagtttttgcacgaaacgcaccatttagcaatttgaaaagtgtgctattaatatcaaaattgtcatccaacttttgttggagaaaaagaatgggcatatatctttaaacacatcatcataggaaccttgactattgaagttgtgtttagctccaggggtataaagttttagcgtgtaacatcggatatacagacacacatttaaaagtattaaatgtaatctaatatcaaaacaaattatagaatccgcttgtaaaccgcgagacgaatttattgagcctaattaatccgtcattagcaaatatttactgtagcaccacattatcaaatcatagcgcaattaggcttaaaagattcgtctcgcaatttacacgtaatatgtgaaattagttatttttttcgtttatatttaatattttatgcatgtgtctaaatattcgatgtggcaggctctaaaatttgccagggatctaaaaagggcctgagtggtatagttctaagctactcactattgagtgataaatatgcctattatggggctttggcagctataagatctgtttgggaggttctgcaagctgctgtttttcataatcaaaagttctccaaacatttcagtttttcattaggattctgagaaactgaagttatagaatccataaaataaactataagtcaaaagttgagtttagcagtttctccatattcctagaaactgactgtcaaccggttgtttctatatccttaaacggaacctataattccttttagaatctcatctatagtctggatctacacccttttgtaaaaaaattctagctaggttaagaaacaacctccagtaataaatctatatataggctatgtctatattcgtattagaagtttttattttagggagtgatggaatttaaaagtcacccctacaaaatacagaaaacaaaataatatagtagctagaaactaaagaagtactccctctgtttctaaaaacttaaaattaaatgaaacacactatgaatctagacaatgttcagattaataatccttaggaaatatcctggttattatattttaggacggtagaaagttttctgaattttcattggttgtttattactagcttcgagaggccgagttgctccacgtggagagagagaggagcagagagatggggctgacgtgccgagcaattccatgggccgtgcggctacacgaaaccaggtgtagaccatttccgcttgcacagcacaacgcccatcatcctggatccccgtcacgcgaacgggttagctaagctacagtcacactagtactccctattaaaaaaattaatataaataagaattcgatatcacttaaacgaatatagataaaaaattatccagattcgttgttataggtggtggtgtcgtatccttatttcggttttttttttttttaccgaaggagaacaccgttggccagctaccggacacgacccgatgaacatgcccgtctaggcgtccatcgagtccactgctccagtacatccgaacctggacgcctctccgtccaggtgcttcgcacggccagatccatcgtcatgatagactggctagacgagctactctcgttctcccttccccccccccc

SEQ ID NO: 62937 - DNA, 15573 bp, Oryza sativa
cccccccccccccccccccactctcctcgactagctatcttgctggtaggtatattacagggacagctccccctcccctcgccggccgtcgcgctctcgaagccgtacgctgttcaaagcgaagcgaatcgaataatcgatcatatccattgcctaattcgtagcacgtcgatggatcagctggtcgtcggcgtggcgcggccgtcgagcccctcggcggcggcgcacgtcgcgtacaagatcccggccggcgacgggccgtacgctcgggccaagcactaccaggtatatataagctctgttttctctcgccggcgttcatggctggcgccgccgcgtccatggggaaattatagctctctctatatatgcatttatttatatattagtagatgctttattaggttaggtaattaatcaggatctagttaggaccgagacttggtacaaaggccttaatggttcttgctcgcttatttcttttttcgaacgaattccttaatttgctaacttttttttgagaggaagatctggctaagttgtttatttggttattactgcttaaatttcgatgagaatatgcagaggaaaaaaataaagaacattacacggcgtaagaatacaataattaattttataacgtactccatatatatacatgccatatggtacagtctttactacaatttaccaattaatggatttcgccaggttggctaacctcagcagatctaatattgggggtgttcgtttgtgctagctctgacagctgttatggctgcagccgtagttaaatttttgatagctactactattgttacagctgtgtatagctgcagagtagcggaaacgaacaaccccattgtaatctactcccaactggtacaaaatggtattaaaatatattttagatacatatttcatattctcggtccttttttgaaattaaaggacctatatgtcctctagtcatcaataaaatatttagttttgcacatcgatctatcttcgaacaacaccagccactattttctattattgcatacactttaactcaacgatattttcatacattgaatctacttattaatacttagaaaattagtactatataaggtcaaagctttaaaatattttttccataaatatttctagaaccatgcacatctataatttctatttagtcagtactcactagcaattttagaagataataaagattattatacaagtatattacaacaacatctactagcaattattgtactagagagtatcttaaatctcattcaagtatgagacatcatctagaataaaatattatataattatgttaaatcatcttcctcatattattttcataacatttcaacttccagtatttcatgatatttagcatatattcatctattatttgtgtagtaaaagcataaggtatcacctagtggttctatatgactgaacttccatatacaacggctttgcatgcatgcatgcatgcatggtaacgcacctcggagctagctagctaacgaagttcactttcttttcagctggtggagaaggatcttgacgcgtccatcgcgtggttctggaaggcgatcaactccggcgacaaggtggacagcgcgctcaaggacatggccgtcgtcatgaagcagcgtggctaccacgccgacgccatcgacgccatcaagtcgctccgccacctctgccccaagcagtctcaggactccctcgacaacatcctcctcgacctctacaaggtatcctctcactctcgaccggccggcatgcagtaatggccgctgcagggcggatccggcacagggatggcggaatctcgagcccccactattagcgtgaagaccatgagaacccccacaaattctccgaattcttttaccatacgtagatgggagagaggattatagctttatctaattgttcagacccctctgttattcagtaaatgacattgttgatgatgcaggcgagcgggaggacgaaggaggagatcgagctgctgaagcagaagctgcggaagatctacctgggcgaggcgttccacgggaagacgacgaagcgggcgaggtcgcacgggcggaagatccacgtctccgtgaagcaggagacgtcgcgggtgctgggcaacctcgcgtgggcgtacatgcagcaggggaatttcatggcggcggaggtggtgtaccgcaaggcgcagatggtcgacccggacgccaacaaggcctgcaacctcgcgctctgcctcatcgagcagcgccgccccgccgacgccgaggccgtcctcgccggcgtgctcgccgggaggtaccacgcccgcgacgacgaccacggcgccccgcacaccggcggcaagatcctcgccaaggtggaggagttgatggcccgcatcaccggcgaggtcgacggccggagcaacagcagcggcggcagcagcagcgacgacgacgaccgcgacgtcgaggacgagatggtggagctgctagacgtggtggtccggcagtgggcggcgccgtacaggaggagcaaccggaggctgccggtcttcgaggagatcactccggtctgcagggagcagatggcagcttgctagaagatggtaattaattaagagtagtagcaaattgttaattaaattagcaggtccatcatctagtgttgggtagatatatagaatttcatgcacctatccgacgtgtcaacggcttcaactttatagggagaactagctgcaggtgcatgaagctaagcatgcatggatgtttttttttcttgtgagtgtgtgtgtgtgaaattaatagtgtgagatagagaagtataatgtgtgtgtgaccagttgcatgttttgtactctggttgtgttgttgtgtacttatgtagagttgataagtgcatggcttggtgaaggatataaatgtgtacataaatgtctggtgtattcttcccaattcaatatttccgttggaaaaaagaaaatattttctatctataaagcttatgcccattaaacacctaaagcttaacatacaagtataatgtatttattgccactcctaaaatctgcatgcaaacatgccacatcaacccattaaggtggtgtttgggaaggatctcacaaaaattttagtctctgtgggagagacttatacttttgtgagagtgagacttatacttttgtgagagtgattaaagtctagtccctccttcccaaacaccatataagtacacaaaactcaacatgcaaacatataataattatatctataatttatttcattctaaactaaacatacacatgctaaatcatcatactaaaatcattttcataatatttcaatacaaattatttcatcatttctccaacacttaacatatagggttcccgcagcaaagcgcggggcatcatctggtttttatgatgaaggataaaagtctaatcatatctatgaatccggacatgcatatgtccaaatccattggtagcgttggatttttttaatgatataaagggtgtatgtattaacgcattatattatctgggtatatgaaaatagtgtgtatattattttagaaaatcttctttaatacgtcatttgctccatattacaattaatgtttgttctagtcaaacttttcaactttgatcaaggtgcaacatttttaacccaaaacaaatatactataaaaatatatttagtggtgtatttaataaaattactttggtgtttaaaacattatcatatttttctataagattggttaaacttaagaaagtttgacttagaacaaaaccataacgtcttataatataaaataaaatttctttatacaatattaggtccgttttattgcctaagaaagtttgaattggcttctcactgtatagttgcaataaaaaaatatcttgatatcatatactagtaagatgcaactgtttcaagttaaaaagggaggatgctatgtggcagtcaaacagtcgttaaatatagaagagcatgggcctggacaattagctctgtacgaaatatattgaagcaaacatgcaaaattacctcttctgaattacaagaatactagtaatattacattgtagaaagaatatggacatccctgtacaagcacaggagagggctctattatatattgtgagcctttgggtccagaaataactaaataaaagttgatgagctagcaacaccatcaatcaagctgatagattcatggtgatttcgcactccctatgtgacagttttgtttcaaaacaataaccctctaacacgccctttctccttttttatgtgtgccctttcttcagcattatcagaactgaaggctatagcaaatattaggtgaggtgagccgtatatgtgttgtgtgttaccagcagttcaagtcacggcaaaccgtcaagatgatgacgaggatcaatgcaacgacaatgccgaaaacaatgagcttcatcttcatattctcccaccacatctttcgccgaatctttgttcccgcttttctaaagtcttgtgcctataaatgaaagaatgaatatcatcatgtccaatagaccacatattgtgcaattaagaggaaataagattatgattcaatgtgagagcaaatgatgaaacctgtgagcggagatcctctgtcttgtcgacaagcagctcaattttctcaccacgatctaaaacctgatgcaacagatgagaagaacacatttccaaggcttcaaaaccaccattgtaggctgtatggaccagtgtccaattggtgacagtaaagggaacactaaccttttcaatgttttgcatcataactcctttgacctctgtaacctgagccttcactttggcaagcttgtcaatctcctcagggtgcgcatcacagtacttcatgtgttctttaagtttaggcctgataaaagaaatcctttataactagcttattcagattgtaattaagggcactcacaccatcatatagccatataaattatgataactcagtaaaattttgcatagaggccatcaagcaaatttttaaaggaaaatacccatattctcgcttgaggctattcgcggtagcattctttgcttttcctccactatatttcttggaaaaatcttcctttactctctcaatgaagccaactggaagttgccgaccagcagactcggtagcaacaacacagtatgctgaaaaccaaatgcattgtcaaatgggaactagcaaaattgaaacaattctatagcagtaactttgctgttcaattagttttatctatactaaacaccaaagaaaataataaaacaataattaataaagatgtggttttctttaacattaaattttacaccaaagaacatatgggatgaatctttttttttccttatggttatatgcgatgaatctcaatgaataaaataggcgtacctttcaaagacaaaaaaaaataacacttattcgtggcatgtaatgtttatataaggacaaagtaggctatggtttgccttttctccaaaaaaccgtaggctatggaactaatatcgcaatgggagtaccaacaaattatcaaagtgcaaatgaaaaggtaatgctaaattgctaagtggggaaaaaaaacctaacttgaacaaacactgaagatctgtaggttttcaataacaaaaaaagatgaagatccacaacatcagataaatgaaatatatattgttgcacattaaaccctctagaaacgacattatgcttataaaaaagaagagttctttttgacaaaagaaaaggaactgtacacctcacttgtccagatcttaaccacatagttaaacgagcatttctaatcaagtaacaacgaaacaccacattaattaaactgatcagtctaacatcaatcaaacaagacaaactatgcacttgcactccgaacacgcccatccaccacattgcaccacgacaaacacggcattaacccagatccaccatggaatagcccaacatgatcccaataagtcgagttgaagggacaaatggtgcaaatgcatgcattgttgaagaaatccgatcgattaaacagatacgacacaacgatccagccaatgccaaatcctaaagcatatccatgaccatgagcagcgaaatggagaaggaaatagaatcgcatccttcaaaacgacgctaatcacatactgtcgatttaaccaagtgatagtcatggaatttttaatatacgagaatcgagaaggggatggatttttttttttttggggggggggggggggggccattactgaatccgtcgtggacatggtagttgaaggtgtggccgtcgcagttgtagctgtggcggttgttggtggaggggagcttctggaggcactgcgcggcgacggaggcgaagttgccggagacctcggcgtggtcggccagcacgacggcgccgcgcgccacgaagctgtagaccagcgtcgtcctcttctgcggcgccatgtccccccctccggccccggccgccgccgcctaggctacgctacgctacgcgcgcgcgcgatcggggaactcctcggcggcagatggagggagggaggcgggcggtgggaatgcgcgggagcgatgtgtgggaggcgaggaggtggggggtgctgcatggagagaggaaggtggtggtggggaatggaggtgggggaggcaagccacatgctaattttggctgatggttgattttctgattttttttcccctcattgaatgatttgctaaatttaggtgttattaatatttgttgtttagaaaatgttataatctagaaagtttttatcgccctcgccttatcccgcatcgcagccgccgtcgccatagccgtagtcttctcctgcatcgcagccgccgtctcgtcgtcgcagccgctgccgccctcgccttctcccgcatcgcagccgccgcctcgtcgtccgcctcatcctcctctcccgcctcgccccggcggcctttgccccagccgccggccggcttgtcggaagagaagagaaagagagagagagtaggaagggagaggacggggaagagaacctgctgatatggcacctgatatatgggtcccatgctgacttaaccaccatgtcggataaaaccggggtcaaaaccgccgagggatctagtttacattggttttgtaagttgaggaatacgttgcatccggttttacggttgtgagatgattctataactcgatgataagttgagggaccttcaatgcacttttatcctcatagatatagctacgtgcggtgactatgggtggtaatgaacataactttttttctgtaaaatataaggactgagttgaaaaaaaggttcggctgacatttaataaccctaacatggacaaaaatggattgtgaaatagcccatgagttctggcccactaccaccgatccggtagcggaaagaaagcccgaagactaaaaaatacggcccgtcccggcccatgcaaaaccgcaaccgtctatctcagcttgccttctctctctctctctctctccatcatctatgtaccactccgcccgcggcggcccgatctccgatccgcacgcagcaaacctacctccagagagagtcgcgtggtgggtgtgggacccacaccccaagtcgaaatcgcgattcgattgccattttctatcgcgcaccctcccccccctccaatctcattcgttcccctttcccatgggccgaaagaagcgaaccctcaacaccgccgccgccgccgcaaaccctactcctccctcccctccggcggccggccaccccgatgcggcggcggcggatggcggcgccgcggtccgggccgtctgcgagaaggccctggcagcgctgcagcgggggaaccacgcgaaggcgctccgggtggtgaaggacgcggtcgggaagcacggggagggatcgccgctgctgctccgcgcgcaggggacggtgctggcgcgctacgccgcggtcctcgacgagcccgtctcccgcgcgcggcaccagcggctcgcgctcgaggcggcccgcaaggcggtcgagctggccccggactccatcgagctcgcccacttccacgccatgctcctctacgagatcgcctccgacaccaccgggtacgaggccgccagcagcgagtgcaaccgcgggatggccatccagagccccaccgacccggcgccccactccctcaggctaccggccccggacgtcgagcaggtcaaggccgagctcagcaacctgttgcagaggtccaacatgacgtccatctcgctgtgggttaagaacatgaacatgggctacacacctgaggataaggttcgggttttccccattcgccgcggcggcgccgacgattcttccgaggtccggctcctgcctgctgcgcctgcgccgcgccgcccgaatgagatcaagaaggctaataagacccctgaagagcggcgcaaggagattgaggtgcggcttgctgcgatgaggctgatggagcagcagaagcacaatgccacatcggcctcatcatccacctcccaatcacagtcaccgggggatgaggccccctcctcgtcgtgtcagtcatcagtgtctgggcatcgcgctgaccggaggaagggtgggtccaggaaggcagcagcttcgccagtgtccggtcgcatgaatcaggtgcgtgagttctgggccacagtgcccatggatcggaggcttgcattcttaagcaccagtatttctgagctcaagtcacactacgctactgcgatgcataaggagaaagatgctgccagtttggtatctgatgtgcttaacgaggcgataaggtttgccactaggagtggaaaatgggagtttttggtatgtggccggtgtgaggagcattttgctgatgctgaatcacatgtacatcatgcaatggaggaacatgtgggtgtactacctccccggttgaatgatgtggtgccggaggagattgatgatgcctgggcagaaaagctcactggttcaacctggaggccggtggatgctactgcggcactgaaaattctcgaggaagaactagctgacaatgttggctcagatagggacaaagattcaatgtcatcggatatttggagtacaaaagataaatcagacacatcagattcctcaacctcgccacacaacgaggagtgtgaaagttttggcgccgtgacaagggaaggtgacaggaagtggccactgtctgatgatgaggaaagagcaaatattttagagaggatccattcgttgttcaaaatcctcgtgaaacacaagaatctttcattgagccatctgaacaaggttctacatattactatggaggaactcaggaagatgcattccgcgtcactgctgcttaaccactcgttggatgagtcaccactctgcatttgtttcttggatgtatcatcactgcggaaggtgctcaaattcttgcaggaacttatgcaggctagtggacttaatgataggaacacagataaggatgaggaagtagctgacaaagatagtttcccaaaaaatcgcagtaacttggagaaggttacacttgattctgattcatcattgcttatccttgatggccaggcatttgaaatgagatctgaccgtgataatgttgttgctgacccattcctttcatggttatatactggaccttcagttgaagagcagctgttggactggaaccatatgcttgatgtgaggtctgatcagtgcacgcacattcttcatgagctcgagaaagagttctcagccttgcagaactcgtacgaacagaagcatgaccagctgagcagtgaggagggcttgcttgctgtggatagccttttatgtgaagagcaaaggcggagggacgacgtggatccctatccatttcaaggatatgaggagctcctaaagaagcgacaggagcagctggagctcaatgctgaggaattgtttagcggttgcagatctgagctacatgctatctctactatcttaagggaagttaaaacagcaccttttagatacgatgaaaccttttctggcatgacctcgaaccatcgtgactatgatgggacagaggaagatgaatggggtttttatgactttgaacattcaaacgattcggtggtacagttggttgtttcaagactgaaggaacatgttgctatggaggtcagttcttctgggtgttcagtattcccataaaaagttatatctatttcacttacagcttaacacgtaacaactaacaatatatccctctcttatctgtttcacttacagcttaacaagatagatgctaggattatgcgaatttcagccgtgattgagcagctgaaactcaagcttgggcctgcttctgtccttgattaccgaacaattatccttccccttttgaaatcattcttgcgagtatgtgtacactaatctctttactcattcaattgctttaatacctccttgctttgttcatttcttaatcgtggttattgtgtgacgattcagacccatttggaagagctggtggacaaggatgctagggagagatctgatgctgcaagtgaagccttcctggctgaacttgctttggatgctaagagaaatgcaaacaaagtgagcgacacaaaacaatcccatgataagtcaaaggacaagaagaaagtgaaggattctcgaaaatctaaggatcttaaggtatctatgcttttgaatttgattatatgtgtactcctgttactcacaaaagggtattttatctttttcctaaattacatctaaatattttctaggatttgagctggagtgatcagtacctcgtccgcccagatagtgtagacgaggagacatcagagcaatcgtaagtaatgcttttactctccttttgctgataaaatcgcactatctaaaatgaatctgaatgcaatgtgttgcgcatgttttctcaaacgtgcatggaatgccttcttttttcatgttcccttttctctatgtatcctcagttacttagtaatgctaaagtgctaatctaaatcacaatcagtgtaaggatttttggttagaaagaactcatttcatatgctgtctgtgttgttttcttgttaaatctagttagcaattaaattaactagttataacttataaggaaattgagaaactagtcagacagctcacagctgagagctgacctttgaagcaagctggaacctgcttacaatattggagaaagtaaattttgtgcatataatcttcttgacatcatgtgaacacatgtgttggagtttacttgatctcaatctttcttttggtaaaccgtttcaaccatgtaaacctgctcaatgtttgtgcatctgttttgaataccgtcttatagtgcttctattaacgtggcacgttcctttcactattacagcttgtttagttgagtggttatcaaatgttgatggttgagtaatcctttattgagccctcactagttgtttcgctctttagcgaagaggaccaattactatactgtcatactgtttttcgtttcctttctcttttgcactggctgctgcatcaatgaatcataagagctccagcccttcctttagggaaaaacaatcctagcaatagtgcccatgcattgtttctgatcaaatagatataaggccagtaccgaactaaaaaatgcataacattatcctcaactttacataattacatattttgcatcacatcaatcaaccagcatgatgcaatccttttaaaaagtgtttatcgtacaaataaaacatgcatacttgcttatatctattcacaacatgaattatgaactgaaaccttgaaggaggtatgtcagaacatatcatcacaaccaccagctccataaaaaggagtaaagaggcatgtcagaacacatcatcacaaccaccagctccataaaaggagtaaaggactgtcatttatcttgagatgtcaaccaccacacattttagaattctccagcaggcggtcagggacatgaaaatattttcgatcttgtggaattcattgctttgaatcattgtttattatctgctgtgggcttcattggaacatactgcagatgttttctaccttccgttaatggctgcattggtttttagtcatgtgcagcttgaattaaaaaaagagaggcagtaatagaatcgtgaaatgcatctcccttttattctatcctattctgcacatgcactatatcacgggtgaggctagtatgcaagaactcgctggtcgtgagggtgcaaatgcattccgaaaaatcttcagcgagggcgcgccgcaacacactcgtgtaccattgtgtaattagcatgctgccgcttaattaatgcaccaccatgtgattagcatataattagggtgcagttatttgaaaatctcggccgcatgcatatgcatttggctgataaaatccacaaagtaattaagtgttattgtggtgtaggttaaaaaaaagatagcaataccttccaatcaataaatttttatccattttttaaaacttcccattgtgataaacacctattcaaattttaaaatctctactcataagttttgtgcaatataaaaagtttgtattcataaactttctatagatcaatattaccaggagacttttgcagtaatttaaatgatctactgatgggattttaaaaaatgcaaactgtaagattcaacaatctctacttataaactttctatatgataaaagttctatttgaaaacttttacagtaattaaaaaaaaactagtgatggaattttttttacaattacaaattgtaataactcagcgagtagaaattttaacaatgattgcatctacatgcaaaagtattctatatatgcaaacatgcatgcacatatagagctgagcgtgggcccacccacgtgcgcatttgtgctatctcggctcgcatgagcgtcgcagagtagccttttcgctatatctcccatctggtgattcaggactcatgcaacaccatttcttgatatacaatatttggttgttttgtttgaattttgggagtctgtcattctttaggttcatgtaatggtggtcatagtgcatgcccctgtgaaaaaaccattcttgaatagaagtgtaatctttatcaacattgatattattatttgctttggaactttcatgtttggatgagttcaattttattgaccatgtacactattgcagtcagactcttgttgattgtgatgactttgtctgcagactttcaacaagtgataattacttaaatgatcaagaagaattcaggaatcgattacgacttgaagcagaggaaagaaagttggaggaaactttggagtaccaaagatggatagaggaggaagcaaagaagaagcatcttgcagaacaacacagaaggacttcaccaggttccgatgggtcagcttgccttcggactgatgtgaatttgaacggggatcaggataagcaccattgtgctcaaaataactcacacactcatcttgagggcataaattttggtgattttcggttttctgaagttcctttgcaggaagaacattctattttgagatcatgtgattctgatcttctgcaaacaaaggagaaaaatcataacgaggtacataatggtctgggctatcctggtacacgcccaatagccagcagcgatgtggaccttattaagcctacagtgaaagtgaatggagtttggaaaaatgtagaatatacaaaggctacactgaaagcgaatggagttgggaaaaatgcagaaaatacaaaggttccaactattcctagcacccaaaagtctaggagaagtaccagccaagctcataaaaagtacattcaaggttgttggtttgtcttgtccaaatcagatattttattttaatcgtttttgcaacttcaatccaaacaattctttacctgtatgttttttaaggtgtgacaggcacttttcctgttgacgatggtgatgatgatactaggccatctattcgacaatctggttcaccagtttcaagatggagcagttctggtaaagcagttgacactgccaatcacagttatcaagacacaaaacaaaatcagctaccactattgtcttattcacaccgtgtgcatggtgctcactccgctggaagagagaattcaagtagtgagaaaggttagttggtgttcactcttatgtttcattcttattcatttaacttgtgcttgtttattcgttttaactacttttattgaaattgaagagtgtattaactccatgttgcacgaaacttaacgtgttaaaactttgagtcgccagcacctaaaatgatcctagccttaatctgtctcctactcgtgaacttctatttaattcaaagaaactggcagaatgttttccagctcaattgtcactcgggcatttaatttttttgccacttttaagatgtggcaatcaaggatttgccactcagtctatgacatgtgggtccagtggcagtggcaaatccttaattgccactcgtaagagtggcaaatagttaaatatctctctgatagatgaaatactctatgaaacatgcaatccatttgttactatagttttgtttgaatgctcaagttatgctaaagccttaaggtctgtgaagtattaaaacagagaaaatgcatagctattcttctagatatttaagtgtctcttttcttattcattactattgccatgtccatgttggttctttttttttttctctatgttttctctaatcacctattatttttggtggatttctgaagcttgattagatggtagtaatgtagtatgttagatttcatatttcatagttgatcttttgatttgagattttttaaacgtgttgcttaatccagttgacagtagtgcaatcccatcaacaaatctgtacattgaggatgacaaaaggttcaaagcagaccttgagagagctgtgcttcaaagccttggtatactaaataccctttttttgctatgcttttcttccctcttatcaacacgctcttactttggaccttgaactgctgtgaaaatttcaatattagctagctccatgataaatgagtcttgtatatgttatctgttaatagctggagatgtttagttgtgattttggttactcagaacaagtttttttttatatgaactgccaactagtttgttgtagcatatgcgtggacatggtgatgcagtattgctaaaacgaagactagcttggctatagccccaaagtgaaaacaaaaaataattcgattttaggaaatgcataacattacctccaacaaattaccgattttgagttatttagtgtgtggggtgcatctttaatattattaatttttaatgagctgatcaatgactgtgattgacattgaaatgatatgtataaagtgcaatttgcaatgctaaatgtcatactaaggatgttttaagtaacaggagaatatgccttttgtcttttcactattgcttcattgtcatcatagatatttgactat

SEQ ID NO: 62938 - DNA, 30391 bp, Oryza sativa
  unsure (1)..(30391): unsure at all n locations
gcaaggggaagctgtcgcacctacttctttgaggagcgctgtgagcaaatcctaccccaacagcaaattctttcaggaggtacaatcttgtactttagggattttgggcacattcctaacagcatttattatccaaaagctcgttatgcatgtataacaacctactaattcggatacaccccctatctactctgcttgttgtctataatgcatgcagtcaatgttctgaatcattgaagtttgaccacaaacatacataaacatttaggcttgtgagatgtaatttcggatactaaatttgctgtcagaattaatttgttcaatatatcttcattgcaggggcaaatgaatgatgcatctgaggttttgggggtgatctttgagtgcttgcataagtcatacacttctcgtgctgactgccaagttaaatctcatgagatcaattatattggttcctgggattgtgcaagtagttcctgcatagcacactgtctttttggaatggatatccttgaacgaatgaactgccagagttgtcggttggagtcaagacgactcaagtacacttcatttttccacaatatcaatgctagttcacttcgaactgcaaaggttagtataccctgggttggatctcatggtatttattgattctattatttcctttcttctgtgattttttggcatgttatttcctttcttcgaactgctatggtttgttagttgttacttgttccatgatgctattttttttttttcaggatatgtttccagatcattcatttgatgatcttttgaagattgtgataatgaatgaccatctagcttgtgatccagaagatggtggttgtggaaaaccaaaccatattcatcacattctttctagcccccctcatgtttttacagttggtaaacttctttatcttcaatatgtatggatatctgcttgcaaccagtcgtttcagtccaggaggaaggagccataacaaatatttaatcttgcattttcgttgtgtgtttgttagcgtaatgctacacaattgcctgctccatttacagtctgacttggccatctttaaccaaacaactgctattccattggcttcctgcctgataacttctacatttgctattgaaaattttctgcatgtgcttgagggcatgtaagttctctgtgtaataatactctttattgacatgactcttcatacttttgctttttcagttttggggtggcagaacaacaaagaaagtgtggatgacatatctggaactttggctggtatttcaactgagatagacatcagtactttctaccgtggtctagaccaaggaagcaaacattctctggtgtcagtggtatgcctatgaggactcattttgttctttcacataatcacatttttgaatggataaaagggcatgccatttttctagggcatttcatgtttgtataagaactttcaaaattgacagtttgctaaatgaatggtacaataggattggatttgccttttgtattaactatagtgaatgtgctattagcctatttcaagttacacagtttgcagtacaatatttctgtcgtgaagtaggtactactggagtttactgctggcactatggctatactgtgggtacattgctaacatttctttttcctattgccattaggtgcattggccagtgggtgtagtagcattagctcaatattgtatatttcactatattacctaaccgcatctaaatccagtcttctaaagtagaaaaacctgtcaattaaataatgcatctagcctactatttttacacatgcaggtctgttactacgggcaacactatcattgctttgcttttgaggatgggcagtgggtcatgtacgatgaccagactgtgaaggtaacaacattataaaccttcagaggcatacaactctgctgattcttactctagcttataagaacttggttctggctcgtgttcttacttgctcccttgtttgtgcaggttgttggtaattgggatgatgtgctcgtaatgtgtaagaaaggtcacttgcaacctcaggtgctcttctttgaagctgcaaagtaattgttccttcagataggcttttccttgtggtgttgtgaagattagaaattgataccaaattcgttttgagctgtgggggataaaggcgtaaagtggtaattcagcagttgcactgatcagttagttttgtcatgccccgtcataaataaacggtcacatgagaatactagaaatagaaaagccagtaatccttttgtttaggttttttggagcttcggtatagttctgatccctgatcctgtcaataagattttggcataggagtgggagggtggccattcgatcgtttgccatctagaggatagagaaaatttcagagattcataagcattgctgaatttattttgaagctgatccgaatgcatcgacgatgtacagagttgtgtttaccatgggaaggctataggggtggtgttcattagtttttggagaagggcgagttgtgatgcaaaactggttgtattcgttggaaaatgttggggaagggatatgtttttgggagcacggtgcttacattgaaatgttacagaatttccataatcctggcaatgttaaaatgaatggtcgccatgttctttaaagcgatgttaaattgcctgagtgtgttactctggctggtctttgcaacagtactcttcgaattccaagctcatacgttcactattttcctcgattatttccatcatgaagatgcatttatttctcaatgggttgtacagacattgcgatttaagtggtaggctaaataaggctttcgctgttatcctatgcattattgcaatctttagagtggccagttttacctggtgcgatctatttttagtcgtccctatactgagttctctctttcccgtcatagtagttcctctaccttgtaaatttgagactggggtttccaatttgtgcgtagcagagcatattgaaatggacaccggggcacagaaggatgttgaaaatgcgagacactgaattgttgcaataaaaatgggttatgcagcgcaataagcttcgggcttgtttagattgatgtccttttaaatcatgttattatttggtaaaattgataattatttggttatacttagtttgttatcaaattttgatgtctattatcaaattttgatgtctacgtaatcttgacaacattatattgagcaaattctactaaaacttagcaatattattcatttgtcaaaattttgacattaccgaattttggaaatgttcattctaacatcaatgtgaacagacccttcgttaaaccttggtaatgttatcaatttgttaaaaatttgacattactaaattttaaaaatattcattttaacatcgatgtgaatagacccttcgttagtagtactcctatacatgaaagttgctaggatggtttggtggacagagcgccgccaggccgctggaggccggggtggacggtcgcggcgccgcgctaattgcggcgaggcagggcggcgccgcacgcggcgcggtgccggtgccggtgccgacgccttcgcgtgcgcggcgcggcggaggcattataatggcctcgtgaccagctttctcgcactcgaaggccttaatttccgggatccaatgggctaaataaaaggcttcgcggcatccaaaatgggctgtattcaattcggcctgatcctaccaaggccattattagttttctggaatgagagaaaaaaaagagagagaatattaaattttgcaattgaattttgtttcactttgcagcaagtttagtattgatttcactttatattacaaagggtatacagaaaatatgtttcactttaaactggtttgtactgtcatataaatgaacaaagtttcgtcaagattttatgaaatttcacaaaatttatatagttttgatgatgtgtgttgttgtaaggtgaaacttatttcgatgcactttaggccctcttcttttctccaacaagagttggatggagattaagattttcgtggcacgcttttcaagctgctaaacggtacgtttcgtgcgaaaacattctatatgaaagctgctctaaaatatcatattaatctattttttaagtttgtaataatttaaacttaatcaattatacgttaatactatatctcgttttgcgtaaaaaaacttaatctttatcttcagaagaaaagaacaccacgccttagtgtaaaatcgtcgtatgtgctaaatctgatgcaaagggacataagatactcgctaagataaaggagaaagtgaaaacctggacatgagcggaagtgaaaagactcatgaaaatgttaccatagcttttttaaaacatttgtatagctttttttttattatttctgaagtctttgtaaatacttttactcctactctacattgaaattggcactatcttgtgtcagattgttaaagaaaaaggagctctttacatggtgcaaaacgcaattaacattgaaataaaaaaaatccttgattctactccgtacgtagtccatatattttctttcagccttcttgaggttatcggcttactgcacgggcatttcgtagcatgagccgtcaaggttgagagaacttgttggtcaactaaaagcacgcacaggaactgagcattagggcatgtgcacatttctgcagtggccgaacgtgatggtggtgccagatagactgccactgccagccagctgctagatctcgtttctgaacccattatataacaataatactattaaattcctaccaaataaaaaatcatactacctccatattagaatataaaaagttttagagttagacacggttattacagaaatagataaaatttaatggagagatgttgtaattggttgaaaagtggagatagatgagaaaagtaaatggtagtggggttgtgattggttgaagagaatgttggtaaaaaagtaattatattttgggacaaatcatatatgctataaattattatattttaggacggagggagtactacaaaactaagcgccattttcacacacgccattgcgaagggagcataactcaactgattagttacttctggtggaaccaatccgtctaggtataaatcctagggcctgttcactttgatgtcattttcaaccttaccaaattttagtaaagttgcaaaaaaaaaggctacatttagttcgctgccaaattttggtaactatataagaaatcatgctaaaattttggcaagttgccaaaaaagtggcaagttttttttggcatcatagtgaacatgcccctagattttacacgggtgctaatatttacgactaattattatttcagtggtaggcgatgtacccgttggcagcgagacgtttgtagtaactttgtcaatctcaagatatatcgacccagtctttcggaagtgcttatagagataaggtgtacgtgtgtatccataagagtgagtatgtgcgcgttatgtacgcttgcatttatattgtgtttctataaaaataaaaacttatgcaagcccagataggcagtacagcgtagcaatactagcagtactactccactatatacttagtactactactactgtaatgaaaccattaagcaccaactaataaaatacaagacagatttagtgagcacatatactaatactaaaatacgtctcgagatccagatccgtacagcgtgcctcgctatctcgcattaacattgcaaccggtcgaaggtatggctatcgatgtctctctcctgtatgcacgtacccccttcttccttgaagcacaaacaaaacaagatctccaatgaaaacttggtaattccttgcttccttcctccgctccccgtcgccgcgtgcgcgcaccgacgcagccgcaaccgccactccactccgccatgcgcgcgacgcctaagagcaggtacaatagcaggctattagctagctataaacatattttaatgagataaaatatgagagagaagagcagcaggctataaatctgtagacagctgcagcgcggactccaaaacataatgtgtatatgataggtgagaccatatattaatagtatagtaagcaaatattatatgaattgactattagattagctatagatgaattagagctagtactgtgagtagggcctcgtctcggtgcaagcccactactggctccagaattcgcagcgattagcgcctggatttctcggttgcagctggctcgccgtgcgtgacacccgatttttgcatcggtgactcggttgcgtcggtgcgaccatttcttaggtttattggataaatggatgtgccgtaatttctctgtacgtgctgagaggagctagttgcacgttgtacgtggccgtatcattcaattttaaccacttgttttccaaccaatcgagtggcatgaaggaagttaacagaactggtttatccgattggctctgaactttgaatacgccttttcattaattttctgcagtttattttgtatggaatgataatgtataataataagtagagtaggattgaagggaactccgttttccattggtgctcatgacggtgttccatacatgtcgtacttgatcgcatacgcggaaaaacaaacaaactactacaaaaaccgttccgtcctacgtacatgcgtggcattcgcctttgcacttttgatgattgcacgtactagtatgtagtacatcagtaggattcaaagccaaaaaagaagaaaaagttaactcctgagccctgatgcagtgtcgtgcctcgcgtcgctaggcagccaaaatctgcaaagacctaaagaaaaagaggttggcgccgacgacgacgagcacgcgagatcgatcgatccgtccacattctcgctggggatttctcagtgacaccatcagtacgcgccacgcatgtgattgtgaatgtgtgtactagtccaacgtccactgtctctcttccaaagtccaaatgcactgggccatcgtacaattgcaaagcaaaaccggcgactcagattttgaccatatgctggctgctgctgctcgcgttacatgtgaaccagcatatatatacacatctcgctagctggtaaacaatgcatcagcagtagaaaatgcaggatgctagtagcaactactacggaccactagtctagtacaagagtgttgtgttgtccccagctaggcagccaggaggcgagacggggcctcgtctgctgctcgatctgccacgcagcatgtggcgatcgatcgatttatcgatcaaaagcctcgccccctgcagcgtgcgaggaacacggatgtggctgccgctgctgctgcagacgcgacccccccttttcccgtcctatttaccctctcgctcgattcgattcacggacggtgagtaaaatcgggaacggtgagattttggacggaacgaactgttcgatccagacatccggtaacggacacacggtaataaagttgtggaagagtttggtgatggtgagtgagatcatcctttcggtttcagtttcaggccttcagagtttacaatgctgtcacgtgtaccgtgcaacaacgcagggatggaaacggtcagtctattacagaaaaaagacggtaacatacaacttcgatttattaaatttatttctcataaaattaacaagttaacttaaaagaatttatcacacgaatagtcatagtcattttgtttgtagtaactataagaataatagaaaattaattcatcatatttatcgatttaactatttagtactaccgaacaatacgatgatgaaaggaatcagaaaaaaaagtgttatgtatggccagaataaaattttttatctaaaacagtatcactcacaaaacgaggcttgaaattgtgctcattttcgtgatcatttttatccctcgtgcttacgagcgagcggattatcctgaagcacaagccttgatagttgatacggtccagataagagcgtttcggttgaaaatcagccggccggtcgcgtcgtcgttccatggctagtagcctaatactccctccgtttcaaaatgtttaacaccgttaactttttagcacgtgtttgactgttcgtcttattcaaaaaatttgtgaaatatgtaaaactatatgtgtacatgaaaatatatttaacgatgaatcaaatgatatgaaaagaataaataattacttaaatttttttgaataagacgaatgatcaaacacgtgctaaaaagtcaacggtgtcaaatatattaaaacggagggagtagtacgtactaatgtactagtagctgtaggctgtgtttagattcaaacttccaactttttccatcacatcaagatgtcatacacacacaacttttcagtcacatcgtaccaattttaactcaaaatttcaactttgaaagtaactaaacacagccgtatacgtgtactacttacaaaacaacacgacgtatccgttgcaggctcatgtcgtagacgcaccgtctaacgtctcgtctccgagagggatcaacgctccaaacgcaagcgtccacgggtgaaatttttggtgtttttcgcctacctcatagtagtaggtacgtctcgtatttggcagattgtgctgcattgcaatgcaggtgatgggcccatgcgtcgtaatctgcatgcacgcgccgtatacgcggaggggacaaacggcgcgtacacgacgcaccggtacacgtacgggcgctgcacagcgtttcacgggccttttcttttgcttcgcttttggccttgggagcattcaggaatcaggattcatcagcagctgaagatatgaagaaatcgtacgtgcagctgtgcgatgagagaactgcaaatgcggtgcagtgttgggttggtttggtttggttggtccctctcctccactataatccactcgcctactggtactggtattacctctttttcggcgatgaaatcgcctggctttatgtaaaggcaagtgttcccccccctgctgcttactggctttattagagtaggtacaatagcggcagcacggactctaagacataatatgtgtatgataggtgaaaccatatattaatagtatagtaaacaactattatatgaattagctattagattggctataaatgaattgaagctagtagtgggctatacgcttagttggtggttaaacatacatggttcgtcactgatgatggctcatttagtcgttgtgttttttttttgacattggagtaaccactgacgcgttgtaacattggcctgatggatatcgtgatatttaagtgttcatacaatcatactaccaatctatcatgcaagttctactggcattcagttggcatttttcgttcattgtaaaagctagtaggtacggagtatcatgcataatataactgctcctccgtttcaaaatatttgacactgttgattttttagaacatgtttgaccattcgtcttattcaaatttttttttatgaaatatgtaaaactatatgtgtacatgaaagtatatttaacaatgaatcaaatgatatgaaaagaataaataattacttaatttttttaaaaaaaacgaattgttaaacacgtgctaaaaagtcaacggtgtcaaacattttgaaacggagggagtatattataggccgattgggaacaagatcaagtgctcaaccgcatttctgagccatatgccgactgaattgaatggggctccaactaacctattgcgtataggccagccacggttactgcatagaaattgcgatggaccttcaattccatctaatagatgaatcgtgtactacttacgcaccgaacaactcatggtggccttcccccatgccctttgtcccggtggcctcaccgtacctatgaaagatacctttcatttcgttttcattttaccactactcctaccttgtactaggagtaactaacttgtcagccttcccgatgtagagtgcccatttcctgaatatggcatttgctgatgaagtgatgacactggctagtggagtggcatgtgctgcgtgtgtgtgtgaactgtttagctgaaggccaagacatcaatcttgcatagcattaaacctgacagagattggtatccatgttgtttgtgatgatttggatcagccatttttataagaaaacaaaagctgttttgattgacaaagagcaccactaatccaccactatagcaagcttagcagatcatactacttgtgcatttccgtgtttgcccccctggttgtgtcatcgcggtttgcaaacacctgcacatcactacgccgacagcttaaaattagacaggtgtacgactaaaaagggcttaaatctactactgtttacataaggacatctctgctcgatcagctatgtactactggcagcattcagctacctccatctgattactccatgctctcaaatcgtaacctccaacagattataggactcaaacagctcagtgactacagatgattcgaccgaagtcgcatacaaatgggtgtgagattgtgagagaatggtcaaatttacttggtatacgagtaaaataatctgaactccgaagcatgttttgaggagggaagaagtgagattagcaccgagaagagtgagcttttgcagagcaaggagtagtaggtaggacaagtggtgacggggagatgagcccactgtctcagagctcacatctcacaggctcacagggtcgcagtgatgagctgccatctttgtactgttccagtgtttctactcctcttgcccccacacgggcacactctttttcaactcctctctttctctctctacgagcaactactacggggttgagagagagagagagagagagagagagagagagagagaatggccattataatagagccataggccaaaagctcaactgcactgagagcagcatcagcagcagttcactgtcactcttcccaagaacgggtgccaaggaatcctagaatccaagaaaggcagcagctgctgcagcaagaacagcacagggggagaggtggtggtggtggtggtggggaagaagaccacacacattcggctgggtggtggtcttcttcttctgctgctgctgccgctgttgccgcttgttggagtgaggagagtgggtgagtgatggggagggggtgcctggctgcgctgctcggcggcgcggtggcggtggccgtgctggtcgccgtcgtccactgcgcggtgacgtacgacaagaaggcggtgctcgtcgacggccagaggaggattctcttctccggatccatacattacccgaggagcacacccgaagtatgtagtagtagtaacagcattcttcaagaatgtgtggttttttttgggacatttcgtggaggggagtttctttttgggggttgttcgtggcgtgggctggcggtttcttggtggaaatgccatggaaagcgaggagctttgttctagctttgttggaggtttttcctttcggcatcagattattcgccaaccatttttttttctgaacgaaatgagggggttcttgaggtttttcttgaaaatgctgctcttttggtctgctcctgcaaccattttgggatttttgttgctctgcaatggtgatatgttcatgttccaagctataattttttgggggtaaaaagagatgagcttgtttggtctcgaatcttttggtgctgtactgatttttcttcgtgtaaatatttgtcagatgtgggacgggctaattgagaaggctaaagatggaggcttggatgtgatccagacctatgtcttttggaatgggcatgaaccaactcctggaaatgtactgtctctttcattattaaccccattttttaacagtgtaatggcacatcagggatttcaatggtttttgctggcttcgtgcagtacaattttgaagggaggtacgatctggtcaggttcatcaagactgtccagaaggctggcatgtttgttcatctccgcatcggtccctacatttgtggagagtggaattttgggtattcctcaagccttaatttgaccgtagtaaaaacacacaaatgttcttttttttcaccattttctgttccttgtatgtccatattttactttcgtttcatgacttctgttgccatgtaaatttgcagtggatttccagtttggttgaagtatgtaccaggcatcagcttcaggacggacaatgaacctttcaaggtttgtggaagtatttcagcatttctggatcttaccagaggtgtaaatcttgttcatatgtgtttctgacttgagttttgctttgcagaatgcaatgcaggggttcacagagaaaattgtgggcatgatgaagagtgaaaacctctttgcttcacaaggcggtcctattatcctctctcaggcaagtgcaaaactttgcttcccatgtcatgtatattttttttagagagagggcctcaaccatgtcatgtatatggatgcaagcacattgtataacattgggttagtacgtagtagtggttgagtaatgtgttgtttgcacgattcatcttagcctgcacattttcctgggttgctcatggtgcggtgggtgttattgtttggacacagattgagaacgagtatgggccagaaggtaaagagtttggggctgccggcaaggcatatatcaactgggcggcaaagatggccgtgggattggacaccggtgtgccgtgggtgatgtgcaaggaggatgacgcacctgacccagtggtatgatgatcttatcctctgtcaaatactaccaccatcaggtgtaaattgtgaaactataccgaacatgttaatacaattatacaacgatacaggacatgctgattcgtatttttgcgagttcagtgggttatctccataagaggtcatgattggtgttctaggtttctagcatatgtatgagcatatttgtcgcctactcatatatcaaacatatattagaagaagaaaaattgacgccaaccacattgattttgatcttgtgaaatttcagtcgtggaatatacaaatatctcatgacttctgtacgaacaaattattgaaattacatttaacctctgttctttaaacagatcaatgcatgcaatggtttctattgtgacacattttctcctaacaagccttacaagcctacgatgtggactgaagcttggagtggatggtaattttttttccccgaggaaccaatatctagtgttgcaagcacaatcccagtacttccattgatgtggttcatgtttatataatttgattctgttgattcatagtggtagtataattgctccaatatgcaaaataattcaggtttactgaattcggaggaaccatccgtcaacgaccagttgaagatctcgcatttggtgttgctcgcttcgtacagaagggtggttcttttatcaactactacatggtatgacagatagaggctcacttatgttttctttaagcttcctaaagggtgatactcattcttgttggttaattgattttccctcaactgtaaaagtatcatggaggaacgaattttggtcgcacggctggaggtccctttatcaccacgagctatgattatgatgctccacttgatgaatatggtgagttacaaggaatatgcttagagacgttttctgtattgagcatgatttataagtgcccttatcaatattatcatcttctgctgctgttatttctctacactatgagcatatttgcagcttttcaagcattaagagtggatcttttttaaaaaaataaaattcagctacaccactatattcttcttactcaatccttttcttgtggggctaatacacaggacttgcaagggaaccaaagtttgggcaccttaaagaactccatagagctgttaagttatgtgagcagcctttggtttctgccgatccaactgtgactacccttggaagtatgcaagaggtctgttgtgattaccctttcctctcagtgaagtatatatatcttaaccagcttgatgtttcatttacatattgaatttatacttcaggcccatgtgttccgatcttcctctggctgtgcagctttccttgcaaactacaattctaactcgtatgccaaagttatcttcaacaatgaaaattacagccttccaccttggtcaatcagcatccttcctgattgcaaaaatgttgtttttaacactgcaacagtaagtttggcatatgcttatcccattatagcatggtttcaattctgtatcccttttacctggatcaagtatatgatgactttgcttacctgattcaaactgttgtaatctccacaggttggtgttcagacaaatcaaatgcaaatgtgggcagacggggcttcttcaatgatgtgggagaagtatgatgaggaggttgattcattggcagctgctccattgctcacgtcaactggtctacttgagcagcttaatgtcacaagagacaccagtgattacctctggtacattacgaggtaatgccagtcgataagttgcactttgcacgtaaaaattgcaatgtacataacgatgaatctgggaaatggtgactattagaaccccttgttcgctgaactttgcattgattttctgattatggcaattgagaaggtgtcctttgttctaaattttagttttcacagaagtaacgattttctaaaattatttcatcaccattgacagtgtggaggtagacccatctgagaagtttctacaaggtggcacgcctctgtcactcactgtgcagtctgctggccatgcgctgcatgtcttcatcaatgggcaactccaaggtttctacttgaaaatgctccccagtctatagagtattaatgtagtaaaaacttagtgaacaaaataacccgcaaaagaagtaatgaataaaatgattataattcccttttgtaggttctgcctatggaaccgggaagatcggaaaatctcatatagtggcaatgctaaccttcgtgctggtacaaacaaggttgcactgttgagtgttgcttgtggactgccggttcgtgctctcatctctgcatgaatttgtacatgtttacagcaaatgatcaattgtatgagttggatttttcttgtcctgctatatagaatgtcggatgcattatgagacgtggaacactggtgttgttggtcctgttgtgattcacgggttggacgaaggttcaagagatctgacttggcagacttggtcctatcaggtatattcagcatactggtagcctggtgcgagttaacgtaagaatgaataaacatgtgacttcttccattccaggttggcctgaaaggtgaacagatgaatctaaactccttagaaggctcaggctcagttgaatggatgcaaggatcattggtagcacaaaaccaacaaccgttggcatggtatagggtatggacaattaaccttgccataatcatttgatgattacttgcctcccattcttacgatagtttgtttttgtaggcatactttgatactcccagtggtgacgagccactggctctggatatgggcagcatgggtaagggtcaaatatggataaatgggcaaagcattggacggtactggacagcatatgcggaaggtgactgcaaaggttgccattacactgggtcatacagggcacccaagtgtcaggcaggttgtggtcagcctacacagcgctggtaagaacattcacaacaatatttgaattttctggcacctcttgccttctcttttgctgtacacaaaaccatcatgtactacttgatatttggttccttttcccttgtccattaaaactggagtgctccatcacatccctttttggttctattgtctagtcagtggagtactatattaacaataaaaattgaactcttgcattcaggtatcatgtgccaagatcctggttgcaaccaactagaaatctgctagtggtttttgaggaacttggcggtgattcttcaaagattgcccttgcgaagcggacagtctcaggtgtctgtgctgatgtatctgaatatcatccaaatatcaagaactggcagatcgagagctatggggaaccagagttccacacggcaaaggtgcatttaaaatgtgcacctgggcagaccatttctgcaatcaaatttgctagctttgggacacctcttggaacttgcggaacattccagcaaggggagtgccattcaattaactcaaactctgttcttgaaaaggtgagaacgctgtttggtcattttggtctacctgaaatttttttcttaaaataatgtggactacctgcacctggacagaaagacccttcgcagcaaattaaccctgttcaaaccacttgaattttttatcattttgcaaagaaactataatcactgcaattagtccatgaacttaccacacatatcactgattttttctggtgcttatttgaatagaaatgcattggactacaaagatgtgtcgtcgcaatctctcccagcaactttggtggagatccctgcccggaggtgatgaaaagggtggcggttgaggcggtatgctctaccgctgcatagggcaatttctttgccgagacgaatttagagatggcaccaaacaggtgggcttgtgcttgatcaaagcacacagaaagcgatgcagagtagagttcaactgtaaagtatcgacgccacatagctgtggctggaggattagagatcgattctagcattcactcagtcgaatttcagattagaggattctaactctactgcatctccatgaattgttcagagtgaccaactgctaattgaagttggtcctgggatggagtgcagggagagtaaaggcaaaagattggtgcattcttttgctcgcgttagtgtgcgtgttgtgttgtttcatctttcttgaaaggaagaaagatgccgatgaattgtgcatgtatcccatatgaggaatcgttgattgtgcagtgagcatgatatgctgcagaacaattgctcgtgtcatattctgaagttcagaaaagaggttgtcaatttatcttcttcagataaaccatataattcttgtgatgaggcctgagggagatttatgccacagacatatgccgcactagaaaacaatttaatcgttttaaggtaggaaagataccattgttgttttttcctccccaaagtattttttgtctgaaagtatgaaatgtggatgatgtattcagatagcatagggtaccttgtcaccaactgagctcaataattgaacttgcatttctggcaatgaaaatgggggagttttccctttcacaacagtaaaaaaaacggagaacaattgagctcaatctggccggcagcgtgctaggcatgatgcttgcggctcaatgactgacaaaacattatcctgaatgaaattgtggaccttgccccttccggaactgatgaccacatgaattattaacagttgagaacataggggcatgaatgcagcaatagctcccaacagtaatgaaacaagtagtaataattttgcatctcatatatgggacaccccccggtgcacattcagaaacgaacaaatgattgtgctaaagaaatactgccacagccaaaccgacattcacgcggccaaaaaaaagagagaagaagatgcagagtaaccacaagacattcattcagctctgaacaacaatatattagtgctaaaatggaagagcaaacaaatgcagcgtaaacaacaatcagcaagcaactgtctctctctgattaactgatctgataaaggtctagaaccataaactaggggtttagaaaacgtatcctgtcagtcagaaaagcagatgtcgcgcgtcccgttgcgcgcagcaaatctgcagcgcaggggcaatccaataataaaaggagcttcctttttgacgatgtgctccccctacccttcgacctcgcctgtcggctgactgggatgcggctaccgacgcccgcccgatctcctgaatgttttttcgaggttatttcgtcatgaatttgctctccaatctgagtgatatggtatccaaaatcagtgcagaatggcatggcaaatccacggcttcgacgacgccagcgaatgttgcatgttattgatgcataagggcattagggcagcacatttggcatctggaactggtcgaccgagctagattgaaatgtcgttgtttgtgcagtgagcatagcatcggttcgttggattgcatactgcaagtctgcgatgacggtgcatttcaacggccaatgtcagctgcgataggattcaacggctgcttgcatccatctcagatggtttcgatagagaagcactgtatcgtctcgaatttgagtgatggtacccaaaaaaacgatgaagaaaatcttatgtggtaatctttgttgctgctctacctccatgttgccacgacaagtcgaaaacaagcgagaaaacaagggggacggagaattgaactccgaccccctaccgtcgcgaatcatgtgctgcctttcctttcgtcttcgcgcgtctgttttgggccgtttcacggacaacggcatgtcaaatccacggcctttctcgtgctcgtgccaaggcctccaggcgttacacgctcgtcatcggcccaagcagcaagccaccggcccaccgctcctctttccctacttcgccgagcccaagcgccgccgtcttcgacgacgccaacaaacgccgcagaaaacgagatttggggcctgttcactttgttgcaaaaaaaaaaaaaaccttaccaaattttaacaatgtcaaaattttgacaggatttcttatatagttatcaaaatttaacagcaaactaaatgtagctacttttttgataactttaccaaaatttggtaaggttgaaaatgacatcaaaatgaaaagggccttgaagtgagagatgtacctccaaacaatttttaatagaaaattgtgagtgtgtttaggattgatcacgggatcttggagttgaaagatcatgggcagcacagcacagtatcggttcattggattgcacactgcaaacctgtgatgagtgcgcatcatcaatggccaatgaccaggatgactggtgtagtagtaccacgtcttgcatctcagatatgtctgatgtctctaattcgctcgaaacaaatgtagaaatcttaggtgcacaatggtgatgattcctgttgcagctagccagcgatcttaccgttgccttgaaaaataacgataatattgagaaaacagggggttcggagaactaaactccgaacaccacccgcgccgtgtatttgggccgtctcacgaagatgtcattgcaaaatggaataagttcacttttactcctttaaaagttgtcttaatctaatccatgatcctaactgtaaaaccggatatctccacccccgaactactgaaaccggtgcaatttaactcccttggtggttttaaatggcggtttcgctgatgtggcgtctatgtgatagtgttgacctagtctgtggcattgacgtggagtttaggtggcattagagttaaaaacatatatgtgggacccatttatcattcacacaaacaaaattatagggcccactgacatgtggaccctacatgtcatcctctctctcttcttcctccctctctttcccttctctctctccacttcggccttctgcaagaggcgatggcggcagcggcagcgacggcggcggtggcgcgagggtaggcgctggaggcactggagcggtggcggcgacggacggggaccggagtggcggcggcgcttcgggctagagttggcgtggatggaggcggaggcggcgacagaggagatggcaggcggtcgagggccggagcgacggcgggtcggcggagagcctggcggccggtggtggctagcggggagagagctagtggcgaaggccgcccccatcttcctccctcctcgccgggctccgcacgcacctgccccgatcggtggagcggattacgcggttgggtccgtaccacgggctgccaaaggcggacggcttgggcttcgcggcggacttacggatggtgatgcgggcctcgccgaagagggatgtggacgccgcgcgaccattactgcggaggagagcgccgtggcgagtgagtgagcatctgagttgctccacggctctggggtctacgccggcggctgtggtggcacggcggcgggtggccatggcgagttgttcgggccttgcctgcctgccgccgctcccgcccgccgatgcacggctttccgtcggggcccagctcccttgacccttgatgccgtcgcctgttgccgcccgccgctgtgcgcccttcgttgccatcgagccgctaccctcgtttctgtcggatgaaggtgaatagaaaggggagaagaagagagagataagggagagggagggaggaggtggggctcacaatattgtttgtgtcaatgacaactgggtcccgcatatatttttaaattctaataccatataagcaccacttcaacaccacgtcggacgaaaactaagtcaacactgtcacgtagtcgccacgtcagcgaaaccaccctccaaaatcacccggagagtcaaattgcaccggttttaacactttagggtcaagatttttggttttgtgattcaggatcacggattagattttagttacttttaaggaaatccaagtgaacttctccttgcaaaatccacggccttccgctcggtcgggtccatgcgcacacccgcgcgtcgtcgtcggcccaaccaaacaccccaaaaaaccaccgaaatctcacgaggcggcaacgcatcaaccccagtgcccgtgtgcggccgtgccccgcgcccgcgcggctgtgccgtggcgggctcgcggcacggcacggtgacgcgcgaccgtacgtgcagccactcgctcgacacggctgcctgcctgcccacctccaagtacatttaacgtcacctccatcctcacacatggactgtcctcccacctgtctcccgccatcgtctcgccgccgcttctccctctccctctctctctactcatcatgtgtgcggatgcgtcgcccatgcatccatcgccaaaattattggtcacctgatgaccgattctctcctgtgatttcagtgcagtttcagcgagatcgatctacctttccgggacgcctccatgcctgtggcttggttgacgatcaaagcgtgtgcgtgccgacgctttatggaaagtacgagatcttgatagcaaagcgcagagagagaaaaaagttgggaaaaaaaagggggaagaggacgatgctggatgacggaataaagatgcaattctcgattagattagatggatagagtgatagatagatagatagattgatagatactattgttttttgtctctctctcggacactcttggcctacctacctcctgttcatcatcagtcgggagaggcaaaagctacgaaagccatctgtccccagctaagctctgcttttgcaaactgcaattgcaatcgcagtgtagtgtggagtgtgtgctctgcctgtcttgtagccataggcacacaagaatgtggttgttgatctggatcgcaaggcctgatcgtatcggagtaacggaatgtgacatcaaaaggcgacgacgcatagaaaaatatctcgccgtctgattttttttttactttacctttgcatcttctcttctctgtcccatcctgctcatatttcaccacctcgtgcagactggaactgaattctgtatagatcctgcatgataaagagttcagtttgtatatgctgctcatgaactaagccgtacctgtacgtacgcaaccggatcaatcatagaatttaagttccaagtgatcacaatatcagttgctacctcgggatgcagtcttgcaggctccattggtactttatgctactatatagatagatgcctagatggtcaatgtttatctgccaattctaccaccatctgaatgtatatatatacaatcagccagaataaatagttgtggcacatgaacaaacaatcattggcaactgatgtgaacgatgatgatccacagatcgaacagctgctggaacccggttggctatctccactagtagcaacttccacaaggctgcttcggcgaaaaagaaaagaagaagtcagaaaaagacgacaagagaaacaacccaactgcaaggtgatgaccatctagacagacagggttaggtagtgcgcttgctcagcagctaaaatgttaatggcatcatcacccgtgcgcgtttcacgtgacttgacatggaaaattcttctttatcccccgttcggtagagaaccattttctgaacgcatttcctttttgttcttgtcctcatttaaagattacaacgtgcagtttttaatttcaatatcaattaaattgttaataagaggtgcatatgctccttgttaatcccaatccgtccttaacaatgttgatctgggttagttgcatcgtgattacctccgtaattttcctaaaattattggaccttttgtctgaactcagctgtcgttcatctagcgtgaaactgccacttgttcgtcaggtagctcctctcttctcttcttcctatcctatctttccgtttgattttgacagccttgtgttcgcatgcagcgatgattggccacattcagactcttgccaattgtcctgaacagcgttctcttctatggactggtcttgaacagtctctgaaagtagcagaagtttattctctattatcctacagtatctcagatgaaaaataatcattagaaacttctgttggttataggacaccacaccgttctaacagtgtagcagaagagattggcgaatcatgtatcgacacggcgaattaagatagtcccaatcacctaattccagtgacgatccaacagaattgaggtcagcttgataaagaaaagtaaagtggacaaggtgagtgtaatcacagaaacgtaagtacatgaggaccctgatgcaattgcgttgggtggcacaggccgatcgatctgaatgagtctgaaacttcttcggtcctttttcttttgagggaaacaggagaggagacccctcttcgtttcaggaaccgacatgctagtatctgttagtagctggggtgatccaacctgatgggatgtctataactaaatgtgatatgacctgtgtttcttgaaaagtaaggattgtgaactacacatttctgattgttatgggcctgtccctctaaaatggagtactactctctgtcttgaatatagtcgcaaatgaataatatgtgtatcttctcctctttgtaactgtaaggttgtgggttcgcgaaaaagaagtgaggttgtaaatttcaaactagaattgtaaatgtggaattaaattcgcccaaatctatgaagatccctgtcatggcattattgaatagatttgtagtccattgaagactaattcgtttccttgtacagtaacgagacttctaggtaacacaatcagatactgtgtaaaaaaaataaatgagatgtgacctgtgtttcttgatagtaaagacatgctaatgacattctcaacgatttcctaatagcttgaacaaaacaaacctcatgatgaaactgaaattactaaattatttataatttttctgagaatcatatgccttagaatacattccatgaaaattgtgaacagtcacagagacaacaatacgcattccttgtccgactgcatgactctaccctattatggttcaaatcccaatgtctacaaatatggttttgtgcatccttattcggtatagaggctagaaataatcctctttttctttaaaaaaaatgcgttggttgtcaattatactcagctataataatcgcattttttcgccgaatctcgtctcttcgaagttggcccacatgtcagcgagaggcacctgcaaagcaaaggcaaggagttgggaggtcaaattcattattggaggggaccatgaagacacttgtccttgcacatcactacctcatgcccaatttctaaagcaagtgtgtgccaccaaactgaaataaagttgagcattagttttgtggccttgggggcctcctgttgcacttttaactagaaatgaaaagaaatgagagattttgggcaatgcaaatgtatatatgcagtacatttttttgcacttcgtcctgtgagatgtctgcatcctccccctatgcaaattgctaaggagcatctcatgatcagttggagagattggaaggttcagaagggaaaagagggtttaggtctaccaactggttgttagcagactaatacgtcttaacagatgccgtcacctactccgagtgatcggcctcctagcaatcaagaaccacctaaatatggcaagctgggttagaattcaggtaaaaacacaccaagcaagtgataactgaattgcacctactctatttgaatgcacagagtgaactaactgaactgctcaacaagtactgtttgctgtaagcgcaaactcaagaagagtaaaaactgagagtttttagactgactcctttttgtgctactgtcagtggatgaactgagttaattcattggaaaaatcattactacttgattgttcagtcaaaaaaattgaaagtgaaagaatccactagaatttgcggctagctccatgtacagactacaaaccaaattgcaagttcagattgagcgttggatgatccagggatactgcaatagttgcattcagtcaatctcgtccgttcaatttcctgctgcatgttcgactgctacagccgatgaaaattccagtgaatccacgagttgaaacctaagtgagaaaatgagggagcggggaaagagatagagaagaataatcgaaaggaaacagacaaaatggtggtggggtttctttaggatttgtagggagatagtgttaggcagcgccttattggtggcagccgtatattattgctcaaggaaagagtgaggagttagaacaactctagtgtagcctacagagtgaaaccaaaagagagaaggaaaaaaaataacaaaaaggagtagatgcagttttagttcttattattctaatcttctctcttgttgcaatttctttttagaatccttgggatcatctctgtccccgttctgggtggtttctgtcatactccaggaactgtcttgttctagctctttgcttggtctgaaagtcgatttctgcacaggtatatagccttatcctatcaggtttaacgttgttctttggttgcatcagtttgtctttgagtttgatctgagaaaaccaaaaggaattatctttttgggcttgattggtgttcatatgaattcttggtattgtcttctgccttcttgcttgttgaactttccgtttcttgttagctcctttgtggttggttggtgtgccaactgaaaagattgcttcttgttacgtagattattgttgagattgttttctgaatttctcaagcagcggtgagtttttgttgaaattgagctgaatttctctgaaaccaactatttctggatgcattcgtttttgtagcttgctgagaaattcagactcctttttttccttttcatgatttcacaagtactggtttgaactgctattttgttcgcattagatgctgaatttatcaaattgcaggtactgcgaaagctttgggaatagtattgcagaaagcgcagcaatctgaagcttactgtccaaggtagacagctgacataagcagtttagcacttgagctatgttggattcacttcctcgtcttcctgacatattccagtttttcctctcttctttcaagaatcggaattacttcagttgtactaggaattctgaacttcgtttgtagttgctgtctgaatttgtggctactgtttactactggactcatcgtcacgtctctgacaaaactcagtacaccatgttgatgcacgagatgtttttgctcctattaaatcttctgtggttttttctctgaaacgtctgactcaagtatgaatgttactagaaagcaacaacctaaaatcagattgcagcaatccagcagtctgaatttactacctgaaatcatctcaaagacgaattggtactactagttttgaatcctcactcgttttttttgttctcttttgcagccagtttgcagctgaagccaaagactgaatctttcatcagggtttgataatatcaaatacccttgtgatgacagagttaatcagtttgtctcgtcatctacgtgatgattcttcttcagtctgtctcttcttctgcttctgaagacgatggccacattcttctcctcttccaccaatcagagagacctcaccggcggcggcggcgacggaggcgacatgtcgttccagcactacccaccgccgtctaacccttactcggactcgtcggccggcggcctgatcccgctcccggcgagcatcgtgtcgcatagccacattgcgcacggcggcggcgacgagccggcggcgttcagggaagcggcgacggcggacggcggcgagatgggcctgcagacgcagctgctcatggcgcacggcgcggcggcgcggggacaccagggcgggctatcgcttagcctcggcacgcaggtgccggtgtctctctaccagtacaggccggcgggcatggcggccgcctcgctgctcagcccgagccagtcgtcgccgatggcggggaggagcgcgcagaacagcatctacgtgcagaactcgaggtttctcagggcggcgcgcgagctgctcgacgaggttgtcaatgtccgcgacgcgatcaagcggaagggtgacaagaaccagggcaaggattccggcgagtgcaagggcggtgacgcgccggcgacgacaaggccggctcgaacccgcaggagcaggagagcaattcagcccccgagctctcgccgtcggagaggcaggatctccagaacaaggtcaccgcgctcatggccatgctcgatcaggtaatgcctcgatctccatgactccatgtcacttccgaacaagaagaacgtgctcgtcaatggaggttttgttgcgttgtggcgcgcgcggcaggttgatcggaggtacaggcacnnnnnnnnnnnnnnnnnnnnnnnnnngtcgtcgttcgacgcggtggccggcggcggcgcggcgaggccgtacacggcgctggcgctgcagacgatctcccgccacttccggtcgctgcgggacgcgatcggcgcgcaggcgcaggcggcgcggcggggcctcggcgagcaggacgcgtcggcgcagggcggcggcggcctctcccggctgcgctacatcgaccagcagctgcggcagcagcgcgccatgcagcagttcggcatgatgcagcagccgcagcacgcgtggcgcccccagcgcggcctcccggagtccgccgtctccgtcctccgcgcctggctcttcgagcacttcctccacccgtaagaaccacctccgccgtcatccatgtcgatcgatcgatctcaatctaatcctcaccaatggcgccatgaatatccataggtatccgaaagattccgagaagctgatgcttgcgaggcagacgggattgtccagggggcaggtgagattgagctccatgaactcgacgctctcatgcaaagctgatggattcaaatcaagaagagaattccatggttttttttttctttttttacgtaggtatcgaactggttcatcaacgcgcgcgtgcggctgtggaagccaatgatcgaggagatgtacaaggaggagttcggcgcggagatggactccaactcgtcgtcggagaacggcggcggcggcggcggcaagggcaaggacgaggcgatctcgtcggaggaccgcgacgagttccagagcccgtcgagcgccgccgcggcgaggcacgccggcgtcgcgggccagctcaacaacccgttcaagtcggaggcgatgggcggcgccgccctggacgtcggcgtcggcgtcgtcggcctgtccagctgcctcggcggcgccatgggcacgtacgccaccggcctcaacctgaaccaccacgtgcaccaccccggcgccggcggcaccagcctactgcacgacgcgctgcaccaccaccaccacggcggcggcggcgacgccaggttcgtctcctacggcgacatggccgacctcggcggcggcggcggctacgacggcggcagcgtgtcgctgacgctgggcctgcagcactgcaacaacgccggccccgtcccggccgagcagcagggcctgctctacggcagcgccggcgacttcgactacatcaacggctccgacgaccggcagcggttcggcccggcgtcgcagctgctgcacgatttcgtcgcgtgatcaaagcacggcgcgcgatggatgcatcgtctgcggcggcggcggcggcggcggggaataacgcaagacggcgtcagaagcctgggccggccggccggcgccgtcggcgagggtatacaggtatacaagcaatatacacgtacactcgtgtgttgtgttgggggggtaagtaaagtgatcgaagtaggggtgatcaggggtgtaattgtaaaactgtatatgagaagggggtgtagcttgctgtaaagatagattggtatttttgctagcttgcagatttctctactgattgatgcatggatcattcatatatatatatgtggtgatgtgttgggtcagattggaccagatgttcaatggattactgtgaattgcagctacaaatgtttcatgttttgtaccagatgttataaagcaatgcagataggaggggggggggggggggtgtatgagttttgtaacacttttttttactgcaagttcatgatctgaacttctgaagatgcatgagacagattgaaccaagcacacaccatgaaaaatttcagaagaaactcagaagcaaatataagtgcaatagtcattttaatggtcatatatcaaactggcagtacttgaatacaagagaatctcattatgtccaggaacttataatgcgaaaggtcaatcaaaagcatcttaattcttacacttgataactagtatatgtagtgtgccccattttgcattagtattcaacttagcatgctgcataccatctgccaaacacttcaaaagatcacagaaaacttgctcaggttgtttttaattcctccccctagttcttcgtcacatgttggtcactggtcagcattcaatggtggtattcacctacaaaaaaaatgtgaaggacggagatcagattatgatctaatcagacttcagaatcatactaatcattgagatatacctttttaatagggctttgatatcttgtttcaatgcagagctttcaaggaacctgtcctcgctatctgaaacatccaccgttgcgagctcaaaatcatcactgctgcagagctcattccactcgaaccacagcttcgacactcgttctttcttgaaggcggtgtggtgatcatcctcctcaggcgaatcagcagcgacgaggcggtagcaatacaccattttagactgtcctggcctataggcacggccaatcgcctggcgcatcactgaagggttctcatggacatccaagatcactatacgagacgcgccaacgagggagatgccctcgccacatgccttgatggagccaaagaagactctagcatctggtgagttgttgaatctatggactgcttgctcacgctgatcctgagttgagccaccagtaaccctgaaaatatgtacctctgatttccatcctttcattctactgaccagcttttccaagaaaatcaaagagcgcacatactggctgaacacgagtaccttccctcccgtggcttctgaaagagacaacagattgtgtacaaacttggccttcaccccgtcgttgatatcaattccggatatgatggaaccgatcttcctattggtgacatttccatcatctgcatcagctttattggcattcttcaagcatggatgaagagaaacggcattgcatctcgagcgtttcgcaaatttatttattccatccaagcccttaataatatgttcctgtttgctactcatattgagaaaaactgtaaagtccacaattccaggtagctcatccaaaagcttgccttggtaatagtgaagcacatctgcagttagctcacgaagattttggataatcaccgctctcatcttgtcatttccatctttctgacggtgttcttgaaccaaatcaaagaagtccttatctga

SEQ ID NO: 62939 - DNA, 1380 bp, Oryza sativa
tgttgagggtggaggcatagagcatcagggaccacttcgagaatagctcctgaagttttgtcaattgcatctgcatcactagaatttctgtgttctgagggacgtgctctgtacgattgcttccgctgacacatgtaacagataatgagaaatatttttgaacaaaaagaaggaatgtagaaggaacataatgtagaaggaggctaggcaaggagctatttagtttaagagtagcaaaatgatttccatgtgcatttctataagagaatctgtttcatccctaggtaaacaggccactaagaatgtaagtatgtaacagcaatattcccgaaaaagtatgtaacaacaatcaggtgactacagcctacaggacagcaggcaaaatataactagtttatgttgtgatgataaatggagcatgtgtgctaccatgaagtaattttggaaatgtcataattttaattctttttcagtaattaattatagtaaaataatttggaccagaaatttcatacctttttccactggtactcaaaaatattttcaatacgttgctggatcagaccacaaacacgacagacaatgcccaaatcatctttcatcaggaaatcgtgctggcattcatcctctgcttgttcacaagaattctctgatgggacaatgttatgatcgcttccaacagtctggtgaagcaaactaagttagtgagccattcaacaagaagaaagtaattacaaaccatgaaataagcaaagattgaggagcattgttaaaaagaactcagttgtaaacaagaggcaagtggtgctaaaccatacagaaagcaaaggtagaaggagcatgttaaaaagaaggaactcagttccagggtgatggtaaagactaaagataaaacatttacaatttacatgttctgaatggcaaggaattgagaagtgagataaaacaaacagaactttttattgacggtcaagcaaaacagcagaatgatactaaataaaggcctgtgcattaacaattactcgtatgaatttcatacagttggcctgatcggctgccttgtttgcatttcagtcagccgctacagggagttgtatgcacttgcatggctgcggtagttgattaggccaagtgagaacaacttcctcagagtgagcatgaaaactgttataaaaccttccagaaataactatcagacaattaagggatctaggcagtgaggtaatttctctcatagaaactgtacgttatatcctgatctatcaaacaacaaacacagagacaatcggaatataaagagagtcaatagtcaatggtgtgcaaatcttatgcgtattcccaaaaaataaagaaaaagccaatggtatacctttgaacatg

SEQ ID NO: 62940 - DNA, 4433 bp, Oryza sativa
ttttgaagaggagagagggatgccctctcccgttctgctaatagaaacgataacaagctcattacaagccaaaatgtcatcaggggaacggaaaacaaaaaaatctactgggagcctgctaactggatgctccaaacttgaaggagacagccacacaaaactactagttttccttgcacagccattacaatcagcttaaggaacctggacagttttggagaacgaaaaaaaacagagatttgcttttgtgtttcttgtagatcgtctatagctttttgaaagtaattttagtgacataactactgataaaatttcatgcaacaactatttattctcaaaggtttcaaactttgattgcccacactccaggacgactaattttggatcagggttcagggggtagtatgagattccgtttacccgtaatatgcataaaactgcttaattcttgtatacacattagtagaataaaatttcaggaataattgagcacaccttgttgtaaataacatcgttgatgtccatactatcctttcctttcttaactgcttgtgcttcagaactgatgttttcattatccagcatggagatttcctgttgttgggcatgctgctcaggcagaacgctttcttcaatataattcgcattttgcttggaatcagatgatttttcatctacaaaggatgcaacactgtccccgtcatcagaatcaactaaaacaactgttgtgttagcaccaatattgtccacattagcaaaagtataatcttcatcattgtctgaatccaagtcaattatattacgacaactagagtttcttccatcttgcacaaggcgatttgtttctgatgacttgagtggactggcatatggcaactggataggtacttcttgcagcttttgtaggatgctgataagttcaagccgcttcatactgattgccttgtaatcattcgtggagctcccatacttcaagtcatcgcattgttcaagcaactgatgacacaaaattctgttacgactaaggatgcttgactgggactggacccgtgaagagctatcgtgaccgctttcatgcttccgccttttgcagctatcagaatccatcctagaacacaaaggaagacttgttagtgttttagaaggtgcattgtgcatttgtgcatggatgattgcaataataaaatgttagtacattgcaataacaaaaaagataatgtatcatcatgaacagaactatcactgatgcaaataaaacatgcggttgttctgaaaattgaagaaaaacaaagcaatacttcgatcatggatttactaccaacaaaaacccatctttctgtctgaatcaaatccatctattctaatctgagcttgctcgcaactcccagacagccgcttgcagtgaccaataccacagtccacaagggaccctaaaaaaaatcgacttcacgggaaaaaaaatttgcaatcagaactcggttattcgatgcttgtttcacaatccccatgtgtagagtctagacagttcaattggacccaacttgcaattagtttgccaggaccataaaccttggggaaaaaaccccaaaacccaagaaacgcacaaagctagggatagaaaggaaatgcccaatctgaccgcaaaaatgcctaaccagataactgaaacaacagacgtgcatgcaaatgggagagggcaaggaaaaacatgatgagagaaagaaagaacttctatttaggaattagggaaaacaagaactgaataacacagtgagaaatgcggaagaaactcacctagcttccttctgggttgagtgatcgatctctcctcctccccctcggagggacagaggaatctgaagaaccttgcgagaatcgctatgagggggaagaaatcaattcaccaaaacttcatgtgagcactggaagttggaacgcatgatgtgctgtgctcttcgttatgattcttgtgaaacacaccactgaacttccaaaatgtgaagtagtactccaggctccagtacatatacactgaactttcttagactgtgcagctgggacccacgtgagtgggccatgcatgtcatagaggaattgacatgggttttccctgacatttgggaggatccgaacggttcaccttccagggtgctttcgagaggatatggcgaccggctggtggtccaacttcgccgcctctctctccgactcctcgtcggcaggagacaccgccgatgccggccgcgccggcgagagagccaggcactctccggcggagtcgcgtgaaaagcttctcgagcgtctcgccggttcagatggcatagaagcaatatgcggcaagcaacgcggccttcaaaatcttcacatttctcatttttgtgtacggaaagctaaggtcatgtacagatgtgccctcaatcttctcacatctcaaatctcattcaataagccaatacatacttatatactcactctgtttcacaatgaaagtcattataacatttcacatatttatattgatattaatgaatctagataaatgtgataaatgctataatgacttacgttgtgaaacggagatactacatatgatccagttgtacaactcaaataaatatacaactataaatcaatttagagaacatgtataatgcactgcgactgttaatattcgtcgaccaaattcaatggtcctgaattcaactggtggggacttttgccatacacattttgttttcaacgtcatgcgcgtgaaagtattgtgttcggggtggtcaagttcctgcctcttgtgttctcggtcgtcttgggcctcggccaccttacgtttgttcgccatggcctcctgctgctgcagctcctgctgcgcggccacctgtttcgcctgcgcctcctccatggcctgctgccgtagccggtgctgcgcgtccacctgtttcgcatgcgcctcctccacctacctccggtaccacgcacgccacctcggcgtcacggccttgttcttgtgcatcgcgacgaacctctccaccagcatatccccgccgtcctcgagggcctcccgcccgatctctctcgcccgagcgatgaagaaatccaggatcacgtcgaagaatttcttgtaggagggggagttgtccatcaccccgtggtagattttgcgcaggaattcggagtacttctcgtcgtacttgtcgccgccggcgacgaggccgcagtgggagcccggcgacgaggtggccgcgcacagcctgaggaactccagctccacggcgtggaacgccgggcggaagttgtcgccggcgccgcggtggccgccgccgcggaacgcgaggtcgaggcggtcgtgcgccagcgccgccgcgtgctcgtccgggaaggcgcccacgaggcggtgcttggtcgggttggacgggtcgaccacgcatgccgcccatttgcccgtgcccttgtctcgctgcacgccgacgtagtatctctgtgtcgacggctgagcggtggcttgcgccggcggccgctgcagtggcgtcgcggcggcgggaggagtggaggtcgcggcctgagaggatggcggtggcatggtgcgtgctggtggtggtgctccttctcccccggtgttcggcagtggcgcgtgaggctccgtgggctggatgggggctccgattgcacgagagctcgtcggagcggggtacctcgccattgctgctctctgttgctgcgacacgtgaggattcccggtcggagtcgggatggtggaacgcccggcgacattgccattgacggagctccctgagcgttcgacaatggcgcgtggggcctcacggtggacagtactgctgtatgagagctcctcggaaccatggcctgcgccattgcagctcgcgctccccgcatccgcttgtgttgcaacggtgcggccgggatgccggtcacagctatgtgggagctctgacctgccggcaccatcccagccggcgaagctccctgcattggtggcgccgcccagggagccctgatagcgcctctcatcgacggagcgttctgcacgggcagtgatggcgaaggacccctagcggtggtagcggcagcgccggaagctccaaagctcgccggccgcggcacgccggtcatcggtgtcgcgttctgcctctgcattgtcggagaaggcgagggagcccttgcggccgtaccacgagcaacgggagccccaaggttcaccggccgcggcccgccggtcatctgtggcgcgttctgcgtggaaggggaaggagatgaaaccctcgcggccgcggcgccaaagctcgccgggcgcggcacggcggtcatctgtggcgcgttctgcacgggcggggaaggcgtcgcggccgtagcagcgccaaggctcgccggccgcgccgcgccggtcatcggcggcgcgttgtgcgcttgggaggaaa

SEQ ID NO: 62941 - DNA, 9261 bp, Oryza sativa
  unsure (1)..(9261): unsure at all n locations
aaacgtcgaggccgtgttggcgacttaaaccgaagccatgtcgaaaccgagttgatctcgctatgctccgagtcggattccagcttggcacacggaagccgcgaacgaaagcgtattttgtgattacgtttagggtggctctattttgatttctacggaatacgtattccttgtttgaacacggctttagttagtaacactcaccaattgggacgaacacctcgactcctcgagtcaccaatggcgattccccgtcgcctcgccgccgccgcggccgccgaaaccaccaaacgctcggcggcaggtctcgccgccgccctcggtggaagcggagggaagcccgcaacagccgacctggccgctgccgcgacggccgcggcggccgccggtcgcgcctccgaatgccagtccctcctcctccgcatgtcgcgccgccgcggcgcctgccgtcgcgagatcgtctcctccctcctcggctcctcccccaccccgcagccgcgggtgtttgacctcctaatccgcacctacacccagtcccgcaagccccgcgaggccttcgaggcattccgcctcatcctcgaccaccgcgtccccatccccgccgccgcctccaacgccctgctcgccgccctctcccgcgccggatggccccatctcgccgcggacgcctaccgccttgtcttctcctccaactccgaggtaaacacgtacacgcttaacataatggtccacaactactgcaaagccctggagttcgacaaggttgacgctgtcatctccgagatggagaagagatgtgtctttcctgatgtggttacacataatgtgatggttgatgctagatttcgcgctggggacgcggaggcagcaatggcgttggttgactcaatggttagtaaagggctaaagcctgggattgtgacgtataattcggttctgaaagggttatgtaggagtgggatgtgggataaagcatgggaagtgttcaaagaaatggatgattttggtgttgcgcctgatgttcggagttttaccattttgattgggggattttgtagagttggggagattgaggaggcgttgaagatttacaaggagatgcggcaccgtggtattaaaccagatttggtgagctttagttgcttaattggattgtttgcaaggagggggaagatggaccatgcgatggcgtacttgagggagatgaggtgctttggattggtacccgatggtgtgatttacacaatggtaataggcggattttgtagggctgggttaatgtcagatgctctgagagttagggatgagatggttggctgtggatgtttgccagatgtggtaacttacaatactttgttgaatgggctctgtaaagagcgcaggttgttagatgcagaagggcttttgaatgagatgagggagagaggggttccaccagatttatgtaccttcacaactttgattcacgggtattgcatagagggtaaactagacaaggcgctgcaactgtttgacacaatgttgaaccagcgtttgaggccagacatagtaacatataatactttgatcgacggaatgtgcagacaaggtgatcttgacaaagccaatgatctatgggatgatatgcattctcgtgaaatcttccccaatcatgttacgtacagtatcctaatcgacagtcactgtgagaagggacaagtggaagatgcatttggttttttggatgaaatgataaataagggcattttgccaaacatcatgacatataattccatcattaagggctattgccggtctggaaatgtttcaaaggggcagaagttcttgcaaaagatgatggtcaacaaggtgtcacctgatttaattacttacaacaccctaatccatggttatatcaaagaagataagatgcacgatgcttttaagttgcttaacatgatggagaaggaaaaggttcaaccagatgttgtcacatataatatgctcataaatgggttttctgtacatggtaatgtgcaagaagctggttggatttttgagaaaatgtgtgctaaaggaattgaaccagatagatatacatacatgtctatgataaatggtcatgtcacagctggcaactcgaaggaggcattccagcttcatgatgagatgcttcaaagagggtttgctcctgacgataaattctgagggtcctcattttcttctttattggattccgtagagccattggataatttaggaaagagaaacgcagggctgcaggcactgtgcagtttgtgaatattcagaattctgctgaaagtctgaaacaaatgcctatggatttgaaggtgagaaattttaatattctgcagttggcacctattaacatcttctagtctcttcatgccactcttctacttattgacctagtggaaccaaccatgataaatgataccaagttactattttgagtatgacttggtaagatgtaatgctatccattttctgaccagcaagaagctaaacatctactgagtattattttctcttgacaacagtggtgcttggttgagttacttttttccttttctttttttttgcattccatccctcaataattttgtttgagatttggtaccatcacactgaggctgtgtttagttccatgctaaaattggaagtttgaagaaattggagcgatgtgatggaaaagttggaagtttgtgtgtgtagaaaagttcgatgtgacggaaaagttggaagtttgaagaaaaaagttggaatctaaacagggcgtgactgtaatttccataggctgctggttaattttgtggaagtctctcccatcaggtaacatgttccatatacttcttcgccaagacccaggaatttgctatccggggttgtgcttttgttttcggggcactggagaaatcaagtacacctttaaattttcaggtactcttcaaaccaaactcgtctctctctctctctcacacacacacacacacaccaaaaaaaaaaaactgtgcttcctcccttctatgttttgtcaagacattgtgtagtggtagtacattgtgtagtcccacagtgatctgaaccaccgtttgagatcaggaaaaggattcaatttggcaatgactgtacagtttattctcacttgtattaattacttatcttcacttcagttgtttgttcctgttcagggaaccagaagtttggaagatcactggaaaatcctagttggtgagagatattagtacacaaagcatcgtgatgtctgagatatctacatataacatacagattccataatgatctgcgaggttatttgctattactggatcttccttacgtcaaagatgtttcttttagtcatgccatgatacagacagacgagtactgcttgctaaggagtcacaatcaacagaacgtgattgatcagaaggaaacggcaagtgagttcaggaaaaggtaacattcaaaacaattataaaaaagatgtcatattgaaaacaactctgcacaaatcagggcaatcaaaacttctgtacaaaaagaacaaatgaattggctgtggagggttaaaagggctccttaagaataacctctagaagaacaggaaaagaacagaaaagaaagaaaaaaaaaatgaatattgtacatgtacatgtttcaaagctctcatggtgtttggcatcttcttccaggattgttaggatcattggtgcatccagatgcacctggctttgctgaagttaagaacaccgtgcttccctgtcgtggctgcgatctcgctcccagcaatctggatgcatgactgatggtgattgtggtgctgaagatcagcatgaaaatgagagctagaggcagaacttgctgtcttctgatcggcatagttgagcagctgacctcctggtatgttctgaattcttgtggaaggcgagttacgaaggctgaaaaactggggtgaatataaagactgtgtcaacacgtatatgttcatatgttgtataaatttataatgctcttgagcgcgtttggttccttgtgtgtcaagcttcgatgtgcctacccgagggctcgacgcgttgtcgcggtcagctacgacttgcaaaaccattcatcacgtggttttcatgtaattgtaaaccttgaccttcgcataagagagcttgacctttggcataagagagtcttcgtgtagaattcatacgaaatccctttcacagtttcaacattccagagttttaagtgcatgatcattcaatactattccgtactctccaaggctcagtaaggaatgctaaatctctcgttttcttcatgttaaagaggatgcagcttgaatggtcgaattcacaattgacggctccaccccaaaaaagttcaggatgactcgaagtcgaatccgcgtaatacgctggcgaaaattgaatgggccaaatgtagcccatatccattttattcatgggtctttgaacaattgagctcgaaagcccagctctctctcgtgaaaagcttaaccgacctagctctcgagggcgcgctcagaaccaaaaatttcgaaaaggtaaggccgaaatcgccgcctcctccctccggtttctccccctcccagagcgtagcctgcgcctcctctcgcgatgcaccacggcggcggcggcggcgcgatccgcgtgctgaatgtggcggagaagccgtcggtggcgaagtccgtcgcggagatcctgtcgcggccgtcgggcgggatgcggtcgcgggaggggcggtcacggtacaaccgcgtcttcgagttcgattactccatcggcggccgcgcctgccacatgctcgtcacctccgtcacggggcacctcatggagctcgagttcgacgaccggttccgccgctggcactcgtgcgaccccgctgatctcttccacgcccccgttcgcaagtccgtaccccaggtacggctctctgtttcctgctacccatttctccgaacagttggtgcgcaacgcgcggtgtcctgtgaattgtgccctcaccagtcacgtgtcgttttttgcatggtgtggtctcttagtgtcttgcgtccatggagttggctgtgtttaactcacggtgaaatgtgcggcactgaaatttcgttgactagtttatgttcgtgcgtttggtggtgtactgtacctggattccagttcgtgggggcctgagggtctaataatgagtacctgatttgtactatcaatggatgcgtctgctgattttgtttagggtactgcacttaaggaactctattctagggttcttcaggagcttgatcgggggacatcgcatgattgctactcgtttttgaattgggaaccactagtgctgctggtcatttgcactgttgcgcagcagcaatctggttccagtcatatacgtctgtgtgttgtactatacatgtgatacattaagttattgttattgtgataggaagagggatacagtaatgcataaactgtcctatttggttattttgaaaaactgaaggctatacttgctattgctggtataagagggtagttgtatgccgggctggccgacctagtatgattatatgaacaccctggcagatactattctcaggcctcaggaagtcgggcttttgttctgaaattaaagtttatcctacaacatcatttatcttgcagaaaaattagtaaactagaggcagaagttaaacagatatacaagtttcctctcattcttccgttcttccagcatcaggagaacaagatgctactctttttgtcggttgcactgccacaaccatgctggagcttgcttgttgtatgtgatttggtgtagcagtatgttttctccatagtcatcattgatctgatagattgcctatgtatcttttccttttgtctttttagaatctcctatcttagatggatttattgggtaacatgcaggcatgccttaaattgctgagaatgaccatgctcatttgtctatttgcccaaacacgtgatctgtttttgtgttttgatgctagtggtatggtctgatggtaatgaagttataattactgctccagtttctttttttttcagctgaggtatattcatttttttaattaattgcaggataagcaagacataaaaagaacattggaagaggaagccaggaagtgtcagtggcttgtgctttggcttgattgtgatagagagggtgagaatatcgcatatgaagtgattgatatatgcgcaggtgccaacagccgcctcaacatttggagagctcgtttctcagctttgattgacaggtatttgttgctactgatgactttctcttcttgattgcaaagatggcatatccatctcctgcatcgcacgggtatccccattcacttcacatccggcccgattggtgttactttgagttagttgtatggagatgaactatggtgttcaagttgactggataaacccgacccacagtcccacactcatcccaaatctcctgttaatgtcttaaagaaatgaaactgcagggaaatccatgaagctgtgcaacatcttgacagacccaacaagctctttgctgatgctgttgatgcaagacaggtaattaaattatcattccaacctttgttgatgttgcattctcttgcatcacatctactgagaagtactacagcaactctagcaaactaaggtcctcgaagagcctctgccacatgttctgactataatattatagcttttgtactggtataggaatggaatgggacgacggtatattttctccttcttatattattcttctcaaatgaaaagcattttcttgcaccttcttagtgtcttgaagatctccgatgattattaagaattttgtacaggaaattgaccttcgcatcggtgcctccttcacaaggttccagacaatgctgctgaaagatgcatttgttcttgatgacactggtgatgataggaatataattctgagttatggtccttgccaggtacttcactatagagtatgaacagaagatactaaatgatgcctactttcatcttggtgtaacatgttctttgcattgcagtttccaaccctaggatttattgttgagcgtttctgggagattcaagctcatgaacctgaagagttctggacaataaattgttcccacacttcagatgaaggcactgcatcttttggttggatgtaagatgcactcgacatgttgtactgattctttcattacaaacgtcatctgagattatttcttgtttggcagacgtggtcatttgtttgattactcatctgctgttgtgatctatgaaatgtgtgttgaagaaccaatggcgacagtgagcccttgacatcttttatttcaacaccaatgttcacgaaataataacgataagtatctttgatgacagaacaaaagtaccagtttagttgtattttttccctgcaggtgcaaaatgtaaggaatcaagagaaactaaaataccccccatatccactaagtaccatagagcttcagaaacgtgcctctaggtacttcagaatgagttccgagcacacaatgaaggtgttaaaaataattctattttggtaaccttgtatacctagaacagttttgctagccaattatggccacatatcactgaactgattgttttgctgagtgctctcttgtcctgtctatatcaggtggctgaggaactttatcaagctggatttattagttatcccaggacagagactgataacttctctccaaacactgacctacatgtatgttttcaaatttactagttcctcttgtccattcttatttcatggtttgatgattcggattacatgttattgaatatttgcacctataactttcatttttacataatttacatgataaagaatatgttctcaaagtcaaatactccctctgttcctaaatataagcatttatagcaattcaaactttgtacacaaatataagcattatcttggacacagttttcaaagtaggggaatctaagcaatttcagccagtcagatgattgggagggaatccaagcaagggcatttgagtttcgcctaaacccttaatcttttctaaacaacctataaatacttatatctgggaacagagagagtaattggtttgttactttttttttggtaattggttccccttttcattttgtgtggatatgctaacacatgatgatccccgtcacgtttaaatatttgatttataaaattctaatcatatgtcattcatgaaatgccactagaaaatattaaaagcgttttctacactctgataaatacctgcgatggttataccattttaaccttcccttgtttgtttgttttttcaaaaagaatatatctattttttccgacatgtttgggtacttttgatgtagtccatcgtacatgaacaagtggctcatccaaattggggaacatatgctcagcgtcttttggatcctgaagcaagactttggagaaaccccagcaatggtggtcacgatgacaaggcacatcctcctattcatccaacaaaattttcagctggggaaacaaattggactgataatcacaaagtatgtgtctttcctatatagcagatactatagcatttttaatattttttaaaggcagtatttcttatgttctacaagtgtgtaataaaactcttcatatttgtcttcttgtgtccagaaattgtatgagcttgttgttcgccatttccttgcttgttgctcccaacctgcagttggagctgaaacaactgtggaaattgacattgctggtgaacagttcaatgcatcagggcgcgttgttcttgctgtgagcatcctcaaaccttgctggaatcgtctattgtttcataggtgttgcaaacgtgtaaataggcagtatccatacaggacatgtaaatatgttacatatcctatacctctaattctgcttgttctttagttctttaaacactttgctccactaataaatctggtaaacaagagtaggagaaagtgtatttcaatcagtaatagaaacaacttgatcttatgtacagaggtgacatagtcttaacttttaagctctgagaagcgtcttctttgtgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62942 - DNA, 15745 bp, Oryza sativa
  unsure (1)..(15745): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggttggcacatcataacggaagtggacgaagacggccgacctagtgccccggtagaagccgccaagaactatgtgtcatgcccggaaattcactagtaatttccgaacttatttgtgtataaaaccctcatccaggaatcagccgaggtacacaaactgacaatttaatatacaaatccatcataataacgttacatacttacaaaagaaaagaaaacagcagcggaattacggtctagcgatggcttcagctccactcccacaggcagctcaactggggtataagccaaacgtcttctccttctggatcctttctcttcaactgaggtttgatggttattgcaagaatgagcatatgacatactcaacaagccacacagcaaatatgcaagtgcacaaggataccaaaggatggcataatatagggttcatatgcgaaagcagcatttaacaaagagttgagaatttgtaaaacagtagagtaattaatcattaatattaatcaacactgaacagcacacccatgctgcacaggcccaaccaaacctgaataaccaaccccggtcatacagatcaaacctccaaaccaggaattatccattccaaatcaggagtcaaattaattatcacattattatcattaatgagtagtgtgggactaatcacaaaaaacattgctcaaagggttgtttgggatctgtgtgacttgccttgagcttcctcaaacgcttccgaaccttcctcaacgaaaacgctctccttcggaacgtcggaaactaaagcgaaagaacaaaatcaagaacaagcataaatagtacatgtggatatttttaacatgtagatcttgattttagaaaaaattagcaacttgaaccactgaaatccgagttacgatgatttagttatgaatttccgaagtttaaatcgattttcatctaataaagaaaactaaaagagatttatgacgtcatcatcgccggcatgacgcgagcgacgacatcaccggcgctagagagatcggccgggctaacggaggacatctacgcgtagaggacgacgacgcgaactcaccgatgcaagaaaacgcgacgaacgacgaagaacgacggccggcggcgaggttctatggcagcgcggttcgggtcggcggcggcgacggcgctccggcgtccggcgacggcggcgagggggcggccgagatgcacctcctccgtgcgcacccaacggcggcgaaaagaggcggcggcgacggcgctagcggcggcgcgacgcggctgcacgatggccggcggcggcggcgactaagactacgcggcggcggcgctacgagcgacgagggagctcgggagttggggcaaacgaaagaggacgactaggggatgctatttataggcttggattgaagagatcggactccagccgagaggaatcgaagctggaaaatcttcgggttagtttggagagataaactcaaaacgaattcgatttggtttatccggatgaaattgatctccgaaacgttaggggaaaggaagaggataaggtggagatgatttcccctcaactaatcggactcgagggcgaccggatgaggcgaatttggtggagaggcggcggcggctcgggctcggcttggcaaggcggctggccggaggtaggggatgggtccgacatgtgggccccacatgtctgcggcttggggagaggaggggcgggcggttcggctgggccgacttgggccgctcggcacgcgtgaggagagagagagagagagttgggccggaaacggcccaacaacttagaggaggattttaaagagtttttcaattaaaataatcactgaaatgatctttgaattgttaaaaatacttcaaatgctcaaataatttcaataaaaaacctgaaaatacttggacactcaaagtatttaacaaaattaaaatcagatcatttaatgattaatttaatatgtgggtaattactgaaatgttcttggtatgattaaaattaggaattgaggtccgaaaaatccgagaataatccagagagtataattaaccatggagaatttaataaaaattaaattcatccatgctttatatttaggaaattttatttcccacatttaacttcacttgtaaattaatgaacatttaatataaattctaataataatttgttaaataatttataaatcctaagacgaaaatcaggatgtgacaactatgtacgtcacagcggttgggttgtgcgggataacgtgaatgtcagtacggtgtactggcacagaaaagggcacgcggagatcatgagagctttgtcccagattcggagaaagagatgatgtggaccacaatgctcgagacattcacccttcccgcgggtacagaggacaaagtgaaaaggtggactctgaagaaaatggcagaacagtttcagagcttcaagagagatctgtaccagaaatatatcctgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatagaggctagcttgcttgagaggggtatcgaatcggccaccgctaattggccggaacgatcgaagttctggtactatactcacggtggaacgctcaacccagctgatggctccctggtcttcggcgatcagatacgcgaggctgcgcgtcgactaacagacacagtggaagcctcttctcagggcatgttccgaccggacaaagggaaggacgagctgtcactcgccctgcagactccagagtatccaggacgaacacgagggaaaggggtgattccttggaagattgggttcaaggaggacatccacacgtacaggagtcggatggggagcaaaagagataccgaggcgaagattgcagatcttgagttcagggtatcgaactacgagctcagcatgcaagaggaggtggcaaggaagggtgatgaacgcatgaccacacatcggtccaatgatccctagccgaccattcctcctgcaatggtgagcccgtcaggaaattgtagcagctgcgcctcaacggggcaggtaggatcacagagcatggacgtcatgcaaacccaggacgaaaccacctgccccgttgatgacatcactcagcggacaccatgtgagctgcatatccccttcaggaacttatcaataaaggtaagctcgtagtttatagattttagatttggccattccgctagttgctgcttatatatgttgattattaataaataacctctcaccacatgaaggtggcgtcgggcatggccatcccaacggacccttcaggtacttaccactgtaggccgattccagcaagatactccaaggtcgaagttgagttggtcgaaggcgcgtacgaggacctcgagctagattaccctagaggagacggtgagacacatctacgagacacaagccacgccattattctatggcgcaagcggtacatcatcctccctaggcgacaagcggcgtctcgtgcaccatctcctccggctctgccatctcctcctcatgctcctgcaccatctcctcctcatgctccagcaccgtctccacctcaggctcctgcaccgactcctcctcaggctcctgcaccgactcctccttaggctcctcttccggcaccttccaagtcaagggccccccaagctccaccgcctgcccccacaagggcaacgaagaaggcgaaagttgacgccgccaagaacaaggacccggggtacgattgcatgcaagaggagcttgacgcttacatggcatcagaagtcaggagacaattcaagcctcgaagtccagaaaagaagattcctatagacccgagtgtcaggaacttcttcaggggtatgtctgcacctgccaaggaggccataaagctatcggactatgagcgaacactcaagaaagcatcttctagaaagtccaaaccagtcccccagcttggagagcaaccaaaccaggagatcgagccattggtgaccggtgaagattttggaatacaagactttattaatgacaccgggctaactatggatcaattgctagaagacgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacaaggacttcttgcaaggagatgacattctctggatcaatttcaagggaatctacgaactataccagctggacgccctcgacgtctctattatgagttgctggattttgtaagtatatcgttcagttagatttcttactacgtctactttaattaattaggtccttgtatataagtagactctatatataatatatactcccttttattgttgtagaatggagatccaaagggcccgacggcagggggttttcgatactggattcatcgaccctcggaaagtaaacgttgcaatgctcgaccaatatccgcaagccacagaggacaatctcgtccatctcctgaaggcgcaacattacaagacgttcatactgttgccgtacaacacagagttagttcaattttactgtcttcctataccaaatttcattcccgtatgaacatgctaagtatttcatatgtaatgcatcccacgcacattgcagattccactatgtgcttttactcttcgacctggaggcctgcaccgtcaacgtatatgactcaatggataaaaaagagtctacatttgacaaggttttcgaacttatagacaggtactgtcataagttcctatattaattaagaatcttgttatagttaattgctactacgaatcatagctttaaactgcatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatatctcgtcgtttgtcatttatttatagtgcgcaaagcaaaagcaaggaactaacttgtgcggctactatgtgtgcgagtattgccactgccttgcagaccaaatcatcaccacaaaagagctcgatgtacgtacaaataaattcaaaatttcattacgtatcgatttgttgtttaattactaatcaatttcatacattcatatagtttattggcatgagggataacctgatcacacacaaggaatttatcgcggcggttcaagaacaactcatgggattcatcaacgaacaaatccttgatcctaagagtgaattctactacgacggaaacacaattcataagtccttagcttctgagctagcgactactactacgtcgaaatcgtagctagctaggacatataatggattgtaattaatacatgactatgtttctatatgcatgtgtacacattttctataatgtaaatatatattttggtcatatatatatatatatatatatatatatatatatatatatatatatatatatgtatgtataaatacatatatattatgcatgtacatatgtattgaaacatatatatgcatggtttatatatatatatatatatatatatataaaccatgcagcaacagggccatgaaaaaaaaaggtcagctcgatctttagtcccggttggtgtcacgcccagaaattctcgaatagaattccaagcagaatgtgcattaaaatccctgtccaggaccggccggggtacacaagcgacaaagttgacatacagatccacgtcttacaaacattataaaagtcttacataaatgcagcggaaaacttaaaggataactggagctaagccttgacttggactgcagcgggaacaccactccacaggcatcctcgacggcacggacgaagcctactcctcggagaaaccaccatctgacgcatactcaaactctggggtttggggaaaatagagcaagactgagtactacccactgcactcagcaagtcataccggaatagaggtatgatgcagggaattatcaaggggtagctatattggttcatttgcataaagcgggcatttataaacggaagttgaaagcagaaaacagttgtaataattaatcaatattaatcatccactgtccaacgctataccacgttgcaacaggcccaaccatccacctatattattcaattccattagattaatctagggtgagtctaatcacggtgaatctggttaaccgcccataaccgcgggcacggctattcgaatagttttactctgatcagaggtgtacaactgtacccaccagacacagccccacgacacgttaccgtgcgccgacatgccaccacgacataccggaaagaggccgcgacaggacccttcgcataaccccctctaaccaagcacaccacacctcaggtttcacccccactcctcgcaaggcagcgggcagtcccctcttgtgcctaggtgaatccggaggccgcataggcagtcgggggcccatccaaactccatcacgcccacccttgcctggatgcgtcggctagaggaaagctacactacaagcccagccgttgcccacgctggcttgtggtaagtacgaggaattcgtccagggtttcccgcgaaccggtccttaattgccatgggcgcgaccatccaaaccatgcacccacggcccaccatttaatatattttaattaaccaacaccggagcggtgagtattaaccaacatcattactagaatgtgattaatgtagtccctcattgtgtgctagttgaactaagcaaagttaagcattccctagtccaatctctagtcatgttatatcccaagttaacaaaggaacatggtacaagatagcatggccatgacagtaggtaaacatcccatagtaatattataaaacaatgcagaatttaaaggaaaacaatagagcatttgcaatataggatcaacatgttcaagtgactagcatgacttgccttgctctgcagctggaggaacttcggcgactaattcaaggtaaaccggagtgtcgggagagccggaatctaagcgacatacaaagcaaacaatacaaacaggctataagactactgaaacagagaacaaaaccatttttaatggattctacacatttttcttgatttactgagacttgaatgggcttaaacggagctcggatgaattagttaagaattttagaagattcactatgtttttactataaacggaaaaatccttaattaaattattgcgcaataaataaatcccggggagagagagggggcggcgctgacatgcgggccccacatggcagtgacccgaggagggcgctccacggcggaccaggtccacggaccgggggagaagcggcgtaccacgtggcgcacacgtggcaccgacgcggcggtcacgcggcagccgaaccgacggccccgatctacccaagggtagatcggacggcgggtgtggctcgcggccggcgcgcgcaggcacggctcaagctggcccggcggccatggcgcatggcggcgcggcgcgcatgcggcggtggcgcgagacggcgaccgacggcggagagcggcgtcgtgggtggctaagcggcggcgcggcggctagcggcacgggagagagagagggaggggaaggggaggcctcaccgacggcgagcaacggagggcggcggcgacggcgggacgatctccggaatcacctaagaaatcgaaatggagggattagagggagggaggcaaaagggagagggcgagggcgccggccgaaggtnnnnnnnnnnnnnnnnnnnnnnngcgcacggcgcggagtggattccgacggcggattccggtggggaaggggtggacgggatggcccgcacgacggcgaacgcgacggcgtcgatagcgcagctcggcacggcggctagcggcgaccggagcggcggcggcggcggcggagaggagggcgacggcgctagggcgctagagggcatgggagagctcggcgagatagggaaaaagagagagggggtggcggtggagcttaaataggggagggggagctcggacgtggccggtagagtcgggaatcgccggccgacgtggggagtggaggaggagagagaggcgggattcgaaaatcgaatcccggccgtttcgagcgcgggcgcgagcgagagagagggggaaatgggtgcggggaacgtgggcacgagggcgacgtgggcgacgtggcccgggaggcgcgggagcggggcacgacggcggttgcgggcgcggtggcgccggctggaggaaggggacgggcccgacaggcgggccccacctgtcggcgaccccaggggagaggaggcgggcggccagttcagctcggctcagctgggcctcggccttcggccggcccagcgggaagaggggggaaaggagaatgggccggcggcccaattgaaggaaaaagagaaaagaaagaaaaaaaagaaaaagaaggaaaatggattttcctgggattaaatattgcttgtgctcaattttaattggttaaaattatttctagagcactgaaaattccactaaaaatcttgttagcgtatttcgacatgtagaactcaagaaaaattccacatgacaaatccaattattatttgcattaatttattagggttttctcttgcttttacaccgatattttctctggtggattataaattcaatttaggcttgggaaagaacttcaggatgtgacagttggtgttaccaaccgggactaaagatcgatctttagtcccggttatttcacccgggactaaagatagcgatctttagtcccggattggtagtcccggtttggaaactgggactaatggggggttacgaaccgggactacaaacactttctccaccaatgagtcgtccccctcgaacttagagaccttgactatacaaaataaaccaaatgtttcctaatattcacaccctaaataaattgcctcttttggtcttctttcttcctatacaacttaatagtttaccatgtgaaatggttaaaccagaaagtggatgaactagagtagattaacgggaacacagactgtggtcaccatcgcgtcttttttcctcagcaagcttgaatccaagttgacacttgatgtctctgctttcacccaaatttggcacctatgttaaaaataggaaaacattgccaaaacttggaaggcgccggtttccttcacggagccggtctgaccgccgtctacgggccggcctgaccggtgtaaagggccggtctaaccgacggtgtgtggccagtctgaccggcagaatttgatttcgagtccgttttcgttggatctcgggattccttgctcgggagggtatgtctcgggttttcattagtttctatcccgagttggacgtggaggaggacccgtaggaggcaagactaacccctatataaggacaaggccagttcaattgaaaaaacaatatactctcaacacaatttagccaatcgaatcactttttcaatattatatttacttttcgcctagttctagcctagttcgtccatatttgtcgatttgcacttaaatcgtctgtcttcactgcgagagtgcgaaatccctttgtaggtttgtcccgtaaaccttccgttcgcccatgagacgggtgtttatcgcttgtttcatctaaatcagctccgctagccggtttaatctatcaaacccatcttgatctagcttttgttagattgaggtggttggcgactccatatcactgcaaggtgtttaggtctcccgatcgtgatcgtcttcttgccaaaaaaaagttgttaacacgatttttagcgactccgttggggaacgacttcatcaacatcattgccaagtgtgaagtggacccaaacaacatcctccccatcactttggaggattcggatgagtaacaacaccaagagatcgaatgtcatgtaaaggcgacgccagaggcattcttggcgagatgcttcatcaagactcgtcaaagagttattcgtaagcccggccttacgtcctaagtcaccgtcaatgaggtaaatattggtgacattgctctttctgttcaaaagcttgtagcaagttccgtagatgaatctggtgccgctactttgaataataaatttgagcatactatgagttcttattttgataaaagaattgagtcatttatgagttccaaattcgaccgacttgtcacctaattctactttaagtactagtcaagcccctgtacttaaaatagatccggtggaattgtacccgtgcatgaaatagatccaatcactaagaatgttgttttgcaccattatctagtacataatccaccagttgctcttgctaatccacatattcctccacatgtaactaatgcctataatgatcctaatgttggatagcctcaagatgttagatatgtccaatataacaatattgcgccgccaccaccttttaggccacaaaatccacaaccaaagcctgaaaagatggaggagcatgtgaggaatattactagagaagcatttggaattgagccaaggaatcatgctagggtttaccaaaagtcgtattctgattattttgataacatcccatatcctcgtggtttttgagtgcctgtatttactaaattaaatggtgaagatagtagaaccacatgggaacacacagaccaattcttagcacaatgtggtgaagctagtaaaagggatgattttaaattgcgcttattttctttatctttgtccggtactgtttttgcatggtttacttctttaccagcaaattctattcatatttgggctaaattagaacaaaaaattcatgattacttatatactggtgaaactgagcttaggttgtctgatttgacatcggttaggcaaaagtacaatgaatacgtcactgattatgttaagagatttagggatgctagaaactaatgttttagtttgaatataactgaaagagatttggccgaccttgcttataatggtttacttgctcctattaaagaaagattagaatgtcaacaatttcttgatgttagtcaacttatgcaaaaggctttagctcaagaaaaccgggttaaagaaactaagaggtttattaggtctaatgataagaagcctaatgctagtattgttgtttgccctgatgatattgattccgataatgatgatggtgatcatgatatttatattactgagtggtcatggactaataagaataaaccttttctttgttctaacttgacaccgactactcgcaaggatcagcaaagtgagattaagaatagttttgatgtggccaagtgtgataagatttttgattatcttttgcaaaaaaaaaacaaattagattacccagaggccatgtcataccatctttagaggagttgaagagtcgttttttttgcaaatggcatgattcttattctcatactactaatgaatgcaatgtgtttcatcggccatagaagaaggatgattgaaatttactgaaggttctaagatgaagctagattatgatttttttttcctgtgaatactattgatttcaatgataagaatgtgttaatttggcgggagcaagctatatctacaaaggggaaggaagttgtgataggagaatctagacctaagatgattgtgccaaaaagtctagaagttggtgtatggaaggagaataaaggtgaagcttcaagttctagaacgccacaaaagtcaaaggcgtctttttagatgcttttgaacaagtatgggaagaagagtgccgaggaacatcctaataagggtaaaagaccaagatcacttccttgggagagaatgtgttgattaccaaggcaattggagcaaccttttccttacaatcctcaactcatgccatgggggccttgtccaatgacgccgctgggttatcctttcccttacttcatgccatgaaaggcaccaccaccaatgtacgagtacatgctgccaatgcaattttataaaggttagctagagccacgaaggtcagtgcatgagcggttgtctttatcaagcaaagaccggtttcagtcaaaaaatcggtttgaggaggaaagaggaggaagaaagcatgctaaagtggagccaaggacttcgaaggtgattactgtcaaagtggggtcttatgatgtaccaatacctactggaaatagagccaaggtggtccagagtaagaaaaccaaagccgggaccagcataacgcagagtgctggtctgaccaggccttctggccggtctaaccgcgccttagggccggtctgattgaagccaattaggagctggaccatcgcgaagggcctgtctgaccggcggtcttcaaccggtttgacctggtctcgaggtcggtctgaccggggtcatctagggagcagttcgggagcttcatcttcatcaagtaaaatcaattagggacattacattgctcctgggatagagacaaattaaaggtggatgcctaagaatttgacggcttcacaaaagaggaggttgcaacatcttcgtgctcaagaaatgagggaaaagaaatccgaagagtggagagatatgagattcaatgagttgcgaccaccagcaagacaagagtggaggcctaagccaatggaggtctaaaagccggtggttgctcaagatgaggaagggaagacttgaaagaagatgagccaccaattgttagtaatgattcaccgccaagggaacatggatgtcaacatggtgtgtatgttgcctatggagttccatgccatggatgaggccagaattgcccaactttcactaggaccaagggatatggtttttgagaagcctgatgagtctaatcgtcatatgaagcctctatatctcaagggacatattgatggaagacgatctttaggatgttagtggatggtggtgccaccgtgaatttgatgccatacttactattcaagaagttggggcgtggagatgaagagttgaagaagaccaacatgacgctcaacggcttcaatggtgaaccaacggaggccaaagggatcttttccgtggagcttaccataggaaacaagatgttgcctaccgctttcttaatcatcgacgtgcaaggtaactgtagtgttattttgggttgttgttggattcatgccaattgttgcgttccttccaccttgcaccaatgcttgattcaatgcgacaataataatattgagattgttcaagcggatacatcggctgaggttgcaatggccaatgcttcaattgaatggcaacatggaaacattcaatgcttgtcggggttagatctttctagctatggtttttattagtatttctaagatggctttgtacctatctctttaaagccgtctagttttcggcttggcaatatagctatgtatgatgagtaaggatgctaatttagagtggttgcaaaagagggtacaagaatatcggtatataaagaacgatattggtgagtccattgaagattttgctgaagtggagaagttggatcaaggttttacatcggttgatccattagaggaagtagatataggtgatggaactataccaaggttgattataaggttaaaataattgagttgtttaatgagtatgttgattgttttgcatgggaataccatgagatgctaggacttaactgtgagcttgttgagcatcgacttatgataaaattaggatttaggccttataaacaaccacctcttcatttcaatcctctcatatacgatcgtgtcaaggaaaagatagaccgattgttaaaagcggggtttattaggccatgtagatatgcggagtgggtgcccaatattgttccggttgagaataaaggaattggtaagattagaatatgcatagattttagagatttaaataaagttactcctaaatatgaatatcatatgcctatagccgacatgttgattaatgatgcttcgggacataatgttattagctttttagatggtaatgctgactgcaatcaaatctttatggccaaagagaacatgttcaaaacggctagtgcaacatatcaaagagcatatgacttttgggttaaagaatgccagtgcaacatatcaaagagcaatgagtttgatctttcatcaggataaaaggactaatacatctaaagcgacataatagccccgatagcgcaagccatcgagataagttacctcttgtcaagaaatcgttgtcgatgccctaacttgaagcaagaactcatcgaaaagtaaaaagaaaaggatggcgatgcatcggaagttgtattgattggattgtcgtcccttattacaatgatctggggtttatatttataccccgagtacaaaacttgtccattatggacacgactcaaactttcctaaagataaaatacaaacaggtccacgtggcagactcttaacatatctctaactcaaaccggcattaatatcctaattaatagatacaattgccttaaatgacctttatctctatgcggcaatgacggttatcccaatcgaggcctaaaccgagcccaagtcaagttgtatcaactgctcgccatatcgactcagtcatactcttactctattttcagtagatacgctacccagtcgattcgcagtccgttttggcaaagatccaatctccttcgattccgcttcgatacccaacttcaaatctgatctgatcttgccaaatttcactgttaacaactgctcccctcatcgaagctctccgctttccgccgccaccatgtcgtagtccatggcgaaatccgtcccgatcctggatcaagccgtctcttggatgcgatcgatggtgacgacggcgatgctggaggaggcggtggaggaggggatgctccctcctcaggttctcatcggctggcgggaggactccgaggaggagttcccgaccccgaacaccgacaagattgtattgttcctccccttcttcctacgctaaattgtacctgtcgctcctggaatttgtgctagcactcaaggaagcaagagcgcctcgccatgagtcgcgctgcctccacttggttgcagaacaccattcccaacgcccctggatggtgagccaggcgtcacatgcatgagcggtggcaaaattgccgacgttgaccctggcagtgcaccacccatttgcaccgctgctgtcggtagacggagcctg

SEQ ID NO: 62943 - DNA, 2798 bp, Oryza sativa
gtgtcggggatgtcaacgatctcggagcccatggacacagaaccaaagcaatctgataccaagttgtcacgggctagggaattggaaggaggattgctgcaccagccaatcgcatctctcgcagtgagaggtcgcggaaagttgggacccaagttctatgggccatatcagattatcgagtgcatcagctctgtggcatatcgccgttgtcttcctccgggagctcatctccatgatgtttttcatgtgggattgtggaagccgtttacaggagtgccaccggaggtcgtgccgtctttgcctccgacgcatcatggccaagtttgccttcagctggaaactgtttcgcagagtcgtttggctcatggtctacgtgaagttcttgttcaatggaaaaataagccggtggctaactttcagctcgaggacgaactacttctcagggggagagatgtcacgtggggattgcagtattcacgccgccgcaacaggaagcccgcgacaaccatgtgatgcgcaatccccaaataggaaaatttcctaaaggatttgaatcctatgaaatttaaatccaaaggggctcttactctgttgcagaaatcattctgtgacaactgagctatgcaggacagaagctccagattttgtgacatgcaggtttataatacacaatattacaaactgtcatagtgcaagcaaatacaacttcgaagtaccaaaattgaacatgtttatgaaataaaggaaggtctctaatcccgaagtcaagacaaaacaagcagtcctacgaattcaaaatctgagggcctttttgatttgtaggaaaagtgtaggaaatttgaaggatttcaatcctatggaaaaaatttctatgaaagcttttgaaacaaaggattgaatcctatactatcctttaaaattcctatggaatggataatcctatagagattttggaggaaagttagcgagaggtccaaccttttggaaaaattcctttgagtctatctctctcatctgattcctgcgtttttcctgtggtccaatcaaacggtcattcatgtgtttttcctgtattttccaatcctctgttttacacctgcattcctgtcagaatcctgcgtttttccattcctgcaattcaaaggggccctcaaaatgagaatcttacagatcgaatgaccaatagccatcacatcatttttttttcctcattgttttatctggtaatgaaaattttcagaagttagtaaaagcaagatattgcaagattacagaattacttaaacatggatttagaaaatgtagttatctactgacaatgcacatgtgcagtacaatgaagtgagtaaaagcaagtgagattacgtggggatattaaaaaattcttaacataagaaaatcaagtgggtcaattattaaatacttaacagtatggtatgaaatctaatgccacagggatcaatcaattcaaaaaaaaaagccagaataatgtaagccataatcatcgataattagttcaatgacttactctgccatccatgagcccatgatcatcgtattgttgcactgcatcatctttctgttgtcattacaaaaaaagccactactgaagcatcaactcaattccaccaaacttggtcctaaagtgcatcactcgactcagtgcacagaacagcagtaaggcaagaatttggcaacctcttaccaagtacgatttctagaacttgacagtatccttttctgaaacgcccttctgatttccaccttggatccaaactccaaagatagctcaagcaatgccttgaaatccttttgttcttgccacttccacaaacaatgcctaggcttccaggaagctccataacactgcaatataagaaattcaacagaaaaataacattaagcatctataattgtaacacacatttttttagttctgattagcaaataattagaaattctgtacaattaattcagacaattagaaaaaatgtttgttacagctgggaaataaattaaagtatctaattacatcctcgctactgcgggaaaaaaacattccttttattctttaaacagtgagataatacataaatttaacatcaatcatcatatttctaagtcctacatttcttctccgcattttggtacttagggaagggaagacgagtcatatactccctccgtcccaaaatatagcaacctaggacccattcccatcctaggttgctatattttgggacggagggagtagtagtttacaaataaatcaaaacaactaaccctatatccagaattatccaacattttattgctgatatgaatattgcatgatcgtaatatgctgcaaattattatgcatgagcatccaaagctttgttggtccaaaaatttgatagaacaaaatacggaagtacttgattgaggagctgataggttcccttttgttcttatgctgcttgcagcctcccacttcaattccatcgggcttgcagtggcacgatggtggtcacccttcttggtggtgctgctgccaacttccccatgctgtgcgcctgtgcccctgctgctgatgggctcggccttgtgattccttgttatatatatccaggagtactgatcgttatatccaagagtactgactacattgatccagctaatccaggtggcttgtatacacacctctctttcatcaaaaccctcaccttgtcagcatcatcccatttccctgcctccacacagatgtttgacagcaagacataatttgaggccttgcaaggttccaattcaaataactt

SEQ ID NO: 62944 - DNA, 3887 bp, Oryza sativa
tcctgcagcccaggctttaacgagtacaattttatcatcgaattgaagaaatgcaatccttcatcaattaacccaccttgactgcaagctgataacacaactaccaacgtgatctcatcaggtctgacactgttagcttccatttcccggaatactgctatcacctcagacccattaccattagaagcatagccatcgatgagtgcattccatgaaacgatgtcttgtactaccatctcatcaaagacttgtcttgcttccaacatccttccacacttagcataggcagaaatcaaggcatttccaggagaagaatcactgataaacccagtcctgacaagaagactgtggaattgtctccctatttgcagagtagccaaatttgcacttgcacttagacaacatgcatatgtacaccagtcagcgctctttgcatcccttctcataagcataaaatgctgcagtgcttcaacaaatagaccattttgaacaaatccagagataattgaattccatgaaactgtatttctcctcttcattttcctgaaaatactggctgccttgcgaatttgtccaccctgagcacagccagcaatcatggtgttccaagaaatcatatccttgttcggcatttgctggaataaaaccatggcctcatcaagcataccacactgaacatatcctgatatcattgtattccagcacactgcatcccgaaccacaattccatcaaatagttgacgggcgtcatcaatcaggttgcttttcaaatagccatgcatcagtgcagtctttgctccgacattgtcggaaggcatcttgctgagcacatccttcgcttcttggagcttcccagaacgtacaaaaccactcaccatcgttgtccatgagattgaattcttctctggcatctctataaacagattataggccgcctccacctgagagaactgcacatacccagaaagcagcacattccaagccacaacattacgctcaggcattctatcaaacaattctcttgcctcgcccatcctccctgcctgacaatacccattgaccaagttaacccaagaaataacattaggtgaggggatccttgaaaagaatgcactggccacatccaaatccccagcacgcacatacccctctagcatcaagttccaggacaccaagtccttatctggcatctcatcaaagaactgcactgatcgagagatttcctcattccggatgagcccccccaacactgagttccatgaaacaatatcaggggccggcatctcctgcaacaaagcaattgcatcctcaaacctgccgttcttggcatacccggagatcatggtgttgtagcacgccgcgcacttctccccgggcatgcggtcgagcagctcccttgcgagggtgagctcaccagcccgcacgtagcaggataccatgattgtccaggagtactcgtttcgggcgggcattgcatcgaatagccctcgcgcatcctcgacgcgcccgtgctgagagcatgccaccatcatggtgttccaggacacggggttgcggcgcggcatctcgtcgaacagcctgcgcgcctcggcgaggcggccgtggtgggccagcgcggagaccatcgcgttgtaggagaccacgttgcggcggggcatctcctcgaacaggcggcgcgcggcggccagctggcccgagcgcgccagcgacgtgagctcctggttgctcctaaacacagcagaggcggtgagcttcgcagctgccattgggggcggtgatggcgctggtgccgccagataccacaattcgggatggtcacggaccgatggccccggatggatcggcgcgtcagccggccgacgaccgccagcagtggagcagctcctcaggcctggatccccgcactcgacctccaccagccgcttcgggaggtggcggccggaggtgctgagcagcaagagatgctctgtgcccggtgccctgatgcgctgcggtggcgagcttgttgccggggctcgggaggagatgcgccgcgggcgtgcgtgcaggggttgtttggttcgtaccagatgatgtcacgcgctttactgcaggatataggtaagatattggagaaatatcaatcagagcgtacatcgaaagtcatacttcttaacagcatgtgtatcaaagaaactgaaacttctttaaatttcagtgagcgtgtacattcaaaattataaaatactgttcaattataaaataaagtcaagagattttttttaaaaaaaatcagacaatagcatgcttatatgcttgatccgatttttatcatgaacagtagagttttttaaaatgactatcagacaaaagcatgaatactttagttatcgttatctaaaaaaatgaaatcttctgccatactaccacataatataccactaacatagaatgtataaagccatacttcttaacagcatgtgtatccaagaaacctaaacctctttaaatttcagtgagcgtatacattcaaacttataaaatcctgtttaattataaaatcatgtcaagagattttttttgtttaaaggaccattagaactgtgcaagtttatatgcttcaattataatatcatgtgaagagatgttttgtttaaaggaccatcagaactgtgcaagtttatgtgcttgaaccgatttgtataacattgatgaacaatagaatgggggagaaagagaagggcgaggagggatgtatgtacctttgtgcgaatcagagatccgtgagttggtcgacaaggcaggcgacggtgtcctagcggtggagatcgggggcggcgcggaggatgggaggagacaaccgaggcgggcgacgaggagtggagacgggcaacggtgtctggcggtggagatcaggcaggcggagcggcaggggtgattctcgttgttggcacgaagactgcacggcgttatggatcgacagtgacctgatggtggggtgacagaattatagggtagattaattatttgatttactcacatggttagcagcaaggtcactgtccaagtgaaacagccagagtagagaaatctaagaaaaatattgtcaatgaatacctttctacccgtggtgaggcgaaggtggcaacgagatagagacggagagacggtaccaggacctcagcagatgcagcgtcctccctcacacagtggccttaataggagtacagcaatttgcctgttaatttattttaaccattcctcatgaaatacattatctgaggaagataataagataaagttcagaatcaatattcagctaagtgagtgttctcataaaccctataaatcagagtgttcacagccacatggtactctgaccagttcccatgcattttcccggagccacatggtactctgacggtccaatgggttcatcatcttggttgatattttgacaggatataaaaaataagaggaccaaaagtacaaaaatttccattctatatcttttttttttacagaaatgccacctccctgaagtttcgagttttatttgatgcagtcatataaaccatgactttttgaaagcaaattgtaatgatgaatatcacaaaaaatgctgaaattgtatactctcttgaaaaaagatatgcagaacggaacaatcctgtgaaactgtttatgcaactgcagacatttcattatagggagaattttcggtttgcaaacatgatgaaaatgcaccttggtttgtcagttttggatagaacaaaagggatggagcttacctaccgtcggtggtggtgatccaccacgatgggggcggcgatgaatcagataagaggggaaagatgggggcggcaatgaatcaccgcggcggggggggggggggggggggaaagggg

SEQ ID NO: 62945 - DNA, 23272 bp, Oryza sativa
tccaccgttcaaattaatctgatggataggttctcttcccttatttctttgagtaaatttcacaatatggttcaaaatccagaaaaccacacacattttgatatttggcacttaagtattttggtagtttagtttcacaaaaccacaccatcgatgaatggattcacccgtgagatgacgtggttgttctatctaggttgaggacgtggcatcctattaatttttcgtgcgatggctggtaataggatgtcatgtcctcgtcctaggtgaaacagccatgttatcccgtgggtgaatccattcatcgatagtgtggttttatgaaaccacacaactaaggccatgtttgatttagcttagaattattataatctggattattaagagtaagctgaaacaaacaaatagattattatactagattattataatatataagctagattagtataattcaataatctcctctagaggagctttttccagattattgagtggctaaagatctactacccttagatgcctctaataatccagagaaacaaacaacacgtagcttattttttgttagcttattataatccagcttagagtaatctgatttaataatctagattacaataatcttaagctgaaacaaacagggcctaaaatatgtgtacttaagtgccaagtgtcaaagtgtgtgtggttttctacaacttgaaccacaaaacgtgtagttttgtgaaatttactctatttctttcaataaaatcaagagtaaattacactggcggcctttataaacttataagcaggtttcacgtaggtccacgaatttgataaataaatatgttgcaggatcaacacatttatttattttgttagttgcaggatctccgtcccgccattctctgcctcgagcttctcctctgtggacttctcttccatgcgcttctccaccaagctcccagacgtccccacaccaccgacccgggaaagagccatccggtgaggaggaggagattgtggaagaaatcccctgtcgatagtgtgcgctgccgtcgacccattatgtccttccccctcaagccgcatggttccagggtggcaaggaggaggccatgaaggttgggtttgacgatgccgccgacaaggccgactcgatggccatgtacaaggcggggctggtttctcctagagaaaatgtaggttaatagttgtatcctctagccccagacttcaggacaggatgtaggtagtcattgtgccctgaagtggagtagagagttgaacttatcttgtttttgagccgaatagcccctgactttattttggaatgacagtaggagttgtggcatggagttgacttgattattgcgttgattcttgcagaagattgtcgatcgctctagtgccaagagagaggctctacagagcatcttcgacaacgtgacggagattgagtgcagcgggtcgagctccagcagcagcagaaggaggcgaaggagtggcacatctggagaaggagctatgggtctcctgacgaaaaatccgcgctcagccgatggtgccagatctatgtagacgcgacctaagtcaacgaacacaaaggcctgggagatctgcttacctttagtgtaagtccaaaatattgatgaggtgcgggcgtgccagtcagttcgatcctacaactaacaagataaataaatgtgttgatcaccaaagagtcgattggctgacaagccgatggaggaattctagccgatgccgatatcagtcgacgtcgatagggttatgagcaatcggctatatgtccaatgtagataatgatataaagacaatcggctgataataatataataaaacaacaatataatctagtagaaatcaatcggctaataatgatatgacaaaatgagtgttgatctaatggttacagcatatatcggttggaggtccgacgtcataaaatctaaatgattagataatcaataaaacctctgttgtaatcagctaaaaccaacttgtacataatccttataagccgatgcaacatccagataacccaacggctaaaactccgatgaaacccttcttggcaatcaagaagcaggctagagattatggttctaagcacgacttagtagatcaaacttaactgatgcaacactaagtatgaaaagaaacataatatccaaacaatcaagcctttgactgattttcagggtggtgaatacattagttaatctaatcttgcaagatgatttagccgatatcggcataaaccctaaaaaggatctcaatcgatatgatcaaattaagatgctaagctagattaactaagatatatgataaccagcggctgtagaagatagattagaacatctaaagcgacgccctaatccaccaacgcaaaccgctgagacaagtcatacctcttgttagaagaacgaagccgatgcccttactcgaagcaagaactcgtcaaaaaagtagaaaggtaaaaggtggcgatgtgccaaagttgtatcgatcgagacaaaaattacaatgaccccgggtgtacacatttatacccatgggtagatactagtccttattagacaaaaaaataaacttttctaaagataaaaggaaaacataaagtccttatcgaacgctaaacacacgttcctaaagataaaaggaaactaacaaactcttcctaattaatagataaactaccatgccacatcctacttgaactcggtctcttttggataaacttcttttaattgataaatttccttaaccgaacccatgaagaattcgactactgacaactgatggtgtccatcggccgattccatgactctgaagctgatacttactataggctgatgataacttcgggacttaccaaattttggcgttaagagggtccaaatttcccagctgaggagggatggtaagatgctctggccaagtgatttggtcttcgtgttagtctttgtgatgatgtgtgcctatctgctgttgtggatgaacaggggagatgcgcacgtgaagcgaccgagtggaagaagctggtggaccagcctaaggcagctagcgggcgagctctgatcattgagctggagacgtagttgcaggaggcccaggaaggagcgcacgattttcaggccaagctggatggtgagtcttgtaaatgttgcttctggctattctcgtgttctgctgctgttgatgtctgtcatcttgacaccatcgttagccgcgtccgagtcaatctctgccgagaaggcgaccctgtcggatgagttggtgaagaaggacaccacacagcgcaatctctaggcggatgttgagctgcgtgcgaaaaatactcagacacattatgagcacttccagcgggaattggacgccgccaagggtcttcatgaggagctggtgaagtcagtggagcccaccctggagctgtttttcccttcccggtgtaagggcaaagatcttgtgcaactggcaacagagctggttcctgaggggccaactgctgttcgtcggctgtctgagggtggtggcagggaatgtggcggtcgccgcgaaggtgactccgtgagtttccatctcctcaagaaaaatgatcgagcgaccccacctagcgtgctaactgtcggtttttaatatcggcaatattatttatgggtgcactagatctaggagagatggtgacatagatgtttatattggttgaaaccctcaaagcgaggtaataccctagtccagttgtgagtagattggatctgtataagtgcgcatctgttgacgagaaatccgcgctcggccgatggtgtcgggtctgtgttggcgcaaactaagtcgacgaacacaatggcctaggagatctgcttaactccagtgcaggtccaaaagttgatgagatgcgggcgtgccagtcagtttgatccggcaactgacaagatatacaaataacagatcaaagagccgatcggctgacaagacaatggagtaattccagccgatgccgatagggttttgagttatcggctatatatttgatgtagaatctgacacttgatataaacaatgatataaagacaattagctgatggtaatataacaaaacaaccatataatccagtaaaaccaatcggctaacaatatgatagaataagcactgatccgaaggttaaagcatacatcagctggaggttcgatgttattgaatccacaagattagataaacagtgaaactttggttgcgatcggctaaatccaacttgtatgtaatccttataagccaatgcaacatccagataactcatcggctaaaaccctgatgaaacccttattggcaatcaaaaagcaggctagaggttatggttctaacttctaagcacgactagggctgatgcagcgcaaagtatgaaaagaaacataatgtctagataatcaagcctttgacttattttcagggtagtggataccttagctaatctaatttggtaaagcaattcagccgataccagcataaaccctaaagagaatcccagccgatacaagtaaattgaactaccaaaatagattaactaagatatatgatagatatgtgtttacattgacaagatcggagtgtcgaagccttggccccggcgatgcaaatagccatgacaagtataaacttgtcaaaaaaagtagaaaagtaaaaagggtggcgacgcgtcgaatttgtattgatcgtggagatagtttacaatgaccccgggtgtacatatttatacccataggtagatacgagtccttattggacaagaaagaaacttttctaaagataaaaggaaaacataaagtccttatgggacactaaacacactttcctaaagataaaaggaaactaacaaatactacctaattaatagataacttgccatgtctcttcctccttgaactcggtcacttatggataagcttctgttaatagattaatttccttaactgaatatagcaagaatctgactattggcaacttgataattctcattggccaattccagaactctgaagccgataatggttttaggccgatgactgttggtatttcttagcgacactgccggaaatataattcccagcaatagcactagaaataatcctggtatattatagttacagatatgatccgcaagcatacggatataccattgtagcatttcacccgggagtattccaaggtatcgtatttattttatcccaagggaagatatgataagagattactatgctaacaattcatatattacttatatacatcaagtctatgcaggggttaatttagttcaaagggtagggtgacacacagaagaaagaactaagaactactctcactaaaatatagtctaagctaaatggagaaagaataataaaagtatcattcctgtacttctagtatatatacatctttaatctatacttactagtatacaatcatgcaaccaatacctcgtacccagtgtcctcctagtgtttcgagagaccgcccctggttgccgagttccttacgacaacctgtcatggccatccaaccggggctaaatacggaggagtaccctccccaggaaattgcacttaggataatatacacatgtagaggacacctgcactaatccttcaccatcagcggccggcctctgatccactgtatattaccccaattaatggtatctaataatctaagcaccgtgcttacattactaaatattactccaattaatggtatctaataatcaacatgctcaaggggaatgtgtgacttgcccttcttcttcacttcgatcttctgaactcttttcctcacgaccgcggacttctgaaacggcgcaatatactcactagcacgcaaaacgagaaaaaactctaataaataccaagtaaacagtacaagaaaagtaaacaaacatgtagatcttggttttagatgaattttgcaacttgaatggctcaatttggagttcgtatgaattagatatgaattttagaagttttgagccatttaaataaatttctagaatcaataccaatttattgcgcaattattatttatttttacaaaggaaaaatcaaggattattgcgtcagcgaggggcgggtgtggaccgagtccaccaaaggcgggcccacgcatcagccaaaaggggagggacggtgcaccgtggaccgggaccacggggtggtccacggcgaccaacagtaggctggccacgcgggcacacatgggaccgaggaggggaaaaaagagaggagcaggagggaggtggctcaccgagcgccgaagcagcgaggaggcgacgcgggaaggcggccgacgacgaggagaggcagcggcgccccgcggaaaaacagcgcgagcgaagcaccgacgacgaccggcaggtgaggaagggcggccgagcacctcctcgacctgtagaatgatgaggaggggttaggggaggatggggtggctcaaggcagcgtgaaccaccgaccggaggggattggaaaaggggtagctcaccggtgcgcgaggggaaatggattccagtggttgggacgcgagctgggcggtggccgagggtctcctcgtccttgcagaaccaagggaggcgacgacgcagtgcggggtcggccggagaggtggcgcggtgcggctgtagttggcgatggtggcggagagagatggtgaacgtggtggcggcgtttcggaaatggattggggaagaggagcagtggacggggtgcggtggggcgtggcggcgctgtgggtggcggcgacatggccgggcgaggcgacgctcgccggcgggaggcggcggtggctcgggttggtggtggcggcggggtttcagcggcggtttggggaggggaagtggtggccggtcttgccctccggcggtgaagccggtggtggtggcgtcacaatgcggcgagggttagggcggcggtgacaggcggttggaacgcgccggcgggcggcggagggaggtgcgacggtagcggggtggtttccgggcacgggagagctcgggaaaatggggaaacagatgagaagggcacgagggtgctttatataggctcggggagctttgatacggccgggatgggacgaattttgggcggcaacgaccggcgacatggggtggcgacgtgggctcgtggcgggtcaatccggcgccatttttttgggggaaagtggggggaatggtggaggagtgggcggcgaccacatcccgacggttagacgcgagcgcgagggacaggaggtggcggattttgcagtggagtgggcggccatggcgggcggctgctctggctcgagttggctgggggttggggacccacttgtcggcctgaggagaggggaggccggtttgagggagggggaacaaacttggaggtggcgggaagcgagctgggccagcccgagagaagtaggcgagcggcctggccgggaagagggaggagggcttggaccgaaaatggcccaaggggaacgaaggagaattaaatttgtttttctttttatttaattgattaaatgatctttgtgatattaaaattacttcttgagctccaaaaattcgcgagaaattttaaagagtattttagggcataaagaacattacaaaatattcatggccatgatttttaaaggaaatttttaattccctcattattttacttaacttttaacataactagaaacaatgcccgtgcgttgcaacgggttaaaactattttaatcttattattgttatatggttgagttaggatgaattcattgtgtggattcgcttggatttttatttttagaaaatcatgagctgcaattaggagtttgacttttatctcaagttagcatccatgttttttaaagagattccttatacgattagttttgtatttccagaagcaatgaacttaaaacccaactgaaacaaaaataacgtaccaaagtactaataaaagcatatttaatttttataatagtagagatagaggtatgccacgctattgtctcccgttaataattttcagtttttatttcttttcacgataataggaggtgatcagatatatttgcagtttttatttcttttcgcaataataggaggtcaacagatatatttactcgttaggatctacttaattatacttgattaggccaaaaaagcaacgatgcagccatgcacatgcaggccatctccatcggtatttccttccaatctaaccaggcgcacatctcttccaatctctacggagtacagagacaagtccatctcgcttgatcgtgggctcgtggcaatagtaaaactgaatcggagtgggtgcttcggatgaagcgaaagggaaacgcatgtgaacgcttaaaaaaaaggcaacgggagcatttggattcgatggcgatgtacaagggaatcggatgtggacgcgtcattgcttccctcggatcacgtcagtagtttttgaatcagagatagcggatgacaattagtctcggatacagacgacttaccaaactgcaaaaacatcttaaacttttataatagtagagaagagatagagatttttaaaaatgcatatttaatgatttttaaatcccgaacaaaaatcggggcgttacagtgcaatagtggcattttgtgtagcgacgatgccataggtcttggtggcgatggcggtggtgttggcagagttggcgagtggtagtgttggcaggccagctcggtgtcacgctaggagcaaagtcgagcgtagcgagcagtgccaagggcaatggtggaggtctgcggtgaaggtggcgtggctgcgacaagacagtcattgatggcatcatggtggagtttgtggtcgacgatgataagctaaggaggctcgacggaggttctggttcgcagcgaggaagacgtggcagtagtggttttccggtgagataagtttcggcagcttagcggaggtgaggttctatagcaatgccggtggggtagcgtgatggtttgctcgcagtgtggcaatggcatagcaatgcaaacttttggcgaaataagctacgacagctcaatggaggtagtagagacaacgacctggcagtgatggttgagttgacactgaggggggcatagattgtccggcggtatatttgccttcttggtgttgttttagctaaatgatgagatagcgatggttgtgttgacattgagggggcatagattgtccgggcggtatatttaccttcttggtgttgttttagctaaatgatgagatagcgatggttgtgttgacattgagggggcatagattgtccgggcggtatattttgcaaattttggtgctgagggggcatagattgtctggagggtgtattttgcaaattttggtgggtcttggttcttgaggtatattttatgtgctctatatttaatcggatatatgcagcctttttaaagtaggaacttagcctatcgaatagggaacttagcccttaaataacccaatttgaaattcgctcctatggagatttaaactcaggaccttaaggtactactcaggtcattgtaaccactaggctacatgccggttatgggtcttggttcagattgttgtattttaaggaaaatgatatgatgcgttctaccatttctgttgtggttatgattgttctacggagaaaaaaaaatgagtaccaataatatgtgttgttgcactagctttagtagtcactaatctgagttccttcaaaatcctcgatcccttcgtggaattggttcatatgtatagaatttatttaccactttggaacgaatatttggtgccttgaataaattaactttggaaaattagtaatttaaaccattaaatttgagataacttgtgagatatggtacgcttcagattgtaatccaatgccacaatctgtttcagaacctagcaccgcaacgagtaaaagttttctgtatctggtactgtgtacatgttgctggatgtgctgaactctgaagcaaattgacaagagttttgcagttttgctcatcagattggtatgcccaaagcataaggctcttagattttagagggaacgggaagaaacataattttaagttttcattgttagacccttgagtaaatttagtagcttgtctaggtcaactccatagagctagatgtcactttctctgttccaaaatattagtatttttaaggtttatacatgtattaaggaaagagttagaaaaaactgaagaaatattatgattggttgaaagagaaagtagatgaaaaaagtaaatggaaaatgattgtattggttgagaggaggtggcaggtgtagaaataattttatttttaagtcatagttatactttggaacggatgtagttagatagaaatgactgaaagaatatcgtgattagttggaaagagaaagtagatgaaaaaagcaaatggaaaatagttgtgattggttaagtgtagatggtaggtgtagaaataactttattttagataagttatagctatattttgagatattttgagatgaatatagtaatagtatgataaaaaatgtaatcacctctttcttttttttcttcactcgcctataacgaacgtgtatcattgggaaaaaaaaaacttacctacaacttcgctgaaataaaaaaggttaaaactcccctactaaagtacctacaactgataatattggacgaggcggattttttttcccttttcacttaggccgtgttgtattcttcaactccaaccttcaacttccacgttttctattagcatactttttaaactgctaaatgatatttttttaaaaaaaaagtttctatatagaagttgttaaaaaagcaaataaatccatatatcaaatttataatagttaatacttaattaatcatatgctaatgatgtttgttgttttacgtgcaacaaaaatctatctctaggttgggagatcgaacagggccctacctgatacatctgacaaagttacaccgcaatatttattaaggttaattatatccataccattaaaaaaagtactaattttaaaatatgccattattatttatttaattggaatcatgccattatagttttacacatgtttaaagatataccactgcttacccctagatgtatttaaaaaaaatagaccaaattacccttttccccttcttccttcttcccctttctcccatcttttcccggcatcggcggtggcaggcatgacccaaagggggccaccgcagtcgccgcctcttccctctctagctcttcttaggctaggacatttgtgtctccctctacaccaacgaagaagtcagcgtggggccctcgatcatcactgtcgctgacatctctccttcctcccccaatccctctctacggctgggcaaggcattgacggggcagagggaagccagtgtgtgatgcagaaggtaggagtgggcattcagtctaaccgaaaattttggtctcgatcttcggtctttcagtcttttcgatctttgaaaagtgaacaccgaatttcagcgaaaaatgttaggagcgaaaaatgttaggaccgacaaattcggtctcggtcttttcggtcttggactcggtcctaaccgaaattcaacaacatttcatatatgcaaagaaataatggaaattttcaacacaaaaatcacaaaaaaaattcgtaagcacttatgagtaaaagtctcttattaggttgcatgcctagaaaaagtaggatgtgaaaattagagtttaatcctattaaacatagtggattgtaggttatatttagacatttttgatatttcggtcttttcggtctattcggttacccgaggagactaaccgaattgaccgaacaaaattcggtctttcactacataggaccgaattgatgaccgaatttctcggtctcggtcttttcggttcggtctttttctgcccacccctagcagaaggcaacaccgacgtcctagatctgctcgcctctgctcttcagcctagatccatccgtctctcctcgccgcgaggagtcttgggcgatgatgatgccaaagcagcaaggaccgaggaaagaacgggcgtttctcctctttgacaagctcgtgcacctccctaacagcctccctcatcgcactcgcagctgcttgacgtgtcttcaccgcctccgagtagttgcccggtgatccacctcgccaccgatggccaccttggcacccaacacagtgaggacaactttcgtgaggagccccaggtggagctgcccgacgtcccgagctcccacagcggagcggacgggttaaagtcggggagcagtgagtaggcactgccggtagtgagattcggatggagcatgcagccaagagaaaggggagaatgagggaagagtgaggtagaaatgagggctattttgtcgaatacatataaaatacacatgttagtggcaccattgagttctcaactcatcaccctcgttttccacatgcacacttcttaaattgctaaacggtacgcgttttggaaaaattttatatatgaaagttgctttagaaaatcatatgaatccatttttcaagtttttttagctaataattaattagtcacgtgttaatctatcgttccgttttccgtgcgaaggggagggaatccctccaaaagatcataggctgagagtacaaacaagtatagacctaattaagacaactccattgtttgggttattcgtggaataagccaaatgacatattcgcaaacgagaagtaatttatgaataaaatttttatatacatgtttttagcgacctaaaagcaaagacagaaagataaatttcgatgaaaaaacttaaaatcggttttaaatttaaggttgaaaatttaaattttggctgataagcaaaagcataagtgaaaagatgagtcacacacagatgaaaaaaaaaagaagagaaaaagctaaccaaatcttcctcggccggcgtcccgactcccgagcgcgccagtgcggggcggggcgtcgttgctggccgcgccgcctcctcctcctcctcctccccccaccaccagtccaccacctccctgatcgaatcgaatcgaatcggaatcgaagcgggcgcccacttgaccaaaaaaattatccgttcgaatcgcgcggagctcgtgcttctcttctcgagtcgaagccttgcctaccttaacctcgcgacggctgcgctgcctgccacccccaccacccccagatccggagatcccgcgcggcgcggagcacactggagcggagcgagctggtgctgcaatggcggcccgcccctgatccgatccacaccaccccgccccatggactccgcccgtagctggctccagaagcttcagccgcgggacaaggacaggggcaagccggcgtcgcccaccgccgcgaggaaggacggagcggcggcgatggccgaggatggggaggaggcgatctcgagcaccaccgccaccaaggtggcggccgccaagcagttcatcgagaaccactacaaggaccagatgaggtcgctcgaggagcgcaaggagaggtcagtccccccgctcgctcactcagcctgttatagatcggctaatcgatcggggattgctattgttcggaaatgcgcgtgcgcgttgttcctgggttggaattcgtagggtgatcttcgaactggagctcctcaaggtcgatttgctgtgctcttttattaaacaattattattatgatctgggttccgagttacttgttaggtggtcactatagtagaatacttgcaattttatgacggcgcattagttacgtgttaataacgctaaaataaaccaggagtatattgggtggatggcaatacagtaatgggaatatgtaggattgtggagggtaaaatgattctatttttggcatgatgttaaatgaggtaaggagatgtgccacttggactagaatattccctccgactcaaaaaaaaacccaacctaggataggatagaatctattgacaacgaatctggataagcgcttgtccggattcgttgtcctaggatagatcacatcctatcctaggctgggtttttcttttgagacggatggagtaacttggaaggaggtaataaaggggtccattatctccaattttttttacttccgtggcctggatatataaccatacgatgtatgtgctactgctttgctgattgacctgctccacaacgaagtttcgcctgagtgttctttcataatgatatctcaattgtaataatttacagcttggacttgcattttgttaatatacttaactgctagtcttcattctttgttgttattttatctcttttgagaaaacggcatatgtaggactatttgtatctcatctatttgcaaaggttgacaaactgcaagccttcttttgtaatgtggcatacaccaaccaaatagggtaggaagaaactatgcttattaataaaacctaaaagtaccaaagttttggcaagaacaagggtaaggctcaatactagaaatgtaaacttgaactatatagccaacagcttctttaaattgcttttagtacccatattatatctctggactgcttgtagccatgcactctgttaaactagtttataccccgcactttgctgtgggatatgtggatgaatgcatgttatacattatagaaatgatagatgtatatgtttaaataatgtgaaaaatgatctggagataatgatttaacattgcttgtatattgagttctaaaaatacaacaaaattgttaatgatatgtcatgtttgcatgatatttaaaatactctagataataattgctagtggatgataatgtggtacacttgcatgtgattgaaaatactctagataataattgctagtgggtgatgatgtgacacacttacatgttgagatttatgagttagtgggcatcaactatatagatagtatagatgtgtaccatttcatatggaactatcacatgactatacaacctatcttcttaggtttctgaataatgaaatataggtgttggattgaacttactataaatcttcttggggcttgactgggaagcattcagtgttattctctgccttaaattgttaaacacaatgcatgtgcaatccttgaattttattaatgaactgtattaatattctgtcattttcggaagtgttctctaagggaagatggtatgcataaataaaaatatgtagcataaagcgcttaactattgcattacagcatcataagaggctattcacagttctcttattgccattttttgtgattgatatttgataactctccaatttcaatctttttgtatgtttcagtaagatgctatatattagttttggatatacatttctggcgtagtttagatatcatcgaacacccattcttatttggtggtaaagatattatgccaaattatattataggcgtcggatgctggagagtaagcttgcagatcctgatgtatctgaagaggagcaaaacaatattctgaaggacttcgaaaatagggagagagaaatcatgcgctcaaggaggcacaaaatgggtgttgatgattttgaattgcttaccattattggcagaggtgcatttggggaggtaagaagggcactgtttctactccctatattcgatgcagatatagttgactgttgtgtcatgcgtaataaacatcagtttctgcagtaccttgagaaaccttttattatacatggagaaaagaaatctatttttagaggcaatatatatgttctctgtttctcctgcagcttgcctccagtttacatttttattcttcaggtgaggctctgtagagagaaagctacatccaatgtatatgcaatgaaaaagcttaagaagtctgaaatgttacgaaggggccaggtaattcatgtgtgtttaagtaattaaatcagcttgtccagcaaacttttggttttctaatgtgttcttttcaggttgagcatgtgagagctgaaaggaatcttcttgcagaggttgacagtgcctacattgttaagctttattgctcatttcaagacgaagagtttctataccttgttatggaataccttcctggtggtgacatgatgactctactaatgcgcaaggatacacttacagatgatgaatctagattttatgttgcggagacaattctagcaattgaatccatacacaagcacaattatattcataggtaattcattgataataaaaattgcatggcattcggtagcaaatttgccactccatctttgctatacattttcagggatatcaagcctgacaatttgctgttagaccgaactgggcacctgaagctttcagattttggcttatgcaaacctctagatagtagtagctttccaaatctgagtgagtttgactatgcagtggggaaaaacattaatccgtcaatggatggtgataaactattaagtagctctgctgctcccaggaggacacaacaggaacagctattgcattggcagaagaatcggcggatgctggtatgttaaaatgctttatagtagcattttgcctcttgtctaattgcttaattctatatgcattccctagccagggcaaatcctaggcccaaacacgtacagaggacattctgtatgcatcacaatcatttgggcccttttggattagaggactttaagatagaccccttcagtgtggtagggatataagttcagtttctatacctatctgaacagaattgattaaattcaatctatccaatctaggcctaaacatgcatgcctgatgtgaaagtattccacatgtttgctagaagaagtcaagtatatttacgtaattttagctattatatgtaaagcaaatgcatgacgagatgattgactgtacagtcaaacagttcccattagttcatgatgaaaacgattacactgcattctgcataagatgaaaatgaacacatccaaaatgtcgatagaaaattgtagaaaaaatggcatggtaatcatttgtttgccaaagagccttggcagtgtgttttttatgtatttactttcatgataattgcaggcttattcaacagttggtacacctgattacattgctccggaggtactattgaagaaaggatatggaatggagtgtgacttgttagtacactttaatgaacttttgcagttcatgtcctaatgttttatatctctctcatatttgtactttataggtggtcacttggagccattatgtatgagatgcttgtgggttatccaccattttattcggaagatccaatgtccacatgtaggaaggtaactttaaatgctatagctaagccatgtcccttcaaagacttgtggatttgtatgtgaattctttctattaacttttgagttcaactttacagatagtgaactggagaagtcatctaaaattccctgaagaggccaaactgtcaccagaagctaaagatcttattagcaaactattatgtaacgcggatttgaggcttggaacaaaaggagcacatgagataaaggtgaaagtggttcacatgatctgttacatccttcatgtttgtaagtttggtaatttatagcatgatgtgttcttacaggcacacccgtggttcaaaggtcttgagtgggagaagctatatcagatggaggctgcttttattcctgaggttaatgacgagttggacacacaaaattttgagaaatttgaggaggtgaggtgtcattacgaagctattttggccagttaatggttccaactttttctctatacatattagagtacatgtctcaagtcaactttaaaaactttgaacatcaatatcttatagaatatttagaccgtatgtttagaaaatatatgcatagatttgtccaaaagcactatattatttttattgttattattttatttagtttttcaaatattttgcaagcaaatagttgtcaaagttgaattctgaagacatatttgatgtccaaaatgacatgtttcatgactggagggagcactaatttactgatagcagaagtttcacattgtgtgaagtcctgaatgtttctgcttatcctgctagattttatttgcatggtcacacaagacagtactaggatagctagcacatttgctttcataacctcgctatcgcatgattaaaaataatatcttgatgcagcagccaacaaaagaaatagtgttcatatcactaaagccctctggccagaatgggaagcaccatcttattattacatattccaaaagcagaagccacgcatcgttatattaagaagaagaaaatgaatctagaagactcaaacatgcccattagggcaaggtgtaatacatgacgacttgccaaagaaatagaaagggccatggccggtggcctatacaaacaacatgtactgccaaatgttagcaaggcctttagccccagctatacaccacaacctggccaacctaatgtagcagcagccatcgttgatgagagaaaccaaagcacatcagccaccattttagttggtaaatgctactaagttatcagggatctgacaagagggaaatgagctttttagccattcagtacactctgggatattatcattagttcatttggccttgtttgtttgactatgtcacaccctttattgcatctagtgttgtgtgaagaaaatatacactgaggcggcagatatttgtacattggcaagtccaatatattgtggctcttgtaacctgacttatttcatcagtgcttacctagtgacctttgtgtgtttggtgtcttgcagattgctccaatgcaaacttcatcaaaggcaggtccttggagaaaggtgcacttttttgcagagatcaggcgaccatttgcttttagttttttgtattgtcaatatattggaggatacatttttatttcaaaattactaagggtcgcttcaggctagcgatattttctcttactcttcctgtaggacaatgtttgcatttgaaataaaagtgtgattcgtcatattttaattaccttgtgaccttttttttttctgactctaggtcctgactaaatgtttctattgtgcagatgctttcctccaaggacacgaattttctcaattttacctacaaaaaccttgaactatcagatgatcctgaacatccaggaataggttggttcctttcctagtctactggcatttattccttgcaaaaccttgtaaaaattgtcttggacatagttttgtgctttacacattatttgtaaccatttatcttttggctctgcagctcaagtaaagaaaaagaataacaagccaacgaggcggacctttaaatcaatattgcatggtaaaaggctgtaacacagactcagatatgggatattgtcataatatttacgttgctttccctgacattttacagaatttgctgatactgaagaggaacctcaaagcagttccttgaactcaacgccatcacaattggatcagttgcccgagagccttgagccttctcctcactctagtatctcctcagaagattcacagtcgcggcatagatagcagttgtaatctgaagtggcaaaaagggtacataatgctatccgcagaacttaacggctattcagaagacaaatttggatgtatagaaaagctcctataaatttgcttttagataggcggtggggtgttccaatagccattttcttatattggagcctttagcatttgtttaccgacaatgccgtgcaatttggtttacattggggaggggtatccgtattcttctggtctgtaaattcctggattctgtcattctatacagggttgagattcattctttggagggaacgtgtcatgcgtatgccgctagtcctttttttttgggggtggggaggtggcagaaatctgcatgtccaccttgtcatcacatttgctgcaacgcaaatttctgagaaacaaagaaaacatgtactatcaagatgcatcataaaacaattgtttccccttctgtgcagttaatttccaatctaccaatactgatatcacgcgggacagctggagtaaatcctttactacctgttcaaaaatagttttcttttattttatgcgagaaaaacatagttttctatataattaaagtatactaatacagacagtaattcctttacaacctattcaaaataatttcttcatcaaatcagcagtctgacaaatagtagtaaatgatttagtgatttatggtactggtttcctatcagtaacggtttttggagagggccaaaaaaaagagaattacggattaacaggacggcccaacagaaaaacaagaaaagaggaacgggctgccgcgtgtattagctaccgattttaaccctttgccacggtaacagccgccaacagaaacccaaaaacaaattttttttggggggaatattatacctatgcatcaccaacagtcctcctatattgtccccaaaactgatgcagcatcaccaacggttctactgtattatcccaaaactgattttgagggctattagtgaaatattggatccaacagatcccaaaactatttttgagagctattaggtgaaatattagatctaactgatcctcaatggtcccgcacgttttggagttcccttcccgtatttgtcgctgagggtccctcccaactcccaatcgtgcgatgcttcgtcaaatcgagccggtcgtccatggcctccaccatcattagctgctagctggtgaccaccatcgtcgctcccactctgcctaggccgtgtttagttttccccctattcctaactttccatcacatcatatcacatcaaaaacttttctacacacgtaaactttcaacttttttttcaaactttcaacttttttcaaacttacaacttttttcaggaactaaacacacccctagtttcgttgacagcctcgtcggtagtctcgtactctcatgcgaagtactatcaccaacgtcgtcttcctcgtactaatcttcctccataagacacccaaaacgagaaccaccgaccacgtactagagaggaaactggagccaaggtgaggtgccagcgcgatcaccgtcgacccgcctctcgtagaacctcacacccagctcatctcgtggatgggcatggagcagagcaaatagagagacctgagccagccgcttctactcgatacgaagctaaaatgagcgaatgtttgccgtctgaaatacacgcagggtaggagtgccgtcgcagacgatggaagtgtggtggtgcgacgtgtgcgtggaggcggaattaggggtgaaaacaaacgggtacttactaaccgcctgcccaacccaaagcttgctggaataatatagagaaaataggatacccgatagtatccgagttcaaacccgaatccgtaaaaaatatgagttaggatagggaagggttgtatccacccgtatgtcccatgctataaaacatatgtgaatatctattataaattcacctataaatatgataaaagattagttaatcactatctttatgagctcacatgtaatattatataatttaatcattgatgtatctcttttagcacttcaattatcttatattaaatatctatcaattagtgatataaattaaatatccgttcctgaatctaattcgaagaatattgggtatgatacgggatgagtgatatgttatccaacgctacccgtatccgattctaaatttaaaggaagatactccctctgttttaggttataagacgttttaactttggtcaaagtcaaactactttaaatttgactaggtttatacacaaatatactaatatttatattaccaaattagtttcattaaatcaataattgaatatatttttacaataaatttgtgttgagttaaaaatattattattatttttacaaatttgaagcggtttgactttgaccagagtcaaaacattttaaactgaaacggagaaagtataagttagaatatagaaatattgtgatccgatcgtaccctaccagttttcaccccataggcggaatgccaggtggtctccggcaagccactcccgacgctcggaacttgtgttttcctgaaaagaccttgttacttggtttcggctttctccaaaaagccgggtaatagtaattaactgatgtctaaaaaaaagttcactaagtgtttcgagtgtacttttaatcaactttcaccttttcaaaccaccgcagtccagctccgaggctccaaacactactggtttcggttacataccggtgctgtttttactatcggtctcatgcaacacacaaaatgtcaaaattgttgtacatcgcaagtgtactctagcacttacacatatccgccaattttcagctcaatgttatctaaccttgcaaattctggtttcccttttttccaccagtagcaaagccatgaacagggatatctcatcatcggccacaaagttggtagttgcactcttgagctgaaggttgcattcagtcggggtaactgtggtgttttccgtaaccaggtggacgaaattaatagagctccaggaacatctatgatgtaggttctcctttaccatggataacatggtgcacgagcttgtctggtaatctctttgttgcctgaaatgtatgtagattggcttgtcaataattaattagtgcctatatatgaagtctagtaaaatacaaacgaacataggcagaactgaaacataaacagaaaatggaatcaaagattactcaatccagtttcataattcttgacgttttggatgatgcacaaataaatacatgtttactttaattatataactttaaaagacaaatccatatatgttgttctagatcttttaaactaaatacttttaaagttattgattgttaaagttacaaaagtttgacctcaaccttatccaaaacgtcaagaactatatatttcttttaaaaaaatattactatcttaatatggaagcaaaaccaatacatggcctgcatcaggttatatatagtcctagagagaaggatgcccttgtctctgaggtgtagaaagagtactaaatgagagagaaggatgcatattacacgagggaccatattggacgagggttatagttctatgtgctttttgaactgctatgtaggaaaaacgttggatgcatttttttaaca

SEQ ID NO: 62946 - DNA, 1394 bp, Oryza sativa
tacacgcctgctgaaatttgcaggttgaatggtgcgttctaatactagaattagaaatgttagcacaaaaaaaaacatatatacttcataatcagaaaccagctgcaacaccttagtcatatgctattataacgatcggtggcttcagatctacaatgattgtccagtgaacaaaaagccaatgcattgcagtggacggaagccaatgagtgaactagtagttagttaattatgtccagagttcaagataaagagggtggcaaacctggaaatgtcgcatatgcaaaatgggctcacacccaacctctgcaaccaattttcccagaggagtcttagcattgaatcggctagcctgataggcaactaatctgttatctctgtcaggaagctgatggcatactttaagcagtgatcttaaagaattcatctgcatggaaaggaagaattagagcaaggtaaacaattaatatcataaaacaaacataatctcagggaacatattgtaatttcttcaactgccataagagaaaaatcacaagaaagtaaaaataaaaatgaaataaagaaaaagacagaaaaactcattagtgtttcatggttaccaagctaaagaatgcaaaagatcaatattttttttacatttcattattatgaaataacaaataatacattatctatacccctttaaaagtatagtggtggtggcagtgagtccgtcaccccacctgctcccattataaattctgcaaattgcccctttaacttaatattcaaaaatcaaatccaaatggatagccacgtggaaaataaaattgatgtgaatattccctgtggcaaaaagatgggtaaagcattttgtgaaaaatatttttttatttaatcaatattataatatatttttattttttccatagcaaagcacgggcattaagctagtaaatgagaaaaggtttttgtgatgtgacatttcttgacatcttgattcatgtcttaaataaaggctctgcttccatggatgtatatagatgtcttgaacaaagcttacatgttcatttcaataacataatcgaaaagcttacgtaaataaacaatatatatttaatcaccaccaaccttcatgtatgggcatgaagcgcagcccccatgtatagagcaaccttcgccagaactcacaccaggaacaacactaacattgtctaaatcagtaactgttgaagaatcaagatggtgggaaccattgacagatgtattagaaacagcatctgaagaaactgggaacacgatttcaacttcaatattggcactttgttgagaagttttataggaatcaaataattcacggacagcagcaacaatagaagtgatcattccggattctgttcctaacacaaact

SEQ ID NO: 62947 - DNA, 7141 bp, Oryza sativa
acaactcttcgtctcttcccagttatcatgaagtagattaatatttttttatagttgaggaaagcataaacttcctacactagtttatataatcaaactgatacatattaatgataaacaaaaaattaacattatccattgctggcctgctgagcctatatgctcgtttttatacacatttcataccgtgctgtaaaatttttcatacttgcgcccattaaatatataaacaaaccatcgaaccaccggttcactggttgaatcactagtttgagataataacaaaatgtaatattccttaccagtttggttgaaaattcaaaatatacaataattttgcccttccgaacacaataattcttttcaattagagcatgactcgcaacaacttggccctgttctttattgttccagtgcaaaactatctgtccaattggtatttgctggttcataagttggaacagacttggatgcaaaccaaccaaaccaagcaccagcactggattttccagtttactggtccagttttttggactataagataaggaaacacagcacgtttgattgaacaaatttataaaatatcctaaaatgtgttgcttgtgaaataaattgtttttcattagattttagaaacaacaaatagaatcataaaagggacagatgtcaaaatgagtcaaggtagatgttatggaagaaaacttttatctgcccatctaaactattgcgatatatccactttactcccgaagtaaaatggctatataaagaataaaccaataaaccatctaaataaacccctaaggatagctccaaaagtggttgtcaccatggcacatcacaaggcagatgatgtggtgccggtaacaaattttcaaaaaaaaaaaaaactgttaatcaataaacactcctccgtgtgtacacatctttctcttccctgctgctgcccttctctatatatctgcagcaccgactagctacgtgtcattgattttgatcttgctttcttagtaacaaatttgttggttaccatgttatgaattatgtcccatagtagcaaaatcattatagagagttacctaggaaattttgcacagttccaaatagttggttcatgaaaaatagaaaagacgacgattgatgttttcttacttcacggttttgaagttgagtgggtaaaactaggcaaaccctagtagttcaaacttaaaaggggtcaaatagacatttttctattttaaaaggataaaatatgaaataaaaggttaaaaaacatgtgaaattggataaattagtactaacacaaaaatatagaaggatcacaaggtcagaaaatagcataaaaccaaacatttagaaaaagctcatatagtggaaatatttaaagataactttcaacgaaaattatatatgagtaaggcacgatatattaatatataagattaggacatccagtctcattaggttgttttttttttgcaggaaaagtatactgcagagaactattctttacaacaattaagttgaaaatctgtaactcaaaatcattgagaattaactaaaagcacatagaaggatcagaaccacataaacctggtagtaatgtaggcgtggcaacaaggcatttatagattttttgttgtgacttggatgtcttctgcaatttcctcatctgacatgacagccattctctgaaatagatccgcaatgtttgcacccatataagaatccgggccataccagacattaagacctggtatttgggcaaatgcctgaaagattaacggataagagtaaacaaaataaaatgagttaatgtagtgaacaataattaatgtccattctcaaaaaaccattcatggttggctagagtttgtagtagacaagaaaaacacctacctgtaatatagttgctacaacgtttgaagaagtgcatgttattgtaggtacaagttcatgagcatgagcttttgtttccaaagaagtattgatataaataacatgtaaagaaggaggagatcttgatgcttctttcaaaaaatgtgtatatgcagaacttgaagcagcgtctgccaatgaacagccaatttgatcacttgacattctataaacaccaacctgcataaatatacactagtcaggactcaggagtagaaactcagaaaagtacagaaatgtctaataaaatttatatcagatagctgtggattgtaaccatcaataaatggatacactgaaaatgctaatatgtttgactccaaccaatactttgtaacttttatttagctgcaagaccaacagaatgctgcaccataaagtctaaaattattaaatacaaataaaaagtagatgcatgtacctgttataattaccgatagcatggcataattttcataacaaaaaaacttgtgttgttacattttcattctaatgtctgacaaataacacgtagatattatttttgtagtttcttcatggcaaactgtaaaacagagctggttcttaatgcaaattatagttcacaattgcataaacattcattgggactatgtgaacaagggtgtcaattaggagaagggatctagaacagctaacctaaaggagagaagttcatcagagacttgggactcttaagacttttttggtccattacatgaaccactacaaggataggtattgcacccaattcaagctgtttgatgggccgaaatccaggcccatccacttgtatgggccagggttttagttcaatccatcggcctgtacatgggtagggccagattgaggcccatgcaaacaaggccttcaaagggattggccccactaattatctgtcaaacaatatagaaataaaatgacataacaaaaatgaaacaaaccaacctaacaagcaagtaaggagttcctggtaacattctatggtgtcacagacagacaagtgttcctattttctgttgatgaagaaacttgacaatgtgtctaaataattctcctggcacattcactccatattttgcaagtcataactaatagatcgaccacagaaccatggaattcttcaaatgttaaatgtaaacaagttggaattgtagaactaagatataagtcataactagtagatcaaccattgaaccataaaattcttaaaatattaaatgtaaacaagttggaattgtggaactaagatacatatgcttactcccaatatctctgacacaattgagtataagaaagcttgtggttagtgttctcttaaatgcacatgctcccatcatccttggctatagtttcatatgtaaaacttcaaacttatattactgctgcagaacaatttcatactttttaacgtgcataactagggaaaaaccaagtttggattatgcaatgaggacttcaaaatcaaaatcaactaacgattgtggatgaaaggatctttatagttataactagtggataccccgcgtgttgcagcagaaaatttgaaaatatttcaaagataactcgaaaaaaataatttgtaaatcatgtacacgtaatatctaaatgaacaatatttgttttatagtaattgatgtgaaactacaattctacatgacatatggatgattatgtatcaaacatgagagggatccaatggctattcatttctaggtgtcatggtttaatgtacattaagctttatagcaataactacatttagtgggttgtaaatgcatatggtaaatgaatggttgagatcaaagcatgagagagatccagaggccactattttctagataatgtggctcaatgcatgttaagcttttggtctcaactatataggatatatagatactcacagatgcatctgtctgtttgatctactcatttatggcatggttgtagatttgaaaaacatagctactgatctacagctctacgcatctatcaatcgggtccaatgagttctgtaacttagtccttccagtaaacaatggagacagtagaatagaaattcttcaaacttaatgacaatcagtgatataaacacataaataccttgctatatccagcttgatcaagtattgcacgaacattttctgacataaaatcaacacctaagacagtgatatattcgcatcctgcttcagccatcttcactgcactatctgccattaccaatgaatcagaaatgtggatgtgaggccaatgcttctttgaagcagttaatatgccttgcacctccggatccatataaaagtgtgcgacaatccctatttttttctccctaagggattttacaagctctgaagtcttggattcattaggagacaagaacattgcctgcacttctcaaaataaaatcagtcagtttcaagactacatggtggaaatgaagggaatttatggtatttctattttacatttgttgaaatacatagctttacaggaggtatttctattatgtacaacaaagtcacaaccgtaattattcagggtatctaacatattggagcatccccaggagatcctccatcatatgatggtgtacgggaggtgaaaatgggcctccagcagatacggcatgtttccgccaaatatggatgatgcgccaaagcgagcatgtttcagccaaatatagcgattctctctcctcacaccatatctcaacgcccacatctggatcgagctcccgcccccatccggacttccgtcgcgacgtccccttcgtcgtcgtcatcgccgttgccggccacaagccgccgacgccaagccgtcaaaagccacaagccgccgcagccgcttacgagcttgccggccacctgcgtcgctcgccacctcagcatctgccgtcgttgcctgtgtgccttcgcgcccgccagccattgccgtcatttcctcaccctccggccaccaccttcacttctgcgcccgctggccgcctgcccgcctgagggcgttgtcgcctgctcggctccgcgcctgctggcctccgccaccgcttccacggctgtcggccgcctgcgccacccgctcgcctcagcttccaccgccagccgcctgcacacatccactcctgctggccgacagccgtggaagctggagtagtctggacaggatagaagagaggaaaagacgaagaggatagaacgatagagaaggatagagaaagagagaaaaagaggaataggggttggaatagaatagaggaaagggcagagcatgggtagaaagttaaaattacccattaaaaaaatatccgttaaaatttactcattcgagagattatcaagataaataacactattaaaatttagtcattcaaaatatagcccttaaaatacaaatgtaaagttagttaaaagatattactaaaatataggagggtgtgatatggatgatctaatgaagtggagagggatatgaaggaggaatcatttttggatgctcatccatatgggcatatggaggatgaaatttggatgagctgctggggatgctctcaggtagtgtttgtgcaatcaatttttagttgtttaatcctttgaacaaagattttttaaaacatgtacaaacaaaaagtcccctacgaccataactacataagttgaaacatagaaactttgaactagcattaatatgaaactgagctgcttttgatgacatcaaagaataggttaacacatatcatagccccacagaaggtctctaaatataaatggatacaattgacgggtgtacttaaggtagttcaaaaactttattttcaaaatggtattaccagtgctggtaggatttgatgaagcaaattaaactgcgttgaaacattacaacactctattgttaaagtaggaaacagagacaactgctgccacaccccatgggcactaaaaccacatagggagaatgagctaagaatctgtaatactagaaagagagaaaaaataaaagaaaagaactagtagccttatggtccatttggcacaggtggccttgtggcccattcaggagtacaaggccatgaccatgagatcgatcagagcatgtgagcattttcacaaaatacaggaatgtatattacatattgcctttacgtagcatgaataggtgtttagggttactaactctttagtatagtttcctatatcaaaaggcagtattatatcccttgcacgcaacatatcctattgaagtaatattgttgttaggagtcatgactagtacagccttttcatgtatacttcccctcgcacaaggaatttgatatctttgcactagtagagaggcgatttcaagcaattgagtaagtaaattcctaaagcaaccggccaatgtggccacgcaaagtggaaaaagtaagaggtgatgttgacatcattaggttgacagttgagtctccattcttgaccatacacataaatatgaccactagtcattttctcatttacaaaaagggagaaatacactgaccaatagaaaagctaccttttctttgcaggtgcaactttgtggaaaatggaaatcggcatccaactttggcagattctatacgtcaaatatatccaagaaaaagcacttacatttttagccatatcctagtgaaaagcaacaaatcaaagatatacactactttctaatttgtagaggaaaccacgtcttttcagtcagagatcagtaatactggagtaactaataagaagagctgagtagctccgtgccgtactgttaacccttccgaagagaagcttggacaaatgatggagaacacggaacatggcaatacacaggaataaaatacagggaacggaaggaataaccaataaaagcaacggaatgaacataataaacaaacgagcaaaagatcacctgggcttcagcgtaggtgccttgagcgcggatggcgccgtcgcggccgatgataagcgacgggaacggctccccagcaggcctgccctcacgcgccgcgatggccgcccgcgcacgcttctgcatgccaatgagcacgttgtgccaggtgctggccctggaccgcgcccccgtccccgcggtggccccaccgagcggcgcgaggtcggccgggtccacgtcgagcacctcctccgggcgcgccccgtcgagcgcggagacgaggcaggcgcagtacccgcgggagagctccgag

SEQ ID NO: 62948 - DNA, 10867 bp, Oryza sativa
  unsure (1)..(10867): unsure at all n locations
gcggcgtagggggcgcgtgctttttcgtagggtggatcggtgcgggtggtgttgggaattggaaattctgaaggctcttggaaaaagggcaaacgcagcttcaccggtagtgcactgcagtggtagtgggcggtagcgtgtgaaacgttcggacgctgatggagtgggccagtggcgcagccgtccacctgtcccgccatgcgatccctctaccccggtcatccaatgatcgtgttagtttgagtactgccgggaggaaattcaattcatagcacagcttctcccagtagcagaaaatagcacaaaaaaatttatgcctctttaaaagcacagctccgtcatttttttccaatcttacagcacttccatcagtttggccgttagtcagaggaatcagaatgcagaaagacaaaaggaactttgtttcaccatcgtcctcctgctgtcttatttgcttctctccaagcgcggctgcacggcaccgtgtagcctacgcagccatgtctccatggctacgagctcgttcgaccgcgccgctattgtcggagcccgttcgccatgcttttggatccggacctcctcgctaccttctgcggcgctgttgacacttacgcctgggtgctcgaggaggccaagcaccacgacgatgacaacgttgttgttggattgggactgcgtcgtggctggttgctactgctattgcttgctcaaagccaaccaacgatatcgttgctttcgcatttcttctgttcttgctattttgggcgtcacagcgacatcggcatcagcgaggactccgtgggagacggtgccagccgggacgagctccgcgctactgggcctggacgccgcgttgccgcactcgtgctgccgcagttattcgtggatggccgatattcgggcagccgacgaggtggtcatgcgccaccgctgccgtagagagcacagagaggaagggaacgtacgaggccattggtttgacatttttttctacttcctccgtttcacaatataagtcatctagcatttcccatattcatattgatgttaatggatctagacatatatctatctagatacattaatataacttacattgtgaaacggagggagtatttttctaggattttggccctttttttgttagaataggaaaaccggttatattaactcgtcattcgctgaaccggttagagcatctccaaccgtctccccaaatgcctctccaagctaaattttagctagtcaagccaaaaaaaacatgctccaacgagttgctaaccggatggctaagccatccgactggccaaacacccacaccgcctggccaaatgtggagaggcaaactcactggccaaatggtgagccccacactgatttgtgtctccgactccgcctccttatccgggcgcaacaaaggcgtcaacctcggagcagcggcgcggacggggatggagctgaggatccaccgtcgctgtcgtcgttgccgccacatctcgatggcgtgagcagcagctgaggaccctcaatgtcgtcgtcgccgccgatttccgccgccaccgtcagatccacccgtccgccccccgcctcccttgccgacgcgagtagccgcagcccgcagcatcgcctctgcctctcattcgtgccaccagcagcaacgtcgtctccgccgcaagtagccgaagcccgcagcctccgcccgtccgctcgcctgcccacccacccccggaggatgcggcggtggggcggcacgacagcgagcgtcgccaaggcctcctgctcaccggccgctggcgttgagggcatgaagggagtggcaacggcgaggtgttgccgtcgcccctctccttgacggcgacgtacactgtacgtcgcctctgccccggccacatccggcactgccgcctccgaccccggccacatccgccgccgccgcctccgcgcccggccacaaccgccgccgccactgcctctgcgcccggccgcatctgtcgcgcgggaagagtgccgagggaagaggaagagagagaaagaaggtgtagtagaggctgatgtgtgggtcctagtgtcatagatggagagtatagatggagaggttgttggagcgaggaatgagtttggcttgacaaatcaattgaagagttggctatgggtgtgtttagttcacgccaaaattggaagtttgattgaaattggaatgatgtacagaaaagttggaagtttgtgtgtgtaggaaagttttgatgtgatggaaaagttggaaatttgaagaaaaagttaggaactaaaccaggcctatatgagtgtttggagagtccaatttgaagaagctgttggagatgctcttaggtttgacgaagatagcgaagcagttgaggaggagcccttgactgagaaaggtaagtcgctacacttgagctagggttgggtgctcgagatgcaactcgaggacaatagtacttaggctccgttcggtagtacaagttaccaactcctcctcctcgttttttgcgcgcaagcttttcaaactgctaaacggtgcattttttataaaaagtttctatgaaagttgcttaaaaaaatcatattaatccatttttgaaaaaaaaatagctaaaacttaattaatcacgcgctaaaacgctgcttcgtttagagccttaggggtagatgccgcaaaaagggaaactgacaaatcaggccatgatttcacatcccaaatttaccctaaaaagtatcttttaaattattcatagaaaaagtaaaaattggtttaaagcttccaacattaaaaatatacaatctaaaaaaatcaaatgaggcttagagaatttttgtatattttctcaaggcctaaaaggcttaacaaaattttaatggagttttcagagcacaaataataattataaagcaataaagaaattattatgaattttcttaaaagaaaaaccctaaaaacctccttctctctctaggccgaaagtcggcccacttcctcactctctcccctctcaccggcccggtctatctctccttcccccgcgagcacgctggtgggccggcccactcggccacgccctgggccactatcatccccgtcctctcgccgcttccgcctagcgcctccgccgctgccgcgagtcccgctgctcccggccgtttccgtccatgttggaaggggaatcactccccaagattccctctctcattccccccacttacccctctctctccctcatcaacgtggtcagatttagtccggcaaatctcgctggcaccattgatggcggcaaaatttgccgccatcgtttccctctctcctcggctctctctctctctctcccccgttgctacaaaaaccctcaccgcaacccctctctcgttttcgccaccttgcgcttcctctcatccatagaatcgagccaccgccatctctctctctctctccgtcatcaccgccgagctccagccaagcctcgccgccattcaggacacccctcgcctcggtgccaccaccactggcatcaccatcgccgccgacctcgtccaccccctccccgcgccagcgatcgctggaaccccgtccgcaccgttgacctgagtcgcgccatcgtcttcctcctctctggtcaccattttcgccacctgccgccgtttggggtgaaccacaaatgtaacatcccggcccagagcttaataggattaataaaatactcatatcaacaagttgcaacttcttttccggaagcccgtctccgaagaactctgaggactgattgaaaaaaagacttgtgttggtttgtgagggcagtcgatgacctataaaagctgccagatgtaagtgggcctggcctgggacaaggtgtgtcaacaagttgcaacttcttttccggaagcccgtctcaaaagaactctgtgacgtggccaaccttatcgacctataaaagctgccagatgtaagtgggcctggcctgggacaaggtgtgtcaacaagttgcaacttcttttccggaagcccgtctccaaagaactctgtgacgtggccaaccttcgggcgcaccgtgtggccgccgcgtgaggcctgcccgtcagccaccatcgcccctccggtggctgacgtgtggggcccacggcgccggtggagggcaaccctgtgagcccagtccacagttgaccgtgaggctgtcgtgtgggccccaccccatggacctggctcatgcgtcaccccggggtgctgatgcaataatcatttttaaattaaagataattcaagaaaatagtaaataatcacctaagcaacatataaacttgaaatggccataacttggtcgtttgaactcgggattggactgttcaagtctatatttttttcttaagaagtcaagaacccatttatgtgctttgttttggcctcttatgtggattttattagagtaatagtctttttcctttttatcggccgtgtagatgatgcagcttcggaagatccgctctacgtggaggttgaagccgacgtttgggaaagtgagcaaggcaagtcatatctccgttgaacatattgatgtcccatgttttaaaattattttattttaaattattgcattaccactttatttaaattcttgcgttatcactgttttatctagctttacctacccgtctttgttatagccttataattgatattgttatcataccttgttccccctaggaaaataaatccccaaactagtgtgtactctatctatggttccactagtatgattttagctagatgcttcgttgtttaactaggcaaccctatgaggttttataactttagactttgggaaagatcacatcacttgaacatattggattggttggcataatttggaattgggtatacacctccccctctactcaaaaccccccaaaatggttttaggttgggctcggggtgcaaggttttgatagtagcacctcggtcaccataaggaccggtcttcgggcctttgttgtaaagcactaccgtacttctacatgtctaagtgggtaaggcttagtttatagcccagtctggtcatgagcaaaaggacacaaatagagatggatgaagtagggtgatggatatctctgaggcaaatgaaggctatacgaggaggtgtccggtagtcaagatctcgtggcatgggatgggcatccagaaggccactcccgaaggatgttctaatgccgtggggctcgaccataacctacctgtcccaggaaccccggccgtaggtgggcgttgagttggtacttttgttcagggctagggtgagcgaagaagtatgttacgccctccgtccatataccgtggtggtatgtggcgtgtggcgacacgtgaggaaggcgtgtcttgtgggtaaagatgtacacctctgtattagtgatatgccctagaggcaatcatagagatgattgtatcacatactatgtttacatatttatctgactttattccttgaaatagataactcattattggttaatggatatgtgattctttcatgagactctttatgttgtttgttactatttctaaaggatccctgatcaaatatcatatgtggaacaaatatgtttaaataatcagcacatgtattaattgatgatcatgtctcatggatcatgatatagagataccaaattaataatgtggacacatgttggtgaacatgttgttggatagacccaacatgagacactgcaagagccatatgtgttgtgtcatcagtgatcttatttagtgttggtgttgaatccttagacctgagattatcatggttcccaacatgtgtagtagcttacttagggactactaaacgctactccgtaattgggtagttataaaagtagtttttgggtatgccatgaaacatgtagtgggatatgaataatcaagatgggatttgcccctcctatggaaagatatctctgggcccctcgatgttgtagattatggaagtgcatggccatgccaaaggtgattgaggagtcaatcacaagttatataatgtatcaataggttcgagtgaatgattgagctattagaggatggcacatatctagccttgagcttaatcgatatcatgaggcaaagtggttcatataagtatacactagaggttcaatcgatatgatctttatgtatgcccggtgggtcaatacgttctgctaggggccgctgttgacgcgtgaactgaaaaggagtttttgggtttcagccgagtgtacatgaacctacagggtcgcacgcttaatgggccggaataggtctcctacgtgccttggaggcctgagtgatggatcctatatattcgtgaggggtgtgaccagcggaggtattgcatcacatgagaaaccctagccgtcactcccctccccgagcaaaaccctagacgtgcgcgggtgctagcacatctgcacgtggcgttccgtccctgtacgtgtggataccggtagaggcgccgctggtttgcagtgctgatcggggtgggaatacggcgaggagaacgcacgaggaggagaaggtcgagctggtgcgatcgactacttcctctacatcgacgcgctacttcgcgagaattccttcgacttcttagagccttcttccgctgcgcagcgcgtcgagtggtaacgatctatgatctaataattgcatggttcctggtttacgcaatagaaaattttgatttatgctatcgtaccctacgcgtatcccaacactctgatcagagtataacctatttgaatagccataccctcggttatgggcaagcctagcaatgtacccaagttagtggtttcactcttaaaacttgttaatcaactaaaacctggaatggttttcctaggttggcttgggacgagctggggcccggctttaaggctgccagttcggtctgacttatcgtaggccttgggttaaggcaggttcgtgtaggttcacggccgtggataattgtaatattgtgtagacctaggtttgaatttattaaatggctttgagcaactaagtggtttaaaaggttgttttactgcaaaacctaactaattattattacacctttgtaccccttatatttattgtgcatttgtcagtgtgacttgttgattacggtggttgtactcaatcttgctcaatttttcccccatcccagaagaggaattcttggaggatgatggcttcggtgtctagctcatgcctgccatcaagtgcatatggtcttcgccctagtcttccgcgcttcttcttttatctctgtgtgttgggcctttggtcgcccatgtaataaaaatactatttacgcttcctcttgttaaactctaatattgtatcaacctttgtgtacctcgtctcctgggacaaggaataatgcacgcacgaatggaaaacctgtcacctgtcgggttatttccggtcgtgacacatgacaagtctcatgtgttgggcacgtcacgaagtgcatgtaaagcatacatccactgcaatgtaaataaataaatctattcaaatagccaagctcatggttaaaagagcaatggaattttcaatactcttgacaagcctcataatatttgaacttgcttagaataggttggataatgatgttggacaaccccggaaggcgggactggtcgttggttaagagaaatggtgattaattgaatggtgaagttaaactgaaccaaggtgggggtttggggaggtggatgaaccctctactattaactacaacttcaacaatatcattgatttaagttaaaaataggtaagtcgtaggtttgcaaactatttaaagaaaactagttttatgcaaaataaacccaggccgctccttaattccatgtgtgcattgtagtagtggcttgagagtacgttcgtactcatcgtggattatgcaatcataaacatgtaatccttaattcaatctttctcttagatgcaagcaatattatagatcgaacctaatcgagacagcatggattgctcgtaatttagacaagatgaattaaagtttacatgagtttatatcacaacctatgatacaatacttaggttaaaatatatatagtatcagctattactctgatacagccttatataagaatatcaatctaggaaatatagtttaaataaagtgatatacttatataaaggacaaatataacatgaaaaacatgattaaagaaattaaacatagcataacagttatatcaactaagattgactgaatccatgattctacccctattggcaatcaagaagcatgttagttttaatgatgttagtttttatgattctaagcaggacttagtaggtcaaactcaattgatgcagcataagtatgaaaaaaagcataaagtctaaacaatcaagcttttgaataattttcagggtggtggataccttagctaatctaaaccgacaaaatgataccggcaaaaccctaggtttggccgaaagaggtaaattgaatcatcaaattagattagctaagatatatgataaccaacaattacaaatattgttttctcccttatagcacatgaagtcttcatctgctaaagctatttgctccattttacaagtttggatatcatacttatagaacttttttaatgccaatagcaacatttttccatgaaaaacaactggtggacttgctacaggccgctgaataattgttggtggaccctgtatagtgcatcatcgtttactcgagtctattcagggttctgcttctgcccaacactccaaatctctagtgataacactggactgaaaatgaaacaaatagaattcatcctccacttgggttgaactggaagactttacattgtttgggttacatggaaacatactcgctgtgttcgtttgtggttgggaaccttccctcgtcacgcaaaagagagcgatggattagcgtgtgattaattcagtattggttaaaaatatttgaaatagattaatatggttttttaaagcaattaactttcctatagaaaatttttgctagaaacatactcttttcattttatattgatcatcatataagtattttcaccaagataaaggacttaactataccgtacaatttatttaatgtgagtatgtggtgacaacaatcaagaaacatgttgtcatgggcattgggcacaaaggcagaggccgtaggcagtccatatcaattaagttagagttaagattattagttaagttagagataatattagattgaatccttactcaggggtcaagctataccatctatataaggatgagattgtatctattatcattaagcaatgaatattaattagtctaatctctccctcccaacaatgtttttctctctagcctaaatctgcatcccttctctaggagccgacgccacccggctatctttccagcggtgtttatcccatcatgaccttgggtcatgacacatgtagactttttactccactacgaacaagaaacgagccattacctacccctgaatgcctgcatgcatgtatgcatactcaatttgcatgcacagatgtaatactattgcgtgtcaaagtcagggctatataatggtcaatttgaaatatctgatttttggttatatgataattaacatggaattataggagtattagtatttagtagtttgagaagcgtacgcgtgaaaatggaagttagcatagcttagtggagaagaaccttatacttgttgctacgagggtcaactccaaatctaagcgttgtaccatggttgtctttagttcacactgaagtttagaagtttggttgaaattggtacgatgtgatagaaaagttgtgtgtgtatgaaagtttgatgtgatggaaaataattctctgattgacaggttgtagaccatcttttttgtccttcatgttgcaaacgaggaataaatcatttcagtgcatagggacgcatctataatctgtggaaagtatgtgaacgtattgcattaccactcatacttatataggcccattaagaatgaccctttctcttcgaccattcaaggtgagcaatgatgaaaaatgggctggatatcctgcgatgctaagccttgcatacaagctttagctcttcctgaatcgtctacttactgaattatcagcagcaaccaaattttaatttatttttgaggtttttttcagcctaggctatcatcaaggattgacttttaaaccgtgaataatataaatataaaggttttatttattaattattttttgttgctacattgatatttctatagtccatcagccgtaggttgagcaaccgcactagtacgaaaatgatttttgtgtgtggacgaaaaggattttcgcgtgcagatcttgcgcccatctgcaacggggtgtctgcaaaaatacatttttttcgtgtgggtgacgcacccgctgttgatgcgaaaaacacacactagcctagaagatctgcttagctccagtacaggttatttgatgagatgcaggcataccagttagtttgatcctacaactgacaagatatataaacaatagatcaaatagccgatcggccgacaagccgatgaagtaattccagacgatgttgatacgcnncatgccgatagggtcttgattggctatatgtccaatgtagaatctggcgcatgaataaataatcatacaaagacaatcggctaatgataatcaatatagtaatataatccagtagaaaccaactgtctaataatgatatgataaaataagcacagattcaaaagttaaagcatacatcggctggaagaccgatgtcattaaatccagaagattagataaacagtggaaccttta

SEQ ID NO: 62949 - DNA, 3548 bp, Oryza sativa
tcacgtgtgggcctcttaaggttccgcacgtaaaaataggcttatttttgcgtgcggacctcttaaggaacccatgcgaaaatcgattttcgcgtgcaagcattttaaggatccgcacgtaaaaatgggaggacgatttttctagacgctgtcagttatggaccgcctgaaatctaagaagtggtcgtccaggaaaatcattttttatagtgccggtgccatagatatgacttgtagtctcaacagaatgctgaaacatcccctcatccgagatgctttgacaaataattgatacaatccgcgaccaggtgctccatagaacacgatgtctgtgcatcttttcaccaccatgacaagattctcaaaccgcacttgcacattataatggagtacttgcaatgctaatcggacaactcaacttccaaatgccattcgtgttggaaaaattgatctctcggtttgaaaaaccgggaggagatcgcgctacaccattttttccacccgttgtctacgcaaaatcaaagcgattcaatttgttttaattcttgattaactacgcgccattatcagtggcgcccaatttatttccttttgagtcgcccccgattccctacagcgctaaatataaaagaatttgttttaattcttgattaactatgcaccatgatcggtggcgcccaatttatttccttttgagtcgcccctgatttcctacagcgctaaatataaaacgggagaccagcccaagagtggatgacgatctctctcaatctcaatcttcccgacaaccaaaccctaaacccgatcaacatatgcgctggaggagaaacatgtgcagttccgagacaatgtaggtgacgaccagaaggctgccgctaccccacaagtgatcgccggcgaccctttcgagatcaagccgacatcctcaccaacgatacgcgaggtggttcgaggttccgcgtcatctacacccactctagttcaagctagaacaattgcaatggcttcaaacaacagtaatttagacctatcaggtagcacgctacctttaaaggcaaaataaaaactttggtttcttctccgtcgggtggaccaagatgcaaagaaactaatttgatttaacccaaaattatcaaagagaacgcatacctgaatgtcagtattccaggtggagtacctttaacggagctcgtatttcatattttcaaaaatcgacatgagataattccacctgtaaaggtcaaaactaaaatttggtgcaatgcacaaatgccgcgtcatctttaaatgcaacgaaggcatcaattacaatatgacgatacgactgtagtgccctgcgttgcaataactcgaagcacaccaagcagaggccagataaggtgtgcggcggtgcgtttttcgaaggggaaatcacttatttttgttatagagcaacactgaatcaacctatttacatgatcgctgaaccttggacatcttagaagtcactttggtagtacaatctgcatgctgcggacaaggtgcagataaaacaaaattactacattgtcaggcagacactctcacactcctatcttcacacactacactggccggggtaaagacggatccaactgagattttcactgccggtggccctccgggagaggaaccactctatagaacggcacagctctttgtggtagatttccatcctcctcgtcatcatcaaacaagagtagataactgccaaaaggaaataagacaagcatattttcaggaaaagcaaatgttgctattgaaatgttagtcataagaatattaagaagaaagtccgattaaaaccttttacacaaacatgtatgtttattttaaggtccagtttgcttggtaccatccaaaaaaatcatccgagttggagaatccatatcacaccaacttttggggctcactttttgtaagtaattgatttttttagcagacttctgttttttttttcgagccagaagaacttttttttggtccaaaatatggagttttggaaggcccattgttttttgttctaaatattgagtttttgtaggtccattgtttttgtttagccataatgagttacatgctggaaggaggaacaaaaatatctgaacacaaaaaaaaaaagatctcgctggaaacacgtaatgtatgattgtatatgcatagcttattaagttatggtagaaatacaaattttctccagatactgcagtaaggtagaaatacaaattaaacaaatacagaaccatcctaaacacataaaattaaatagcaacacatgagactatacaaagttgtaaaaacataaatacttactcgtcagatttcctctgcattgtttgtagcccagtttcacatcagcatgatgacagagcaaaaatagttaatcacttatcaaacaatagaaatcatagaaatgtaatagttgtaaaaaagatactatagatggctctgcaaaaccaatacatgttagggaatcatttgtggaataaaatcatgtccatgaaacataatgttgaaattcttcgtataaacaagacatgtcacacatgtaaacggagcttgctggtattaacagcatagtattattcgatagtatcatagtagtaatcagattagccactaatcaacaatgaaaccaggttacacgtttctgtttcagcccttctaagttttcagccctattttggcagccaatagttcatcagtcaccactcaagaccaaggtggtaaccaacttctcaagttcagaccgttagaacaacagttagcatgagtttggatacaaacaatcttaatggtttgtttcgaatacatgagttttcctgattccttcaaaaaaggaactactaggattcctgtgagatataggattcctgagctccaaaggagagagccctaagataatcaaattggcatcagagctcaaaatcttggtggttactgattcagagcctgtgaccagtcaccaacaatctggcaggaagagtttaatttcgaaaactaaatttgaattaagaaatcctcgcaaaaaatgaattaagaaaatgtaactggcaggcagttaccagtatttgaattaaaaaaacaaagaactcttaagttatgtattagaaacactagttgcttactcaagactaagaaatcatatttccatgtatatccagtaaaataaggtttcggggatgggtgcccatgatttctttggcaactggtttttgaagccttgattggcatatggtgtgcaaaatagcggtctgtataacagaacttataatttattatcgcaaagcaatgcttatcaaacatacgataactgtattcgaaacgaaccttgattgacttagtggtcccaagataatcaaactacatcccactaagtcagataccatagccaaccttaagacaatcaaactgggatgtagtgttctaaatagtgatatgcaataggaatttgtaatttgttatagcaaaactatgcttattgctatgcaaatcagtgcaatttatactccaaaaaggagtggtggtgg

SEQ ID NO: 62950 - DNA, 17908 bp, Oryza sativa
  unsure (1)..(17908): unsure at all n locations
ccaccccaccaccaactcccaacctttttaggaatggagaaaggacatgtggggccagagggcccacatgtcaatcacccaatcgccaactctgtttatgtggaaaggaaaaaaagacactgtgcagctagagggcccacatgtcagtaacaaaatatatatagaaattacgagatgatgatggtaatgcaggttaatgataattttcattaagtaaaaacccattgcaacgcacaggcaatatgctaatagtatcaggaattcaaaacttgaccaggtagtgccaacaggccgataataatttccaccaaactgctggcaagaagtagcaagcaaacaacttgcagttacacccataccagtgcaaaacaatatggttactggaataactgaatttggttgggaagcaaccagcatccgatgtgaaccggatgatatgtcaatttgcacgcgtatcaacgaaaatagtctgttatttttatttcagacagtatattctttcagcttaaattgtactattcaatttcaagtgccagttacattggtgtgaaacctaaaaatagtggtattttacataggttctaaccattcaattatgttattctgaagtgagagaacaaaaatgtaacatctctcgggaatctcagcaaaagtatgcagatgcattcctaaagataaggctaagaactgacatgaaaagggaaactaatcaaactacttactagagattcctttgtatgttcataactgaaatcggtcgtgtaagttcaaaatattgggataaacatgcattatacagcagattagagttaaaagagctcggtaaccttttgcactgtcgaaaaaagaacataagatacccatgtatgggatcttcctgccataattagcatgtgtatttagcaatattgtcaagtgtgctcaactaattgcacatatctaccatcttctcatgttcaacgaattgaattgttatgttgaaaacttgaaattggtctacatattgctgcataagtgataaattgtacaaacattgtcatgggacagaaaatgtatctatacaaataacaaatatgcttcatctcagcttcaatcaataacaactaccaaatccattactttggtgggagagcatctggattagaaagcattttgatgctcatatactccccatttctaggatgacttattttcaagttcatactttcaaggtaacctcaacttaaatgttttcaacaatcaaccatacttcttgacagaactaaaagtttcaagtgtcagaaaaagctcatcatcttgatggtataattgaatatgtaaatagatgaaactgaccatataacagggaatacatccatacatatggacaggacaggactagaacacagaaagaaactcaaattactgtcaagacttaaaagatttacataggattcatgaaagattttaagatgttaccttacgattagaggcaacagtagctctatatagtgctgttgtgctaggataaacagctaagacttgtcgaccctgcccaaaatctggggcactggaaggatcccctctctttggaaatggaataatatctgacataggcaacttgtacttcctattacaaaagggggaagtaacattattttacatgtggaacaaacatcaattatagtgcaaattaatgctcagagtttgcaaatgtttcactaaacatcatatacataaaaaactagagtgctttaacaagagtacagcgaacatgcgtatagcatggtggtaaatgccttctgttgggaagctactgaccagggttcaaatcctggtctttcaccaaaaaaggtcactcgctggttcccccaaaaaacatgggttaagaagaatcgacctatggagggtgggcctcaaagcacgggttaaggttcgatccattgagggcttctccccatgtagggaaaaccggtttttgtgaccgttctcggccccagtttcgggtgctttttcttagttgcaatacctctggggaggtctttccccttggggctgagttcttttttttacagtagtacagtagagggaaacaggtaaggaaaatgaggaagttgatggaagttaattttcaaccctacaacacaattcaactcaattaatcaaaattaactgagtcacatcttagcagtaaatatctataaataatccaaagggactaaggtttaattattagaataaacttaacacactattgttactttcacagaatcattaatccctcgtatggtattatcttacccattctcaacactagtaacacctctctgcctaaacacacatttggtggatcctgtaaagatgtaggagccaggaaaggagtacaagagcagagatccaaaccgactgatgttgaagaatcagcggatgagttgtggttagggttatcaaggaaagggtcacacaaaagcttgtgggttgtggctgtaggatactgtaggattttttttaatgaaactagaagtgnnnancctggtctctgcaccatgggtgctcataaccattacactgccataatcagcgataaaaaaagagaaacaagatagaaatactccctccgtttcaggttataagatgttttgactttagtcaaagtcaaactgctttaagtttgactaagtttatagacaaatatagtaatatttacattaccaaattagttttattaaattaataattaaatatatttttataataaatttatcttgggtcgaaaatattactatttttttctataaacatggtcaaacttaaagcagtttgactgtgaccaaagccaaaacatcttataacctgaaacggagggagtagaagacatggccaataaaggaatcatgctgaggccaataccaaggaacacccacaccaaccttgcgacagcttgcttcaacaggaacaaccagcatcctgatgccagggaacatgatgtggcctagcatcaaggaaattgaaggctacacctaaatcacctcaaaggatcattgacttatcatcgtgcccaaccaaagaagaccagactgaaggtcagaccaaggatttgcatcccagaaatcagttatgattagtcttttttttgtatgacatatgcttgctaattgcttggaagcccctaattaagttgaacctaggcaccttaggagttgccgctgaccatctagcaccttcttgaacactagttataatagacaaacagacaatgctgccatagtgctatggccaatccacctgatctggcaactaggtaaggacgccatctgaaaatctgcatgcctgagggcataaccgattcatgggagacctgacactagtgtcgtggcaatatctgatctggccagatagatcagaggccagactcagacagcacacacgcttgacatcgctgtctgtccaccaggaaacaacagctgcaggcagaagaggcctggtcgcagcagcaaaggtagggggaggaaaggaggaacagcagcttatgtttagtcctctaggttgacccaagaggcctcaaatgtagcgtaggattaacaaaatgaactagatggtcccaaaggttcagtatcaatgaacatttcaggaatcggaatatattgaaaaatgacctgattgttatagtaaaagcaaacaagaaaccaaaatgacagtcctggacttatctcatacttttgggcactctcttcatcgtcacctggctcctcatcaagtacctcatatctgcaaattcaatgaattcatgaatgcttccttcaagaatagcaatattacagaaccccactcccccccccctccccaaacacacacacacacacacacacacacacacaccccaataaaaatacgacatatattcaagtaggaagtaaaaatgggcactgggggctaagatgatgtcagacgatccaaaggaatcggacatgattttgcaagtggttttcatagtagggatgacgagtcgtgtctccacaagactaagccaaaagggtggcactatggtccatttgcaccaagagagagagctagtccattagagacaggaagaggggttaaatggaggtagtgctgtgctattgtgaacatgggtatggtcttctctcaggacaaacagggcgctgcataagcctcgtctcaggaaggatggagcatagaggcagcacagttcagtgtggtggaggagaaagcagtgtgggcatgaggagcagccaagtacaggagaggacgaggtaaaaccacaataagaggcagcgtggtagacaaagtggtggcagcttttcactataaagatggtcacagactagagttctctcctactaatcttagatctaatggttaatggtgacagtaattgagatcaaacagctcaaaattaaacggatggcgtggctcaaccaaagagctggcattccaactactttggttatatatagaaagatataaatagagtagccccacagctctgctggctgttttcatattcatgtttgccaggctcttctggataatcatgcaacctgaaatgataaccttcttgttatttacaatttccttgtctacctcagatatcctaaaatgctccatagacccaggactcatggtcctctcaagtaataatgactacaataagacagattaggaaatagttaatagtctaaaactgccctcatccgcacaaagttttttcccctagagcaagttttcatacaagaaatatataatatagataaaaggtgaataagacatactcttttgtttccttatcgaaatgtatcaccttcaccacaaaccattcatctttttcttcgtctgatttgaccttagctgcaacctgaaatggcatagcacaaatgtgagacatttaatatatacagcatgttatcgcacatgtgcaaaagagcagaactgatttatgcacaattgatgatgtgctaaagagaaaggaagggtaaatttctttatcaagcatatcatccgctacaagtaccaacatcaagtatcaagtttttttagcgcatggtaaaatgtctcaaatagatgtcagttcaaagactggaaagggtaatatcaagacaatcctaattaaccctggaccttggagttcttgccgattagtttgattaaatatatactatagacttaacaagtgaaaacaaaacaagtatggttgaacagtttttatgcagaggatttcagtaattttggtgtttttaattgataatgttcattaaatttacataaacttacatacaaaaatggatgcagcgttcttttcgtaagaatgcaatgatgttttcattccacaacacaaaatcattgcaactgaatgatgaaagtatctttttttctagaaaaacataaattataatttacttctgtatgctggtttttccagcagtacagagggcattaaaacatgatgctgaacaagtccaaatttaaggataatagaagttacagtaacatctccagctcagagaaacaaaataatgttcaggaagcaataaaatctaggtacaggtctttgatgcaagaaaaaaaatcattacataaaatagataacaaaccccagccgggtaccacaaacgttatggagatttgttccggttgaatattcttcccatgtttttttgcaaacttcttcaaaattttgcttactcaatcttcactaaatctttagcaatacattttttttaagtagttcttgatgactccaagaccaaaatgctatgttaaataggataattggatctcactctcacatgtacatcccatgagtagngttcatgtaaaaccatcctaaaatctatatatggcagttgtgagtattcaagacgcagaaataaaaagagtcaggcatgttgggtgtttgagggaacacattgcaaaattgacagcctgaacaagatttaaacaaccctgttaaaactaaaacaccacataggaaagttactaacaagtcttcacatggaaagtagaagtgtttttttcatcagcgttgctgtagcacaaacagctgaaatacaaaaactaactgatatttccaaattcagctgaagttgaaacctgttctcctttcaggtttgtagcttggtcaagttggctcctcatagatgcagaggagaatcgtgtagtatctgtatcagacttcatcctcttctttttctgctcaccaacttctgcaaatgtagcaagcatctttagtttttcatgctcaacaataatttgtcctgaacctgactcgcaaaatcttttctagtgcttacctatcttttttcgttgtgcagctgaagttccagattgcaacaaaccatccaatagtccaaccaaagcagacgatgcactgcaaagtaatacgaaatatttgatcacattgcaggagacgtttcttccaatagaagacatgcactcagagcggaccagataatccaagcaaatatcagtaaaatagtaattgaaagcaccaatataaaatcattgaagtgaaagcgctgctgttgtattgtttgtgatcccatgatggccagcatgaataaccatgttctacaaagccaatgttcaatgtttgaagaaattgtgcctaacaaagaagcaggaactttctgctgacaagtcgcacaaaagttttttcttgaacacacaggaggactgcgatcatttcatttataggcaagttgcacaaaagtaaaaaaatcaaacaagcttatagtccaccattctatgctaaattctgaaaaaaaaaaagtaaaataggttaacatgtgcaagatatacagcatattcatgacatcaaaagtgaaattttagtttcatcaaagaatttttttactagaaattcagtaaatcaacatttcacatagtatgtgatgctcaattctcttttcttatttacagtcatctactttttgaacggaagcttctgttcaggcatataggatgctgtacctattattgagaagtcaaaaccaatatgatgaacttctgagactctttttgaaattgttagcgcttcattttgattgttataactgaaccaaaactgttctctgaggtaaacagttggtcacgactactatctatttttgtacatgcactcaatagattcaggcagggaagtgtttgtactttctactccaccctgtcccacaaagactccacttttgagacaaagttgacaaattagtggtgagagaaagaccacagtacccctgattataagaaagtagtatgtgaagtggtaggtaaggggtattgaagggataaaagtaaacttctcgatttgcggaccgagggtaaataagaagctaaaaatggagtcttttggggacagttgaagggctagaaatgaagtcttattggggcagagggagtagcttttaagacttatccagcagatcagactgtagggagttccatgattttttgtagatcttaactgaacaaaagaatagcatgtgcaacacttgaacaaataaaatttcaacatacttgctcctaaatttagctaagcctggttaaaaatgcttcagcatgtaagatttcaatataaccgatacactgattgtgttcatcagtattgttctttgtgttcatttataatgttatggaagtccacaacagaatgactaccaccggaagaggccagatggaatttctttagaagaggaagcgctagatgaacaatgccacttggcagaggagagggctggaacatgaacaggagtacagggcttttttttttttttagttaaccttccaataacagttaggcagccctttatagatatggcatacactcaaactaacatgccaacacaactaacggatagaccaactaacagataacctgaccattcagaataacaagtcaactgactaagcctaatgacttatctgccacaggcctcatcccttgacaatgcagacttgccacatgattgctgccacgacaggcctgaagaagcctctcacatagtggcatttttcttgctctagattggtaaaaggaactaatatgtttgcttgtttcatttatatctaaacaacttagatttatagcatcttttcatataatagtttatgaacttagaataaagtgttaacttctattgcacagttgtagctggggatagagagaaaacacagatctgatttatttgttagactaatgattatttaaacccaccatccagaagcttgaaaagtaaccgaaataccacctcaactcattcctcttgacccacaaagaaattgacagaatcaatgtacattgctgacacatgcaatttcaacaagattgaaccacagaaacagcacctaatcacaatattgaaaattcaaattgataagtctgctcgcatttcgcatggaaattggtgatgacttcaatagataagctagtacaacagtggtcaaagttgattttttttttaataaatgtttcctaagaagaacagcatgcagcaatgtttttgaaaggagcacgaagaaaattgaagtgagaaaacaaatgtgtgttcacaaaatttttgacatggagctttgacaataattgatttatcctttttaagaaaacatcttaagataacaaaaaaagggaaaattctatcagttcaagcttcatgaaattacctgacttcactctcacaaagttctttggcacgtgtatataaagcacgaagccgaatcaacgtagcatcaacctgtttatcaaccatctctggagctacaaaacaaaccaaatgtaaagaattttaagatttatgtccattctagcagaccgtaaacattactgcccacttaaatagtaccaagcacaaaataaaatccatagaacaaaaatacaggagggcaagggctcaggcagacagaagcagcagaagcccagacatatatcagctggaggctgatccaaggaatagcaacaacaatctggaggagcactgtaataagatactgtagtgatccatattcagcagaaagaagccagctccaacacaagagaagaagcatggctaggatatctagcagaaagaggccataattccaacagagccaacagaagcatgcaaggacacctggcagcaagatgtcatttcgaacagacgcaccaccaacattcgagaggcctgtactgaagtaggagaattcttcaagggttttttctctatatgcaatatagatttatttgatggcttaacaattgtttcatattcaagttccatagtttcatttatctgtttgtgtctactaacataatgaaaacagtacgatgttactaatatgcatgcacgaatctgactatcaaaggaccaccatcatgacaacaatgcccatggatcaaaacttcagttatttatcttgagcagaacactcacagttaaataccagaatttcaacatgatttcaaagagaacgaaaaggacaatttcaagcagcctctagagtctagagaatacaaaaaacttcatgtatggaccctcacaaacctgaagtggcctttctgtaaacagtgattcagaaagaacaagtagttaaattttcagcatagatcaatagaaaacgaggagaaaaagggaactcttcattctcctctaaatccattccgcttctcctctcccagccaagaacaaaaatatatggatgggcttaagcatagtgatgggaacaaagcagcttacagaagcggagtattttgtggatttcattgatcttctcggtgatgctgtcctgatctttctgcagctgatccaggtgattcaacttctcaagcaggtgctccatgtaaccttgccctcttcttcctcctcctcgccctccctctccccctgccctagacgatgacatctcctactctcccttagataagaatttgaccagatttgcacgagtgaacaaggcacagattgatggagatccaaggaagggggttcggttctctcaatttcagctttaaaggtgtgcaagagcaggtgattggaagtaaataaatgagtagtccatttctaaaaggacaaattcaggcgcaaccaggttacggttgcaacctttattgctggttctaggcgtatgtgccagtttgccttcctagctgtcgttttgcttattgggctccgcaacttgctcattttcaattatgttcagcagagtatctaggtgctataacctcatgagtattcttaagcacatagtaatatattgtgtttcttattcatttggattcgacaaaaaaagtatagcctatgatcatccagtctactcgtatatatattccttactcttatatacattccttcttcaagaaacaataattgactagcttgattggcgaaatattaacgttttcataaagatgattacccaaattgatcgaagaaatatcaaggttttcataatcttctactattagttatattcttatcttctactattagttataatggtatatcattaactatagaagctataaagttctaattcgtctcatttaccctactacccttctgtagaaaataccatttttgcacacctccatgcgctgctcttgtggcatgtatggaggaaaacctacagtttttgttcagttacccataagagatttcgtatctctgctgctcctgataaatatgcatttatgttacctataagaaatttgtgtctatcctccttaaaaatatgcatttatgattgagtcaaaaagaagttgagcatgagcaagcatcttgacttaagttaactcacaaaatggtcttcatacgtaagtagccttcgagattgtttctttcatactcacactccccagccaataaatgttgttaaataatagaagaaaacaatatttactgatccaagtatttcagcaatgcatcatatcattacaaatttggcttttcaaaacacaaacctagaggttatattcatatttcgatttttttttatgaacaaagataactgggtaacttaacagagatgtatactgacatttttttttctactttaccttgctcccacttcccaacaaaaacactacttcttacgcatctccatggcatataattttactctcgaacgtctggaaaagaaaacatctactctttttcataggaagatttgtatgtttgacacatgcatgagattcatacaccctgaaactttaaccaaacaagcaagcacaatcaagaaaaggacaacagatcagagtttcagttctgtttttttttttaatagagggccaaaaggcctctttccagcgatcctagagtggagacaacagcagtcatgcacgccccatccaccccgcacaatcaatcctaatggttgtgctcgagcaagctatcagtcttgcagctaaacacatcctagccaactactagcatatcgcacaaaccaacaaaacaagtcaaaacccccgtagcaccgcctcccaatccacctaattcgaggtagcaagcagctagaaatccatctaaaccgtccaaaactgaacatccagctactggataagaaacgcatccaacatctaactgaagggggccgaaaaccgttcgtccgttatctacaaatataatccaacacctcggcaacaattcgaacagcacggaaacgaaaacagcacccacgcgcgcgcatggcgagctacttacaggagaggatcttcttgtgcatcttgttgatctcggtgaccacctcgtcctgctccttgcgcagctggtccagctccttggccttatccagcaggctcgcaatgtccgctcctccgccaccgccgccgccgcccgcgccacctccccctccgcctccgaccgacgacgacatccccggcgcggatttcccccacggttcggtaaaggaatcggagggtggatcgaatcgatctactactctccagttgggggatggggggacagctcgaggcgagccgaggcttttatttggtgccgtgcgccagtgcagaacagcatagtcggatgggagaatcaggaaagcattttctgctataaacacaaggttatcgggataaggatacttaaaatggtatcttagtatcgggatatgagattttttaaaaaaagtttaattaatatttatattaattacatatagccactatatatatataatatagtaataataatatatgtcatgcaaatataaatatttattaatagaaaccacgttggttttcatatatttaattgatttttatataaacttgagaatatttatttacattattttcaaactatcttattttaaataatattttatagtatcgaagggatcgtagaatcgggatactacctaaaattttataggatcgtgtaataatgaatagtaggatcgagatactatgaaaattaaaatactaggtgggatcggtattgttttggcttggtaggatcgtaatatcgtaagatacgatatgaatcaggatactgacaatattaataaacacaagcataccatccgaatatttactactctcactagtcaccatccaaaaaaaatactgcatctccaatactagattgttttttattttacaaatgaagtatttatcacttttaacgtagaatttaacaatttgccacgggactcacatgtcatagatatattagggcccatatgacatatgagtggcaaattattaaatgtcacaacttaaaagtggtaaatagttaaatgtcgtaggtttgttggggctaaagaaaaattggtgcctaagtgctcatgcgttacaatggatgttaaaaaataagtgaaatacatgattcgttatgtcatttacgtacatgatcttataaatcacataattaattcataataatagcttaatgtatctgttaatgaccaaatttggtagaaccatagatcggattcaagaccagagtcagggcggatttgaagggattctggttgagaaaagcagagtgtgtatcggctacggatggcatcggctgccatatgcatcggctgacactaaatccgacaaggacaagccgatgcaaccgatcccgaacaggtggtcctgcaactgttgtcgggatcaattaaggcacttcataggcattgccacgcaaggattagagtccagaaaaggaaattgtatctattaattagaatattttgttaaattccttatagatatttttggtaaaattccgcctaagggacttgttcgtgttttaaattgtaatagagatagagtcgtgtccagcaaggacatgttatatacttcgggtataaatatggcccgacaccttataaacaagggacgacagttcaataatacttcggcgcatcgccacccttttctattttcattgtttcgacgagtttttgcttttgagttgggctgcatcgagttcgatttccaacgaagaggtaaagcttgttatggcggtttgtgttatcgggattagtgcttacatctccatgatactctaatcccgcccatgtgaatcgctaagttatcatatacgctgtataatctagattgatctcgtcatctaacctcattggctagcctctatcatcgaaaacggccgatagatttagatatcgacattgagttagattatacaacgtatctaccatcttgaaggagttttcatcggtttgtttggatcttgcgtttctcttcacacttaatgttgcatcggttaggtccgatctgttaagtaatgtcttgaactgtaatatctaactcattctatgaatactatggagatagtatcggggtttcagacgatcttacctggtttagcagtcttgttccttatatggttcttgatcttctaaatctgccctttatattaagatctcacttgtttgaaatatatcgagctctctatcggtctgttagggtatcccaattcctgggtttatgcatgctttatatatttcatttgtactaatatcttagtgtgaggtggtatcggagtactagccaatacgcgttaggtttgctttatcggctatgctttgagcatatacgatccctactttgaagtatttttagacatcaagtgatttatgctgtctcggcatgttgtccgatctatcccaatcacttggtccaaatgtatttcattggacagattgtgtattgttgacatctacagccgatcgaatatctaataatctctatgcttgatcttccctcgccgatctaatgcaagttacatcggcttggcaccgaacgatatgtcatcagcaaatcaatcgatcggctaactttgttcttctttgtctcttgttggttgcaggatcaaaccaactggcacgctcaaaacctgaaagcagtttcttttgacctatactagagttaagcagatctctgaggccagtacgtgttttccacatgaacagtatcatagtataggtcaaaattgtgtttaaccagtctaagctttgcatttggccctcttaataccactgaggaaaaaaaagtgcaaatagcccctccttcctatagtgcacattcaaatatttattcagccccctctcgcacttcatttcaccatttcgactccctagcacaattaataaggagggcaacgattaggcgatgccgacaatcgtcagcaggccgaggtgctttgggcggtgatttgtatagcataataggtggcacacgataggcagtgcaacgtggcaccatcgctagcatgaaggtagttgatgaacatcaactttgaggggggatagggatatgccttttttctgtcacagtggcttatgtaggggtcaaatacaaagtttcgatcagtatggacagccacattagtgcccaacactggtcaaacgtgttttgcacctgattgtcatcattaaaccaagattatagacctaaatgtgcaatttagaatatcacgaacctaagtgacaccttggtcaaagtttaagcatcgatcgtgaatttcactcttaaaatatcaatctttgattttgggtatgttaaaccctatgattgctatatattgtttgtataattttctataactctcagtgaatttttttagcgttgtattttagtccaatgtcttaatcccctccaacgcacaaatgatgacataccaaatccaatccccgcacatatcttaccttctacttcgtcgagtctctattattgatcggtcacacatcaatctttcacagtaacaattgtcattctacagttatcctatttcatgatatcctagaccatactctctactagttttgccaatcccactcatcatccccatcattcccctagggactatctcattcattgttaggttatacctcgaccgtctaggtcttctgtaaacccaccccctctcaataccacccgaaatctatctattgtgcttgaaaaggaaataaggtgaaaacggtggtctaaatatttgtattgaatcaaaggctaaatttgaatgaaatcattttcaaagtgatgtgtatcatgtttagcaatttcctaaagagcacctattactttgtttagggtttttagtgttcaatgctactaatcattaaaataaaccatgcttgctattgtgaaaggagttgtgttcctagtgattaagtgtgccacaacattccacccatgaaggaacttaattgtcttcaatgagtaaagcaaacattaaggacctatttgccacaccatatgagttgagagtgaggcggaaatggaataggtttttctttgcattcaaaatgatcaagcaagtagtgtggttcatgcatggctagaaagtttgcgttgaaattcaacacgcaacagtttgtctaaaaacttagtagatcaaacaatttgatggtgacaagtccatccaaccctgagaaacaaccattttgaccgaatgtacatcattaggttgtgtggattagataattcatgatgcgaccaagagtactatggatgcaactatttctcgtgtaaagtatcacgaggtaaattcgaataataacatgctccaacttgattgcattaagaatatggcactatgtaatgacataaatatatttatttatttattcagtgacatataagaatggggctgcatgtggatattggacaagtcatgtgatgcatcagaagatagagatcaagtcttcacaagttcaaacggttacatatcgttacttctagtgtggtagttacaattatttcgtaacaatctcaatcttagtgatttgagattaagggagaatgttagataataaggcatagatttgtacttttttgtgttgtgttgataagatagtttctaaccctagaggttgttgtaaccatgaggatataagatatatatctcctgaccttttgtaatcaccatgccaaggggtttttctagctatataaacacacagacgagcttggaggaagggcatcgattcaactaacatcaataacaaaataattttaggaactaggaagagctaagcggcacgctttgctccatccggactcattgatttgctctagaacaaagagaacctccacattataataatttatagataacatgtgttgaatctcatcccaagagaatcaattttctggaagaatgtggtttgggtttctcaaagcacaaaagtcaacaagcgcaccaccatttagagacccaggatatcagagaagacaatgtatgaactatttgtggcgcaaaactaacaatggatgttggcatgttgcataactaccaatggcaggaagataaagatgtggggagcacaaatgaataaatgtcactcatgattcacttataccatttttcagaagcttaggatggccatatctccatggtgctcaagcatcgcatggttcacgttgtaagaaccaatcaattgtaggaagggatgttcattgcataaaggactaagagtatggcgggctcctcaatagattgaatagacatgatgtaaacattcattcagtcatttgtttaataggacttcagtaagaacaaagaaaaagagaagattttcattccacttttgtaggttatgcattgatagtaaaacaacataactagtgctctcaacctctgttacctaaacatcacaaacttgtcatccaatggaccatcaggagtatacacttatactacctttgttttctaatagatgacgtcgttgacttgtagaataacatttgaatattcatcttattaaaaaaatagtgtacatatgtcaaactgtaattcatattttgagagggaggctgagcaccacctcgtgcggagacaaaaataatgggattgctgggaagcgacacaagataatgtggaagcagtgagcccatgtgggggggggttgtaggatcgagatatcgactagagggggggtgaataggcgatttaaaattaaatgtcacctgatcaaaactaacctaagttgctaagctcggcgagggacaagtctaactaagcaactaagttatgttatgcaatcctagggtgaaaatggctcaagtatgtctctatgaaatgtaaattttacaaagtaaatgatacaagagacaaggaatttttcaccgaggtttggaaactcgccggtttcctactccccgttgaggcgagcccaactccaccgctcaaccacgaagccaccgcacacatcctttgtaaaggggtgggcaaggcgggagccggcccatggagaggactacccaagcctcgatcactcggggtagttcttccttcactccaaaggtggtgaactccaaaccactcacaaccggcaccgggcttcctccataatcttctcggagaggtcaccgagcaactcctccacaagccgtctaagaggcggcaacctccaaaagtaacaagcaatgacgcggctcggagatgatcaagtgccacactagctctacaatgaagcaatgcac

SEQ ID NO: 62951 - DNA, 2447 bp, Oryza sativa
gtgcaaggggtgtatgcaattgaagtaggtgccaatagagtccccttgctactggtgtgggagtatttatactcctacccaccaaaactagtcattgggggcgaaatcccccaacttagtgtactaccggtctgaccggaagtgtgtggccggtcagaccatgctactctacaatggctagttttctaggcgttgtagccctgacattgggccccatttgcccggccggtcagaccacagtgggatggccggtcagaccggcctcggctcggtcagaccgccatcggctcggtttgaccaacctcggctctggtggctctggatcggccaccccagagcacaccacccagggcatatggccggccggtcagaccggccaacacccgccggtcagaccgctctaaggcgacggtcagaccggccatgacgctgcgggcagaccggctacaccggccgatcagaccggcacttgggcagcggtcagaccagccctggttacccagaccagtgacaacaggagatagacaatgaaattgagcacaagtctaaatgcaaacatgacctaatgtggcaatatgaatcatctctcattacccctcttaatagtacggtgaagctaaaattaaactagcaaatttgatcaccctacaccttgatcaattggaaattaaaacactagtttagcatctttttctcttcgctttacgccatcaaattttaatccatcggtagtcatccatgcgcacacataatgtgaacctaacttaaaatatatagctcagtagaatggttagtctacaattagtgcttgtcattaattaccaaaattaacaacaggggctgtcagggttacggataaggtataccctctattgttggatgtacgttgtatactgatacggtatacccgtacgtacacggatagttcctttatacgttaaggaaatccatcacgtgataggaacagaatccacagatggaaggagtcctactcggacgagactgggtctttaccatatcgtgaggagtccgatatctccgattcctacttggagatcaactgacccgcggtataaaaggaaccccctgggcatgacctaaatcatcgaatctcaccgccaacacatccaccacagcctacgaagccggtgcctacaggagccaagtcgccgggagatctagtcgaaccaactcgactacggtctcgtcggtatcatcgagttccgctattccctttgtaatctgtggtttccatcatataatcccatatcaactggattagggctattacctatcaaggggcctgaaccagtataatccttgtctttttgtttgcttgatgtcgtactacgtagatcctggtaccaacggaccctaataccctctatatccgctctacgggtatccaccgtcgacaggggcctatatgcttaggggggggaggagatgttgcggcagtgccaacatgcgatgattggagtttcgaagtggtccatattgattgcctggagttgatctgctcaagcatagaccacgcatgccggaggtggatgaaggacatatattttcttttagaaagaatgatgctttgtttaacacgtcaagaaaattgaaaattccatatgtatctgtaaatttttacctaatccttgctatatcccttaattctcctcattcctttatatacttctgaattttagtttggacctttcatactctttttgttagtgttagttgatcgttaaattcctataataagttcattttgccatttggtagaaaagcataaaaatttataagttttattattgaagggtaaaaatttatttcatggggctattatatttaagagtttgttatgtgaaattatgatagaatttctttgtagatatcacaaaaagttaatatttgtttattagttattgaaaattgtttatgtatagtataaatagatttgtcatatacagaaacatgttgtactcttaaaaaatattttacatgtacaatttttaataattaaataaccattaatttttatatcatatataaaaataagtttttatcgtaaataatatatcgcataactcataaatataaaagtctcatagaacaaatttatatacttcaataatatactctgtaaatttatatgtatttttcataagaaataaacgatcaactaatggaaaatacatggaagtgatccaaattaaaattcgggttatacaaggaaatgagcaaaacttagggatatagaagatacatggaagtgaaccaaattaaaattcgggttatacaaggaaatgagcaaaacttagggatatagaagggattgaacatagtttaagaggtacacatgtacatatggagttttctcaaaatctatatagttttgtacagttcgacgcatcatataatgaatagtttggatttcttcgaatttaata

SEQ ID NO: 62952 - DNA, 8400 bp, Oryza sativa
atgttataaaatgtgtgatccacgaaaaaactcttgtcacctaggatctaaagctaacatatactaatctgtcaaaaaaaaaagagaaaccttatgtctaggttcgtagctaggataggattggggttttttttatagagggggtatgctgcaaatgcataacatttttttatttcttatttcttatgatctaaggttacccttagcaatatttcctttttaactactttctcaataaaggtgaaacaaatatattattttattgttattttacgtgtcacattgagcgtcagcggaacaggagcgacgatcaatgagcaagtataatagggactataagaaggctgaatgctaaggtggatgagagaggagagagagatgagaagtaggccgtaagtttacagccggtttaggcataggaaccaagaaaatttgtgacagacatgtggaccatatatttataatgaagagttaaccactacatgaataaactgagagatagactatatacaataaacaactgcttagggttcacaattccgatgaaaaccagttgaattccgtgaaattttgacgtttcgacacggctcggaattaagtttcgattggaattttgaaggttaaacagtagattttgtcaaaattcagttgaaaattatcaaaaattgatcaaaatttatcaaaaactgtgataccgatggggcttaaaatttagtgatcaactgataatataaaccttgactggctgtattattaaaatttagtgatcaactgctaattgaccttggaagaacctacaaaacccgcccccaaaaccttcccgtggctcgagccgaatattagtagggctttcttcatttccgcctccattgatttcaaacgaaaaccgccgactgcctcccctcccttcccctctccgtcgtgcccccttccggccttcccccaatggcgtcgggctcctctcgagccaacatcgaccaggtaaaccctaacgccggcgattctctcctccccatctctctctcccctcaccaccacctccaagcattaacgcactcctcgatccgcctctccgcagttcttcccggccaagaaggggagggcctcgtcgcgcaaggacgagccgccgtccgggagcccgaggggcgccaaggggtccctggaggggtaccttgtccgttccccttcaaccgcggcggcggcctcgttggactcgccgaggggtggtggggacgcggcgggcgccaggaggagcctctccgcggcgatggatgtcgatgtcggccatcccgccacggcggtggcgacagatgagggggattttgagctgaagaggtttgcgatggagttcttgtcattgtcccattactgcaggtatgcgattcttgtgcaagatgaggggttccttttttcctttctgtttaagaaccggtcttgtgcgaagttcaggttgtaattgttgttgcagtgttatcccttctgtcatgggtggtgctagcaatggcgaagcgggcaagcagcagaagaggagtgcgatccagtcgttcttggctccttgtagcaatgcatctgccaagaagcagcgcgttgctcactctggggacttggaagctctaaaggttgttgtgtgtgtgtatgttgggggggggggggggtgcatacaagattcatccgttttggcgattttctatgaaaagtgatacataagttgcaacttacatttggatgtattgcaggatgtaggtcataaaacccccttccgggaaaaatgtggcactcaatacggtggcccagaggctttggaggtttggttgatataagaaaatattgagtctaaaattgttttggaaattctcatattgttttttttttctttatggaattctgatggtgtccttaccatcaggaattaggtgaggggacaaagctgagcagtgagggttttgtggctttgcaacgatgtagctttaccccaaatactggacagaaaagggttggattttcaacagcaccaggggctggggaaacaccgatgtctgtatccacgaactctctgatttcacccggggaggaattctggaatgcagcaattgaatttgctgatggcatttctgctcgggctgagaagggtcctggaaggcctgagtgtgatgtggatgacaagtcatcctgtgcagttgcattgtgctctaagattcttcccagatccggaaatggtggttctgaccatgaaaacacagtaggaagcaatgagacaaagcaaatggacagatcttcatataaagaagaaccagtggcagcaaataatcatcatgtaaacagctctccgttgcctgtgaagcatttggacttttttcatgaggatgaaattcaagttccaggcctgaaaattgaagaaaaaggtggtgctgtagatctgagtcaaaagagtcaaatgaagaacagagaaaatctcacgcattctgtagataacgtgaataaaagtacttttgacatgcacatagattcttcagctacgattcatgatgagtgtctgtccaagttaacaacagaagggaaaaatcatccaacaagagtgggtgacagtggttcttgtctgactagaagagacctcaatcaactgatctatagtgaggataagctgcttactgcgtattcagatcatggcaagcctagcaaagattgtacaaataaatttgcatcccaagaaatggaagccaacactcctactagttctgttccccaaaaggaccactcaaagctgtcaagttggcttccccctgagctctgtgctatatacatgaaaaagggtattccagagctgtatccttggcaggttagttttttcagtttttgctcatgtccaatgtcgtgcttttgctagtcatctgtcgccagcagaataaaacattgctctaaagcacaactgtgcaagttaaaaaatttgtatttgctgctattctcacaaaatatgactatatgctactacctccgtcccaaaatataagaagtttcggggttggacatgggtattaagaaagtaggtgaaattaaatgggggtttgttgtgattgattgagaagaggaagtaggtggagaaattaaaaggtggaaggttgtgattggttgagaaaacaatgtaggtgcaggagttgttatattttgggatggagggaatatttcatttatgctagtaaagtaataaatatattctactcaccagattgaattaataacaaatcctaagaacctgttccaacttgtaagtacttgtgtcctgtcaaactactccatatttcctaaacattctgtgaattaagggtatgcatgccaaaaagctacttctcttctttatttgaagggatccacgcagaaaagtccaagctactatcttatcatatgtctaccacttccatttgtacttagcaacgcgtggacctggctttctacaatctgctttctgaggcaaaccactcaatttctctttaatttatctatttcactgacctgatgttacttgactatcttagtttttgccaaagctaagtgtttccacatttgtcttctattttttcaaagaagtataattgttctccatcattttcttgtagaacatatctgaacatcataagcaattaaagatgttgccttgattacaaactcagtttaaaagtaaccctcacatactgtctgtttcaagtgcttctccacagaggcatgctcaattgtattccttatccatagggttatgttcccatgtctactgcaggtggaatgtttacttgtggaaggtgtcttggagaaacgcaatcttgtttattgtgcatctacaaggtactgggagatcttgcactcttccctgttgattgataatctcagtatccccatgattcagccctttttgtataagttatttttaaacttgtttcttttgtttgaaatgcatacttctccagataccaccttcgagtttttattagtatattcataaaaataattcctatttcatatattacagtgctggtaaaagttttgttgctgaaattctaatgttgagacggatattgttcagtggaaagatggcaatccttgtacttccctatgtgtcaatatgtgctgaaaaggttctgccatattttactaagcttaccttttgaatgtttcagcatgcttgtattgggttgtataactagtattttttttaggctgaacatcttgagcaacttcttgagccgctaggcagacatgttcgaagcttctatggaaatcaggggggagggtcacttcctaaggatacatcagttgctgtatgtaccatagagaaggccaattctttggtaaacaagttgttggaggaaggccgtctttctgaacttggcataatagtaatagatgagcttcatatggtaagttaaaccaatttggtcctcaaaatttctccattttctttactttcaagatgttgcatcggcttcttgcttatgtttactttagagagatcatgggcatgggtcccattcatggcggatactcaaacacagtatcttccgctgacataacctattcccatgacaaatttctaacgtgtattgggatttaacttttatttcacctaataggcatctgtacacttaagagatacatacatagtgacattaagtgcatggatgtaatcatatctaagtaattcagaaattacatagctatttgacatgatcttcaacattttcaagctaaccattgacaagacatatagataagagatttatactagttgatcttagtcttatagaattagtacttattgttctgaaaatcagtttatcttaatgacagtatttgttgttgttccatgtaaaatggttttgaaaaatgggaaattggtttggtaccaacaaaatattacccttttaggtttgtacactgatatttttggttcacttccattaccttatttgaaatttctgtgctctctttgcgagaggaacacttgtaaaatgcctgacttactactgtatgttcctattacctgttgccacttggccagctgatgctggcgagtgaagtgatatagattcatgagagagagatacagaggggaaaattgccatgataagagcaaattgggcaaatttgagagcgctgaagtaggtaaagcgatttaggtgggatggaaaattcaggtggtataaaactaaacaaatcaaaatttggtggtatgaaaaattaccttttcatttgaaaaacataattctgccatccaatatattgtaaatgcggtacttccagaggacatgccaatgtagtgtacatacaatataatacattgtatttttggcctatactcaatattttcaagtttgaaagttcttgagcaaactgcgaaatgaatctcttcacattacaatatttgaagtactaacagtgtgcatgtgcattacaaccgaagttggtcttcattatattggaacatattggtgtacttttttttttttaaaagagaagatgagtttaccataacatattggtcaatgcttttgattagggaccagtctagcatttctcgttgctttccccattttttttgaaaaattcaatgccaaaaatataacaaaataaaagtgtttcgagaagcatttgttatgtcaagaatattgtgtctctgagtcccaagtcctgacctattcctgtttacctttcccctcatgcaatttgaagttcttttcttcttcctttggaagtcctttggatgttgaagaacatgcaatttttgagtgaatcgcacattgtgccacctattattaccaaagtttcactttgtaccaccacctgagcaatgcctttacttcagactaggttagatatcatttccattgcactttggaccacctcttcctcttcacccctctcagcctttcttctctccaaaactttggctcatcaacatcactacaaagagaagagaggaggaggatattgactgacaggatcaaattcagccactggcagtgccatgagttgaccaattgacagcgtgaggaggcggtctggtttgactagttcggccaacacaagcttgtccacggtacctctattagcagagccctgccactgtgcccctttgtcaatccctactgctatccgctgcactgttagacacagagttccagatggtggggagaagatactgagtaagatagaaagggagggtggaccgaagtgcaacaaatggaaatattacctggacaaaaaaaaatgcttaaatgatggtccaagtgaaactttggtaataataggtggcctaatattttatatacatgcatatttcatttttaacatgcaattttgtgtttataggttggtgaccaacaccgaggatatcttttggagctgatgctgacaaagcttaggtatgcagctggtgaagggaattcagaatcatcaagtggagaaatctcaggttctagcagtgggaagatggatgcaactcatggattgcagattattggtatgagtgctactatgcccaatgttgcagctgtagctgattggcttcaagtaagagaacttctgtaatttttgttcatactattatctgtttttttaagaaatgctgttatctaccataaacatgcttgcagtgtaatatcttacggtcattcaccatcattttgacaagaataatgtattatttaaccaaactgtctaatgaaatacagtagtaagtagtaacaagttatgtatgctgatttgctgaacttcaaagtttcacatgtatattttttgtgagttgattttccttttaatgataacaccaccatacttttgattattatgctgaaatgaaatagtgtactgtgctgaatgtacaagtagaaaggatgctgggaaccattgcattacagtgaggattctactgaattagctttttttttttccgagaaaaccataaaatttagcctgtcctgaggttccttgtagtgtctccacaaggtggtggagggctggacaaacactgtgtgcatcattttgacagttatgtcttaagggcctaattagaggcatctaaactacaaatgactgatgcaaccaatctgatttttatgctgcagaaggacgaagaatttactgctcaagtatttcactgaaaataatgtggaactgtgcgatgctctatagtgttactatatttgacaaacagtattagacatgctctataggctttcaacagtatttgacaaacatatttacagtggtacgggacattgacataggtgttagagtatgacttggattcgagtatctgattcagcaaatttggagaaaaaggattcgaagattcgtataatacatattttataaacatattatataatataaaatattaacatgtaaaatagtcggtcaaacacttaaaatacttttaataccagtgttccaaggagtattgtggacataagatccctttcctatgtctgttgtgcatggaagcttcgcttgtatgctcattggcttataagccacaggccacagccagaatttgaattttattagaacttaatttcagaattgattttgtagtttaattgttttctatttttcagccttggcttttggaccaataagaatagagtataaaagtcttaccctatttttttattactttgtttattttctaagcagtacctcaaaaggtgcaggctgcatgctctctctccagcctcctgcaatcctggaaaagctgcaacctttccgcctcttctttgtgcgcacgcacacactctctctcttcacttgctttacctcttaccgcaacttcgttcctctattatcagcagctgcaagcctgcaactctcctctctttcctttggactctgtcagatgggtgccgtcccacgtctaacatgcgttgacgcacgcgtgtcaacatggtaaaagaaaaaaaaaagggacttgcgagtcccagtaacactgcatatttatcaataacaactgtcatgaatattgctataaatatatctaagagaatttcacaaaattgcaattattttgtcaaaactatcactttgttacaattttacatgggtatttcacaaaactgcaacaatagtgaacgatttatcacaaaacaacaactttacctcctatgtgtgtatggcatttgggcccgacttacaccatcataagtattgcatgtgcgtatgacaggtaggctcaaactttgtgagaaataaagttgcagctttctggtaaaatcatacactttgaaatgtctagctgaaattgcagtaaattgataattttgacaaaatagttgcagttatctgaaatttactctattatatgaaatctgcaaactgaccttcaaataccagcttgagtctcaatgcatgatagaa

SEQ ID NO: 62953 - DNA, 6647 bp, Oryza sativa
  unsure (1)..(6647): unsure at all n locations
caggttgttcagcaggggcattctgttcttttgttttgctccagccggaaaggctgtgaatcaactgcaagacatgttgccaagtttttgaaagtggcttctgttggatcaagtgacgttggctcagaatttccagatgctacatttgcagttgaagccttgaagaggagcccttctgggttagatcctgtattagaagagacccttccctctggagttgcataccatcatgctggtttaacggtattgtaattttactataatttctcatatcatgccatgaagagttggtggaccttatttatgccattgtcgttgcccctaagcatttagaatctgcactgcgtagctgaatgaccttttttttactacattttagtagatgctgttttgaatttattactaatttctaaaaccattccattacttcatgacaacctttatctttcagtaggactgtaggaaacatgaatgtatgcattgtacttttcttgatgtctattttgacaactattctcctagctattgatgatcgtgagcttataatatgtagtcatttctgtttcatacaagtacggctttctcttttggcaggttgaggagagggagattgtggaaacatgttaccgtaaaggtcttgtcagagttttggctgccacttcaactttagctgctggtgttaacttgcctgccagacgagtaatatttaggcaacctaggataggtcgtgacttcattgatggaactcggtacaagcaaatgtctggtcgtgctggtagaactggcatagatacaaagggagagagtgtaagatatgaaactttcatttatactagatgtttcccatgaattcatcagcttagtttcaattttttatttatgtatctggttgtgctgatgttttcttgtttatgaatgtctaatactttgatatttgaaatgtagatacttgtatgcaagcctgaagaggtcaagaggattacaggtattcttagaagtaactgtactcccttggagtcttgcctctcagaagataaaaatggaatgactcatgcaatcatggaggttgttgctggtggaattgtgcaaactgcaagtgatatccatcgatatgtgaggtgtacgctgcttaactctactaaaccttttgaggatgttgtgaagtcagctcaggactcccttcgttggttatgccataaaaggtttcttgagtggaataatgaaactaaaatatactctactactccacttgggctagcagcttttggcagttcacttaatcctgaggaatcgttggtaggttactttctttagttattttcaatattttttaaatttaatcttacaattttctatttctctgtgtaggtcgtgctggatgatctttcaagggcaagagaaggctttgttctggcatgtgatttgcatttggtttacctggtaaccccgataaatgtagatgtcgaacctgattgggaattgtactatgagaggttcatgcaacttacttctcttgagcaggtatttctgttgcatcttagaacgttttttctccaacaattagtctgagtacatgtaatattttcatatcctatttgtgtatatcaatagtaaaggaccacagactgattcttgctattgtctatattgtccttatagcctgacaggcaaccatccttttcaagtgaaaaatgtatatatttttctctttacccaagtaaaaaggtgaacactaagatgacatattgagatgatcagataacttaaaatgtatcaagtgatgttgtcaaggaggtggcattaaacagtatgttgttttactcttattgtaaaatggtagtgatactaaatcaaataatattcatgtaatgcatcacaaggccatgaactcatgcacccactttacaagttcatggcactatgctagaacttactctattttatctatagtattgatgcttgttggtaatgtgcagtcagttggcaaccgggttggagtaatagaaccatttttgatgcacatggctcatggggctgcaatgcctgttcgtggaaaacctcagcgtgctggtatccgcaacaggtcaccaacacgaggttctggtggaaatgcacttattaatgagcaggcacttcgagtttctaagcgcttttatgtggccttgatgttgtcaaggcttgctcaggtataattcaactctgcaagattgtatcatcaatttgcttactattcctgaaacctagtagtatgttaacgatctatctctgccatgccagcaaagtgcattactctaattggttttggatctttttttatttgtaaatatagtatgattgaatatttaatgaagctatttaatgtattgtatctttcaggaaattcctgtcacagatgtttgtgaggcattcaaagttgcaagaggtatgattcaagctttacaggaaaatgctggcaggtttgcttcaatggtttctgtgttttgtcagagacttggttggcatgatttagaaggccttgttgctaagttccaaaaccgagtctgttttggagtcagagcagagattgcggaacttacatcaattccatttgtcaaggtttgcttatgtcactttgcatgcatgataaatcctaagttttgtcccatcatatcttcctacttatttttatatgttaatatgttatgggatgcagggttcacgtgcaagggctctttataagtctggtttgcgtactcctgttgccattgctgaagcatctattcctgaaattgcaaaagctctttttgaatcttctacttggtctggccaaggtctaatactctagctatgtttaaactttctattaaaatatttgtgtatgttgtgttagtctgaggttctgagactacagtagtgctgcaatgatggtggtggtggtggtggtagcagtagctttactattagagaaatggtgaaagtaatagctcaaaagccatcaaactcgtaaattagtactcttaacaacctgagaacaagacttctcttcctttggagatggctgtaatgtgtagtccacattggcattcctttctattttctatttttgttttcctctctttttgttcaacattttggatcagtttagtatcaaggggtcagattcatcctattggcttatttcttgtgattttcctgccttgtgtaataatatctgttcaatggactaggtgattctggtttacgccgaatgcaattgggtattgccaagaagataaaaaatggagctcgaaaaattgttcttgaggaggcagaagcagctagagtagcagcattctcagctttcaagtcacttggtgtacaagttcctcagtttactacacctctactcccaactatcgatgaacccccaactcgagatagcatggtttctgttggcagaggtcaagctagtgatgatacaaataactgcttcagttatggttctcaaagggcttctacagagagaactttagggaacgatatgcaccctggttcttccatacaaataacagagagtgcaagaatagtgaataatgccaacatcgttgtccaagtagcatcacctttctccatagaaactaaattaagcagcagaaatgtggctgacaaaggccctgttaatgcatataatttcccaggagggtttgacagttttcttgatcaatggtctactgttagtgagttttcttttgatcttcattatgtcaagaagtcaattaaatcatcttcaacctatttcgatattcttggtttggctgtctgttgggaaaattcacctgtttactactgcaactttccgaaagacctaatgatggctggtagcaatgactccattgaaatgtgggacgaactaacgagaagatggaacagagtaatcgaaattatgcgacaaaacagtgtcaaaaaaatgacctggaatttaaagttccagattcaagcattgaagtatccctgtgtttcttgtcaacggctctctagacttcatcttgactacaaaatgttgaagaatgttgaagtcctcgacaacttgtatgttttcctacaaccagtttctgtccacagtggattggacatatgcttggtggcatgggttctctggcctgatgaggaaagtaaaacagtgccaaatcttgagaaggtataatatcttatgctgtgatatagaactcatgcttggtttcctctttaaatgttttcatggcaatctctttcaaccttaacatttcccaatgatttgttaattttttgacagaaaagatttcttaattttgatgctgagatatttcagaaaatgtactttatttgtaatttttacctgatattaattaatagttagtgaagagacgactacacaatgaagctgcagcagctgcaaatcgagatggcagatggagaaatcagatgcacaaagcagctcataatggttgctgtcggcgtgctgcacagacacgggcattgtgttctgttttgaggaaattacttgtttctcaaaatctcaatgatttactcgaaacaattgagggcccattggtacgttctacccttgccaaaatgcaatattgtcatcaaatgctttgacattcacattatatttgttgggcaggtaaatgttcttgctgatatggaactttggggaattggtgctgacatggatgcatgtctccgtgcgaggcatatcataataagaaagctgaaagaactagagaaagaagcttataaattagctggcaagagcttctcactaannnnnnnnnnnnnnnnnnnnnnngttctttatacacacttaaaactgccagttccaaaaggttgtgggaaaggaaaattgcatcctacactgacaagcagtccttggaccatctaaggtataaatttgatctatttgttgtgtgtgtcatttctaggcattgcaaatttattatattagcaagtgtttttttttcctttcaatgtgccagtcacaaacttttcatgattcaagcatttttgaaatttaaaatgtatttccttgtatatctagtctcaacaatggttcactgacataatgtcttcatgttgtattatgtctggattgaagtatccttgtgtccattctagtttctgcatgttgaagatgtcattacggtgttgtcttgatctaagctggaattattggggtgccatcacattttattattatgtctgattacagtatgtttcaagagttgcatgtcatgtttggcttggtgcttcaaagaattatagtaaagtgagggtcagggaaggaagaaaataattcttacgcctttcagaatgtcatggcaatgctggctcagaatttgttgaacatgccaatgagttggccagggaaactttattacaagtagtgctgtaatctgtatattcttttgatgcttcactcaaccctcacgtaattttttgcaagtttcccaaggaaagtgtttgcactggtaacaataagatttcagtaaatgtggagaattgctcttgttgaacttctaacttagatcatcactccgtctaatagtcttttgctctgtttattcagggattgacatgtatttagagatgctttggttttgttcatttttaatacagtgtcatattattatgctctttttattcagggatcaacatccaattatatctgtaattaaggaacatagaacattggcaaaactgttaaatggcaccttggggtccatttgctcacgggctcagttgtgcagcaaatcacaaagatacatcatacaaggaaattggctccagacatcaactgccactggccgtctatcaatggaagaaccaaatctgcaggttatgttacattattgctagtgttttgtataatatgattatattcataggtcatagcaatgattgactgcattttttccttagaaaaaaaactgactgaactataatttgtagtgtgttgagcacttggtggatttcacaacattgaagaatgatcatgattccacaagcatgtcaatggttgatcatcatgaaatcaatcctcgtgattttttcattcccacccaagtattgctcactcaacaattgtttcatgctgtatatattttcctatcgcaagtaaggtaattttgtggtctcctttttgctaggagaattggttgctggtaacagctgattactcacagatcgagctgcgtttaatggctcatttttctaaagatactgcattgattgaacttctaagtaaaccagatggtgatgtatttactatgattgcttcaagatggactggtaaagcggagtccttgatctgttcaaaggaaagagagaccaccaaaagatttatttatggcatcctctatggaatgggtgccaactctctagcagaacaacttgaatgcagcccagaagatgctgcacagaaaatccaaagttttaagaggttctttcctggtgtctcttcatggctacacgaagctgtggcatcatgtcgtcataaagggttagtttgctttgtcatagccatttctgccttttatgctctgatatgttttccctttgatttttttatcttttcttttgaggtgaaacattaggggtagaccctactgaagtatagagtaaattgcattggtggtacatgaacatttttt

SEQ ID NO: 62954 - DNA, 14707 bp, Oryza sativa
attcctgcagcccctactggagaaaccatctttaatgggttgtccaaaaaccataatagtctcggttgcttaaaaaaaccagggctaaaaaaatttttagtcgcagttaaaaagggtagcggtattttttctatctcctccctagcgcgtagatcaacaaaaatcaaacagagcaagcgtgtcgatcaattctcaaaaaaaataaagaacaaaaaaaatcagaggcgcccagctcccttatctgttctcctcctccactcctccccatccatctcttcttttcttcctctcctccttctcaactcctcctccagatgcacttctcatttagttttctccttcttctccttctccactcctcccctccccttatctttgacctagctggcaggcgggagggccgcggcggctgcgtcgggggcggccggcgccgggcgggaggccgcggccggcgccggttgggaggcggcggccgacggacaacatgtttttttttcttctcttctctgttctctgtgatgaatgctgacgatgttgtagatgtgaactttttttttctctgttgtctatgatgaatgcttgttgtcctggagatattgtagatgtgaataaatgcaaagaatattgatgctttgatgttgattttattcatttgatttgtgatgatttgggcttttttttattttattcattcgatctatgatgatttgggcgatatgcaaagagtaaaagaacaatgaaaaagaaaaaagaccaaccggataaaaggaaaagaaaaaaaattttttaatcctggttggtaacaccaccggtacagactgttgcacctcccaggatcagcctgatgccgcgcattccaaataaaaacgcaaaataaaagatcatcgggcgcaaccaataaaaaatcgccgcttcattgatttcaatataccaggtactaaatattttcacatatcaaagaacgttgtagttatgttagaactgaaaaaaaatatcggaagaatgggagcataaattaagtgggtcacgttgtatatggagtgtatggtccgatgaacgtgctttgctggatgatggtcttttatattgaatttttacggtataatttattggtagtataaacaatccaatgacgaattagtttcctaccctactgcataaatggttttttcagggcgagaccctctcctctcctttctcactctctcacctcttcttctcactcttctctcctctgcgcagctctcctatctcactctcctcttgcagccagcggtgggcggcgcggccggtagtgggcagcgtggcaagcggcaggcaaggggcactgctggtggcaggtggagggctcgaccggtggcatcaggcggctctgcctccgccggcctcgtgacgggcggcaggcggtgctatcaacggtgggcttccccgcgcatcgacggaggcttcgatagctgatctggcaactgcggcgaatgcaggcgccggcaacggaaaaggcggcaactccctcggcccttccacgcgcggatcgagcgacgggctcgagcgggaggccgggagcggctctcccctgcccttccccatgcggatccggcggtgggctcaagcgggagggtaaatttgtctttccatgttacacatgacgggcagttccgtaaaaacccattcttcactccggtcgaaaggaaaataatcgttagctgtttcgcgatgcccagagaaaagcaggaaagtagcttgtattataccgttttcctctccctgttttgcggttgcaatcttgtggatttatcaccacgtagtatgtacctatgccgaatgtcgatgatcaggaacaagattaattatgcatagctagattaaagtgtgtttaattagagaaaataatcgccaatttgtttattactagtatttattaatgtattagatcgtcgttattctttggttgcgatctatagtgggactaaaaattaaatagtcctgttgtaaccaccaaccgagactaaaaatccatttttagttcttcgggtttttttttaaggttgggtttaaaaaaccaccggggggggggaaaaccccttttaaaatttttttttaaaattggggggaaaaatttttttctcgccagactgatcaaatatggtttcttcactagttaataaagaacgtctgcacctggacatacgcactcgcgcactgtgcggagtgaggataaccggctcgatgaaacagagcaaagcaaatagataggggaaaatagaggaagtagagaagggcaaatctgtatatggtaactcaataaaattcagcagaccaagcatgatttcacgttatcaacaaaccatatatgatttctccaggaatttcacaacaaaaccatcgtgaccttctctataattatcattgatggtttttatgcacaaagcaatcatcaacgcaaattatacagaaggtcacatagatgtagtggtggatctagagtcctaacgtgtctatcgttatcatagcatgctaattatatttagaatatagtgttataatatatagacaagcaatttaaacatagcttttgtcgaatgtcatcgctgtcttctgacaccagtggtaacactgtagatccgcctgatagatggtaagcgctaacaaaatattatgttcatgttatcggatattatgataaaatagtaaccaaatttatcccataccttttagtaagttttaactctccaacaaagccatgatagtaatttcatcaaataacaattatcccttgtatatctaatctttatctttatttactacgtagtaaaaaatacatagtagtggtggtgagtcctggataatctaagggccgatattacccttaggatcctcgtgcagatcaaaaggctcagatacccctcatgctgtcccgcaccgcccccacctccgtatcacaccgtccgcccgcatcacaccgcctgcccttggacgcccccgttacctcctccttcatgccacttggcgctgcctccgtggcgcccccggtggctccttcgttgtgctgctgccacctcctccgccgcaatgctactccatcgcttcatagcccctctcctcctccagccctatgctccctgctccgtccggtgcaccgccacttcctatccccatcatgtattccaactttatatctccctactgctgtcatcctccaacttcatatctccctactgctgtcatcctccaggtaattgattctatattggtttggtttatcggatagtccgtggaagatcgagctgctgctaagtcaggatacatacatgtcacagcttaatttttgtttcaggatttataaattatttaataaattattaatagaatttatattaaatgttcattaatttataagtgaagttaaatgtgggaaataaaatttcctaaatataaagcatggatggatttaatttgtattaaattctccatgattaattatactctggaattttcttggatttttcagagctcaattattaattttaataatacaaagaatatttcagtaattattcacatattaaattaatcattaaatgagctggtttcaattttgttaaatactttgagtgttcaagtatattcaagatttttcttggaattacaattgaaagatcatttcagtgattaatttaattgggaaaagtaattaaaatccccttttcctttttgggccgaaacaggaaagttcacctttagtcctcggcccattcttctttctattcggccggccttatcccttccaatagtctagtttgcatccctgcttctatcgggctgtgcaatagaagcccagacaaaagtctgttttgcctccctgacactgttcatcttccagctcggacagagtccgagccagccatgcccgtgtcctgttgccgccgcctcctccttccaaaatccggcctcctcgttgctcctttttccaaattagttgagggaatggaatcctctcaatctcctctacaatttcccaagaaatcccaaaaagtttctatggaaatcctttccaatttcgcggatcaatctttccttttccggcgaagatccttaacattcccgcagtttttcccgtcgatatgggcttggacccgagctcccggtcctatataaaggaccccctagtcgtcctctacctatcccctcaaatcccgtcttccgccgtcgccggaaacgctctccccgcgctcgccttctctctccacctccggccgctgctccagccgccgtgcgccgtcgctgtggtcgtcgccttcggtcgccactgccgccattgggttcacgaggaggagaagaagatcgtcctccacttccccgaagccgaaatccacctgatgaggacataattagctcggatataaccatgactaccttatgtattaatcaaataaaggtgcatatgttctacattagatatatttgttatatatttgaacaaacgctgccacacaatgagtttcgtgtgtttttgtttgcagaggtacttgcttgggcgaaagaaaagagaccgagcgtaaggaatgcatggatgattgaagaagttgattggggaccaaaccaagaccttctgcaagtcttcttttttttttgaaggttttctttcatcttaacacgtcacttttggtccataaaagaaaagagataaagttctacacgttttgatttcggattcaggcctcctgacagcatcaactttaaatggacctagcctctgatctagaaggaattttgaggcctatgagtacttgttggaaagcttatgggtctactttcagatggttttgtccccatgtcaaaattcctaccgagctgccggaaatctgcaaaacaagccacatatctcatccagtccgaatctgatttgggttttgggccttgtaattgtgtcgtgggcttagcccaagggatgtgcgccatagggaaaccctaggacatccctaatcatattaattcagtagccgtcatcgtttagagttgggttttgcttagattatcctgtcaagaacagtttcgccgctagatcggtttgtggaaccccaaattcgagtgcttaattattcatatgcaatttggttacaatctatcttgttcttgcttgtgttctttaattcgcatgcagggattagccttctcggcgaggtaaaccgggtttcggcacttttgataaccagaggagacgtggtgctgcgattacggggctcagtagcgtgttcgttcagaagccggatcgagttgtgtcacgactccacccaaatctttgtttatcaataccaatcggaagatcgggacctaacatccctcatcaccaccggagctccatcagcgccgtcaacccgaagttcaccgtcgcgttttgatatccagcgaggccctgcagcacctcccattgtcgccaagttttgtcaccgcctcctttgggttcgcagctgcgaggtgaaggccgtccactcctccattgtcgctgctcatcgccggaaagtcgtcgctgccgtggaccagtacatcgccaccattcggatctcgtcaccgccatcttccgtcgctctccgtcatcacgtaagtgttggtaaggaccgtcgtctcgtgctctttctcccggtgtgctccctttttgccgctgctccgtagttcaccggtgatcgtcgctcccgtgtctgccgtccagtgatcccgcgtggttgtattatctttgccacgtcgttgcatctctgctgtcacttcaccgccacctagccacttcgttgtctctgctgtgccatgtctaactaaaccctagaatggattcaatctaatccgttggatctcagtcaactctcggttaagattaatctcagccatccaaaatcaatataaatccgttctctcttttcaatggcatattattcatttttaatatatgtcaactaccaaatataatctaattttttccagagattgttttaatcttttatctcagttataaatcatttgtatattgtttaattaatttggaatagtcttttctctaataggattaactggaattaaatcttgtaaaattcataactaattcatataaaatcggaatgaggtcgttctagtctcataattcatctacaatcatgatctacatgtttgtttactttatatgttctgtttatttggtttttattagtctttttcctcgttttgcatgttagcttgtcgttttcgtcgtttcgaaggttcgcgtgtgtgtcgtaagagttcaagaagataattgaagaccaattattgcaaggcaagccacacagatcctaatatacaattcctttgagcatgttgatcctatatttaaagtctctatttatttcaactgtgcatttattttcgaatgtcaccgggtggtgtgaacttattcctttgttatggccaatttgcgttcattactctattccttgataccttgtgttattataattttactagttgagctttgtatatttgttcagctagatgttagacataattgcttagccatgcttagaaacattagcacacaattgggataactaatgttttactattacttaatgatggatatttaattgtagctcacaatggttaatcgtgattggttaattaattaatatgccattaaaacttgataatggtgggttgtgagcacatggttttgatggttgtgctcatgacaattaaggactggttcacgagtttcggttgtgaaacattaaccgtgccaaccacaagccagcatgcgcaacgcctttaccttttgtatagcatggttcattgcggggcaccagattgagaagtggtggagataagcccacgggggtcgctggggagtccatgccttgtttataagggggtgattatgatccaggaacggtgtgctgtggtggattgtattatgcgaggggtactgtcacagctcctttccgaggtaccgtggtggtattgaggcgcatggtaacatgttgtggggctgtgtcttgtgggtacagtggtacacctctggctagagtaaaactattcgaatagccgtgcccgcggtcatgagcggctctaacaatgtctgtcgtgattagtctcacacttttcaccataataaataatgctataactggtaataatttgattagctcctggtttggaatgatacattcctggtttggagatagatctgtacagccgggtatggttgtttagtatggttgggtctgtgtagtatgggtgtgctgttcagtgttgattaatattgatgattaattactctactattttacaattctcgaatgtttgttaaatgctgcttttgtaaatgagccctatattatgccattctttggtatccttgtgcatttgcatatttgctgtgtggcttacggagtattccatgtactcaccttgcaataaacaatcaaacctcagttcaagaaaagttgcgaaggagaagacgtttggcttataccccaattgagctgcctgtgggagtgttgccggagcttcgctagaccgtaattccgctgctattttctcttttcttttgtaagtatgtaatgctgtattattgatgaatctgtatattaaattgtcagtttgtgtaccttgtctgattcctggacgaggatttgacacacaaattagttcagaaattactagtgaatttatgggcgtgacaagttagtatcagagccatctcaactgtaggataagccaaatggtcaaactttaaggactaattttcaaaaaacatgattttgtgaaaatgtttcctttcttccttctccagaattctttgcaaattgctttatcatcctttcctcttcctctttcagcttgagtagttctgaaactagttgttgaaacttgaagaagccaatgtggtctacttatcaagtggatcgaggaatatgaaggtgatgatcgatctgaagtgtccagttgtcaagaaggaatgaagtttggatcctaccttagaacttaaaccgccaaagtgactttgaagtatagttagtagggtagaacgcttttgtttgcttgtgtgtaggtatggttgcattctcatcattgaggaagttcattgatgagtgtgtaattgtactaggttgctcgtttaatcaacttgaacaatataatggtctacacacaccagatcagtgataacctagttaaggtctttatctttagtgtaacccctctccttctatcttctccaaatctgcaacgaatggtgaacactcatgctagtggaagtggaaacaataacaatgaagagaacccaacccttgctcaagttctggctcaacagactcagttaataaacatgatgatgcagcagatgcagaaccatctcaaccaagggaacaacaatgctccaccgccccagaacaagttagctgatttcctttgtgtgaagccgcctaccttttctagcactatcaacctagtggaagcaggtgattggctacacactattgagaagaagttggaattgctccagtgcacagatcaagagaaagttgtgttcgcttcacatcagttgcatggatatgcttcagaatggtgggatcacttccggatgaacagagcagaaggacaaccaatcacttgggaagagtttaccgaaggattgaagaagacacacatacctgcaggagttgttgctttgaagaagcgtgagttcaggacattgaagcaaaaggatcgtaccgtgactaagtttctttatgagttcaaccgtctagcacgttatgctccagaagatgtctgtactgacgaggaaaggcaggagaagatcttggaaggcctgaaggatgaactgtcagttacgttgatctctcatgactatgctgattttcatgagctggttgacaaagcaattcaactggaagataagaagaacaggatggacaaccgtaagagaagaatgactgttttccaggaggcacagggcagtagccagaggcagcatatcaagccatcccaagttggtgaatcaagtctaacatctcaagaacaatcgcaacagttgaacatcggtggtgagatcaattcagagactaatgcaagcaatgaagttaacatcaagcaagctactctatcggagccagttcagcaggatcagtctcaagaaaataacagtagtggaagggagcagcaagtatgtttcaactgttatgagccaggtcacttcgcaagaaagtgtccgaagccgaagcatcagcagccgcaaggtcaagtcaacaacattgtcgtcacaggagccaatgcagtgccagttgcgtcctcaagtgttacagctcagccaccagtttcaaagcagcagtagtcttctttaaagccttagaataattatcggagttatggaataagatagactgcagttgacctatgcccttttctttctagccgttccgaatctcgggacgagattctttgtaaggggggtagatttgtcacagcctgatttttgtttcaggatttataaattttttaataaatttttaatagaatttatattaaatgttcattaatttataagtgaagttaaatgtgggaaataaaatttcctaaatataaagcatggatggatttaatttgtattaaattctccatgattaattatactctggaattttcttggatgtttcagagctcaattattaattttaataatacaaagaatatttcagtaattattcacatattaaattaatcattaaatgagctggtttcaattttgttaaattctttgagtgttcaagtatgttcaagatttttcttggaattatttgagcattggaagtatttttaacaattgaaagatcatttcagtgattaatttaattgggaaaagttggcaatacaccgacgtataattgtattgacgtggatttccttacaaaaaccctaggtatacatatttaattataccctaaggttgatacaagtcctgattcgacacaatatagggccccatcatttggctttttcccaaataagccaaaacggcttattagggaataaaaaaatgaatttgtaggtaaaaattttatatatgtgttcttggtgacttaaaagccaatgcagaaaaaaaaactacgttgaaaatatctcaaaatcaatctcaaaattaattttaaaaatttaaaatttagctttttctttggctgattaggccatccgatgggagccataatatttcctaacaagaaaagaaataactaatcatgtctatttaagagatatactaaggaaaatataaagcagtattgtcgtagttttcaggattcctcattgaactcggcttaatctggataaatttccatctaccaatcagtttctttcattaaccaattccacaaaataatcgtaacaaattttggtgttaacaagaagtcaatgtgatttggaggatatatgaagatcttgtttcgtcgatcaccttaatggatggttcattccaccggtgctcatcgtctagttccatgaacaggcataatgacaatggtttcattgtctaatcagatctctttggttcccatttcttgattctccctttttgctaggaaccatttagttccaagaaaaactatcttagccaaagcaatgtactccctttgtcccgaattataagatctatatatttttttcacgatcttcaatgacttaagttaaccaataatttatttcatattgtatcatcaacaaatatacaattagcattacatggaagtattttataatacgaatgtaatgacataacatatataatacttggtgtagatattgttagtgtaattattaatcaaaagttatcgagtttgattttacttaaaaattaaggctccctataattcaggacagagggagtaagatgaagatgggctattatattgtattgcaaagttccaaaaaaaatctagtttattataacatgagtgatgtcagctatgaaacatgcgaaagtgaataaagccaaaatttaccgcagaagaaaataaaaatgccattttgtaacaacacaagcaagagagaaaaagaaaacctttcatgggtttgtggatcactggtttgcatgctagaaaataggcactgctgatgacaatgcaggaagttgatatctctggtacaggtcattgaactcatgaaaatttcagaacacataaaaaaactaaggggcaattgcttatttgaccctgttttgaactgtaactaccaatttaaccctgctttttaaaatgtgcttatttgaccctccttttaaaaaacgaagcactggtctgaccatattccgtttggatgagttaacggtgttaatttaggcgtaaatagtccattttacccatacttatttaacccagttgcttgtttgacctgcttcttatcctctctctctaatctctctctatctccctcgagcgctgcggcgacggtggcggcagttgcggcggaggaaagagcgacggcggcggcagctgcggagggccgacggctgcggaggagcagcggcgctgggagcgaaggggcggtggcggctcagcgacaccagcggtggtggtagaggggtgttgacgtaaaacacgaggcctgggagatctgctgaactccagtgcaggtccaaaactcgcgttcgggtatgctagcgtggcagttgatttgatcctgcaatcaacaagaaataaagacaaagaaaccgcagttaaacctataaatgatagctgatcggctagatgccgatgacatatcatttatctctgagccgatgtcatatgtaaatcaatcggcagttggaactagataataaaggactaaatctattcgatcggctatacatattaacaatatataattcttatatcgatatatatttaaatcaagtgattgggatagatcagtccctatgccgagacagtataaatcacttagatcgaaatatatattaataatagaactatatatgtttacagcaaatccgatcagatagatctagcatgtatcggctaatactccgatacagctctatgttaagatattaaaacaagcagaatataccaaaccgaagcttaatatacgtagatgcaataatatcttgacataaagagcagatttaacatgtcaacgaagcatatagagcaaatatagttaaaccagataagatcggctgaaactccgattctaccctaatcggcaaccagaaggcaggctagagactaatattctaagcacgacttaatagatcaaactcaactgatgcagcattaagtatgaaaagaagaacaatatgtagacaatcaagctgctggaagtttcatagagtggtggagatcttatataatctaaatcaacgtcaaaatctaacctaattggctgccctctattaacagatgttagccgattgtaggttagatagtgatattgccagagattatgtaagatatatcataactcgatgaattacataaacaagattagagtatcataaagatggaagcactaatcccgagaatgcaagccatcataacaagttttacctcttgttgaagatcgaaaccgatgcagctcaacccaaaagcaagaattcgtcgaaataaaacaaaagcaaaagggtggcgatgcgccgaaattgtattgaacgtgtgtgttaattgattacatggggttcggggtttatttatacacaaaaattacaaactatgtccatatcaaacatgactcgtatctctaacaaactctaagatacaataagtctttatggcagacttttgccctaaacatatctctaagaaaattacataaaatatcctaattaatagatacaattgccttctcaggactctatccaagtgcggcaaccatcttgaagcaccttaattcaacctgatatcgtatacgaagttgtattgtcagaatcggctatatcaacttactcagtccgattcggatccagccgatcctaatcgtagctgatttggactcctgccgattcttgctctgttctcgaatcgatctccgccttcgactccacttcaatctaatcctcttttccgatgctgatattaccaaatttggtcgttaacatatgccccccaagtctggaatatttggtaatgttccggatttgctgtatatcaactccgagcaagtttcgcactttgccgttttccgactgttacagttgtgctttaaatactaaccgtcaccctcgaaaaatttcacaccgtcctcctccgttttcaccgctaaaaccaactttgttctctctctctccagcgatctctccaacacacaaggcgatcccaggcgatttcatttccgatcagatctccgcctatggtgatgtcgtcttccgctagcccgtctaccgcgccatcggcagagtacgctgaggtaagttctcatcggatagatcccttttcctcgcatgaaatcgatttcctcttttctcatcgtgctttctgcttcccgattcctttggatttgcagcacctttccaacctagtcgcgattcccagccggtcgcacgaaaaccactattttcttggcccaatcggcaatattgaccccattgatttcatcattggtgaaaccaacagaatcccctttagactagtgtcacgaccggaaataacccaacgggcgttccttacgtgcgtgtattattccttgttccaggaggcaaggtacaccgaaagttgatacatttcagagtttatcaagcggaagcataaatagttacattattacatgggcggcgaaggcccagcacacaagaagacaaacgggaaacagcggaagacaagggcgacgaccacaggcgcttgactgcaggcacgagctaaacaccaaagccttcatcatcaaggggctccttttctgggtttggcaaaattgagcaagactgagtacaaccaccgtactcaacaagacacacccataagtgcagaataaatgcaagggagtacaagggggttataatataaagggttagggtttgcagtaaacagcattaaaagacacttagttgctcaaagctattttgtaaatacgatcctagagctatacaagattattaatcaaggccgtgaacccacacgaacctgccttaacccaaggcctacgatgattcagaccgaactggcaacccgaccctgggtcccagctcgtcccaagctaacccaggccaactatttccacatttcagttgttaagcaggttttaagaattaaaacactaacttgggtacattgctcggcttgcctataaccgagggcgcggctattcgaataggttatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccctgggacaggtaggcaggactgagcccctatcagcaggacaccggccctatgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgcttt

SEQ ID NO: 62955 - DNA, 29794 bp, Oryza sativa
  unsure (1)..(29794): unsure at all n locations
atgggccgaattcagcccattagagagaaggagggattttatggtttttctttttataaaatcattttaactttctttatttcttcttaatttttatttgtgctctgaaaattccactaaaatttatgtacacattttaggcttttaggaaatatacaaaaatcctgtaagccttatttgacttttaactttgcacattttaattgttggaggctttcacacggattttaattattctaggcttaatttagaggatgtattttagagtcgttttgggacgtgacaactaaccaaccctaatctgggtcactggaagaatactttcaaatcttggccatctcttgagaaaaccacccctgagaagagttggaccacctggtaccagcacgtatcggctagtaagaaagttcactgggatgagattgggatcggccaagcgcttgctctcaccatagccaattctgctaaggatgaacctctgatggctgccgccacctatttttggtccaacaccctcaatgccttcttgttcaaccaagggccgatgactccaactttgatcgatatcaccatgatcactggtttggatgtgacttcatcggctaatcccatgagcatgaacaccaagaatcaattcgacttcaggacaaaaagcataggtggttggtctggctatgtagcagcatatatgggtcaagggtctgttactcctcgagagcatgtagccttcttgctaatgtgcctcgaaaaatttctcttttgtggatccagttgtggccctacaaccaactgacaatttgtagccgaagccttagaatcaaagaaagaatttcccttagcaagatcctcctcggctacttataacaaacattgaacaatgcatcggccaagatagccgtcagctcagtagtcggtgcaggtggaccatggtggctgctgcaaacctggttgaacctaatggtcatgaaagtcgtcaatcggccatctgtgacagaagctgagttcccattgccagagccgattgtaggagatgatggacaagaacacactcatcgcagatgcacatcatatggggaatatgcgtccacaccaaccgatgctggagcaaagctatcggccgagctgctcaaggattggttctgcagcttctatgaaggctttaagaaagacgcccgagtttggtttccttatgaagactcagtagatcttgaacttccatcagactttagatttgaagatatcaatcatgaaaagtatcaaaaatccagagaaattcttacagctgcaatcagcccatgcatccttcctgtcggcattcatcaagaagaaatatccaagtttcctatgagttttatcacccaatgagctcggctagacaacttggattaggccaactcccaatcggcttattctttgccgacaagatccagtgccgaggagaaatcacatcaacgctgatgatggatcggctgcttaacctcccaggaccccctctaggcagcattgacaacattgagttggcgggattcaagagcagaaacttcgacagatggtggggtgaatggaagctgcacctgttttcatcaatcgacttcgatgtatatgacagacctattccctgatgtcataccccaggtaaaccttgtcattattaacttgaatgatggttagccgattcgtcacttgactaatcttttgttcttgttttgcagaccatcgactcttcccctccgcaccaaagcaacagtggcagtgacattgaatatgctccaggtctgattcctaatggaggtggaccatcccccctgttattgactaccatgccccaaagacttcaactctgcatcgcggcctattcagggaaccagccgatgcaggcaagaaaagaaaaactagatcatcggctatgggtactttggccttagctccaaagaaaaaggccaagtccaagaaaactaacccgactgataagccgactgatgatctgcctgccttagatccatccatcgaacaagctctagatgaagaggaaattggtgaagatgttgatcaggctgcagttgaagtgagtgacatagaaagaacaccatcaacttcacccaagcagacatcaccaactccttctgctcgcactcatttcacaagagtaagcaactcttcttgatcccttttgtaatcattttactttatggccgattactcacaaattttgtaattacagaaaacaagattgctatgaagaagaaatcggctgcagcaacatctaaaccagctccaccaataagatagtctcgattttaattagttgatcccagccgattttatataacactcgtttattttacagcctcctcctcctccttctccttccgtccagcaatcgtcaagtgaccgaactccatcggctgtgggaagtcaacacattgaggaagaacaaccagctgctcctgctatcccagtatttttccttcgatacaagaaattagatcggctatattttacctagctcttattctctccgaaattgtctctgcaggctttagccgatcttttctcctttgatatcagagattatcttgatgagacagaagaagatacttcaagcaaagctctagctcccttatccgatgatgtgaagaagacacttgaagatatctgtcatcggctggaagcatcatcattagataacttggtggtaaactgtgggccaattaggactcggctacttgagatccaagctctaatcctagatgagctagccgacatccttactccaggggtctatcttgagcaacatcaattcaagctggaaaaggccaagttaagactagccgaacgtcgggagcgcaaggatattgaggccacaattcaagccaatcgtcagcttgtgcatgaggagaaatccaaacttgatcagctttcggagggtccgatcaaatccaacattgatcggctcgaggctcgcaagattgagctactggcacaacttcaggaatgcaacgccaagttagatctggagcacaagaaactagccgatctcccgcggtccgtcgaagagcaaaaagcaagacttaaataggctatcaagaatgttgctgatctgaccaagtctttgaagatcattcctggaactgatgctcaagatgcccaagccattgaagaagtcgaacaaattacgcaaagggctatttcggctatccagctgtacttgtctcaataacttttgtgtaataggacctagaaatttttgtaatcggctaagataccttaatactctgttgttttaacaatcctttgtgccgattaacataacttctgattttgctcaaaaattttcactttcatttttgtacatatgtgccccccctaattttataatgttaatagcattgataaaattacaaaaacaactaagggtgatataacaatatcggccattgtatatcggcaaaccataaccgattacaatttgaaaaaccgactaagggcgatataacaatatcggccatctcaagacgatgaaaatacatcggctatcatgtatcggcaacaacagccgatcatgcattaacccaaacacttgggtaatatttcttcaaatatttgccatttagtgctctgccataaacttctccatcgagtccttgcaacatgtaagctcctttagacacaactttataaatttgaaacggtccttcccaattcgccgactacttactgaatttgttatcccgagttccaatcggcaaaatcaacttccatacaagttccccctccgaaaaatctttgggtactactttcttattgtaatgccgagcaacacgcttcttatccttggtaacttttgcaagagctcgcaatcgcgactagactagatcctccctctcatcggccataaggttgtaatattcatctgctgttaaagtattttgcaattccgttcttctagagccgattctaacttcccatggcaaaacagcctcatgtccataaacaagtttataaggagggacttggatcgatccatgacacgcctaccgataagaccacaatgcttcggcaaccgagtatgccattgccgaggataatcagaaattttcttcttaatcaatttgatcaggctcttgttagatgcctcagcttgcccattagcttgtgcataatatggggaagaattcaacaatttgatacccatgctatcagcaaactgaacaaactcatcggacacgaaaattaagcctcgatcggttgtaatagtttgaggaatacaaaactggtagattatatgctcttgaacaaactgaattgcatccccagaatcaactttctttaaaggaatcgcctctacccacttggtgaaataatcggtcgccaccaatataaacttatgtcctttactcgatggtggactttcatatcgatcatatcaatggctcaacctttgaatggccatggcttaataataggattcatagccgacgccggcactcgctgaattgctccaaacttctgacaatcttgacaccctttgtaatatctgaaacaatcttccagcattgtcagccaaaaataccctgcacgccgaagtaaccacttcatcttatgagccgattgatgagtaccacaaattccttcatgaacttcgccgattgcaactttagcctgatcggtactcaaacacttaagcaacaccccatcaatcgtccgatagtaaagctcatcatccaatagactgtacttcaacgccttatatctcaatttcctagaagccgattgagatggattatgtaaatattgatgcacatcatacctccaatcatcggctgttattgctgcaatttcaaccttagcatctttgatcatcggcttatacctcgatgccccctgggccaaatcattaggttcaatattttgttctcgagacacatgctttaaagtaaccagccgaaattccttcatcagttcttggcacttctcattataaaccattaatgtatcattcttgcattcatattctcctgccaattgactgattacaagcaaagaatcccccatgatttcaatagcatcggcttcaactaccttgagtaattacaaccctttgagcaccgcctcatactcagcttgattattagtcgcataaggtttaatagtataagcaaactcgaaacatgcccctcgaggggaaattataaccaagccaatgccacaaccattagtacataccgacctatcaaagaataaagtccatggcacaatctcgaccgagccgattgaatcatcaggatgttccacaataaaatcggctatagcttgtcccttaattgccttcggcgactcataccgaagatcaaactcagttaaagagaatatctactttccaacccttcctttcaaaattggagccgataacatctatttgacaacaccagccttgcatatgacagtacactcattggatagtagataatgcctcaatcttgtacatgaaaaatataggcacaagcataacttctcgacagggaaatatctagtttcagcatccaagagccgacgactaagatagaatacaactcattcctttcaatatagctcctgaatcaagactgagccgattgacttctcaccggcagatagatacaatctaaaaggtattcctttctatggaggaattaaaacgggaggagaactaagatattccttaatattatccaaagctttctgctgctctgccccccaagtaaactgctgatcggctttcaacctgaacaatggtgtgaaaggctctaacctaccggataaattagtaataaatcttctaacaaaatttatcttgccgatcatctcttgcagctctgtcttgttctctggaggctgaatcttcttgatcgcattaacactcctctgagtcacctcgatccccctctcgtgaacaagaaatcccaaaaactggccagccgatacgccaaaagcacattttgtcggattcatcttcaggccatattttctggttctctcgaaaaccttcctcaaatcggctatgtggtcctctatttctttagacttaataaccacatcatcaatgtaaacctcaaccaaccagccgattagatcatggtatatgtaattcatggctctttgatatgtagctccagcactcttcaagccgaaagtcatcacaacccatatgaacaagccgattgcaccaggacacctgaaagttgtcttatgaatatcttcttcagccataaagatttgatcataatactcccaagcgaagcaatctctgaattcttttaacagctctatcaacttggttctaaattctgcagataaatttttactaataaacgtcggccttggtcggtcacctagacctatatcaatttcttccaaatcatcagccgacataaaaccctacccttgtttgtcatcgagatcatctaccgtgtccttgttgtagacatgtgaatcctccacggcgccctcaaaataatagcttgggctctccatcttcaattggctgtatatcagaatcggacacttttagaaaatctccatcccaaacttttccagataaacaatcaagaccatccatctcccaaagagctaaatcggcacgtgtaacattgactgacctgtcggctggcacaatttcaatcttgtcgccttgccactgaatcaagcattgatgcatagttgaaggaatgcaacaattagcatgaatcccatcccttccaaacaacaagctataagaacccttcccatcaatgacaaaaaatgttgtggggatggttttgttgccgactgtcagttccacgttcaaaactccttcggtttctgatggattgccgccaaagtctttaagcaccatgtttgtcttgatgagatcttcagcgtttctgcccaactttctgaatgtagcgtaaggcatcaagttcattgtagccccaccgtcgaccatcatcttggacatcggcttcccattgacataaccatttatatacaatggctgaagatgtcaattctctgtcccctctggcttctcaaaaactacctgccctggcgacaaaatcaatttagccgattcttcttcaacttcatcgatatcggcttacttgatcccaaactcggcaggcaaagtgaaaaccatgttgaccgaagcagttacgacgctttttcctttagctaacctttttgcttcatcagctgtggcttcatcggctacaggaacctgattcttaacacgccacacccgcctcggcttcgttttcttcagcaaatggttaatttcctgctcgacctcctgaaagcgctccctgttcctcaatctttgaacccttctcttttgattcttcgtaaagataccagaaggacaccattgatttttcttgttttcattgtcctcttagccacgatcttgattcactggacccaatctttgatgaacaggaactcttgtctgccttagccgattgcccctactatatgatcggcttgagctctcggcaatatcaccgcacctaggacagtcttcaatagattgcaacctcataccttcattccaacaacatctaaagaactcacaacccaatgaggatcaaagccatcgtcgtcttcttcatgatgcttctcctgctgcttgtcatacttcctctgatatttgttgataatcttagccgaattcacctgaaaaccccttgcacgaccccgatcggctgttcggccagctgtatgcaccatattaacaggaaaaggattgccatcaaccttcatcggcctcttagagtcatcaaacttgattttgcctccttcgatagccgcttggatctgctgcctgaagaccttgcaatcattagtcatatgagacccagaattatgccacttgcaataccttttcttacctaattcttcagccgatggaattgtgtgactggcaggaagttgaatctgcttctctcggagtagcaagtcgaaaattttgtcagccttagtgatatcaaagtcatacctctccttttttcctgagctctttacccattggcatggtataacctttttactccttacccactcagctgcagctatctcataatcatcatcctcatcgtccgatccatatatataagggcaaacatgattaacctttctagaatttttcctagcctctgcatacctttgttcatgcaaggctaccttctgtgtaaggtgtgacaagctttcaaagtcttcatatgagaacttctccttaattagagcaatcataccctaaaaagccaaatcggctaactgggcatcagtcaaactcaagctgtaacacttatttcccatctccctgaatctctgaatatactcatgcactggttcatcatgcttttgcttgatcgatgttagatcagacaatttcatctcatgaatcccactatagaaatagctatgaaactgcttttctaaattagcccaactattaattgatccatacggtaaagaagaaaaccaagtaaaggccgatccagccaaagacaaccggaataaccgaaccctcaaggcatctacagccgatgcttcaccgcattgagctaaaaatcggctaatgtgctcataagttgatgtactatcttgccctgagaactttgaaaaatctgaaactttaaatcggttaggcagaggaactctctcaaactattcaggatatggctgtcgatataggtttccagcgtctttcggcctaagcccgaactgctccttcatgacatctacaatcaaatcggcccatggccgctgttgaggtgttccttgaagttgttgtggcataggctcaaattgattgtattgaggaacaaattggggctgagccgatcctgcttgctggtactgaacatgaggtgatggtgggtgatattgataattcaagttgcccccctggtaattttgaaggtctggctgaatattgcacaccaaatgttcaggaataacttgaggaacaaccgtgccatctggctgcacatgatgaaccaagtgttctgggacaacctgatttgcggcatgctgcatgggttgaccaccaggtgttgcaaacccagccgatgcattcatcggaccttgctgctgaatcggctggacaacctgttgcctcaacagtgtctgctgaatcagctgcaagacctgtcgtcttggtggcgtctgctgaactggttgcacaacctgttggattggaggtgtttggctgaactagttgcacaacatgttggattggaggtgtttgctgaactggttgcacaacctgctgccttggtagtgtctgctgaatcggctgctgctgggctggatcaatggtgtgttgaggacgtaagaacatagatgcaacctggtcttgcgttagccgattcacattctgtccagtgtgctgtggctgttctctcaccaacaatcggggattaattaattggcctggggctgaaggtggtgcagtaggtgcgggagccgatgctggtatcgtcggctgagctgatggtgcattaagagggactgactggcgactggtagattatcggtgattaacggccgataattcgggaacacccctccttgtaggtaaactggtcctgtaacctgatactcggccattgaaccatcaatcattgacttcaccatatttctcagattgattgatcaaagcatggtgtacagtgtcacatcctgatttttgtttcaggatttataaattatttaataaattattattagaatttatattaaatgttctttaatttacaagtgaagttaaatgtggaaaataaaatttcctaaatataaagcatggatggatttaatttttattaaattctccatgattaagtatactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggaattattagaaatgatcttaaaagcctaaaagagaagatctaattttaattaataaattccaatataaaatggggccagataaaatttcattaaatactttacttgattctatagttcctagatttttctaggatttatttgagccaaggaagtatttttaatcaatggaatatcatttcatgaataatttaaattgaaaaaggtttttaaaagtctcttttggctttgggccgaaagccggcccaaaaccgctctctctctcctccccggcccaagtcggcccgcagccgagccgcagcccgccgcgctccttcctcctctctctcagtcgctgataggtgggtcccacctgtcggacttgtcttcctcctccagccgtcgcccggccgaaccctagccgagccgcgccgccgccgctttccaatccggtctatcctttcccgatccggtgaaatcaatagagggaaaatgatcttctcgatctccgcttccttttctcttatggaatcgtcggctactttcgtttggaaatccaaggattcgagttcgatttggatcgacttctctcctcagaaccctagctttccttctcgccgccgatcgccgagggcctccatcgccgctcgctagcccctttataagcacccccgagctctcctctatccgccgccacctttgccttagcccgccgtcgcgtctagcaccgcctccgcgtagccctagccgtcgccgtcgttgccatcggttcagccgcgccgcgccgccgttgcagccgccgtcgtcggtcgccgtcgccaccatcgggatcgcgaggtcgtcgccatccccgtccaccgcttcgccgccgccgaagaccgccggagcgccgccgtcaccgtcgacccgaagaccgtcgccgcttcttcctcgtcgccggcgccgtctgttgctcttccgccgttgttttggtcaccggtgagttcgccgcgtcaccctctacccgttggtgtcctccgtttgcgtcgtcgcgccatcgttcgccggcgagcatgcgccgcccgagccgtcgccggtgatgacgtcatcgctgacgtcatcgttgccgtccgccatagaccggtcgtagaccgtttagatcttggccgttcgttgtggatagggtagatctcggccgttcgtttccgtgagccgccgccgtgcacccggtccaccgtgaacccgagcccgttgacgcaataatcctcttttccttttcaaaaataattcattattgcgtcataattcaattaaaatctatataaatgttttaatccgatttaatctttaaaaattcataactaattctttgtaactcagtttaatgtggttcaagttgcaaaggttgtgtaaaataaagatctacatattaaaattatccataaatagaattaaatttatttaattctttttaaatgggctttaattagatttaatcttgtaaaattcgtaataaattcatttgaagtcagaatgaggccgttcaagtctcataattcatctaaaatcatgatctacatgtttgtttactttatattactgtttatttggtttttattagtctttttcttcgttttgcgtgttagcttgtcgtttccgtcgttgcgaaggttcgcgagtgtgctggaggtattcaagaagattaattgaagaccgattattgcaaggcaagccacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactgttgtgaaacattaaccgtgccaaccacaagccagcgtgggcaacggctttaccttttgtataatatgattcattgcggagcaccagactgagaagtggcggagataagcccacgggggtcgctggggaggccatgccttgttttataagggggtgattatgatccaggaatggtgcattgtggtgagttgtgttgtgcagagggtattgtcacagcctctattcgggcactttccagtatcgcgacgcatggtagacatgatgttgaggctgtgtcttgtgggtacagtggtacacctctggccagagtaaaactattcgaatagccgtgcccgcggttatgggcgggttgagcaatgtttttcgtgattagtctcacacctctcacaataattatggatactatatctggtaataatttgtttagctcctggtttggagttagatctgtacagccgggtatggttgttcaggatggttgggcctgtgcagcatgggtgtgctattcagtgttgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcctgtgggattggagctgaagccatcgctagaccgttattccgctgctattttcttttcttttgtaagcgtgtaacattattattaagatggatttgtatattaaattgtcagtttgtgtacctcggctgattcctggacgaggattttatgcacaaataagtttggaaattactagtgaatttccgggcgtgacttacagcatagtcaacctgatcttgaatgttgttgaactgcaactgcgttgcattgtcgtcttgattaacacctccaccttgaactccctgtgaaccatcaccttgaaccccctaaaaccatcaccttgaaccccatgtaccccttgagagttgtcaccttgatttggtggaaaaccatctgtagcacctttgtcattcagttgagccgagccatcttgagtttgttttccttctccatccttagaggaaccagtctcgggatcgtcaagaaccacctttattttatacttctgaacaagtgtccccttgcgagtctgcatgaatgagttcaagaattgatcacgtgctgcctgcatcatcgcttcaaaatctttcttttgatcaggtgtgaatttttctggatcgatgggtacgacgttcccttcattgacgtcggtcaaacctaacttctggatcttctccttgacagtgcctgaactagccgaagatggtgatagcggtggtttctcggccatgagaaggaattgcttgtctgacttcttatcggtcccatcgggcatgccaaaagagtgttgacgtaaaacacgaggcctgggagatctgtttaactccagtgcaggtccaaaactcgccttcgggtatgctagcgtaccagtcgatttgatcggcagctggaaatagataataaaggactaaatctattcgatcggctgtagatattaacaatatataatttttacatcgatatatatttaaatcaagtgattgggatagatcggtcgctatgccgagacaatataaatcacttagatcgaaatatatattaataaccgaactatatatgtttacagcatagctgatcagatagatctagcatgtatcggctaatactctgatacagttctatgttaagatattaaaacaagcagaatataccaaaccaaagtttaatatacgtagatgcaataatatcttgacataaagggcagatttaacatgtcaacgaagcatatagagcaaatgtagttaaaccagataagatcggctgaaactccaatactaccctaatcggcaactagaaggcaggctagagactgatattctaagcacgacttaatagatcaaactcaagtgatgcagcattaagtatgaaaagaagaacaatatctagacaatcaagccgctggaagtttcatagagtggtggagatcttatataatctaaatcaacatcaaaatctaacctaatcggctgccctctactgacagatgttagtcgattgtaggttagataatgatattgccagagattatgtaagatatatgataactcgatgaattacataaacatgattagagtatcataaagatggaagcactaatcccgagaacgcaagccatcataacaagttttacctcttgttgaagatcgaaaccgatgcagctcaacccgaaagcaaggactcgtcgaaataaaacaaaagcaaaagggtggtgatgcaccgaaattgtattgaacgagtgtgttaactgattacatggggttcgtgtcacaccctgaagtttctttcccaagcctaaatgaaaattataaatcacctagagaaaataccggtgtcaaagcaagacaaaccctaataaattaatgcaaataataatcggaattggcatgtgggatttttcttgagttctatatgtcgaaatatgctaacaagatttttagtggaatttttagagctctagaaataattttaaccaattaaaaatgagcaccagcattatttaatccttggaaattcttttctttttttcttcttcctttgtcccctcctttttcccaaatgggccgccggcccatttcctccacctcccgcgccgttgctgggccgaccgaaggccacagcccatccgctcgcccgagcctcccctctccctcgggcgctgacaggtagggcccacctgttaggcccatccctaacctttggccgcccaccgtctgcagccgccgcctcgcaaccgcccgcgcccgccttccccgcgccacgtcggccacacccgcgtgtgcgtccgcccctcccgcacccctcaaccccctctcccgctcgcccgcgcccccgagatggccgagattcgaatttcgaatcccgcctctctctccacctccacctccccacgtcggccggcgaaatcgggccactccaggccgttcccgacctctccgcccctatataatccatccccgcgtccttctcatttttcctttttgcgccggcctctccagagctctccatcgctcccgcaccgtgcacccaccagccgccgcctcttcctctactccggccgcctctagccgctgctagggccgccgccgcaccgcgccatcgccaccgttgggttcgcgcggccgaggtccacctcgtccacccctcctccgtcgaggttagccgccggagcctcatccccgtcgtgcgccggtaagaaacgccatggccgccgtcttcggccggcattcccgccctctatggtctctctccctcactaatcctctccatttcgttccttaggtcgtcccagaccccgtccgccgcttgtcgacctccctctgtcattcctcgtcgccggtcaccgtcgtctccctccaggccggtcggaccccttcggtgaggacatccctccttccccttccttcttcctcctctcttttccctagtagcgccgccgcttagccatcgtcgcgccgtcgccgtctgccgaatcgccaccgctgtccgctggttgccgccggtgccgcgccgccgccgcgccatggccccgggtcggcttgagcagcccgcgcgcgctggccgcgagctccctgccgccgggtatatcggggccatcggtccggctgcccgcgtggctgccacgtggccgccgcgtgtgcgccgcgtcggcaccacgtgtgcaccacgtggtgcgccgctcctccccggtccatggacacggtccaccgtggaccgccctccccgagtcactgccatgtggggcccgcatgtcggcgccaccctctctctccccgggattttatttattacgcaataaatcaattaaggatttttctgtttatagtaaaagcacattgaatcttctaaaattcatatctaattcatccgagctccgtttaagcccattcaagtctcagtaaatcaagaagaatgtgaagaatccattaaaaatggttttgttctttgtttcagtagtcttatagcctgtttgtattgtttgctttgtatgtcgcttagattccggctctccggatgctccggtgtactttgaaatagtcgccgaggttcctccagcagtagagcaaagcaagtcatgcttgtcacttgaacatgttgatcctatattacaaatgctctaccgttttactttaaatgctgcatcgttttataatgtcaccatgggatgtttacctactgttacagccatactagttttgtatcatgctccgttgttagcttggggatataacatgacttgatattagactagggattgcttagccatgcttagttcaactagcacacagtggggaaaatacattaaagcatagatatctgattctagtaatgatgttggttaataccaccgctccggtgctggttaattaaaatatattaaacgatgggctgtgggtgcttggcttcgatggtcgcgcccatggcacttaaggatcggttcgcgggaaacccctggaagaattccacgtacttatcacaagctagcgtgggcaacggctgggcttgtagtgtagctttcctctagctgacgcatccaggcaagggtgggcgtgatggagccgggcgggccctgcgacggcctctgttgcttccggattctcctaggcacgagaggggactgcccgttgcccgctggggacgggggtgaaacctgaggtgtggtgtgcttggctagatggggttatgcgaagagtcctgtcacggcctctttccggtatgtcgtggtggcatgtcggcgtatggaaacatgtcgtggggctgtgtcttgtgggtacagttgtacacctctgatcagagtaaaactattcgaatagccgtgtccgcagttatgggcggtcaacgagattcaccgtgattagtctcaccctagtttagtctgatggaactgattagttcaggtggttggttgggcctgttgcaacgtggtatagcgttggacagtggatggttaatattgattaattattacacctgattttcctgctttcaactactgtttataaatgctcgctttatacaaaagaacctctctagctatcctttggtaatatcctgcatcataccccctgttccggtatgacttgctgagtacggtggttgtacttagtcttgctttattttccccaaacccccagagtttgagtatgcatcagatggtggtttctctgaggagtaggcttcgtccgtgccgtcgagaatgcctgtggagtggtgttcccgctgcagtccaagtcaaggcttagctccagttatcttttaattttccgctgcatttatgtaagacttttataatatttgtaagacgtggatctatatgttaactttgtcgtttgtgtaccccggccggtaatggacggggattttaatgcacattctacttagaattctattcgggaatttctgggcgtgatagttcggggtctatttatacccgaaaattacaaactatgtccatatcggacacgactcttatctctaacaaactctaagataccataagtctttgcggcagactttttccctaaacatatctctaaggaaattacataaaatgtcctaattaatagatacaattgccttctcaagactctatccatgtgcggcaaccatcttgaagcatcttaattcaacctgatatcgtataccaagtcgtattatcagaatcggctatatcaacttactcagtccgactcggatccagccgatcctaatcgtagccgatctggactccagccgattcttgctctattctcgaatcgatctccgccttcgactccacttcgatctaatcctcttttccgatgctgatattaccaaatttggtcgttaacaaggggaagcgttgggtcggcgatgaggagggccctcgcgccaccgtcgccactccctccctctgctccgagcccggcagccaccggcgccgccgctccctctgtccgcttcaagcacggcagctgccgccgacaccgctccttcctcctgcgcgccgatgccaccgcttcctccgtcggccgcagcactcgccatcgccggcgactaaaaactgaagatgtggggattgggaatttgggatggagaggtggggatagggttaattagtaatatgggggtatttttgtcactttggggtagtatgttttttttttcttttttctaaatgttgttccaacggtgaagtctaaacagagtcaaacggaaacttcaatttcaaaaaagagggtcaaataagcaaacctgaaaaagtaaggtcaaattggtagttgggctttaaaatagggtcaaataagcaattgtcccaaaaactaatcaagaatctattagaaatgaacaaatatcaatcgtgttgggataatttgaggactgcacgacttttcttctcgtcggagaagacgaaagaaaggttacagattaatttttatttgtaaatatgccgtttcttattcacttaataagccaaatgatgggggcctcgacctttattagaactcaagtgtacagcacctccactcttcatcatgctatagtttataagagctcatatgttggtgaaatatgaagagtggcagtactggagacgatcataatgttttccagacccccagttctctaagctagctagcatgtatttatatttttcaggtagtgcgatatcttttgtaccaactagcaaccaaaatattgatgaaagaattagcaacagcaagtgtgatagccaccagcagcctcaggttttcttgcatcaacgaacatctcctcacagcagacagcactgttgttcgttcattagccacatctgcttgtcttccgtcttcagcttcagcttgccatgaatcaaattcccagccggtttgtccccagcagccagcccgccatccatggttggagctagacatcatttgcttcctgctttaacgggtggataccgatgcttctcttctctatgcctctcattccttagtcatgcccagatgcaggccaagctaacgagattgtctaacaaagagcatcaatgtcctttgggatgtttctgcgcagttcttatgtacagtagaaaagatgaatatgaataggatgattggttgaagcaatttaatggtactactgcgtgatcacggggatttactggacaatgactgccactgcaacccttatactacatctatcttccccgcacaatgactgcaactgtaggggtgaacgatgaatgcaatatgaaagtttattaatgtaattttagtgctacaattgtactcgctccatttcatattataaatcgtttgaattttttcttagtcaaacttatttaaattcgatcaaatttgtagaaaaacatattaatattttcaataccaaacaaatatattatcaaaatatattcaatattaaatttaatgaagctaatttgatgttatagatgctactaaattttccaataaacttagtcaaacctaaagaaatttgtctaatgaaaaagtcaaacggattataatatgaaacggagggagtacaaaactgtagggatactcggtttgagtacggtatcttgaaatcacccatgatcgtccaggattttgatcgtgtacagattgataaacaaaatatctttcggtacatatatttgagattttacataaaaacattacatatgagtatattagagtaggttttaggggccgatagaccaaacttacaacgacacactccctacaaatagaaaaaccatacacaacataagataaaataacaaaacaacacaggtgttgcctgagagcggatcgacctagaacgtgaactcgtcagcaccgaagaaatcttccccttcccgcgcctcctctaggaagagccgatcatttgaaatatgtagttttgtcatatttcaccttaaatgtatatgttttttttataaatttgatgttaaatttatagttttgtgatgcatcatcttaaatctagttatatgataatgtggtcaatatatatgtcttacttaaaaaaaaaaccttggtatctgcttggaaggcgtcttggacctaaattcaacgtacatgacagccccagttgggctaaagaacgttttttagatggtaatttctataattacaaccccagttgatcctagcctacctaaaaagtaaatatctcctaatgccacaaagaaaagacaggagttgtcaagggcaaatccaccctgtgtcgtgaaccataagcttcatggaggccatcacaatcctttcgtaggatccatcagtccatggcaaggttctgaattgctgatgccactcattccaaagccggggctgtttgtgttgtcctattgggatgttcataacactgaaattacaaaaagtcatctctcaagacttttgtgtgcttaaccctaaagtctcttttgcagccgagggcatgttgtaaccaaattgaagggaactgaaaaatgattgggaggggttcatatatataactaagatagtgagaccagatgcgatgaacattacagggacgagagagtaatgacccaccctgtaccattgcacgatcgatgaagtgatgaatggtttcatgggagtagctacttgttaaataactagtggcctattcgctgattcagagtagtagacgacgtctcatgcacacaatcatatagtagatgaacacggatatagggaggggcaccacagctttattgctttaaccatatgcggatacatcaaccaaccactcaagccctctctctcagtatatatacccatattaggaagagtcctattaggatacgtttccatatatttggtatgagcccatatttatctctggcaggagataatagtttcataacactccttgggcgaataccgcgctatacacatgtctcattaaaaactccgtccaaaaacccagtgggagaaaaagataggagaaaagagtacatcgtacacgctagttatattgcacttgttgcctcgttaaaaaccttgcgtgagaaatattctagtaaaaactcactaagggaaaaagagtacaacacacgatcttcttgatcgcataatctttaatatcgactattcttcataaatagctaatgatctatatgatttattatattaatcaacttggattaacacaacaatatagtggtagtaaccttcaaggtaaattatcaaaataatgattaatttgattaattctttgtaaatcaaatataggacttccaagtcttaagtatgataatcaatgtttagcatatatgctccccctcaataagacatccgttgaaacttccatgttccaatgtcataaccatatttttattaatgtgtaaaacaatgataataaaattaccacaatgtttaatctttcgtttacttatttcataagttctactatgaacataagaaataaatcaacgtataggagcaatatgtataatcacttattcaaatgtgcaatacaaacaaagtttaatccttatggaggattatgggaaaataagatgcaacgatacacatatgcggtatgtataaaataattagctcaatacaagaggttaaatattatgcaactttctcttggtggatttatcagtcatcattaccaatttgattgtttcactaatcttcaacaattagcttaaaccacttagagtgacataaaacggtctatattttggtattaggggaattaataagaatgccaaataccatcaataagtatatcttcatgatatataaattcttacacctttatagtatgtagaaaactaccaatccacttgcaagctagtggatgtgattttcctattcattcgtttgaacgggtctgtccacttcatgggagtacgagttatcggtgttatatggagattaaccggtaattcatacattaccataatcctacggggatcaacttattcttccggaagtcattttctctactatgagaaatattctcgcttctaggagaaaaactcttcgtgagtcatcgtaaactcttctacgagtcttgcaattctcttcatgaaaatatagtgtgcttcatgatactaattagtatgagatttacatatatgttgcggaattgttttctttctagtgaaaacttcatatggattttcataacccataaactgcatatcatttattcattcatgacttttgccagcgatatatatagtggaatttaatacattcatagtaggagaatatcggtcttttccatgaccaaatgagccgtcgcttttcaccacttcatttcctattaagtctgaacttccatgttcacatagacttatttagcgactatggttcaacctcattgctttcttcaatagacctgatatgagtgctactatgcaactctgccatggactttggttccggatccggattctcattagagaaatattagtaatcatagaggcgatgttgtcgacaactattattttctccacatactcattccgtgaagttaattcattataaacaatatcttagtcatttccaaacataagatgtatggttgttccgcaccccagaattagatagatgtgcgttctgggttttcatcttcatgatgaacctcttcatgaggcaattcaccttcatggtgattactctacaagagttgtaaggagttattaatgggtacattgaaaatagtcattagatcttagaatccgcacgtgttcccgtagattttagaacattgactaacatgtcactctgcatttgtggatatactattcaaaacccggggtataccactgttagcagaaagtttactacaagtaaacataacttctgattactcctttaattcataattatctagcaagcttccgcttctggcttacacgagaataaactaaaccttctagtttagtttggcttgtacgttattcttacttataaagatctttttcttcttgaaaatataaggcatctttaacacatgggcttttctccccctgatgctgatattcgatctttatctaatagcatatcacaaaaatcccctatcataggcactggattaatggaattcggtccatttgtatccccaacttcatgtggaggcccatatatgtatgctatggtggtgatatatgagggaaatgttcattcattgaacatgcacttatacaaaataaagggggtaaagatattatatgcagtgagctaacataaaaattaatgcaatggcatgaaaaattgcacatccctaatattgtaggttatcccaagtcatagagggttattattctgcgacaatgaagcccaaacaaatatccactagtcgacaaaattcctctattttctagcttttttcttatttgcccaagacttgatccaattactcatactatattcaattctctaattaagttggatcaatacacttcatgtttatattcatgcaacatagatatgatcataagatggatgtgttagtattatataacttcatgatgtcttcaagaacataactataacactaaaacattaatctatgaacatagtttaaccatcatggaacttttcaaatcacccaaacattattctacgagaatatttattcttcttgaatatgccaataaattaattgggtgacatgtctaacttttattcattacgccaaagtaaatgtggtgtcatttgatcattcagaatcattcgaatccaaagggtcattaattatttaggatattgtttactacaagtaaaccaatagctttcaaatagctatatgcaatttcatacttcctcgatgaatatgcaattttcaatggccaataaataacacacttcgttgtgtgacaataattcataattatcccaaataagattcgctaatagtttgtgctatttttgcttctagcatttgacctataacacaccaatttgcctgccacatatctacaatttcttctgcttctttattgcaaatattctgaaattaatttgcaaaatacacatattcctcccccttttcacgccaatcataagaanacttataaaatagttgttgtgaaacccacatatttgttgtaacttcaagttataacttttctaaaagaaataatgtggttgtaggtagatatatttaagcttcaatgcataaatattctaattgttcatgtgcataagtaaacaactttgcatgtatgccaatatggcgtcaatgcacttagaactatcaacctacaataagtaaacaactttgattaaggcttagtggataataagaatatgtcaacatgcttttcactgaaaaataattatgggtcttgatcctatatatagctaggtagtcattaacatgttgtttgctttgggtcatataatgttgtaatcagattgcacgaaaatgtgtaacttttagcaactactaccactgtattttaatatattacgttattgacttttttttttgacaaatgtttgatcattcatcttattcaaaatttttgagtgaatataaaaaaaattaagtcaggcttaaagaacatttgacaataaattaagtcacaataaaataaataataattatattatttttttaataagatgaatggtcaaacgtatcttaaaatgttaacggcgtcatatattgaaaaatggagagagtactactttgctagatcgttatgtcgagttgggaactcatttctccgcacggaaaatggagtaacgcattttcttatgattaattaagtatttactattttttaaaaatggattaatatgattttttaaagcatctttcctatagaaactttttgcaaaaaaatataccatgtagcagtttgaaaagaatgcgcacggaaaatgatggaggtgagttaggaaagttgggcaaagaactgaccaccttttgtcattaggggtgacaatgccgaatttggccacaatcgcataatattgtagatttattgtggcgattgtagatgcatccctaccttagtttccctgttttctggagtaattgcaattagtggacgttacgatcctgaacctggaacttcatagcaacaaatcttggagttcatcagtcccattctctggcttttccttacctgatttcaatttgtagatattttgcttccttgattccttttattttaatttctctgaacatattgtatttttctaaccaaaatatgaaaagaaccattagtttgtttcatattgtaatggaaaattttaaattatatctaacaaagataatatcaagcactgccagaacaaaaaaacggagagaaattttgaacatatatactgccagttgaagtgaattgatttaaattgaactttgccttggatgaagctcaccatgtttcactttgtatcaagtttagcatatagaaatttctcataaaatctgaatgaaatttcatgaaacaagtcgaaggtcagaaagttccaggagattcaatcttgatttctaaaatttcccttcaattatatggtgaacctctttacagagtgataattatttcaagatacccaaatgtagagtgaaagtatatcctgatccggtgcaaagtaaaccaggatactctaccttgtgcaaagcacaatttactcaaaatattttgatctgcagtttaatgaatgaagagatatcccaatccaatttatgcttgaatatcacattgatgggtcattatcatgtcccatgccaatagtgaaggtgaagacgacatgttttaattttgcatgaaatattgattgtcttgctacctaagaagtatgagggacgagggcgtggcattggaggagagtgatgcgccagtcgtagtcgcccccttcgaggggagggggggtccgctgctacggcagccggtgtgcagaagtagacaacaacagagatcttctgcttttataggaggataacccttgaaactagtagtactactatacattgctactcttctattgttcagctggcatgttctgcagctgcacaacacaagcactgccgcaggaatagctactgaacgctgatgtgactttgctgctactactgcaaagtcacatcatgaatgtctatacttatctagaaattgcaaggatgaggaccctgccatgtgctggtatattcaaacggccggcatgatggcatgacaataaggttcaggatagcttgacaataaggttctagagcctagctacataatcgagaagcaagaataacgcaggtagacgccggtggaggagcacagacgaagacggaaatccgtaaaaggtcaggtgtagaggcgcgatcgaaagatgaatgaatggagacgcgggattgcgtgtgagatggaagaacgaaatcataggcaggtcacaggcacctacgatgtttccagagcacagtgagcgatgtctagccagaccaaccgtacatcaaacaggacgctcattggcacatggatatgggcaggcacaaattatcacaaatctagcggtttagagaacggtaagtcgattctgaaaatcagcaataataaaagtggtaacgcacgagacttaaaattaaatggataaaaaaaataaggatttagataggttcaaaccgtcttgattaatggcaataccctactcctgtttggctattgtatccaccggatgtatattaatctgatgacctaattatgttatgtccttggagggcttcgtgctctccttatataggttgggggcaaagttacaaagggaaacccaatcggacataacatggatttccttatatagttacatacactactacacaaatgattttcctataagagcaccctaatatattgtaaacgggtcataagtgtccacgtctggaaaaatcgacctttatttttatttttacacacaactcgttaagtggcctacatggaaaagactattttcacatacaaacatcttaaggagccgtatgcaaaaatggggatattttttagacgggcctatcaaagaaccacatgtgaaaatcattttcgcatgcgggcaactcggagataagtgggccacacgtgtccccgcatccctttttctcctcctcgtctctaccacacatttcactcctttttattttctctcttcccgttcaactctcactccacatctcctctcacccttcctttcccactccacctcatatcttttcctttcctctcctcgttctcttctccaccaccggtggctaaggcggagatgacggcctcgcaggcgggctctggcggcatgcagagacgaaggtctctttggcaggcggcggaggcagcctcaggggcgggtggtgacagcacgcggattcggccggtcccatccacgagagcgacaacggtgcgcggatctgtcgacagcgattgtgggacgggtggctccgtcgccggcaaccgcagggagggccgatctgtcgccggagaccgcaggacagacggattcatcgtcggcgaccgcggggagggcggatcagccgctgacaaaatcggggaaccccctccccctcccgcacatggatccgccgacgacgggaggggtgatgacggcagtagtggcggtgggaggggcgacgacatggtggttgtggcgacggtttctaggttactgttctgtggctagggttttgatttctggaattttttttttgcgattttctattagcacgtgcagacggcttaagcgctcgcagtcgaataagccgtctgtgtggatatatgaaacccgtaatctccacatgtagtttctacaatgcgaacgtagcaatgtctggactgggcgatctccgtgggagatcatccggactggtataccaaaacctttaagtttaatggatcaatgaattaatggagatgagggattgcttgtgagacggaaaggctgaacgaaatgacaggcagctcacatggcagaccatctgggctggtaaaccaaaaccttaggtttaattgataggatagggtcaattaaaccctagattgttcagtcccgcacattgtacttccatgcagatacctgcaatgttggttaatctagcagttatttctatcctgaagtacttactacagaatttaacaaatatagtaactaatatcttggaaacaaaacaaccctcaggaccttcttggaacacaagttttggaacgaaaatcagtgtaaattacagggctgaaaagttataagttgggctgaaaaactttgttgttcaggtggggttgcttgtcgcattataatctccgattgagcccaatccacccataaaagaaatatctcctcctggtaattaacacaaagaaagaacggggtaggagtactaatctgatctggttgcaggcgagcctgcggcctcatggtgaaccagcagctgcatcagcaagaaacggagtgtacacgacgtcactcgagaggacatggcggaccatcgcctatggcgacacgggctccttgttgtcgccatgtgtattccagaggacactcaacgtggcaggttacttgaagctccctcttgcaggattcaccaggcaatggcaagattctgaattcctgatgccacccattccaaagcaggaatagtttatgctgtcctatggggatgatcagcaaaagattgcgattaaaaaaaatagcgtctcaagacttttgtgttctccaacccctgtgtctttttttttgtgccaatttaagggaagtgaataatgatcgggaggggttcatatatatagctgagacagtgagacaagagataattgatcagcatgacagggatgagagagtaatgacccacctacaacattgcaggatcgatgaagtggatgaattttttagataatggaaatggattatatctccggcttctgtcataagacacacagccataagtttaatagtaataaaaaggtaagataaaagtaaatcaaaatgagaaataaggtgatgggacaaatccccaactcccctttattattgactagcgttcaaccatataaaatattttagctagcaattcttatggaacaacgccacccatagtggaataagagacccttggctaccgattccaagagtgtagcaccattgcgcatagtatcctgctcctcctgtggtagcattgtagaccaaaagtggagccagtaggaagacatgaagataacctacatagggttagataattgtttaccattaaaaactttatcattgtgacaacgccaaattgaccaacatacagcactagctctaattagaatcatcttcttaatggacctagatacccctctaagctaattaccgaaaatgtttttggacctacatacagcactagctccgattagaatcaacttcttaatggacttagatacccctctaagctaattaccgaaaatgtttttggcgttacggggtgcggggatattaaaagcaaaaaacacgcatctctaaacaaactaagcaacacgata

SEQ ID NO: 62956 - DNA, 7579 bp, Oryza sativa
tttatataaaaattgtagccctcgacgcgacctataactttgtagttgaaaagtttttgaactaaaattgtttaaggtcccaaaatattgttgcatgtttatagattttgaaattttaattttaaaattacattttgggacaaaaaatgacttaaaataaaaaaaaattcaactaaaaagttgtagatcgcgtcgaggactacaagtttgatataaagtttgtctttattagagttcacatgaaaaagttatgaactatttttaaatataaagtctttagaccgtcctatttaacccagatgatattcaaatccaagtttagggaccggggtgacacaactgaacaggttggaggacctaaacgagtgatctaaaagtttaaggatcgggatgacacagttgaacaagtttgaggacctgaacagtcgatttgcgagtttcgggaccgggatgacacagcggtacaagtttagggaccggtgatggactttactcttattattttgtgatgaacaattatcatttgagattattgttttgatatttttagattattggtgaagtggttttggagaaggttgattttcagatgataaatagggactgctgtcagtttggaccagttagagcgaactgtggttgccgatcagaccggcgtgtgttgcgcggtcagaccggtcagcccgcggtctgatcggccgaatatgtgtcgatttcggtttcaggttgttttctgtagatatttgtggataaatcatgtttatgatttctagatgaatactaagcgttgttgacagaaaacacgaggcctgggagatctggttaactccagtgcaggtccaaaactcgccttcagatgtatgagcgtgccagttgatttgatcctgcaatcaacaagaaacaaagacaaagaaaccgtggttaaatccataaatgatagccgatcggctaagtgccgatgacatatcatttacctttgggccgatgtcatatatacatcgatcgacaaccataaatgaataaaaaggaactaaatctactcgatcggctgtagatattaataatatataatccttatgtcgatatatacttaaatcaagtgattgggatagatcggtcgccatgccgagacagtataaatcacttagatcgaaatatatattaacaacaagattatatatgttcatagcatagccgatcagatagatctagcatgtatcggctaatactccgataccactctgtattaagatattaaagcaaataggatataccaaacagaagcctaatatacttaaatgcagcaagatcttaatataaagggcagattcaacatatcaatcaagcatataagataaggtagttaaatcaggtaaggtcgactgaaactccgatactaccctaatcggcaaccagaaggcaggctagagattgaaattctaagcacgacttaatagatcaaactcaactgatgcagcattgagtatgaaaagaagaacaatatctagacaatcaagccactggatgtttcataaagtgatagatatcttatataatctaagccaacgtcgctatttaatctaatcggccgccttgtgttaacagatgttagccgattgtaggttagatgacgatattatcaaagattatataagatatatgataactcgacgaattacataaacaagattagagtatcataaaaccgccataacaagtcttacctgttgttgaagatcgaaaccgatgcagctcaacccgaaagcaagaactcgtcgaaacaaaacaaaagtaaaagggtggcgatgcgccgagattgtattgaacgtgtgtgttaataattacatagggctcggggtctatttatacccaagaattacaagatatgtccatatcggacacgactattatctctaacaaactctaagataccataagtctttgcggcagacttttgcccacatttatctctaaagaatttacataaaatatcctaattaatagatacaattgccttcttaggactctatccatgcgcggcaatcatcttgaagcttatcaactcaaacccgatgtcgtacacaagtcgtattgtcggaatcggctgtatcacttaacccagtcagactcggacttagccgatcccagtcgtagccgatccggactccagccgattcttactctgtttccgcgacaatccttatcttcggttccgcttcgatttaatcttcatatccgatattgatattaccaaatttggtcgttaacacatgccccccaagtccgggatatttggtaatgtttcggatttgccgcgtatcgacttcgagtaagtttggcactctgccattttctgacggttatcctcagtgctttaaatactaaccgccgccctggaaaatctttaccccattacttccgttttcaccaccgaagccaattttgttctcttcctctccggcgatttctctgacgcacaaagcgatccccaggcggcttcatctccggctagatctacgcctgcggcgatgtcgtcctccgccagcccgtctgccacgccgtcggcgagtacactgaggtaagtcccggtcggctagatcccctttcttagcatcagatcgattttctctcgccttatattgctttccctttctcgattactttggatttgtagcatctctccaacctagttgcaattcccagcctatcgcatgaaaactactactttctcggcccagtcggcaaccctgatcccacagagttctttattggtgaaaccaataggattccttttagattggccaacccagatctaggtcactggaaaaacaccttcaaatcctggccatccctcgagaaaactcgacccgagaaaagttggatcacatggttcaagagcatgtcggctagcaaaagagttcattgggacgagattggaatcggccaagcactcgatctcaccatagccaactcagctaaggatgagcccctaatggcaactgcctcttatttctggtccaacaccatcaacgccttcttgttcaaccaagggccgatgaccccaactctcatagatatcatcatgatcacgggtctggatgtcaccttatcggctaactctatgagcttgaacacgaagaaccaatacgacttcaagaccaagagcataggcggctggtcaggctatgtagcagcatacatgggccagggttccgtcacccctcgagaacatgtggctttcttgctaatgtggctagagaaattcctcttttgtggatcaagctgtggccctacaaccaattggcagtttgtagccgaagccttagaagcaaagaaacaatttcctttaagaaaaatacttctcggctacttgtaccaaatgctaaacaatgcatcggctaagttagctgtcggctcagtagtcggagcaggtggaccatgatggctattgcagtcctggctgaatttggtagtcatgaagtttgtcaattggccatctgtaacagaagctgaatttccaagactggagccgattgtagacaatgatggagaagaacgtactcatcggagatgcacatcttacggagaatatgcctccataccaaccgatgcagaagcaaagctatcggccgagctgcttaaagactggttctgcaatttttatgagggtttccaaaaacatactcaagtttggttcctctatgaagattcaacacttctagaaaatccattggacttcatattcgaagacatcaacaatgaaagatatcagaaacccagagaaatttcttcagctgcaatcagtccatgtatccttcctgtcggcattcatcaaggaagaaacatctaagtctcctatgaattttatcatccaataagttctgccaggcagtttggaatgggccaactcccaatcggcttattctttgaagataagatccagtgctgaggggaaatttcgtcaaccttaatgatggatcggctgcttaacctccaaggaccccctctaggcagcattgataatatagagctggtaaccttcaggagcagagcattcgacagatggtggagtgaatggaaactgcatctattccatcaatcggcctctatgtatatgacagatctctttccagatgttgtccctcaggtatgtcttaatttactcaatttcatttgaatagttgcttagccgactaaccttgactaactttcctttcgacctgcagacaacagagttctctcctcctcgccaaagtaacagtggcaggaacattgaatatgcctcgggattaattccaaatggaggtggaccatctcctcctgtcatcggctatgatgcccccaagacttcagctcttcttcaagggctcatcagagaaccagccgatgccggcaagaaaagaaaaaccagatcatcggctgtagatacttcagccccagctccaaagaagaaaaccaagacaaagataactaagccatctgatgatctgcctgccctagatccatccattgaacaagctctggatgaagaggaaattgaagaagacgttgaccaagccgcagccaaagtaagcgacacagaaagaacaccatcggcttcacccaagcagacccctccaactccttctgctccagctcacttttcaagagtaagcagctctctttgatcctttttgcaatcattttactttatggccgattactcacagattttgtagttgtagaaaaagaagactgctgtgaagaagaaatcggctataatgacatcttaattctttcattagttgatctcagccgattttgtctaacacttgtctcttttacagtctcctcctccttctcctgtacaacagtcatcaagtgaccagactccatcagctgtagggattcaccatgttgaagaagaagtccaaccgactgctcctgctatcctggtaagcttttctttgacacaaaatacccagatcggctatgtctatttgacctctaacttctctttaaatcattattgcatgtcttagccgatcttttctcttttgacattagagactatcttgatgaaggagaagaggataccacaagcaaagctttagcccccttatccgatgatgtgaagaaaattcttgaagatatctctcatcggctagaggcatcatcgttagacagcttagtggttgattgtggctcaattaggactcggctacatgagattcaagctctgatcccagatgagctagccgatgtcctaactccagctgtctatctcgagcagcatcaattcaagctggagaaggccaagctgagactagtcgagcgtcgggagcgcaaagacatcgaggccacaatttaggccaatcggcagcttgttcatgaagagaaggccaagcttgatcagttatctgaaggtccgatcaagtctaatattgatcggcttgaagctcgaaagattgagctcctggcacaacttcaagaatgcagtgccaatctggacatggaacataaaaagctagccgatctcccaaaatctgttgaaaagcagaaagcaagactaaaatcggctataaaaaatgttgctgatctaaccaagtctttaaaagtcatccctggaaccgatgctcaagatgcccaagccatcgaagaagtagaacaaattaggcaaagagctatatcggctatccagcgctatttgtctcggtaactttctgtgtaatagaccttagaaatttttgtaatcggctaagatactactgatgtttatcttgataatcctttgtgccgattaatataacttccaaatttgctcaaaaattgtcaaaatttgtaactggtgtatatatgtgcccccctaattttacaatgtcaaaagcattgatttaattatagtttaaaacttagggcgatatagcaatatccgccattgtatatcggcaaaccacaaccgattacaacataaaaacaactaaggacgatataacaatatcggccattgtaaatcggcaaacctcaaccgattacaacataaaaacaactaagggcccgattataacataaaaacaactaagggcgatataacaatatcggccattgtaaatcggcaaacctcaaccgattacaacataaaaacaactaagggcccgattataacataaaaacaactaagggcgatataacaatatcggccattgtaaatcggcaaacctcaactgattacaacataaaaacaactaagggcgatataacaatatcgcccatcccaaggcgatgcaaacccatcggctatcatgtatcggcaacactaaccgatcatgcattaacccaaacacttgggtaatatttctgcaagtacttaccattgagcgctcgtccatagacttcgccatgaagcccttgcaacatatatgcccccttagacacaaccttatagatttggaacggtcgttcccaattcggtgaccatttgccgaatttgttatcccgagttccaatcggcaaaatcaacttccatacaagttcaccttccgaaaaagtcttgggtaccacttgcttgttatagtgtcgagcaactcgttccttatctttggtaacttttgcaagggctcgcaaacgcgactgaactaagtcctccctctcatcggccataaggttataatactcatcggctgtcaaaccatcttgcaattctattcttctcgaaccgattttaacttcccatggtaatacagccgcatgcccataaacaagcttataaggaggaacttgaatcgatccatgacaagccatccgataagaccacaatgcttcggctaaacgagtatgccaatgccgaggataatcagaaattttcctcttaatcaacttgatcatgcttttgctagatgcctcggcctgcccattagcttgtgtataatatggtgaagaattcaacaatttgatacccatgctatcggcaaactgaacaaactcatcggacacgaagattgaaccttgatcggttgtaatggtttgaggaataccaaatcgatagattatatgttcttgaacaaattgtatagcatccccagaatcaaccttcttcaaaggaatcgcctctatccacttggtaaaataatcggtcgccaccaatataaacttatgccctttacttgacggtggattaatcatgccgatcatatcaattccccaacctcgaaatggccatggtttaataataggattcatagccgacgccggtgctctctagatcgccccaaatttctgacaatcttgacatcccttgtaatatctgaaacaatcctccagcatcgtcggccaaaaatatccagcacgtcgaagcaaccacttcattttatgagccgattgatgagtggcacatatcccttcatgaacttcaccgattgcaagtttagcctgatcggcactaaaacatttgagcaacaccccatcaatcgtccgataataaagctcattatctaacaaagtatacttcaacgctttatatcttaacttccaagaagccgattgagacagattctgtaaatactgatggacatcatatctccaatcatcggcggggtgcagg

SEQ ID NO: 62957 - DNA, 2689 bp, Oryza sativa
atcatcggctgttatggcagcaacttcaatcttaacatctttgatcatcggcttatatcccgatgccccttgggctaaatcattagatattccttaatattatctaaagctttctgctgctctgtcccccaagtaaactgttgatcggccttcaatctcaacaacggtgtaaaaggctctaaccttccggacaaattagaaataaaccttctaacaaaattaatcttgccgatcatctcctgcaattttgtcttgttctctgtaggcttaatcttcttgatcgcattgacacttctttgagttatttcaattcccctctcatgaacaagaaatcccaagaactggccagccgatacgccaagagcacactttatcggattcatcttcaagccatatttttcctagttctctcaaaaacttttctcaaattggctatgtggttcgctatttccttagacttaataaccacatcatcaatatagacttcgaccaaccagccgatcagatcatgataaatatagttcatggccctttgatatgtggctccagcactttttaatccaaaagtcattactacccattcaaataagccgattgcaccaggacatctaaaagccgtcttataaatatcttccttagccataaagatctgattatatcccacatttccatccataaaactcaatatcttatgtcctgaagcagcatcaaccaactgatcggctactggcattggatactcgtcctttggggtagctttattcaaatctctaaaatcaatgcacaccctcacattgccgttcttcttgataacatgaactatgctagaaacccactcagcatatcggcaaggacgaataaaaccagcatcatataaacgcttaatctccgccttcacaggttcgagcatatcggctttgcatcttctcggaggctgctggtgcggtctaacccctagtttgataggtagtcgatgttcgacaatcgatcggctaagtcctggcatctcataatactcccaagcgaagcaatctctaaattctttctagagctctatcagcttggttctaaactctggagataaattcttactaataaatgtcggccttggccgatcgcttggacctatatctatttcttcgaaatcatcggccgacattaaaccttgaccttgtttgtcatcgagatcatctactgtatccttggtgtagacgtttgaaccctccacaacgccttcaaaataatagcctgggttctccatcttcaattgggttctccatcttcaattggctgtatatcagaatcggactattttagaaaatctccatcccaaacttttccagataagcaatcaagaccatccatctcccaaagagctaaattggcactggcaacattgactgacctgtcggttggcacgatctaaatcttgttgccttaccattgaatcaagcattgatgcatggttgaaggagtacaacaattggcatgaatccaatccctaccaagcaacaagttgtaagaacccttccgatcgatgacaaaaaaggtagtagggatggttgtgctgccgactgtcagctcaacatttagaacacccttggtttccgatggattgccaccaaagtctttgagcaccatgtttgtcttgatgagatcttcagcgtttctgcccaacttctagaacgtagcttaaggcatcaaatttactgcagccccaccatcgatcatcatcttagacatcggcttcccattgacatagccatttatatacaatggtttagcatgccgattttctgtcccctcaggcttctcaaagattgcttgttctggtgatagaaccaacttagccgattcttcttctactttgtcaacatcggtttgtttgatctcgaattcagctggcaaggtaaaaaccatgttaactgatgccgttacaacactattcccttttgccaacttcttcgcctcgtcggctgtggcgtcatcggcttcaggagcttgattcttaacgcgccactcctgcctcggctttgtcttcagccgatgactgatttcctgctcaacctcctaaaagcattctctattcctcaacctttgaacccttctcttttgattttttgtaaaaataccagaaggacaccactgaatcttcctgtctccatcatccttttggctatagtcttggttcaccgggcccaacctttgatgaataggaactcttgtttgcttcagccgattgcctccatcatacgatcggcttgatctccctgcaacattactgcacccaggacaatcctcgatagatggcagcctcataccctcattatagcagaacctaaataactcacaaccccaatgaggatcaaaaccaccattatcttcttcataacgcctctcctgttgcttgtcgtacttcctttgatacttgtttataatcttagccgaattcacctgaaaacctcttgtacgtcctccattagctgttcggccagctgtgtgcaccatgtttacaggaaaaggattaccatcaaccttcatcggcctcttggaatcatcaaatttgatcttgcctccttcaatggctactagaatttgttgcctgaagacttgtaatcattagtagaatgagacccagagttatgccacttgcaataccttcttttgcctaattcctcggccgatggaa

SEQ ID NO: 62958 - DNA, 4872 bp, Oryza sativa
cgcaccgagtgttcacgaacaatctgatgtaccaccgtctggttctgctgcacatgatgaactaaatgctctgggacaacctgatttagagcatgttgtcctagctgattgttaggtgttgcaaacccagccgatgcattcattaacccttgctgatgaatcggttgaataacctgttgcgttaatggcatttgctgaatcgactgcaaaacctgccgtcttggtggcgtctgttgaattggttgcacaacctgttggattgggggtgtttgctaagctggttgcacaaactgctgccttggcggtgtttgctgaatcggctgctgctggactagaacaacaataggttgaggtggtaagaacatggccgcaacctgatcttgcgtagccgattcacatcctgccccctatgctgtggttgttctctcatcaacaaccgaggactaactagttggcctggtgccgacgtagacgcagcaagtgcgggagccgataccggtgccgtcggctgagctgatggcgcattgggaggaactgtttgaacagatggctgagtattggtgatcagaggccgataatctggaaagacacctccttgcaaataaactgggcctgtagcctgatattcagccattgaaccatcaaccattgatttcatcatgtttgacaaggtattgactaacaccccagactgattgatcaaagcattgtgcacggcatagtcaacccgatcttggaagttattgaaaagctcatgtgctgcattgccattctgactaagatttccaccttgtaatccttgggaattatcaccttgagaaccaagaccttgaacttcttgaaaaccatcgccttgatttccttgagaaccatttgcaacaccttgatcacctggctgagccataccatctggagcctgttttagttcaccatctttggaagaacctgtcccaggaacatccgcaaccaccattaatttatacttctgaaccaacgttcccttgcgggtctgtgtaaatgaactcaaaaattggttctttgcttgctgcatcattgcttcaagatccttatgctgttcaggtgtcaatttatccagagtgatgggcataatgttgctctcatcaacctcagacagacccaacttaaggatcttagctttgacagaatcaggttctctagccgaggacggtgacggtggcggtttctcggccatgaggaaaactgctgttgtgactctgacttctaatcagtcctatcaggcatgccaaaagcgtattgacagaaaacacgaggcctgggagatctgcttaactccagtgcaggtccaaaactcgccttcggatgtatgagcatgccagttgatttgatcctacaatcaacaagaaataaagacaaagaaaccgtggttaaatccataaatgatagtcgatcggctaagtgccgatgacatatcatttacctttgggccgatgtcatatgtacatcgatcgatagccataaatgaataaaaaggaactaaatctactcaatcggctgtagatattaacaatatataatccttatgtcgatatatacttaaatcaagtgattgggatagatcggtcgccatgccgagacagtataaatcacttagatcgatataatctaagccaacgtcgctatttaacctaatcggccgccttgtgttaacagatgttagccgattgtaggttagatgacgatattatcaaagattatataagatatatgataactcgatgaattacataaacaagattagagtataataaagatgcaagcactaatcccgagaacgcaagccgccataacaagtcttacctcttgttgaagatcgaaaccgatgcagctcaacccaaaagcaagaactcatcgaaacaaaacaaaagtaaaagggtggcgatgcgccgagattgtattgatagtgtgtgttaataattacatagggctcggggtctatttatacccaagaattacaagatatgtccaaatcggacacgactattatctctaacaatctctaagataccataagtctttacgacagacttttacccacatttatctctaaagaatttacataaaatatcctaattaatagatacaattgccttctcagaactctatccatgcgcggcaatcatattgaagcttatcaactcaaacccgatgtcgtacacaagtcgtattgtcagaatcggctgtatcacttaacccagtctgactcggacttagccgatcctagttgtagccgatccggactccagccgattcttactctgtttccgcgacaatccttatattcgattccgcttcgatctaatcttcatctccgatgctaatattaccaaatttggtcgttaacaagcgtatgtaatattgttgtgctaatgttgagtctagttgaagagattttatgctccaatatgcatggcttctttgtaggttcatgtgtaggtaagtcttgatgcctcgggagagcgttgtcagtgatggatcgggagtcaacctgggagaagatgatgtccggataattaggatatcatgtgggatgtttaagctaaacatcaatgcacgtggttggtatagattccatatgacatacgacggagatatggtgtgcgtatgggatgtggagttgaatttggaaggagtccaaatttggtacaatcactactaaaaaaggcacatacaagtcggcactataggggctagaatagctaaaaccagcacatatagtgtttttcccacctccactgactaaaaatagaaaaaacctatacttatactataagtgcctttgttttataacaaaccgagccaagccagcgagcccagccctcggcattatctctttctctccaatccccttgatcttatctatctcacgcgtctctctctctctctctctctcttctctctctcatctctcgcggcggccggagtggcccggcggaggcggtagcggtagcggtcacaccccgccgccccttcgctagatctagtgggaggagaggcgtcgactgcctccgacggcagaaggggcagcgcccttcccttcgccagatacggcgggaggagaggcatctgcattctctgatggatggaggagatgcggcaggggtggcaccctccccttcgccagatccggtgggaggggaaaaagcggccttccacgacggcaatggtagcacccacaccttcgccaaagcagaggcagcggcggctgtagtggaaggggagaaggaggctcgcccctccccctatcctcctttctatctggcgacggcggcaggggtagagtacttcttgatctgtgttcttgatgttgtttttttagaccgtgttcttgatgtattgatgaacttgtttattgtgatctatgaacttgttgattgtgtgatgtgtacttgttcctttttttagatttttaatttatgtttggtggctttcaagcatcggctcggctcctggttttttctttttgagtaaatttcactttgggcgtgatttattaaccaaagtttcaccatgaaaccaggcctaactcgaccttttcagttaacactaggtatgattaccttcttttgcagtttggaccgggttttaagactttgggccaccacgctggcttgatctgagcctagtgaactcagttcggggaagagaaattatcgaggaaaactagtgtatgggagagaaggaagatagtgtcgtggaggcggaggcggacatgctcaacgcctcggtctccaccctcgccaccggtggcttctacgcctgcggagcggcacgatgcggtggccgtgtgcacatctccggttctggcgaggcatggcgcagcggccgtgcatgctcttcttcggctccggcgcggcaggacggcggcatgctcttcttctgctcgaccgcggtgccggcaacggggtgcacgcactgctccttcagctcacggcagaatgggaggattccaaaagcctcaccaagttagagtaggaattattagctaattgtattgtaaataagtaccactaaagagaaggcactggaaagggaaattatcacaagtacctcatgatcaggtacatgtacatatggaacttggaacctctttccatgtttttagtggcaaaattgacagctctatcttacttgcatacacatttagaaacaacacagattcattccaccaacaccacaccgaagctgaagagcacgccgccatgccaattcggagccggagaaggtcacgccgccgccacgccgtgctgctccggagacttggccgggagccgccggtggcgagggtggagatcgaggcgttgagcaagtccacctccacccccacctccacgacactatcttcctcctttcccgtgcgctagtctcccttgataactctctgcgctgaactgagttcaccaggctcaagccaacatggtggcccaaaagtattgaaacccagtccaaactgcaaaagaaggtaatcatacctggtgttaactgaaaaggtagagttatacctggtatggtgaaactttggccaataaatcaggcccaaagtgaaatttactcttttctttacaaatcgtatacatcaaaggtgttggttcctaaaccggcatcttggagtcttctcatcagtgccgttttcgtggtgtcggttgggaaatccagcacctttgtgtagttcccaaccagtaccaatctacatttctgtagttgtgaattggagtttataaagtttgtttctcgtccagcatggtttcctagaggattaggacttcttgtatgagtttggttcatggttttaggcaacctacctcagctataaagagaaagggctgcaggaat

SEQ ID NO: 62959 - DNA, 7276 bp, Oryza sativa
tgtttgaggtagtaggagagagtgatagtgatgatagtgccagtgattctgattatgttgatagtgactatgatttgtctgattctgatgatgacttgtatgtggacaatattgatgtggaggtagaagacttaactggaaagaagaaaaggaatagtaagaaagctagaggcagtgaactgaagggcaaagaaatagtagtttgtacaaattcagagggagatgatgaggactatgacactgatgaaggcttggaggcagctgattctgatggggataaaagtggagttaagtttaagtttaggtcatttagtaaggaggatgtcaataatccagtgtttaaggtgggcatggttttttcttgtgtagagttgcttaggaaggcaatcactgaatacagtatgaagaatagagtttatataaagcttcctaggaatgatcagcaaagacttagggctcactgtgcagagggttgcccttggaatttatatgcttcaaaggacagcagagctaatgctttcatggtgaagacctacaatggagagcacaaatgctagaaggaatggatcttgaaaaggtgcactgccaaatggttggctggagagtacattgatgcatttagagcaaatgagaagatgacacttggtggttttgccaagacagtgcagctggaatggaatctgacaccatctaggagcaaacttcagagagctaggaggttggctttcaaggccatatatggtgatgagatcaagcagtacaaccagctttaggattatggtgttgagctaaggaggtctaatccaggcagttgtttattcctgaacattagtgatggtgctttagcacattgtatatgtcacttgacgcatgcaaaagagggttcttaaagtgctgcagacctcttatttgtttggatgggtgccacataaagacaaaatttggtggttagattttgacagctgttggaattgatccaaatgattgcgtatatcctataccattagctgttgttgagactgaatctctaagctcttggaggtggtttctacagaccctgaaggaagatctaggcattgataatacttatccttggacaataatgatagacaagcagaaggtagttctctaagctcttgatttatttcttctaaatgtcaccaaactgttttgtgttaattgttgttcttggtttgtgcttgattgcagggtttgattccagctgtgcagcaaatttttctagactcagaacacaggttttgtgttagacacctctactccaactttcaagttcacttcaaaggtgaaaatctgaaaaaccagctctgggcatgtgctaggtctagttcagttatagagtgggtggcaaatatggaggaaatggctactctcaatcaggatgcacatgattggttgaaaaaaatggaacctagtacatgggttagagcatattttagtgacttcccaaagtgtgatatactcttgaacaatagttgtgaggtttttaacaaatacatcttggaggctagggaattaccaatgttaagtatgttggaaaagattaagcaacagttaatgactaggcactttaacaagcagaaggaggctgcagaacagtggaaaggtcctatatgccctaagattaggaaaaaagtgctaaagaatacagacctagctaacacatgctatgctcttccagctggcaaaggaatctttgaggtccaggatagaaactttaagtacattgttgatatcaatgcaaaacattgtgattgtaggaggtgggatctcacagggataccttgcagccatgcaatttctagcctcaggtaccagagaatcaatgctgagtcagtattgccagtttgttatagtgtacaagcattttcaaatgcatatgagttcaatatttggccctgtcaagacacagctaaatgggaaaagacaaatgggccacatgtgaagcctgctgtctatgaaaagaaagttggcaagccaacaaagtccaggaggaaagcaccacatgaggtccagggaaggcatgggccaaaaattagcaagcatggtgtggagatgcattgcaagtactgcaatgaggcaggccacaaccaaaggggttgcaagttgaaaaaagctggactcaggcccaatcagcaaccaaagaagtctattcaaaaccctgaagtcatcacaacagaggtaatgccatcttttattcaatgatttccttctaaaatcaaaacttccatttaccatgacttctctgtaggtgcaatctcaatctcaggtgcaaactcagtctcatgttgaatctcagtcccagcagttgctgacacaggttaacaatgcaatggtatctcagatgtttgaggagtcctcccaagttactcaaatgaacttggcacctaggcctctgcctgacaaccaatttgtcatggcaaacaaaccaacagccaggccaatgcctctaaccacaacagcaaaggaaggaaagctgagagcaacaaaaagaaaggctgcaggtgatggtcctgaaaagagagctaccaagaagaagtagaattgctgatagaactgcataagagctaggctagagagctatcagtactttcttttgtaatgacaaatgatagtgtcaatctgattatggctaccatgtctccttttataattatcgaagaaatggctggcatcttttattttgtaatgccaaactgaatccaggcattaactacatcttcctgttctggctacatattctcagaatgcaattactgattatagcttcaatttctcattctgtttaaattttgcaatgctctactgtcattttgtctgaactttgaaaagttctactgtttgatgtgcacgtgtattattctgagccatgcatgtgtaactgaacagattcaacagagactgatggatatgcacattatttgttcattgcaaacataagaaagttaaaaacttcatccaaaattcagaattgaaatataacattgcttattcacagcacattgcacattgcacttcatttgaaacatcacattttttttctgcattgtttttcctgaatacaaattcacttcacatagcacattgcatatacatcacttaaaccacagaacgatgcaaatacacagtagcagaccaactaaacacacaccaccagctaggaacagcttcaacaacaccatcatcttggtcaaaatgaaaatcatatcttccagctccttgaaatgtccaacatcgggttccttcttgaattcctgagcactgctcttcttcagctcatctccatccttcattttggcctctttcagcaactctgcacaggcagcttcataaatgaagccactcctcttcaggaatttgatgtaggcttcctcccaataccagaaattacaaccacttccatccttctatacatttcacagattgcaacatgtaaatttcaagcaaaatgacaaaaatccacaaagggcactttatcagaggcaagagatttatcacgtggtctggacatgtgaagaaaatgcgacctcgattagcttccgtggtcgcggttagctccaagatctgcttcaccccgcatgaagggcacttaatcagcgggattgagggcctcctcctcttgcgactcgagtggcttgagctgcttgcagaagccatgccgacgacgatgaacacacctcggccgagtgccctccctcgccgttgactctcagccggaagccctccctcgccgtcgactctcagccgccctcccacgccctcactcaccgtcgactctcagccgccctcccactccctcactcgccgtccaggggaaaagagagcagaaaagagagggctagggtttggagaattcgagggaactgaggggcttagatgaaaaagtgcacggtgcgggacggtgcagtgtggcatcacacgtgtcgcgacacgttgctgtccacgtatgcacgaaacgagtcaaagcgttctctggaccggattgatacaataaaacaagattagtgaccttgaccctgtgtttgtatgttcatggacctggatgaaacctcctcacaagtttaaggaccgccagtgcaatttactcttcttttagccaggttatctttcgttagaattactttcttgtgaagaaaccacataaagaccattgaattactttttttcgttagaattactttctttagatgaagtggatgaatgaagctaatatgtcaacaaacgattcatgaaaacataattaagacttttggccccaatagctatacatagctaggtatgtacgtactccctccggttccactgcacccctgctcagcttcactgttttctcgtgtaatagaaatcaccggacgttatgaccctgaaggcctgaacctggcatttctgggaagatggcaatcagcttccctcttttcttgagtccatcctctgttttttttccccctgtggtttcaatctgtacactaattaagaacagaggaagtatgcaagtctgtaaaatgcaaatttggaatggtgcatattatgtactacttgacaattagattacttaaatatctgcttggatgttttcataataaatgcttatcataaacactaaccaaagagtacaaatcagaaccaccttgctagatcaaatccctctcatgagtcatgagaatatattatgttggaagatcttatggtcatgaacccttgacatgttaattagcgcgcgcgtactacgaaataatacatgaatataatccgggttttgtggataatagtaaaatgttgcaacaaagccaaataatactgatgagattcggttgtatcactggtgaccttttatttcgtgattgaatcatcgctgtatgaaaaaaaaattcatacaactgaaattagtttgcgccaataaattatcatgggtagggagctacacaccaatgtgataaaccatgacatatgggtcttttccatgccaactaccatcagcacatctggcggatcagtaatcctcggttgagcaggcagacatctgactgttctgagatatcattttcctgatcccgcgcattccaatcagacattcatatttcaattgaaatggaattaaatgtgaaaaatacccccctacaaatcacttgtgtttcttctttgcctactactacttgatttcgtacattaaacctccacacaagacaatttctcctaacaattgtggttggtctctcgcaacctccttcctcccttctagtatctgccttcccaaatccctgtatgagctaagatgatggcagaacacgatggcacaacttgtgcgctagctgtaatttctataataccaacctatcgaggtggcatgagtttctattgtcccatgacgctggaggcccatgcagcactagaaattgaaataactaggtgaaataattgacaatgggactttggggaagttaggacataaattaacttgttgggaggattttctgtataaaattgagttgtagggggaaatagaaaaactagtgagttgtagggggttatttggaatttcactggaattaaattatgagcaaagaatggcggatttcttttttgaatatttaaatgtcatgattcagctcctgttgtttttgcgtgctctagggcgcataattcctctggaaactcaggatgtatcctggcagaataagagagagaatgtggggatacgtgttacggctactgtacaaaatacaacaacgatgaacccgatcaaagtgaggcgtgctccacgcatgccaggcgtgccaatgttcaccttgctggatccgaatgggcagatgtgctagctgtaaagggtgcgactatataagcactcgagaggaggctagggccgcatagaatttgtaaacagcaaactgaatccccaaactaatcctctgtctcctcaatctatctctgatttatttctgcagttaagggtaaatacaacaagacctagatccgggatttcaaaaaattcaccggttatagatatatattttggtccaaagttgtcaacgctggttcatttggtgcaaattaggagtaacatgcatccgaatggtgcttaactagtttctcttttgttcccgatctgcttaattaaatgcttagcgattaacaagcccaatatcttcttcaatcatgcaagaaattaagcgcatcgattttgcaagaattcaattacttcaaacttttcaattccatttaacagcctctgagccaatcaatgcttaacaaaaatgaatcaatgctattctgtaaccatcatgagcaggcatcatccatcaacaggattcaacaacaatcacattagccatggtacgtgtcagccggttgccacagatgtgcacgctggcgctcagctgccccagctcctcacttctttctcttagggttagatacagatggagtgggttactgatcatatcgatatagaacgctactagccacaacagataaggaattactaagctacctttattaatattatttcttgttcctaaattatcctttagaaatcaacggtgcatattatttcgttgaggtacctgtatatgttgatatgctgatatgagattgatcaggtagtgaccaacgcagtgcttaattagctttctcttgtgcttacgtttttcaaaaaataaataaatgaataaataattagctcagatttgtcattttggtcatatacaacggtcatgctatatagagtcagaacttttgaaactttaactatcattagtttttcaaatgctctatttaaaaagggaaaacaatagtatgcttagttttgccatgaaaaagtattatcatagtataaaaacttattagatattctaatacaaaattgatagtcaaagtttgaaaattgagagattttacggtctcgaggtaccacattttatctctcggtgtgtttggtacgtactaggagctacgggtacctctagtaactcttgaggactgtaaaatttctcattaaaatttcaactcaaattttgctctaaatattaatacttatgagttatgaccggatggagtatatgatacggatctgtatcctcaataaaaattttaactcaaattttgttctaaatattaagcacttatgaccggatggagtatatgatacggatccgtatcctcaataaaaatttcaactcaaattttgttctaaatattaagtacttatgaccggatggagtatatgatacggatccgtatcctcaatactagtgtatacaca

SEQ ID NO: 62960 - DNA, 2723 bp, Oryza sativa
gttcgccttcaacacttcaagcagtaaacaagtagcagcagcaaatcaaaatccccttttcatcatcattctctccaaatctggtgatgttctctggcaccgatcgaatctatgatccttgtcctcgagctcctcttttcttcaaacagtagcagcagtgaagttccaagatgcagcaacaagtctcattcccattgtgaatattctgttcttcacccagtggttatcctctccttctccatgttcattcactctctacactaattttgcatatttctgttgtggctctgtgctgctacagcctactatttgattagtagaggagtacatgccatatcatgacataattagtttcattgctcgtcataatcatcttgtgcagctgcctgttccctcaattaattcctactttcagtggtagaatttgttaaaatcgtccccttaatttatattgatccctactgtcaccatcagtggcttatgcatctatcaagggcagggcacttctttcgttgctcatttccatagcagtcaccaagctcatcgcctgtatatatcctcagcattgtgcttgcttgtacactgctgctgtcaaccatctagtagtatatatcctgtgtccttttgctagtatatcaatgtcttctacaaatcaatttcccatgtttcctataaaatctgtcaaagtccattgtattgttcagtccgtcgaagtcatgctagtcaatcttttcccagctccaagtcggagttggtcttcatcataatcatcataccatcgtcaactccatgtcggagttagtattcgtcttcagtttaccagctccatgcaccaccaccctcatcaatcagtgaaggactgaagaacagtctgtgaagttccttcaccatcattgtcaccgtctttgaatcaatgaaaagccaaagaacagtttgtgaaggcttctggtaccaagggctgaataacagtttgtgaaggctcgaggtccacttcattgaggaggggatggttttctcttgttcttcatccaagagcaatgcttcgacaacatctttaaatagggacttcgtatttatagtagtatattgtttatctagtgtttagtttcaaatgcaatgctattgtatatacattgcatttgagtggggctgttaagagtattatgtgtttaggggtatattagtaatttctcatatctattgtattcatatgtgccctttgggctaactcaatgactatggttaatccccaaatcttatctcaaagtgacacaagggagggattaggggaagcaagggattcattccgcacagggtttgagtgacaatgggaggattcactcaatccggtggtttgcttcccattggggatttaatctccaagaatcgaacatgccctaagggtgtctgccacagaaacacatggtaagcaagccagggtcctaagaagcagaggagcataaccaggacaagctgcagtatagatggccaaaaggcccgcccggcacggccaggcccaggcacggcccaccagccatcgagccggcacggcccggcggccgtgccggcccatgggctgcgcctcctgcccaggcacggcccaccagacgtcgggccggcccgaaggagcgggtggcccatcgtgctttttttaaataagtctattttctgtccctcctctatgggctgtgacatctatataacgaaaataagtctattttccatccctcctctttgggctgtgacatatatatatagtgaaaataagtctattttccgtccctcctctttgggctgacatatatatagctaaataagtctattttacgtccctattctttcaattgtggcatataatatgtctatttttactccctattgtttatgtgtcgggcctggcctgcggcccatcgtgccgtgccggtggagaggcccaggcacggcccggtgattgggccgggccggcacgagcccgacccttgacgggccgtgccatgcttgggccgggccaaaacgccatgccatgggccgggccgtcgggcctcgggccttttagccatgtataggctgcaacactaagttgatagttaggttaaacaaagaaactgggaattggtttgtgagcacgttcatggatgggcacaaccatgacctgatatctagctccgacctgacatgtgttatccggtgtcaacgtattgtcacctacgtgcctccttgcaaggtgggtatcaatgaagcactgagctgactttataaaaaaaaccaataggtgataaatatgcgaagggatatctggtctggtggtaatagattttcccagcaacaatcttacttttccggaatcccatatagtcatttttctcgtgtattagtggatctaggacatgatcctcacttatgttactattaaacactagaagaccaattgacagtggcgactcatagcgacgtgagaagcaggccacggcggccagtcgtcaacgcgtgcaaatgttggtcaagcctcctatttcttcagtcttccagatgctattgattctctttttctttcgaacagactttcttgtgtgtacatcttgattaatcttaagaacaaacaaactataatattgatgtatttgattttcatttattttaattaatcttaagaacaaacaaacaaacaaacaaactaaaatagtaaaaatctgaccattgattttcatttaaattggtgggtc

SEQ ID NO: 62961 - DNA, 2218 bp, Oryza sativa
aacactacctagttccagaaccttcaggtacctagcagtccttgatacccattgcacttttgacacggaggaacaatcgatatcaaattgatagaaagaacgaacacgtgaagcatttatacttagctggactctgactgaattctcatgaattgataaccgacgaggctcgcactcaaccaccgatctctgagctttattatgtatcatgcagaatccttccttttcggatattgaaattgccagctccctgataatgtcatgcatctggagttcccatactcttccaagcttatttctccgagcaacttgaagcaggcagcgatctactagcttttctatgtactccattgcaatctcctccagtgtcatgttttttcttggttcaacaagaccttctactactaatagtttacatagccgcttcccgcgtatcatatagtcctctgggaagatactgcataaaaggaaacagttcttcaagtggaccggtagatgcttgtagcttaaaccaaggagtcgagtcaccatgctgagtccttggttatccaagcgattgtgcaactcccagttcagttgattatagaatttctcccactccatcaaatccagccgtttgaaggatagcaagttgcctactgccgttatagccaacggtagaccttcacacctgccaacaatctgtcttgctactcggtccattgcaggaggacatgtttgatcttcaccgtgccggaaagcccacatgcaaaagaggtcccaagactctgcctcatctaatcctcgtagttgaagacggcgcttgtcttctgccaaagaagcaacatcatttatgcgagtagtaattaccaccttacttctgatgctgctttcatctagaaagccttccaagctgaaccaaacatttgtatcccacacatcatccaagaccatcatgtatgtccttccctgcaaagtctcctggagcatcagcactacgccttcactactcatgcttcctaagtcagctgagcatgtatccttcaatgcacactgtataatcttcctcattatttcagtaatgtcatatgtttgagacacggtaacccagatctggcaatcaaaacggttcttgctagctttgctttcggaaacagttttgacaagagtagttttaccggaacctcccataccccatatggaaattattgagcatgatctttcatttgccattagcaactcttgcagcttctgtcgctcatttacaaaaccgacaagtttcttattatgcattatgtggtggagtgtgtgacctttgctatcttcatacctgatggagctggcactttcttcagataagtcaatattgtactgaagtttcaagtttcgaatattttggagacgattctgcacttctttgagttctgctgctattctgcgcaatggcatcacactttcagattttctgaagaagttcttcaacaattccacagatggggtttcttttctgccaaaataatagacaaatgtcatccaggatgtcttcaacttcaaatgctatctgctgaacttcctgcagaaaggtttcagcctgcctgctggagctttctttttcttggccatcttgcaggaaagattgcatcaacctaaactcacttctaatttgctttacaatgctttcaacctcaattaaaactgatacctccttccccagatgtgaaactaatgcctgcgtcagatgtgaccccaatattgatccaattttgcataggattccaaacaccacagactctgccattcagtgctcgatctctcagttcagatattttcaaatgcaagacctgaaacaaaatgaacaagcatccaataataaattttcatcctacaaattactttgtaccagagttcttgaaaaattgcattaagttaaaaaataacagaacggttgtcatttcagacttatttcacaaattttttggtgccagatgtatccatgtaacaattcaaataagaaaccggtgaagtttaagtggcatataaggaattttctcttcaaataaacagatgctacacaatctaatttctggtccaatcgaaggcaatatactctttctttttcagccttttttatgtaaaaaacatggaacccaaaccacaaaaccacctataagcctatacataagggagagaaacaaactaaatacggcacgatgaacggagaaggtacatgaattacctg

SEQ ID NO: 62962 - DNA, 7853 bp, Oryza sativa
  unsure (1)..(7853): unsure at all n locations
gaaatccccattcgagggacaaccgatcaagatgtcaattgcagcttggaaaggggaaatggtttaaatggagagagtgggactggcgtgtcagcctaggacaagcatataatatactccctccgtcccataatacaagagattttgactttttacttgcactgtttgtcccctcgccttattcaaataaaatgtgcaaatataaaaaatgaaaagttgtgcttaaagtactttggataataaagtaagtcacaaataaaataaataataatttcaaaattttttgaataagatgaatggtcaaacagtgcaagcaaaatgtcaaaatcccatatattacaagacggatggagtattttattaagagtgtatttttttaagttcattttgtcttaatatttatgttggccactttccattgagtaaatttcacggaacactacaattttcagggaatctgtatcactaccaaaccacattcaactatcggttacctgataagaaaggctcaccggtcagtgactagccgtatacccccccttgtgcgtctgatacgcaggcattcgctggagccgaagttagcgaatcagaaacgacaaaaaaaaaaaaaaaaccacgctaagcttttttcaggagtagcgtcaccagacccatgtgcacaacacgaagacaaccaactctttttgaagctcacgtttgcttgcctgcctacttcggtagttcggtcttttggttttcggcccaactcgagtttacgacgtatataagaagttccaaacctagtatttgcaatgatgctctgattttctgcatacatatacatgaatatattttttttatctaaagtgtgatttcaaatcttttattaaagaaattagttactataaattctattactagatataaattttatcttagggatgccaagtcttttataatattttcttattatggatgaaaacccacaatattttttaaaaattatttctatatgtattttatgtatgttaactttacatgtataaactttttatatgtaaactttatatgtacaaattttatgtatataaactttacatacacaaattattggtagaaaatagtttgcatacaaatcacaaagctgcatccgcccatgaacattttgcacttttgaaagatcatgggaaaaaaagaaaaacaaaaggtgcaaacaacgggagagggccaatgcaggaaaatgtccatccatttagccctaagaaaacttcaacgcatgcagaccatatgctgaaatccagaatgggagacggcccatgtgcttaaatgcagaaaatagaaatagcatgtttgcttgttagacttttcggaatcaaaccaagagaggaaacagaacgctatagttgaaagagaaagtgggacgttcgcgcgtgtgactaatcaggaatgcgcattagtcgttccgccgcttccttcctatatgccattcacccgtttgccccgaaaaattatgtagttgcaaacctaaaaactagtctatagtaagataaaaaaaatggggcaattacgcatctgagcttgttttgaagcctaactactaatttgaccctctttaatcaattttgtttattttacccttcttttcaaaattgaagatccaatcttaccctattctgttcagggtatataacggtgttaatttgagcaaaaaatgtctcttctacctttggtcatttgaccctatttaatgtctcttctacctttggtcatttgaccctattttatcagaattataaataaaatatatcaaaattttggatagcaaccaaaaaaaatataatctctttgccacggcggcggcgtcgccgacccggcggcggcgcacccacggaggaagacggaggcctccgcgcgcggggagggagggagtgagcggcgccctatgctcttcgccacggcatcgtcatcgtcattgctgaccatcggcggcgcgcgcatggaggaagatggagaacgacccgcgcggggatggagggagcggtgccctgatctttgccacggtgtcgtcatcggtgtgcgtggaggaagacagaggctggcgcgctcggggagggagggagcggctccctgtgatcttcgccgcagcgtcgtcgtcgttgccgacccgggggcagtacgtgtgtggaggaaccgaggaagacagaggccggcacgcacggcgacagagggagcagtgccctgtgaggcgctggagctcgccggcgtgcggagggcgggcggcngcatcacgcgcacggagagaggaggaggccggcgcaccgaggacgagcagtgacagcttggcgccgaaactcgccagctcacgggagaggggcgccgctagatctgcggcttgtacgcccagcctccgccggatccaccgccacaacttgagctccgccaccgttgctcctcctcgtcgtcatcaagctgccgccgctccttccgctcgtcgttgctgctggtccttctgctcgccgtagctgtcacctgtcctttctccgcgcgcaccgcctcctccgcgcacgggctgccacaggtctgctacctccgcgtgcgccaccacaggtccacgcccctccatcaccgctcgtctcaatcgtgtgccgccgccgccgccgatagacaagatagagacgggagtgaatggatagggttagatgtggatggggtttcttcagaatagtttggtcaatacgaataataattaaatttctttttttttcaaaaaaatgaaactttaacggtgtagtggaaacagggtcagacggagtattcatttttgaaaagcagggtcaaataagcaaactaaaaaagtaggatcagtttagtactccctccgtattttaatgtatgacgccgttgactttttagacaacgtttgaccatttgttttattcaaaatttttgtgcaaatatgaaaatatttatgtcatgcttaaagaacatttgatgatgaatcaagtcacaataaaataaatgataattatattaattttttgaataagacgaatggtcaaactttagataaaaagtccacggcgtcatacattaaaatatggaggtagtatttatgcttccaaacggagccaaataagtaattgtgcctaaaaaaatagacttttaagatttgcactatatatttttccataagtaaaaaattttactactttcaagtatttgcactatatatttttccctgtttgcccttgccgaaattcttctactgttacaagttgaacttgttagtgtgctacggctgtatattttccaagtttgtcctttctgaattttgaaggcaaagtattatccttccggaaacctcattgatatagttttcatcccaacgtcttccgtgacttagaaaagtactgagtacagctttattgaaaaaaggcgtaatttggagaataggggatggtgacaaggtgtatatttggagagatcaatggatcccaaaggctgctgggttaaaggcaacaggcaagaaagagaaatcgagattaaagtgggtatctccactaatctttttctaggatcgaacagcaagaactaagccaaccagggagggtcaatggttgtagtatccaaaaccaaaacttttagcgaaattaaaagttaccctcgaatcgatgacacgtggtctgactagggtaaatgcgctggtctaaccgcctggacaccattggtctaaccgtagtagtcactccagctgtctgaccgctgtaatcagccgccatcgcctatagccgccgccggtctgaccgccgttaacctgccggtctaaccagtccgacgccattcgtctttgccagtggaccgctgagcctgagcaaacacaaatcgaagaactctcaaagtcgatcgcaactttattactcagatctgtgtttacaaagtgcaacaacagtgctcctcacgaaatgtcggctaaactcgaaaccctagctatcctctcaactcaatgctctcttaaacgataccaggaggccacaccctccctctctatatatacacgaggtaggcagcctaaagccacgaaccaaacttgtacaagatgttctaatcctctaggaaaccttctcgtacaagaaactaactttacaaactccaattgtaccaaatttagacaccctccaattcgaccagtcagatcgtgggctggccggtctgaccggtagcacctgcccagtttgaccggacccgacaatctagcagtatctgttcatcacctgcaaatcactttgccaataatctccaaatattaaaaccaataatcttatatgccaattgttcatcacagaataagaatcaaacacactttgattttacacttctacaatcatgatgctgattaaatcctaaaagtcaagccttcaccgagaatatctgaagattttgttacctggcattacgagaaaaatggtatcttttcaatatgcagtgcttataaattggtgctagcagaaagagaactaaaagatggaagttcttgtagcaatgctactgatgggagtagacattgctggtacatggtttggacagcaaacgtgccctagaaagttagagtgttcgcctaccgcatcgcacgagacaatctccctacttaggccaataagtttcaaaggcaattagtgacataagaaaagtgcacgatttgtggatttgaaattgagaattttcacacaatggttagatgtacaaaaagcgaaagctctgcgacatgctctgtgcaggatttgggctctcctaggggaaagctcttttaatttttttggcgtgattgctggaaaggttgtctatccttcttatccttcttagctctgtaccaactaactcttgtcatatccttgtgctgttttggggagcttatagtatttacgtaatgatattgtccatggcaaaggtgaggagatggtggcaagatctgcaatgttcttacagagttaccatgactcttttgcacaagccgtggtacaagaacctggtaaaaaggtaaggcagttttgagtgcagtataaattaattccccaaacccgaagataaatagaactttgggcgtgggttgcagctcatgggaattgccagaactggttgggccaagattaatgttgatggtgcttttttgcaggctcatgcaatgtggtatagttctggttcagtcttgttatcatatttgaagtacattcgccacggggcagcggtggaaaaattagaattgttagcttgcagagatcaaggctggcctcaccaacgagcacagatcgcggctggcgagcaagccgaggatggctttccgtccctctcccagctgccaccaccttcacctccccttccggtgacgacctcgaggctggccatcgagcttcgacggggactagatcggggcgtcagcgcgctgcggccgtcctgtccacgtcgcgagcgtcctctgccgacagcctccagatcaaggcgacggtcgtcgagctcgatcaaggcgacggttgtcgagctctccggaggatcgagagatggcgacgaggtcggtggtgggcagcgggggatggcgacgagccccgcggaaacgcagagccgagggtcgtgaccttcttggcagtgtggagaaggggatgacagcaagctcctcggtgcggcgcggagctgggaagacgggggatgatgggctcccttttcggtcatcgagacgggctccatttcctcatcacccttctccctttccctacccaggcggtttctccctttcccttcctaggcggcacaggcaatggcaagccatgccctccacaacgcctctcctgccttctctccccatgccaccaaccctcgaacaggctgaagaacgagtgaccatctttggttccgcattcttcgtgggaccgcacgaggatgatgtggcagcgaatctttgatgtggatggccaaggccgaacgccaactatatgcattatgcattatgaatggacttaatagatggcaggcagtaccgcggtagaggcggccatgcgtaggtacctagatgagctaccgcgcgcgccgactgcatcgacgacctaccgtacgatcgagttcattgccctggaagtcgcacgtactcggactctcgaagcagcatgttagctcgttccttgacacactgcaggtggctctgtatatttatctgaagagctgccgttgatatttgcactgctctagcatttgtgagttagtagctcttatatactagcacatcatgtcgcgcattcaccacactcgttctaaaatcatgttattcgttctaaaatcatgttatgtggtagagtggcaatctatatatctcttttaggtttctggttgctcgtaaaaaaacatgtatcggataagtgatattgtatatgctgaaataataaatgatttaaactttaaatatatgcaaacttttacatctgtatgagttatagtcctatagttgttttcgtcattacataattaacccccttatcctctccttattttttttgtgtgcacctttatatccgccacgcatatattttgtaagtttttaaggaatattttagttttgttttaaattagtgtggaagtcattaaacttatatttgggagaccacgacctcctcgttcgaaagaatatgtaggtccatatagcaatttttatctcaaacacattaataattgatttttagaaacataattaattatatgaatatacattttgaatatgctcttaatagttcgatcttgccaaaaatagtttttcactataggtgcaaatggtaaaattatatatgtaactttatatcctctacttattctctagctttctctttcttttctacctttcctgttccagtagtttccgaaagcctcttgaataactttttttaccatctgtcaaattcagtggcgaagattcattcactatcttttatctttttaaaatctgtagtttgtgataaatttgatattaaatttataatactgtgatgcatcatcttaaatctatatttttgtgataatttgattaatatacctatagttttatgaaatttacttaaaacaaagaaacaaccatcagtgtctgcttggaaggcctgttttggacctaaaatcaacgtacatgacagccccagaaattgttcaagttgggctgaagaacgttgtttagatgggtcatttctagaattacaatcccgagttgatcccaactaccaaaaagaaatatctcctggagtcgtgaagggctactccgctctccttgtggcttcatggaggccatcgcccgcaaggaagaatcgataaatcatcttattacagccttcacgattatgtcattacaaccatgagtccttatcaggaccttgccatggactgatggttgtaacgacatgaattgctgatgccactcattccaaagccggggctgtttctgttgtcccagtgggatgttcatcaacactgaaattataaaaaattcatctctcaagacttttgtgtgctctaattaacccccaagtctcttttgcagctgaggctatgttgtagccaaattgaagggaactgaaaaatgattgggaggggttcatatatagagctgagagacagtgagaccagaggcgatcaacattacagggatgagatcatgagagagcaatgacccaccctgtactattgcacgatcaactaagtgatgaatggagctaatatatcaacatgcttttcactgaaaaataattatgggtcttgatccactaggcactagatatatacatagctaggtagtaacatgttgttcgctttgggtcatataatgctgtaatcagatcgcagggaaatgt

SEQ ID NO: 62963 - DNA, 12543 bp, Oryza sativa
cggtgagaggcggaaacggacggaggaggtgcggggagggtttaagtagggttggaagggggagagagcggccggaggggaaggaaaccggcgcggcgttctcgggttccatcaatggcgtcggcgggattagcggagggtttccaaacgaatccaagggagagggaatcacggggaataattcccccctattgattgcacgcggggacgacgggatgcggcggattcggcggcggcggcggcgggagcggcgggaggaaggggatgacgggtgggccccacccgtcagcgagggtggcgggtgggcccgcccgtcagcggcgcgcgcgcggggagggaggccgaatgggccgcgggaagaggagaaagagggggagggagatgggccgaattcggcccattagagagaaggagggattttagggtttttctttttataaaatcattttaactttgtttatttcttcttaattattatttgtgctctgaaaattccactaaaatttatttacacattttaggcttttaggaaatatacaaaaatcctctaagccttatttgacttttaactttgcacattttaattgttggaggctttcacacagattttaattattctaggcataatttagaggatgtattttagagtcgttttgggacgtgacaaacctaccccccttaaacggaatctcgacgccgtgattcggaagaactggcgaagagatcgggatgggctgccttcagctcgtcttcacgctcccaagtagcttcttcctcggcgtggttgctccattggaccttgcaaaaacggattacccggttcctggtcctgcgctccatgttgtccaggattttcactagtctctctacgtaggtcaagtcttcgcgaacttcaatctgctctgagtcggcctgctcggacggcactcgaaggcatttcttgagttgcgacacatggaacacatcatgcacgttgcccaaggaggcgggcagctccaactggtaagcgacttctccgcgtcgagcaatgatacggaaaggacccacaaaccgaggtgcgagcttccctttcgtctgaaaccagcgtacgcctcgcagcggcgtgacccggagatacacaaagtcatccactgcgaattccaggttacggcgtcggttatctgcataactcttctgccgagactgggccacctttagattctcccgaatggttctgactttcgcttcagcttctctcaagatatcggtcccgaacacttggctttccccaacttggtcccacaatagcggtgtccggcatttgcgtccatacaacgcttcatagggtgccatttgtatgctggcttggtagctgttattgtaggagaactcggcataggggagactcttatcccaggtcttcccaaaatctagaacacaggcacggagcatatcttctaggatctgatttagacgctcggtctgtccatctgtctgtgggtgatacgcggtgctgaaatttaagcgggtacccaactcttcttggagcttcttccagaagtgagaggtgaattggcttcctctatcagatacaattttcttaggaacgccatggagactcacgatcctagcgaagtagagttcggctagtttgctccctccataggtggtcttcacaggaataaaccgtgctaccttggttagtcgatccacgactacccatatagagtcataaccgccttgggtttttggaagtccggtgatgaaatccatcccaatttcatcccatttccattctggtacttgtagaggttggagaagtccggccggtcgctggtgctccgccttgacacgctggcacacatcacaaagggccacgaactctgcaatttcccgcttcatactaacccaccaatatttttctttcaagtccaagcacatcttagtgctgccaggatggatggaatagggactttcgtgagcttcctgaagtatcaactgtttaagttccctgtcgtctggaacgcatacacgatttccgttccatagggctccatgttcatcttctgtgaaaccagcggctttaccttgtttcatattcttgaggatcccatgcatatctggatcattcttctgagcctcgcggatttgatcgagcaaggtaggcttggcttccagcgtagccaagaatccatggctaacgatgtttaggttcagggcttccatctgttgattaagttccgatggaatgtcacggacgccaagagtgttgcaatggctttttcgacttagagcgtcggcgaccacgttggccttaccagggtgatagtggattcccacatcataatccttgatgagctctaaccatcttctctgccgaagattcagatccgattggataaagatgtatttcaaactcttatgatcggtatatatttcgcagcgattcccaatgagataatgccgccagatttttagagcatgaaccacagcggccaacaccaaatcattggtagggtagttgccttcatgaggccgaagctgccgggaggcataggctaccacatgaccttcctgcatgagcacgcaccccaatccttggcgcgaagcgtcacagtacaccaggaagtccttgcgagtatccggtaagattaacactagcgaggaaaccagcttctctttgagagtttggaacgccttctcgcattgcgggctccacacaattttttcttccttcttcagcaactgcgtcatgggtctggcaattttggagaaattctcgatgaatcttcggtagtacccggccaaacccaaaaagctgcgaacctgagtgactgtcttgggttgcttccaatcagtgacggcggtcactgtttcaggatccacggcaactcctttagcagagatcacgtgccctaagaacttgacttcggacaactagaactcacacttgctaagcttggcatacagttgatgtttccgcaactttcccaacaccagacggagatgctgctgatggtcttcctctgattgtgagtacaccaggatgtcgtcgatgaagaccacaacaaacttatccaagtattccatgaacactttgttcattaagttcatgaagaaggcaggagcattagtcagaccgaacgacatcaccgtgaattcatacagcccgtatcgcgtggtgaacgcggtcttcgggatatcttcttcacgaatacgcaactggtgatatccggagcgaagatcgatttttgaaaagacagtggcacctttaagctgatcgaacagatcatcgatccggggaagagggtacttatttttgatagtaacttcattgagagctctgtagtcaacacacatcctctttgtcttgtccttcttttccacaaaaaacacgggagcaccctagggggaagtgctcggccgtatataccccttttctttcaactcttccaactgtttcttgacttcgactagttcatttgctgccatgcggtagggtcgcttgtacagaggagtggttcctcgagcaagatctatccggaactcaatctctcgcttgggcggcataccaggtagttcttccggaaacacatctccgaactcactgacgatgagggtttccgacagtcctatctgatgaagttcggaactgccgacagaggttgggggtgcaaagaaaacaaccggttgttccggccctcggtacagagtgacagtgcgtcttgcgcaatccactactccttggaattgagccaaccaattcatcccaaggatcacatccaagttcttggtgtctagaagaatcagatctgagggaaaaggaattccctggatttctataggaacggcagggctataatactttgctgtcataacccctccaggggtggtgatgagcagagggtttctaagcctttctacccccaattgatttctccccatgaatggcacagatataaacgagtgggaagctccagagtccaacaaaatggtagcagggatagaatgaatgaggaacgtacccacgatgacgtctggagttgtcagcacatcctcggcggtcacgtggttcacacgaccccgaatgacatccttaccaccgttgttggggcggggaggcgcttggccttgctggcgcctcggctttgggcatttatccgcaaagtgcccgggctcgaagcagttgaagcacagacgctgctgacattgaacgtctctgcggccttgtccaggctgcacggctggcgtaggaggatggggcgcacgggtcccttgctgactctgtgtcacgcccggaaattcactagtaatttccgaacttatttgtgcatgaaaacatcgtccaggaatcagccgaggtacacaaattgacaatttaatatacagattcatcaaattaactaaaacgataaatacttacttaagaggcacttagtcctcaccatgaagaaaactgcagcggaaaataaaatctagcgaagctctggctccactcccacaggcagctcaactggggtataagccaaacgtcttctccttctggattctttttcttcaactgaggttgattgattattgcaagaatgagcatatgacatactcagcaagccacacagcaaatatgcaagtgcacgaggataccaaaggatggcataatataggctcatttgcaaaagcagcatttagcaaaacatttaagagaagtaaaacagtggagtaattaatcagaaattttatcaacactgaacagcacacccatgctgcacaggcccaaccattctgaacaaccatacccggctgtacagatctaactccaaaccaggagctaaacaaattattaccagttatagcatccataattattgtgagaggtgtgagactaatcacgaaaaacattgctcaacccgcccataaccgcgggcacggctattcgaatagttttactctggccagaggtgtaccactgtacccagaagacacagccccacatcatgtcaccatgtgcctcagtaccaccacggtacctcggaaaggagctgtgacattacccctcgcacaacacaatccaccacagtgcaccattcctggatcataatcacccccctcaaaaaccagaggcatggactccccagcgacccccgtgggcttatctccgccacttctcagtctggtgctctgcaatgaaccatgctatacgaaaggtaaagccgttgcccatgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccaccattaaataatagtgaataataagttatcccaatagtgtgctaatgtttctaagcatggctaagcaattatatctaatatctagttgaaccaatatatatatagcccaactagtcaagttataatcacccaaggtatcaaggaataaagtaatcaagtacaaaagggccataacaaagaataggttcacaccacccagtgacattcaaaaataaatgcacagttgaaataaatagagaatttgaatataggatcaacatgctcaaaggaattgtgtttgggatctgtgtgacttgccttgcaataatcggtcttcaattaatcttcttgaacacttccggtgcactcgcgaaccttcgcaacgatggaaacgacaagctaacacgcaaaaccaagaaaaagactaataaacaccaaataaacaatacataaaaagtaaacaaacatgtagattataattttagatgaattatgagacttgaacggcctcattctgacttcatatgaatttattatgaattttacaagattaaatctaattaaagcccatttaaaaagaattaaataaatttaattcaatttatggacaattttaatatgtagatctttattttataaaatttttgcaacttgaaccacattaaactgagttcaaatgaattagttatgaatttttaaagattaaatcggattaaaacacttatatggattttaattgaattatgacgcaataatgaattatttttgaaaaggaaaaagggatttattgcgtcagcggctagggtttgcggtggactgggcgcacggcagcggttcacgggaacggacggccgagatcaaccctatccaaaacggacggccgagatcaaacggtccacgaccggctcacggggaacggcaacgatgacgtcagcgatgacggcagcgatgacgtcagcaccggcggcagctcgggagcgcaagctcgccggcgaacgacggcgcgacgacgagaacggagggcaccaggacgtagagcgcggtgcggcgaacttaccggtgaccaaaacggcggcagaaaagcaacggacggcgccggcgacgaggaagaagcggcggcggagatcgggtcgacggcggcgacggtgctccggcggtctccggcggtggcgaagcggtggacgaggacggcggcgacttggcgatcacaatggcgatcttcccgagcgacgacgacgaccggaacggcggcggcgcacagctggagcggcgacgacggcggcgctaggtcacacgacgctagggcgcttccgacggcgagagacgaaggcgagggaggtggcgggtagaggagagctcggggatccttataaaggggcaaggaggcggcggcgaaggcccacggcgaccggcggcgagaaggaaaggtcggggttggagggagaaaagtcgatccgaatcgacctggaatccgtcgatttccaaacgaaattgaccggagtttctataagagaaaaggaagaggagatctcgaagatcatttcccctcaaaagattcggccggagaaggaaagacgcggccgaattggaaagcggcggcgcacggctcggctagggttcgggcggcggcggcggcgcgaggaggaagacggctccgacagatggggcccatctgtcagcggctgagagagagaggaggaaggggcgcggcggactgggccgagggaaagagagagagagggttttgggccggctttcggcccaaagccaaaacagacttttaaaaacctttttcaatttaaattattcatgaaatgcaattccatttattaaaaatacttccttagctcaaataaatcccagaaaaatctaggaattatagaattaagcaaattatttaacaaaattttatctagcccaattttatattgagatttagcaaattaaaattagatcttctcttttaggcttttaagatcatttctaataattccttttaaacaacaatttataatttaaggatttttaaacaagaaaagctcttaacaaatataattagatcattaatgatcaaataattactgaactgttctttgtatcatttaggaattgagctctgaaaaatccgagaaaatttcagagagttgacttaatcatggagaatttaaaaattaaatccatcgacgctttatatttagaaaattttatttcccacatttaacttcacttgtaaattaaagatcatttaatataaattctattattaatttattaaataatttataaatcctgaaacaaaaatcaggatgtgacactctgctgctgctgcggctgtgggacgcgcaccacgaattgaggttggggcacggagcgaggttgctgctgctgttgctgctgctgcgaggaggatccccctggatagggattggtgtagcggatcctttggttagccccctgttggttgcggaaattcgtcaggcgacgcttgtgcgactccagttccttgtgcttggcttccaagcggatgctcttgtccaccaaacgctggaaatccagatagtccccggagaccagacgcacggacagctcagggtccattcctgccaagaacttctcttgcttctcctcatcttcacgaacatcctccggggcgtacctggccaggttgttaaactcatgcaaatactccatcacagagcggttgccttgcttcaactctcggaattcccttttcttaagggccatgactccggcgggcacatgggtcctccggaaagcggcggtgaaacgggcccaagtaataggctgtccttctggctgcgtagcctggtagtggtcccaccatagagatgcgggcccctgcagttggtgagcggcaaagatgactttctcctcatcgttgcactgcacggtgtctaactttttccccatggcatgcaaccaatccaaagcatccacggggttattggagttagagaaggtaggcggacggatgcggaggaactcagcgagtttagagtgttgtgggggtggtggtggaggtggagcatgatgctgtggcggattttggatgtggtggaggaaagcagtcgtcatgttggccagctgggcgaggatttgggtgaggatggagttggtgtctggtggtggtggtggaggcaggggaggaggtggaggtgggctgccatggttgttgtggttgctgccttcggggtgactgccttcaccggtagcagcacttctcctggttgtcacaatctcaaaatcccacacagaaccggcaaacagagagagctgactattaaaactaactagccacgactaccataattcttgaatttattactgctattaaattggttcattaaggttcaagttgcttaagcaaataaaataaagacaggctccgatacagttataccccacaccggtataaccatgccccacacgactcaagcagaaagaccaacgagaagaacacacgtgcaagcctactaactgctcgtctacttctgcgacgggccagggcggaaggtgagcagtagcgcatctttcgtgctacccacgccagaggctccctcctcctgaggaaccaagggcgcgggctcggcacgaggggtctcgacaaagcaggtccacgctagggactgacgaacaagctcaggcctggaggtactcttgcgggcggtgatcttcaggctgcggcagacgcggcggcgcttggggcgacagacctctccctgggcgatcttgagctgacacagctgcgcctccactgcgtctaggtccttcttcagctgcagattctcctgtcgcagctccaggatcttcatgttgttctcgaccaacccgcggcgcaccatctgatggaagtcgatacgagccgcgtcgtacgcctccaccatgcgtgccaggtgcatgatggtagcgtcatcctccgagctagcatccctgaaggtggcgtagtcgcgggctcctccgcgacgagggtggtagcggtagggcgagtgctgcaactcgtccgggtagcgctggtgaagagtgccgatggcgaggagtgcggcgttctggcaagcggcagagaaagaatctcctcccgcggtgactgccaacgaagtcctctcaggtgagccagtgaggatcactgcagtgacctcccaagcagcatggggctctacatcgtcaccctcctgctccgggagctgcttgccctggtaatccactccatgcggataccccaggacaacgcacatgccccgcagctccaaaacgaagctagtcaggtccagaccacgacggttgatgctgccggccatctacaaacaaaaagacaaaagagaaaagcaacattttaaagattagattttggcgataaatgaagcagcaggacagagagagactaaaggattttcacaaataagaaaggatttttatttggaaaatattgttaaggcttgggatgtaaggctcgtcctagggtcaagggggctctgataccaacttgtcacgaccggaaataacccaacgggcgttccttacgtgcgtgtattattccttgtcccaggaggcaaggtacactgaaagttgatacaattcagagtttatcaagcggaagcataaatagttactttattacatgggcggcgaaggcccagcacacaagaagacaaacgggaaacagcggaagactagggcgatgaccacaggcgcttgatggcaggcacgagctaaacaccaaagccttcatcatccaggggctccttttctgggtttgggaaaaattgagcaagactgagtacaaccaacgtactcaacaagacacacccataagtgcagaataaatgcaagggagtacaagggggttataatataaagggttagggtttgcagtaaacagcattaaaagacacttagttgctcaaagctattttgtaaatacgatcctagagctatacaagattattaatcaaggccgtgaacccacacgaacctgccttaacccaaggcctacgatgattcagaccgaactggcaactcgaccctgggtcccaactcgtcccaagccaacccaggccaactatttccacatttcagttgttaagcaggttttaaaattaaaacactaacttggatacattgctcggcttgcccataaccaagggcgcggctattcgaataggttatactctgatcagaggtgtacatctttacccacaagacagatcttcctcacatgtaaccacgtgccacataccaccatggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccattgacccccgactttgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccaacctaaaaccattttgaggattttgaatagagggggaggtgtgaatccaattccacaataatccaaccattccatagtgtccaggcgatatgaatatcccaaagtctagagttgtaaaaccacctaatgttacctaattaagcggcgaagcatctacctaaattcatactagtggtaccatgagtagagtgtccactagttggggttttgtttattctagggtgaacaaggtaataataacaataacaataataaggtcataacaaaggtaaataggcatggctagataaaacagtgataacgcgggaatttaagtaaagcgataatgcaataatttaaatcaaaataattttataaactgggattcaatattctcaaggatgatgtgacttgccttgctcactttcccaaacgtcggcttcaacctccacgaagagcggatcttccgaagctgcagcgtctacacgaccaacggaaaagaaaaggcttttactctaacaaactccacataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaaggggtttattgcatcagccgagggggaggggcgcgcggaccgggtccactggagtggggcccacgtggcagcctcacagtccacggtggaccgggtgcacccgggctcacaccggccggcgccgtgggccccacgcgtcagccgcacccgatggcgcgggcggctgacggccgggccccacgcggcagccactcggcgcgcacgagggcggccacgccggcgcggttggcgggaggcggcgcgcccgcgccccgatggtcgccggcggcggccatagacgcggcggagcggcggccgagagaggggagggaagggggaaaggaggcgacggtccatggctcaccccggggcgacggcggcgacggaggaggcggccggagcagagggaggcggtggcgcggctcgggttgtcggggacggcggagctccggtggtcggcgaccgaaacggagaggtggacgaggtcggcgaggatgcggcgaagccgaaggaggcagcgctgaggcgggagacggtcccggcgagcggagaaagccggccggaggtcgtcagcgacggaggagagagagagcgacggcgcgagctcgattccggcgaggaggaagggcggtgagaggcggaaacggacggaggaggtgcggggagggtttaagtagggttggaagggggagagagcggccggaggggaaggaaaccggcgcggcgttctcgggttccatcaatggcgtcggcgggattaggggagggtttccaaacgaatccaagggagaggaaaattttttttaaaggccccggggggggaaaagggggggtttcaaacgaatccagggagagggaatcacggggaataattcccccctattgattgc

SEQ ID NO: 62964 - DNA, 8250 bp, Oryza sativa
  unsure (1)..(8250): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgacggatacagggctatgaccatgcagatcgatgcaggcggcacgtctcgatccggcgcgacacgatctgatccttccccggccgcttgggagtacgtaaacgtacgtacggttcgtgccgatcgacggggtgtgtgggcgtgggtgcatgtttggaggcatcctcttgtcctacctacttaccccgaccgagtacaaattaatgtatacatgcatgtgaggtgttcttgaggctttcttaaaattttattgaaatttcataaaactatacatactttgcacaatttatcaaactacagatttaaaaacttattttataaaactacagatttaatatcttcatttatcataaaaccacaggtttaatgtcttcattaccacaaaactacaggtttagcattgttaaatctgtagttttatgataatggagacactaaatttgtagttttgtgataaatgaagacactaaaatctgtagttctgtgataaacgaatacactaaatctgtagttttgtgaaacaagtttttaaatctgtagttttgtgataaattgtataaaatatctgtagttttgtgataaatggacatactaaatatgtagttttgtgaaacaagatcttaaatctatagttttgtgataaattatgcaaaatgcctatagttttgtgaattttacacaattttatttgatcgatctgcaccgttggatgcgaatcagatgcctcgtatttagcttctctgaatgaactgcgcggcacatttctctctaagctcagtcattaagggcaccagtcgtccattatctagctaggatagttttaacactcgcgcgccaatggacggctggatcttgatcaacagctaaaacatgggactaatgttatatgataaattgataattcaggttattgttaaatagctaacggtgtgctcaacttatatgcgatatgcacatgtaatacacttttggtacaacaatttcgtttgcaacttgcaactctaacaaatatgctgactaaccgccactgccttttcaccccatccggacatgcatgatgacgcccacttttatactgtctgtatatatagtaccagtcacacccatgtcattgcgacggtacattaggtggtgtatggatccataagtcctggggacttatttcagtcctagaactaatcactttagtccatggctgttttgttatagagactaaaagggactaaagttcattaaatacgctgcacaatgaccatgttacccctaaaatcatacaaagagaaatgcaccatacccatgcatgagggcagcaggtggaaaagagctactttagtcccaataagctactcccttagggacttatactaaagcactttagtccctcctgtttgggactctacagatttaaagggacttaaagtggagggacttcttttttagacctaaaaaaacagggccttagtaaactgtgcgggggatccgcgcactaaccgtgcgtggctacttttattcaccgtgtggaggagataagcaataacgagtttctatagcctaaggtatacgtatagaacacaccacgagcacacaactagtaacaaccctttgaaaggattaccatagaaattctgaatgatttaatttcctaaggaaattttcctatgaaatactttgattcataggaaagtataaggttcttatcggttgctcatatttcctactaattaagtcaaaatgacttattagaaaataaaaaaacatctttttgtaaaaaatttttatgcatgttcttagcgacttaaaaactaatgctaaaagaaactatattgaaaatatcttaaaattgcctttcaaattaagtttgaaaattcaagagattttctccagtccaataaaatgtacctcgaggtatcggtatcttatggtaccaaatcgtttccgatcgttatatctaacaatgcccatcctgcccagctagatccaacgattagaaatgatttggtaccgtgaggtactggtattgttggaccagagcaaatctcaaaatttaaattttaactttggctttggcttattagggcaaccaatgggactcttaagaatttttctatagaattatatttctatggctcaatttcataggaaaataagtaagggggtgtctagagccaggggtgtaaagttttgacgtgtcacatcgggtattatatagggtgtcgcatggggtgtttgggtactaatagaaaaactaattacagaatccgtcggtaaaccgcgagacgaatttattaagcttaattaatccgtcattagcaaatatttaatgtagcaccacattgtcaaatcatggagcaattaggcttaaaagattcgtctcgcaaattagtcgcaatctgtaaaattagttatttttttagcctatctttaatacttcatatatatgttcaaatgtttgatgtgacagggtgaaaaaatttgggtgggatctaaacaggccctaagaggtctaatctcttggaaatttttctttcctttttttgtttcctatggtgctatcaaagggaccctcttcatattttctatgttttctatttcaatttttgtgttttatctattgctgtgttttctctatcatgtgttttaaaagagctctaaaataccggtgacgcaaatgaaatctaagatttttttattttttttctggttagtgtaatccgatacaggacattgaggggagcctaccgggagatcggtgaagtacgagaaatcataacggaacgtgcgtgcgtgcccgcctatccccgccgaccctgcatatctccgcgcgcgcatgcaccgggtccggcgcgaggcacggtctggtccgcccactccgggtccgggatcggagacggacggacgggagagagagacgcccacgcggccgtgtaccgtactgcgtgggcgcggttctccgcgcgcgaatgctacgtgcgctggattcgatttgacgcgcggcgatggatggtggtgggggagaggggatcggatctctgctagctccgcggggcacccagggggggaaggcaatttaacgggagccggctttttgtctcctggatcgttcgaccgcgccggggcgcggggcggcgctgcgctgcgctgcttgcgtcgtctcgttcgtacaagtacgggacgacgtcctatcgatcgctttggtcagatcgttccggtatggcccgtagattgggcaagtcgaacagtgctccctaacatactgtatatagggctgtgtttagatccaaacttctaacttttttcatcatattaacatgtcatacatatacaattttttagtcacatcgtattaattttaacctaaacttccaactttggaaggaactaaacacagcctagtccgggtttagtttcccctattcccaacttttcatcacatcatatcacatcaaaaactttccatcacacataaatttctaactttttttcaaactttcaactttcttcaaacttccaacttttttcagaaactaaacacacccatagttatgctcattgtggctccaatgcttagggtgtgttcggatgccccttttcccaacccctctccctcgttttccgtgcgcacgtttctaaaactgctaaatggtgtgtttttataaatgtttctatacgaaagttgcttaaaaaaatcaaattaatccatttttgaaaaaaaatagctaatacttaattaatcacgcgctaatggatcattccattttctgtgtggaggtttctggttgggaaccaggtacaacgaacacacccttatccctattgattcaaagaaaattcatcagaattttagagtctttcattactatagtaatttttttaaatatctcccttcgaatcaaagaaatgaatcttatggaatggctaatgccatgcaaattttggaggaaactaacatgagattctacctcacggaaactttcctttgaatctttatctctcctctaatttctgtgtttttttgcggtccaatcaaacagttattcatgtgtttttcctatgttttacaaccctctgttttatacttacattcatgtaacatactaaatttttcagggtaaaatttttgcgaaaatatctaaagtcgatgttcttcgttctttcgaattggagcctcccaatccttatattccttttgtttcctctaagtttccaccttccgcttaactttatttagtttccctctccaaaccaaatccgagatatcccaaagaaaattcccaaaatcatcagaagagctcgtgtttattttaagttaaaccggagtaatcatgcaaatattctaaaacccccaatctcatcgattcctattcaaaaatatcctaccaaaattctattaaaaatctctccaaaaattcaaatagatcactgtgtttcttctcgggccgagttcctagcaatccagcccatattctggatttcctttgcccatttccctctgtttgggccgtgctggcccacgactgctgttggcccagccgaggcagccgccgcacgcgccgtcctgcgccctgctcgtgttcgcacgcgctagtcgcgtgcggcctcgctcctgcctgcgctgctcatgtgccgccccgagctcggcacacgcccgctcgagccgcctccaaaacagccacgcagttgctcgttgccatccctcccttgtttcccctcctcctccagaccttctctccttcaaagtgaacgagccgaagtccgctattcctctgtagacatcaagtgctaatctcgttttcatccccaaatttcttctgccagagccaaggccggctgtgcagccgtttcgccgtcgtcgacctttttccgccgcaccatagcaccagcaggaccacctctcactggtgagaattttccccaaccttctttccttgcttctatcgggttcctatcgtgctcctgtccgccaccatggctaccaccgtgctcagtttttccggcgcttcatctctatcaactaaccacaaaaatggaaccttctcatccgggaacgcgttttgacgcgctcaccaggccacgttcgccaccggagctcgccacccaatcttctctctcctctagcggctggaatcctatagttcgcgttccggccagcatgaacatcctctcagagaaccagcaacagcttcgagttcgtagcacctggggacgaaattacctcaagacgttcttactgttccgccacaataaccgtcatccaacttttctctttttatctctctctctctctgtgttcgtggttcacagaggaagaagaacagtactagattcaatactgttccaccatggtccagcctgaccacaccacctgagccaacctaggtagttgtcaaccaaaagaaaaccgattcatatcaattcttccatcagttcacccccagattcaaaccaaatcaattctagtatctgtaacaacaataatcccaaagtgcaaccactactacacatgccatgaatcataaccctaggataaatctttttttcatccaactcaaattaactctcgatttaacattttcttttgttcgggctctgattcacaatatttattttatcgtttatttgtagtatttttgttataggcttatttggtcgtttcttcgtgtgcatacgctagatcgcgttgaagatcccaccggactcgcaggaactgaagtggacctagaaggctacgttgaagctcccgaaggccacatttcacgaggcaagccatagttccaatctttgatcatattgaaaccttgtagagaaccacttagttattttctgcattgagtatttataaaattattttgcatatgaattatttttgaataaacttgttagtttagttattacccattattacattgttattattggccaaatccatgaattgctatatcacgtcctttgataacctaggtgtagatttatatacttcacaataatattctagtggataagactaccaaatatctatactcatatacatggtttacccgtcgtcacgtggtggcgtgtcgggtgatataaaatgtgttatttgatatgagtcactcgcctggagtgatatggaagattaattccgggtgaagatggatgttgtggtgtgtgaggccgtgcatattgttataattattttgtggaaagtgtatatttacacttgaagtatgcacgggcctgtgctagttttggtggctttcccggatataaggactacccccttatgccatggaaaatgatgtaatttgcgcctatccataggactgagtaatcagacttagcctagtacattgtcccactatatgaaagactgtagggtggctctatgagcaggtttggggtggacatgtggaaggggctttggccaggttgacatgatccacaacggtggaacccgtgaaagcagcgaccgtctagccttgcttaggcctagcaagtgcccgactgctaggacggatcaatatcccactgggcagtaactagtagtaagtgggattctcaaacggctatgttgtcctcagcctagctagctgttgacatcaggtgggtaaagctgggcagtctctacagagatgagtcttgatcattcgaatgtgccgtgcttccggttaagaagctatgtcattgggtgattcctatttatcatggtatgagtagattttaaattaaaatatggaatatgacgaagatgaggatgaatggtgattaatattgctaccattttaaaatgatgatttataattgtttgcgaataaaatgtttgataaagtagggaaaaactatttataataggcttgttatggaacctccttgatgaactatattctttgtacgccttgcatatattctatttgtattattatggatgtggcttgttgggtacctcgttactcacctcttgcataaaatgtggttcagacgatcagttcttccctgaggaggcgcaggaaggggaagaattctatggtgctgtcgagtttttgttctaggttgatctgctctcaggcgttgcctgtggtgtttttatcctattttgtgtttgagtcttttgtttgtagggagtgtgtttggcctgtcggcccctaaaacctgtcttagttatcttttatgtaataatttctgtaaaaacttgggtatatgtatcgaaagctgttctgtatatcaatctgtgtgcgatcgaaatcctggacggtcgcgggtggtttcgggataccatactcaaaccgggtatccccacaattcatatcaaaatcatatgtttttcctattcctacgttttctcaatcctgcgattcaaatgagcccttagggcccctttgaatcacaggaatgaaaaaacggaggaataggaaaaacatatgattttgacaggaatgtaagtgtaaaacagatgattgcaaaatacagaaaaacgtatgaatgactgtttgattggatcacaggaaaaacacaggaatttgaggagagataaagactcaaaggattttttctatgaggttctacctcttattaaaattcctccaaaacttatataggaagaggcatttcataggaatttcataggattccatagggttcattcctttgattcaaagggctttgtaggaaaaattcctataggaataaaatcctctaaaatttctataaatttcctttgaatcaagtaagtctaaaatatagaattgcaaaacacgtaaatatctacggagtatttgattagaccgtatgaattcgatgaaaaagatagacttcaataatttttttaagaagttgaagctcttactaagtttcatctaaaatctatattaagtgagccatttcacaagaattttataggatttgaaaatatccaatcttttttattaaatgattaaataggagttttctatagaatttaaattatataaaattcctatatatattttttatccaaggactcttatagtgcacactgcttggcatgattggctaggcctggcagcgagccgctcttaaatctctattatggcagccaaccacagttaaatttgctcttaagcatcgagtgacaaattttaca

SEQ ID NO: 62965 - DNA, 4888 bp, Oryza sativa
atgccctcaaagggcagtctattgtgaggagttcccataacacaattgcaaagctataaacgtctactttatgattgtaatgcttcttttctccatgcctcaatgtcactgtgctgtacaactgtggatatatttcaggattagcaaatattgacaaaaaagaattatattgacaaatatgaactgcagtaacagaaacctctggagccatccaacggtatgttcctgtctctgcagtcatcatctctgttaatgtctcttctcttgctaaaccaaggtcaacaagcttgactgttctctggtctgcggtcaacagcaagttctctgtacgtacagaaggacaaaacaatggctcatgataaaccttatttgtacaaatatttctggcttgattttttttcaaaaaaatagctctgaaaagaaaatactgaaaaaaaacaccaaatagtattaggtaaatttacagtagagaaatatagtactgttttttgaataacagagctatgcattgattcgtgaactagaatcagtagtactccactggcatccgatgttcagctcattaatatttcctggcattttatcgaaagaggaaataatagcagtccttttctagttgctggttcacttttgcactaggtacacccgtcctgaatgttttgctacttgatacactatacagtataaacttagcatgcttagagattctattatatcttaaaccgaaaaacaataataaaccatttgggagaaccacctctttccaaaaggaaccgcccttggaaggtggctatcagaaggtcagaactgaagctacctttttaagatgcccgccccccaggggcccctctaatggatcatatgccggtcgtacttggaatcttccacattactaattcgtccacattattattcattgaaaacatagtacaagatggacttaaatttggtttcttccatcgaaggtcaaccaagaaatcctcagaaagctgtataatcattattatcttgaaacatttttctataattagtaaatttcccaatcaacgccatgaatatctagacagatctccatcattgcagaccagtccatgcaataataaagaatgaagagaaaaatggtatgacagattgaatcagttccttcccccactatatttgctgattgaggttattacctcattggacaaacatacacaaacaatatagattgcctgctcccctgcactcgtcttccattacacccacaattagtgctatttgtggtatttaggcttagttcccataaatagactagcccataatagcatcacatgcagacacaacaggacacaggaaaagaggaacaagccattgacactgctaccttttgacttaacttccaaacatcaccaattcaccataacttaataagattgaatgtaaaaagaagagctcattcctgcccttgaaaaatgcacattgcttgtgcaatatgaagcttaactttacataataggtcagacagccagagtagattatattctcaattctcatcctatgttactaatgagaacattttatttgtcttgaatcttcaagtgactttggctggtggggtaaatccacaaagaatgtttaatgtaatattaaaataaaaaaaacattagttttttggcaaacagctgtgtgaaattcaaattattattagaagttgatacaagatgacatatgagtacccactgaagaaattgattatgcacaggaatggaccatgcccccaacacccaaggacacacacacaaaaagaagtcctgcaactgtctgacctcatggtgtatatgaactaatgaatagttattattccggattgcagaaatccaccatgtaaatgcccatgaagcaaccaggtttccaaatagcaatcttaccaggtttaagatcacgatgaatgatcgcgtgcgcatgcaaacattccatggctcgagcaatatccaacgcaaatccaacagctacacgaggctccaggctcctaggccgaaggccaaccaagtacttgcgcaaagagccccccactagtagctcagttaccaccaccatgacaggctcaaggcaagccccgataaactgaacaacaagcgagtacattttcaacattcaaaagcatccacaactgccactccaagaaaagaaatgataagagtcaacaaaaagatcaagaccttgacaaggttcttgtgctgcacccttgacagcatagtcacctctctcaagaacctcccctccctcttgaccatctcctcaggggtgtcccccttgtgcacaatcttgatggcaacattttggttcttgtacctgccaatcccagcatcaatcaaaaattaatttagaagcaaaactttcacacagatcatcaaattatagatgacagtgcaaaaatatgagacttacttcccctcgtagacctttgcatgtgcaccttcgccaatccgtggcccaacaaagagaagctttgggtcgatgagccacttggggtcgatctggagaccttcgcccgcatagaactcactcccagattccatccccgtcgaaatggatccactttgggtcccgtggggtcacacgaccccactaatcgcttaaatagaagaacagcttttagggaaaacttggaagttggtgtaaaagcatagcatatggcacgcgtacagcgcatcaaaagacattaaggttattaagaaactcaacttttagaaagtttttgcaagtcgatagaaaagtatatcataaacacaagtaaagtacctcacttcattggacgtaggaggaaactagaaggatctaacgtgttcaagcaaattctacttccagaaagtattgtaaagtatgttgtatatatcatgaatactgattgaatgttccagaaagtgacagtgtgacatttctatataaactataacgtaaaactggggtagaaataaaccatgaacaagtgctgagcatgatacttgacataggtaaaaactatgaggaacccacatgtattcaccaattaaactttttggaagtatttgaaagttggactggtacatcacgaagacacgttggtcacttacaaatgcacggttataataaacaagaagaaaccctcgaattggacaaattcacattcctaaagaattagaagttaatttgtacaaaaatacaagcgtatagcacagtggcgtagatgtatatatatactacaatgatccatggcattcgaccatttctactcaaggtacatgagccacactaaatcactaattccctcttaagcttacaacagagccaactaaaacctttgatcagagcaacaaaatgtgcataaatatccagcattaaacttccaacctaatgccccacgaacaaaaaaacaaaatggttcaataaaatggtattccatgtgctttgcaaacatagtgagctacttgggggccgcattgggaaacaaaatcacaaagaatttgaaaactaagccacgatttgtcatctctctaccaaactctcaccaaaaaaaaaaaagaaacagccacaccgcattgtatcatgacaagatcaccatccccgtactaactcactcgtgaccttgctcgagcccagcctagccccgcacgatccctgacacaaaaagaaagggagaaaaaacaaaaaatcgagccaccttttaacggcggcttctaccataagcacagccacagagcagtcaaaagcctaaacagcacgcttaaaagcctaagcccatttctcccccacgcgtcgcgcagccaatagcggcggcggcggccgcagcacagcacagcaaagccgagctcgccgctggcgcgcgcggggggcagagcaatctagcggaatcccggcgggatcaggcgggaatcagtagggagcgggcgggggtggggagcagagcttgcttaccacgaagccccggatctccaatagccgcagcagcgcccgcgctctccccctcgtcgcctcttcaccaccgcccgcatcagcagcagcagcgcggcgccgaccgccgcatcgggtggagagggtggggaagaagaagaagaggaagaagctgcgtgcgacgcgcgggcgggcgcgcggtggccgaggcggcagcagcagcagcaacgcggtgagagacgatggggatgtggagagagagagagagagagagagagaagaggggtggggggtggtggtgtggcggtcggtcggagggagcgaggcagcgtgcggcccgtgaggggtaaaaaagccagggagggagggatgggtgagactgagagatcgatcgagagagagaagagggattagctaatgactccggcaatggcagatttgtgctactaacagtttaatggtcgccttctttcaactaggggcatgtttggtgaagcttttagctgctgcagtttatcctagaatcagaagcttccctaaacaatacagttttttgttcagattctgaaaaattgtagttgtagaatccagaaaataaactagaagctggaaaagctggcttccaactagttgcttctcagaatcttaagccctcccaaacaggccctaagggcctattcagattgtagctaaaataaaccttaccaaattttggtaatgtcaaaattttagtaagatggtaatattgccataattttagcaggatttcttaggctctgttttgtagtataagttcccaactcctcatttccgcgcgcacgcttttcaaactgctaaaggtgtgttttttttgcaaaaagtttctatacgaaagttgcttaaaaaaacatattaatctatttttgaaaaaaaaatagctaaaacttaattaatcatgcactaaaacgctgcttcattttgtgtgccggggagtgag

SEQ ID NO: 62966 - DNA, 5928 bp, Oryza sativa
ctcactcccgaacagagccttatgtatttaccaaatttaaaaacaaactaagcattgacattttttttgacaactttacccaaaaagtatggttgaaatagcatcaaagtaaacaggccctaaggacttcgactcagctcggctgtttcccaaatcgttttgaatggggttaccgtcaccccatgatttggacggttatcatgataaccgtataattactgtaagatataccgtggttttaaaaattgagaaggttaccgcaggcgatattcgtatgattttataaaaccatgatccaaccactgaccactgtgtagtagtagcacactgcttgtgtagctgtagcttgggtggcacggggatttgaggggagagacttagtctattgttgtattagtagtgtttttgtttgcatggaggagtaactaattggttgatcggttattagttagtagttaattaaggaagtgtcaaagtcttaaaactcttgttagtgcactccacaggtcaggtctccaaaattgcttgccgctttcctagaattttcttctgggtggtggctgtggttagtggtgtgtggatatggagccatggaggtatagagaggtgatttgtgaaagctcttctaacaagaaaccatgtaccctgtttctgaatggaataaagtttaaaaaagggaaaaatcttttttctaaacttataactgataaatcgcacatgaaaatgttaaaatatataggtaaccgtaaaaaggtcaaagtgtgggggtaaaaacagaaatactactcactcaaacccaaaatatagctgccgagatagtagtaagagtaagatcgaaactacaatactataattatacttttattatgaaaaagaataatcaaaactatatgattatactcattaaaagtgccattattagctttcaatggaagctggggtatccactacactaaaaaggagaataattcttattaacagatatggggtaaaacagaaatgctggaacaaatataactccatgagtattaaaagtggagagaaacaataggtggaaaatgattactttagtgccctaagatctgcacatattcaaaggacggaaagataagtctgtaaaaccgcccaaacacggcatggaatgggtcagattggtttcgctaaaatgataatcattggggccatgatgcatgcgaataaattatttatcttggcatcttacattacatcacctagatgaaaatggttttataccacatccttgtctaaaaaaaatgattctttcttagggatggttcttaatgtagcagtactactagtgctgctggtaaagtaaggttggctaatttggtactcctagtagtgattctttgcagtgagtaatcggcagtatataagggcctgtttagttcccacaaacaaaatttcccacgctgtcatattatatatttggacacgtgcattgagtattaaatgtagaaaaaaaaaccaattacacagttcaccaggaaattgcgagacgaatcttttaagcctaattgcgtcatgatttgacaatgtggtgctacaataaacatttactaatgacagattaattaggcttaataaattcgtcttgcagcttcccggcggaatctgtaatttatttttgttattagactatgtttaatactttaaatatatgtccgtgccaaaaaattttgccaactaaacaagccctaaaccaaaccaagagagaatgtgtcatttgtgtgtgcgcacatacaggatgtctagtgtcctttaatatctactattgcggtatgtagacgaaacatttctccttctgaacggagaaattttccgagaatttcacagaaagtaaaccaattcatgcaaaaccacactgcaaacccctgcatctgaaagaagaccaatgtaccaacaaagagaaacaaaaatccaactaagggcccctttgaattggaggaaaaacataagaattttggaggatttcaatcctataggaaaatttcctatgaagctctttgaaacaaaggattgaatcctatcaaatcctttgaaattcctatgaaatagataatcctatagagattttggaggaaatttagcaagagcttcaacctcttagttactttcctttgagtctctctctcatctaatttctgcgtttttcctgcggttcaatcaaacggtcattcctgtgtttttcctgcgttttgcaatcctctgttttacacttacaattctatcaaaatcctacgtttttcttattcgtacgttttctcaattttgcgattcaaaggggcctaaaactgatctaatgatgcttggtccgatgtttattagggtcacagggaccccacaggctaaccaaatttgtccatgtctggagcccaggcgtccggccaatgagggcgtaggcaggcgttgcgcgtgtgagttgtgaccttctctctgcaccagcgatagacatggatggagatgcagatagactggcacatgaagccagaaggtggcacgaagcagcctgaggccgagagctccgtgtcctgtaaattattgcattattagtacacggtttatcttggctaatcacctggttaaaaagaacttaaattattagtagtatatgctagtggtacaccagtactagtgtaagtacacttggtatgatgattgtgatgataatgatgatgatgatgatgatgctttctcgcctctgtcgacagggggcacttgtcagatcgaactaagctctgatgctccattaggagggactaatcactgtgcagcatgattagtttggttattaaacaatcggatcttggggattagggtgtcacccgtggggttcatatgtgtattttatctgctccgaattttgtaatgccagttctgggctggagaagaagcctgcacttaaaataaacttatgtcaaaaaccagggcatcgtttcgattgcaaaatttgcaacatcgatctagctgtctctctggtcgctgcgggttggagaaggggcagcttctctagtgtggggctgtgggcctcgatgctctaacgcgtgccacgtgtgccccaatggtgtttttttttttgttcttttcggaaaaggaatgcaagtacagtggcaagagctatgaaatctgatcatgtgccctccggccctattgactctgattttggattttcgtttgtatgtttttaaagctttcaaatagtgtatttcatactttctccatcccatattaagttcatctctagctccttccttttatcccaaaaatacgttcattttttaaagtaatcattacatcagaaattgtgaaagtatggaataattgtattggaagatgataaagtgagaaatagttgcattatgatttaataaaataaaagcattgtagtctctcttttttttaattagtatgtgtgggatgtgtgaaaaataaacttatttttagaacaaaggtagtacaaaaatatttctatatgattttttaaaaatagttttctaaagcaattttttaactacttataactagttaattcattcgttcaaaccctaaattttaaggatttatcctcttgtcccacatgcctgtaatcttagatgatctcacgtgtcagcgctataggagtataaatcctcaattttcaatctagggagaggatatgaccaaatctctccaaataattgtcaaaatgataccttttgcttacgatttaagcatggcacgccaaagtctaatcgaatcaaatttcgcccccacactcacggagatgctactggaagtctgcaactgaaaacaacatgcgcaacgcaaccacacgcacggagagtcggagacgtaaagacgactttgacccacccaggaaaaggaacaaaatttctaccagaaagtggcaggcagtcaggcaaatcggtcgcggtcgtaatccatggcggtagcgatggtcactcgttaataccgatccaagcctgcgttctacaagtcaaaaaggcaggaagaaaaatgtccagaagcaatgtagacaaccacgttgttaagctaggagatttacaggttacagttactagcaacaaaatggcacattggtgcattcgtaagttgctaatcttacttgctagtttagtttgagtacaaggctcacgcaggatatgcatcagattcagaattatactctgccctgtgagcatacctcattcgacaggccactagatgactaggcctttgtctggtgaggtccaacgcataattgcataaagaaaatcacgcgacaacaaaaagagaaagtaacggaaacagataagcctgagataagggaacatagagtacatcaacaacttaatttaagagaaccttggaagaggtctagtacaattacagttatcaatggatgagatcatcgccgtttgtacaagcaaggtttcaactgaggccaatcgatgtttttgaccaccttactcttttcctgcaaagacgtgaaaccacagcattcaatgccagactatagctgaacaataatctctcaatgatcaaagtatagagtaattttcaagtgcaattaaggtacggcagtggcataactgacctttttccggaaatggaacagaatgaacattttgtttttcgcatcctacagaaaggaaccaattgccaatttaggaaacatgatgacactgttctcttttcgcacagaacagtcttgtgtcaatacagaacaattttcatatcacaaaataagtaccacacatgaaaaggatacacaaaatgggaatccgtcatgtgggtacatcaaaggaaacatttcagataccatcaccacaaagagagaatgggcacaaagaacatattagtttctgaagtacatggtaaggatgcgatgtttgaaaatatgacctattgttcggtaactactgcactaaaagcaacatcatcatggctttgaacatttagtgatgcccagagatagtaataaattaaatagtaataaatatatcatcgagcgatagtatagattaaatagtaacaaatatatcagcacaaaccagtggaccagaatggcctcagtttctgaccatattaaatggtcaattatgaaatgggataaatataataatcacccaatcctatcaagctaattttcagcccaacatccaagaagtcagagattttttttcttgagatatacaagtcgttattccatcagttcgctaatagatgatatgtcctttttcacatatgcgcttcaggagtttagcctttggtttggacatcagtaaacatcgccatattatgttataatccttcattccttctaggacttcactatataaaattaactcattgtaactaagaggttgtttggtttgttaccattttcggccataataaattttggctttgggaaaccaaatattacctcatatatcctccataccaaaatttggtaattctagaaacttcctaactcaacatcatgtcaaaagtttaggcaaggcatcaaaccaaacacaccatatatacctctatcttaactgattttggcaccgctaaagctggtatggttacaaacggcaacaaaccaaacagccccaaagtccacttgagaaaaaggtagaagaaaccgtaagtataccttcgaaacaagggaaaacccaagcttgctgatggcctcacaaaatttatcaggatcagcacctgcagtgtttgggtctagcctactcctcacttcagcaataagaagccaaccactgcataaacaaatgtatcaatagtaaaaaaggaagcacatactttgtcatagaagtgtagcagctaatcattaggggcaaaccttggtttgagaactcggtttgcttcctctatataactcggatagtttgttcccattaaagacagacaaaaaattgccacatctac

SEQ ID NO: 62967 - DNA, 3142 bp, Oryza sativa
tgttgcacataatggaaatcatgaaaaatgtttagaatgtcccaagagctatgtttaaaatggcccaaagctagtgatttatttccttcttgtgacatattaaagaattatcagaaattgtttttggttgataatgcacctccattgtaagaatagcaactggccagctgcttttacctttggccctcatacacatacttacattacttgtaattcatgcatgagtgtactgagtatttgagtatcgaccataatggcttctatttttaacacaggaacaacatgttaacatcagaaaaattcaatgctaaaagagtattgaccatgtaatgacttggaatcatgaaagataaattgtggaacccacactaagaaatcaaggtgcacaagaatataaccaatatttggaggattaaagttgggtcattttgtaatgacacatagtgtagttgtgaagcttagtaagaatcatggaaaaagagcatacatggctgacaaggaattgccagaatttcccctgaagctaaactggaaatgaaccaagaaacactttgttcatttatgctaacacacataaacaacatgccaacacgttaaagcaccaaagaggtacaaccatacaagatatggttaaatgcttacatgagccatatcacaggcaatgactgaagggtcctctgaaacaagatcgatggagaaaaccttgttcttcacatttttagaaactgctgcattgcctagacaagatgtcaattgtattaccatgattatgccagggaaataaaaaggaaaacattgtgaaaaggtgtcggcatattgagagtaaatgtttagcattcttaccacagccaaaatctgcaactgtccaagatgcactatgactcttcaaccaattgattataacatttactggttgctctggccaatgcgacatttgctctcgatatcctgcatgatactaaaagaaaacaaagtgaaatctcagccatatatcaggtggtatgaaccataggggcaattattgctgcaatgcaaaaagtccctgcatatcgatcgctgcaatacattttcctcccacaaaatacacaaaaataattattcaaataagaaagaaacaactaacagcatgaggtttgtgtagatagaactgtagaggtacaaacaataaggcactgactgaagagttgatgaggtaagatatgaaaaagtcaccacccagagttcaaaatttgttgcccatactcttcaaagataaaattcatctagcaaacaataagattaccaaaatggatgaaaagtgcatagcataccacatcaaaaagatcaggctcatttgtgaagtagtcaaatgcatcttgtccactgaaaagaaaaaaaaacaatgtttgagtaaaagtgtgaatattgcaaaaatgaagctctgattagtgatttctacatttccagtttccaagggtaaagtcgaagccacattaggaactccaatttagaatattctgagtcatacgtgagagggcaatccatgtttttcaggcataccggttgatatgaccaataattaacagtaccgggtcagacaaagcatgaaggttaagattgatgcatgtcactatctcttagcatgattaaagatagcagtattttgtacaaaatgtaagctacaaactgtgtggatatttcaacatacgaaatttggagtatcgtcatgttcttacacttcattattggttgaagactgttcaatacagtattgataatgtaaagcattcaataatagcagcacatcattagcataaaagtagtgttatctggagaagaattcgaacctgcaagtgtatagtttctcatttaacattctgaaatgaccaccagataaccttgcacgcatctagagtgcacatcataaaaaaaacatatcaactaattagctcagagaaaaaaaattcaaagaataaacagaaggtaaaataagtaaaacattcatataataagtcatgagttatctccaaactgcaggctagttcattaattttgttttttaagcaaaagttattaaattattaaggagcagcaaataaaagcctaacgtgaatactgtgttgcctaaagaaaatgtgaatactgtgcaaattcagagcaatgtatcacattcaaccatgcataagagcatacgaagcactactgaattactgaggtttggcacttctactgtcgctactaaagaataacagaggaggcaccctatgctttgacttcacccacactgagagatcatccagattcactaaataacccatcaaccctagtcaaaatttattcccgataccaccccgaacattttgtacttccaccgactcctgctactggcacggcatatactcctgctcctacctaccaatacacgcctaggcctcgcaaacctctgctccggagagccgattaccttgtcgaggaggctcgcgggcttcggcttgctgccccgtcccttgggcgcggcgtcgtccccgcgctgccgcttcgcaggaggggagggcggggacgccgacgccgccgcccccgaagaggacgaagcctggtgctttcggcggttccggccgcctcctcggcggcgccgcttgcggccgccggctgccgccgccgccgcctcctgcagaggctccatcggggagggaggcggcgcgaggggggagggagttcggggtttcgtgccgctgttctgggttgcggcgactacagtgcagcgagagagagtggtggacggaagcgggccagggtgaatatgtatatatttcggcccaatagctttcttgggtctggctaggaaaaagtacaccgaacgtccatcaacttgtcatcgagttacaaaatcgtcctccaactacaaaaccagatatccggcgtcccgtaaatcaaaaccggtcataataggttctttgatgttttttttgacccggttttatcctatgtggtggttgagtcagcgtgggacccacatgtcggggctgccacgtcagcctcctcgctctatgtctcttttcccctcttctctcccttcctcatctctctctccctactctgactcagccggctggaggacgagggcgtcggcggcgaggagcagcgcgcgggcgacgaggggagg

SEQ ID NO: 62968 - DNA, 13070 bp, Oryza sativa
tcaaagaagggacagagagatgaggaagggagagaagaggggaaaagagagagaggaggctggcgtggtagcctgacatgtgggccccacatgggttacacgctgactcagccgccacgtaggataaaatcgggtcaaaaccaccgaaaggcttattatgaccggttttgattagttaagggacgccggatatctggttttacggttgggggacgattttgtaactcgataacaagttgagggaccttcggtgtactttttcggtctggctatatgtaagaggcccaagagagcgtgaggtttgagtgtgctgaactaaggcccggtttgataagtctgaattgatggaagaatatctgattttctgataacaatcgaggcagcaaacgaatgagttattacagagataaaaatgtttgtcgatacccgtagactggatgattggggtattagggttcgttggtacgagtatctacgtgatatgatatcaagcaaacacaaagacaagaattataccggttcaggcccctaatcaagtaatagtcttaggtggtgtttgaatctcctgaagataaagattaaatgcttcacacaaaatgagatagtaataacgtgcgattaattgagttttaattactaaaaacatgcaaaatgaactaatatgatattttagagtaactttcatatagaaagtttttgcacgaaacataccgtttagcagtttgaaaagcgtgccacgaatatctaaaattttatcctctacttatagaagaaatgaacataccctagtccagtttatataggattgatatgaaaaaaccacaaagtacaatgggaacaaatgaatttggcgataccgatgggatagtagtcgatggattcgacgagacctcatggtgacttggcttcacgtgctatgagattcgatgccttcgaatctcatacatggcttcgtagactatgatgggtgtgttggcggtgagattcgatgccttgaacccctcccagggggtgccttttgtaccgtaggtcatcttgatctccaagtagaactcagaaacatcagatcgacatcagaccccgtacaatatggtaaggaccctatccctaccgagtaggactttgtcagtctctcgactcgtaaggatattttccttaatatctgatgaattttcttagagcatacggaaacaacccgtatacgtgaaggtataccgtattcatatattccataagtcctaagataggaggtatgccttatccataatcatgacagtagcccccaacttcaacctaaatgaactcgtgttgtcatctgcgacttcacctgttagcgtttgccgtactcatttagtcgatcccgtatactttgaaaaatcatattaatctattttttaaatttattttagctaatacttaattaatcatgtgctaaacgctgcttcgttttgcattctagtacccaaccctcactcccgaacacaaccgtacgtctgccaatcgtccctctatgagactagtccccactcccgtagtcctggacccggtgcggatgtgttcggcaccaacccctcactcattatttttcgcgcatgcttttcaaactgctaaacagtatttttttaaaaaaatatttatatacgaaagttacttaaaaaatcatattgatctatttttttaaaaaatagtaaatacttaattaatcatgtgctaatatatcgctccgctgtggcgaacacacccgaattcgtcgtcatcctcgacgacttcgacgacggcgacgccaaagttccttcgcctagtcgtcaaacgccaaggccaaaacttacacgccaagaagagctagcagcagatcattaaacaaaacggcacacctcaccgacaatccaatactcctacgaaataccgatgcgaggattatactagatcccaccgggcccacatgtcagcgaccctcgtgcgaccccaaaggcgaggagcggaggccgccgccctccggcggtgtgctctccccggccttgcgcgaaaagaagatggcaggattaaaatactctaggatattccagagcccccttatccagttctcgtcactggcacgtgggccccaccgtgggccccacgggaggaaaaggatgggggaccgcacgagtttttacactctcacccgtaacattacacgtaataaatttcacatatacccctgtgggggtttttacacgcagccccctctacggctcccccgcgagcgtggcccgcgccgctgacacgtgggcccccagccgacttaatggcccaaccgtcttctctggttgtcgcccaggcttcgcatcgaaggaaacggttttgcgcgataaaagggggggcatcgaggagggactcggccgcatcgccaccgccactctctcctctcctcctctctctctctctctcgcaccaccgctctcttccgccgctgcggctcacggctacgcagctctcttcccctcctcctcggctccgctctcttcgatcgatctagggtttggtcttctgttgggggattgttgttgctcttccgcgcgatcgatcgacgccgcgtcctgagggtttgaggggtttccgccctcccgccgcacgcccgcacccccgcgatgtccggccggagctcgccgatgtacgaggggctcgcgtcgcgtcccgacgagtgggacgtcgtcctcaaggtgagatgatcgtctatttttcaggattgagctgtggttttgttttgtgattagggggaggggatggcggagggggaaggggaaggggaaaggggaatcgctcctggtgggggtttgggggaagcgtggggggcttgcgtacttatcgttttcgtagggtttgattgacgaaatgtgtggtgttgcgggatttgtgtacgctagttagtttttttttggcctgtgagaaattaggggagtttgattactctttgttagcttagaggtctgccctggtctgatttttttttctttttttaagaatcgtcagctcgttttgatgaatgtcgattcctccgactgttgatgacgcgcgcctgcctggtgttaaactaatcaaaaaaagaaaaaaaaaagaagagccttcatctttttgcacaaaacaaaaatcatactcctacatgagttcagtttctaagatgtattctattcttttaccattctgatgggtgttgggtattggtcagaaaaaaataattcagccgtccttaataagtactcctaacaattattagtggtctggtaccatttcttaggcgtatgtttgagctgagtatatttcttgttgttttgatgcaattattcacgtacaaccgtgcttagtatgtttattgtgatttgtttcctttatggcctcacttgtatatgctcatgtgcttacttcttgactgtactcgaccacatgcaaactttctgaatgtttccaaacctcaaaacttcttgaacattcgattatctgctagtgtgaagttccctgtttgattggtgataggaatttatttgtctagtgggatcatgatcttgggattaaatattccctgggccaggggaggtagtgaggtatatggctaatctaaattctaaaacctccagctcatgggggagaggtaataatacatcttaccatttgtaggcaaactattgtcttcagcttcaaatccgtgtaactttcacatgtacaatgataatctagaatgtacttgcactttgttcaactgtggaaatgtttttactctgtaggttttactgttgttatgcctttttctaattgataggtacgatgattatgatattactgttatttgaaatgaaatcgggccaatattttgtcctagctgagataccgagatttaacatcttcagtttgtctatgctttcagagttcatgcttgctttataaacacacgagtatattttgagttccactgttggtaaaataaccaaaacttctctaggatattttgccttttaatatactattaccttatacagtttatctacattctatctaatgatatatatgaaacaagtgatgccctcgttattgtacacttcatatagaacctttttcctgaatccggtgatgcctggagaaacattgcccaaaggaagggctaaacccatctattcaattaggagcccagtaataccataggagtctgtctgagaaattaactacccccacaatgaattattgtatagaccaagtgcagaaagtcattgagccttagcatgggtttgttttcactgctcctttttattttcatattttaatgttcatctagcttcctctttcttaatcaagttgcaacagatatatttttgcatcaaggaaatatggcaactgatgaaaataattcaatcttactatcctaggctcaaattagaatagtagacatcacaaaaaataagtgattaaactaaatcctctaccatctgaatggaccctatggatcttcaactattctttcaactgacttcctataaatatgtaatgcagtttggatatgtgttatctagtccaatttaatttcttgatggtaagaatcatacattgtctttcattgttcgtgtgttttgtgttgtttgattcaaattttgttgttagcagttctcaaattatcccttttcacatatttcaggtgaagtatggtgaaactcttaagaggttcggtgggtatgtgcaaggaccacaattcagcctgaacttatccgctctccggtccaagattgcatctgcttttaagtttggttcggatgtcgacttcattctgacttacactgatgaggatggggatattgtcatgctggatgatgatgatgatctgcatgatgctgctattcatcagaaactgaaccccctcaggattaatgttcagttaaacaacagccacactgcagcacctcaggccaaacagcaggattcagataatatacctctcaggtccaccaccactgaagacccactagctcatattaaatcagttatcgatgaggttttgaagccgatatctatgaagtccatccaggagccagttcctgagacacttgcgaagctgtcccatgaagtacttgaagccgcatcaccacaattagctgagctaataaaaccttttgttaaactggttacaccaagcaacaacaacccatctaatgggcatgctgatggttcctgcagctcctcaactggtttgccccaaacacaggttgatcccaaaactaatgacgagcccaaaatagacacaagtttggggtcgcaacccttggacacgcagaactccaaatcatctggtgctagaggtcttaagactctgtcagttgaggctcctgctacatcgggtgttaaatcttctcaaggtcaacaggcatcattatacccttccattgaggagttgctgttctccccctttttaccgaactcaggtgatgacaaatctgccagcaagggaattagtgatgctcaaagcaagggaaaatctgttatgacctctgctacaccacctacccctcctgctgctcctgctttccgtccagctcctccaattccatctctgaatgattggtctcagccaccagcacgtggatcgacattttacccatctatttggcagtctgaagctgatccaaaagccaatagtgattccagatggcgtgttccattgtgcagagctggccatccattccaaccccatgctcccctgagccgtccacccccaccaatgcctgcaccaatgagctatggaccttctccacattttccttaccctggccgcctcttgtcctctggccatctgcatggagaccttggtaataacattgagaactcaccagcacgcacattccatagatggattcagtgtgatggttgtggagtgcaaccaattgttgggcctcgatacaagtctaaaacgtaagattttaattgagctattgctctatctagtttctttttcctatctcagtatttgacatccctcctcttcgcctctttgccaacagaaaagaagattatgatttgtgtgatgcctgctttcatcgcatgggcaatgaggtcgagtacaccaggattgacaagccactcttaccccagagattactgagagaccctacattggtgagtacccaatttgtaggcatgagtgcacaggcatacgcttgcacgtgtatgtttgtcgatgcattatttagcaaactcatccatcctgtactctggtttgtataaataggtttaaggacacaaaataatatattaacaattagtttgtcctataatttcttggtttcagtgtcgcaagatccattcacgggctgcgatgaagtcaaagcgggagaaacttgaaagtcgcttcattttggatgtaactgtcctggatggaacattgatggcaccttcaactccgtttactaagatttggcgtatgcataacaatgggtctatcatgtggcccttgggcacacagcttatatgggttggtggcgaccagtttgcactgcagacctatgttccattagaggtaggtactatgcatactgtgacctcttttcagtttactgttctaattgtagttatgcatactgtgacccctgttcagtttactgttttgactgtagtttagactgcatgctatttaaaatatgtaaaatcattaaacctgagtttgtgttctgtgcagattccagtggacgggtttcctgttgatcaggagattgatgttgctgttgattttgtggcacctgcaaggcctgggaggtatatatcttactggaggttagcatcaccttctggccagaaatttggtcagcgtgtttgggttcacatccaggttgtcaactctaccattccttttgtccatataggtctagaatcttgacactcatacctatctttcttaacatctaaattctgattgcatctgcaggtggaggatccttcttttgtcagtaacaacaggactgccgctataaacttgaatttgcccccagaaagcaatatcacaaacacaagtaatttgattgatgtcaatattgagcctgtggatcaagtcttcaaccaacatgtcaatagcacaaacaaggagttacttgaacatttgatacaccaccagattgacgagcccaagaatcctgagcctgctccattacctgtgcccattgtttcttccacaacatctcttcaccccatcattgatgttgatgttccctccagttcaactgctgctgcttttgtgcctgtctttgatgagcctgcgcctgaacctgctgtgactcctgtgcctccaactgttaatgtgcctgctggtaatgcacctgcgtctgttggtgcatcatcatctgatcatcatggcattgacaatctcacagaagagaaactgctgaaggaacttgaggaaatgggttttaggcaggtcgatctgaacaaggagatactcaggcagaacaagtacaacctggagcagtctgtcgatgatctctgtggcgtcagcgaatgggaccctctcctggaggagttgcaggaaatggtaagatcacatgtgccctattctggacagtgctcacagcctcacaggcacgaatgtattggcaaggttctgaagttagctgttgtttcaccttttcagggctttgaggacactgagataaacaaggagatgctcgagaagaacggaggaagcatcaagcgggctgtgatggacctcatcgctagggagaagaaagaccagtgaagatcgtgtgctcttgagccatccctatctataacctaactatgtgtgtatatgcgtaaataatgtgacgaggtgtaaggctagcgccggccgccggggctgctgctacagtctcagggcctgcttgcttatgaactgtgtgtggtgttgtgcgactggtatatttgtcgcggagatatgtgttaagtgcgcgtgcgcgcctcttaaaaagcggttaccttgccaggtaaactgcgtgtaattactatgggcttagctgctctatgcctcttatctactgctgtgactggaacttgatggattaataagatctatgttgcgtatgttaatcgatgtttgtatgatctcgttcattctttttttctcccgatgttctattggttgccctgttggtgctgttggaatgaatgacctgagattgtccggctttgctccaatctactagtaagaatttgttgctttgctggtgctgttgactgtcgtgatgaatatctatgctctctttgcgttttgggagagccctttctttttttttggggaataccagagcccttttatttaactaaagcagcgttggtgtcttaagaaaatggttaaacaacaacaaaaatggtgagcttgaccgtatcggaattcatggcctctcgattgactgcacttcatcaaacaaagtcacaaaatggttaaacgaaaacctccaaaaaaatgttaggaatcagcaaggtaaatataacaaacacacaggcactgtggtccagtaacctgggtttaaaagttttaaacagcaaaacggttaaaacaacaacaacaaaaatggtaaatggtaaggaatcagcgaaggtaaacacacacaaacacacggctgatgcgaaacgaacgacgcggcgacggtctgcagtagttcttctgtacatacggatgaaagcaccggagcaagcaaatgctgtaatctccgatcacagattctgctggaggtaggcgtcctcctcctcctccgccgctgccttgtcctggccggcgccgtacctcgtgacgtcggacacccagctgcccagcgacgagacgctgcgcaccagccactccttgggcgtcgacaccctggggctctcggcgacggcgctgccccggcgctcctcctcggcgcgggcgtcgcgccaccgcctggccatgtactccttgacggcgccgacgccgccggccaccacctccttggggggcacggcgagcgggttctggtcgaggcggagccgctcgaggcgctggaggcggccgaagcagtccgggagcgcgtgtatctggttgttgctgaggtcgagctcgcgcaggccgagcaggtccccgaacgacgccgggaggtcgcgcatgtcgctgaagttgctgctgaggttgagcgactccagcgccgccagcctcccgatccccgcggggagcccccggagctggttgaagtgcgcgtccaggaggcgcagcgaccgcatctcgcacaccgacgacggcagcgaccgcagcttgttcaggtgcacccacagcttctccagcctcgccatctcctgcccgatccccgtcgggaggtacgacagcacgttgtagctcacgtccagctccaccagcgacctgtacgtttggatcattttgtgatgatcaccattagcgagaattgaagtttctttaactggatctggatgccattggggagaagaagaagatgatgatgatgcgtgctttggccttggctggttgattctacctgcattttgagatgctgtcggggagagacctcagcttgttgcccgagacgtcgaggatcttgaggctggtgaggaggcctatggagtccgggagggagaccaacgcgttggaagcgaggcgaagctcttccaggtgttcgagcccgcctatggcatctgggacattctgcaaattcaatgaaaatagctagtactaacagatggaaagaaaataaaactgaactttacagtgttttctagctttgtgggactgtagcctgtaaaccagaaattcttgaatggaccacatcaccacattcagttttactagcatattgcgcaatttcgtagttggaagaaaatgatttcttttttataccatatttgactcctctatgctcataattcattcgtgttcaataatcatgatatcaaaaataaacatgcgtgatcttaaaaaaaaaatgcaaaaacaattctcataaacctaactcataagtggattgctttcagtgacaattttaattaaccagcattgcgttctacccgtcatccattatttttggggcatgcacatctgcaatgtcttatacgatctgcatttctggactgaaaaactacccgagaaatgcaaaacataacaaatctccctatcacccgaattccccggatcggacgaacagttcttctaatttctaaatctgaaacgacgtgaactcgtgatccgcgaacgcaaccgcgcaacgcaatgcaggttttgcaggttggcgatcgataaccacagaaaatgacagaaacaaatcagcaattaataataccttgagctgatttcgcgagacgtcgaggacgaggaggccgcggatccggccgagctgctcgggcaggtggcggagctgccggtcggcgaggaggaggcgctccaccgccttcccttcctccgcgtcccggagcacccgcaccacctcgtagtccaccaccccggcctcctcctccccgccaccgccgtgcgccgcggccaccacctgcatgtccctccctctcatcgccgtccggtacacgcgatccagcctctcgtccgcctcccgcagcaagccaccgtacgactcgggcgcctggtccagccgcaccacctcccggctcttcgccaccttctggtcctcctcctcctcttcggcctcttcggcggcgtgggagcggaggaaggcgcgggcggagtcgacgagctcgtggtcggggcgggggccgaggaggcggagcgcgtcgcgcgccgaggagacgtcggcgacggcgcgcgtcatggcggagaggacggacgggtggcggagccccggcatgcggctgacgaggtcgaactccgcggcgcccgacggcgcccgcggggacggctgctcgatgtcccgcgcgcgcggggtggacagcgacggcgacaccggcagcagcgacgggagccgcgacagcacgtacgccaggatcgggtgcgactgcggcgtcggatccatggcggcgaccgcgacggcgacgtcacgacggcggcgtgcgtgcgcgcgcgcggctggaaggggagagagagagagagagagagaggaggttacgtacgttgttgttgccggatcgggtggcgaaaaagaaggggagaggtgggaacggccgaggggggtttataggtggaatttttatcttccggccgacaggtgttttttttcccatttttcctcgaggtataaaaataggtttgtacataaattaagcatgccttatacgcacatgcacacacaccacacgtgcgcgtacgggctgttactcgtagcccacttattattaaattttgatatacatcctgtatgtgtgcaatactatcttcgataattaatgtatgacgttcttaacattagtttcaatttgacaaacgacatacagtatcaacagtatatattaatgattaaagggagtagtagtttttttcacataacatttgatttttttctatgcattggtttataagagacggccgggcaatatattatgtttttactaataaaagttggaggtgtatttatgagttatgacaaacatcaggcatacttggcaaaatttatggcaattttgcactccagtagtccagcagtacgcatgcagcactaatataggtgaactaaaatgcctaaatcaatttactctgccagcctaaagtggagttagaaaaactacaccatcatcacagtatgaagtgatataatatagatcatcgtaaaacttaagatttgtttgtagaaacaaaacttgagattaaccacgggtttctatctttctggataagacgtttatggataaggatgcagtgaaaaaaaaaacactctcttgaacaggcgaaaacaacgtgaagcgacaagcacggggagctccaaccttcgtctccccctctcttgcggctctgaaaaattctttctcgatcgaatgcgatgcgaggcaacaattcatgcgctgctaggatgggccggcccatggacatggagactggagcaatttctctcggaatagttttatttggactccttcatctttggttcctgattaaattgtctccaaccgtaaaactggtataacatctttttcatcttaaaaaagtttttgctaacatggtaggttaatcgtggctgactagctgagttagcatgtagagcccgcatgtcatattaatctcatcttattcctcacatctccatatgtctctttccccatctctttcgctaggcggcggcgatggaagcagatcctctgacttaactgcacaacagttaagtcaaaggatcctttccggcggcgatgggagctcggtgaggatgtgaatatggaggatagcagctgcttggtgcttgcccatcatggtggcaatggcagaaagggacactgcagcagcatattgttgctgtgtatgctttgactgctcatgcggttactctccactcgtgaggggcgtcatcctcgtcattgaatcccttgtcatcgaagaacgggatggcgtggtgggtatagttctcctcccgtcgtcgacgcaggccgaggcttcttgcggcagcgggtgacgagtgtggcgtagtcctccttggctacggtgtcatagatcgaggcctccgtcctcacctggatagtggtggcagcaaaggaatccacgtcgcaaagggggccttggcgagctcccaccaccacttagcgagagagagatgagaaagaatatgagattaggataacatatatgggactcacccgctgactcagctagtcaatcgtggtcatactattacgtcagcaaaaaatcaccttttaaaccatcaaaaagttgattggcaccaattttcggagatacggaagacattgggcctattcactttgatgccattttcaaccttaccaatttttagtaaagttgtaaaaaaaagtgactatatttagtttgctcccaaattttggtaactatataagaaattctgcaaaaattttggtaagttaccaaaatttagtagggtttttttttttgacatcaaaatgaacaggctcgttatacctgattctaggcgattcgatcaggaccgacatatgag

SEQ ID NO: 62969 - DNA, 34258 bp, Oryza sativa
gcgtgcgtgctacagcttgctatccccaatctgatctatctctatgtgttcagtttacctagtagtttttttcttggaaaaatcttaatgcttcccttattgcttgaataacatgtatcggaatagcttgttggtgcatttgcgtgtctcaatttaagaatctagtattagtttcctaactgtgtgcaagtgcccgtagccttgtgtaagtgctctcctttttatactctttttttcccaaagagtaaatttcacaaaaccttgtattttggggcatccggaacgcaaaccccccaaaccggtggttttgtgttacggatcatccaaaacctgaggaccgagctgatcaagtatctatagaagttgcataatgatgctttaatcaatgcttgaattcatggatgatttgtaaaaaaggtactgtacactacattagagtcctgttaaaaggaaaaattattatgatcataggtctgtcctgctcatgcataaatggataaacctgttacttttagtgttgattaccttttctctgtattttttccctgaagatccatgcctctatttacggtgataaatatgtctacttaaacaacaaagcacaaagttccttgtttcttgctgaatcttagtacaagttgcgcaatgtgcgagtgtttttggcactaatcacctcagaaattatgctttatttatttgttagtttaatttcttaatgcaaaaggatttttctgaattcttgctagcagtgaacttgctattatcttgcaccataccacaaaaacattattaattttcagtggctattaaagaaccatgtccttgatgtaacataactgcaaggatagaagaaccattgttgtctattatgtataattgtatctctacaagaaattattatggtccaccttgtgatataaaacaaaagatacaaggcagtacattagagataaacggacgaacaagctggagtatgtaacattgtaactggctgtaaaagctttttacctaatcatgtgttttgttgccaaagaaatgattatttactctggccaatcctgaaaaattttatggtcgaaactttttggagtcagcctatctctttgccattgcggaaatttttatgaagtgcaatgggctgtacacctctcaaaacactaattacatttcacaatcactcacataaagtatgccagaatctttgtgaagagcaatgtgtagaagatagataacacagcaccaactggaattgtgactaaccaggaggccacaatttcacgcactgtctctgctctgaccctattgagccctcttgcaaatcccactcccatcactgcaccaacaagtgtatgtgtagcagatattggcaatccaagttttgatgcaaacaatactacagaagctgctgcaaactctgctgcaaaacctctagttggtgttagttcggtgattttcttgccaattgttgctatgaccctgtaaccccacattgtaagccctgcaacaattccaaaacctccccaagcaaggacttcagtaggtatgactatctcagcactgcttgctacaccttgaagaatggacaaagctgccgccagggggcctatggcattggagacatcattgcctccatgagcaaatgacatgaagcatgctgacaagacctgcatgtatccaaatacaccatatacaatctgcaattgagctcctgttggtccagctatgtccgaaagaaatccaacttgctgagcatttgccttatcagcagatgctatcttttctgcttctgaggacagtaggtcaccaagctgtttttggatcactctgttaacgattacggctcctattgcgccacatgctaatgcttgcaggatagcgattgaaaaagtcttgctgagaggaaaagcggcaaatgatattgcagtaacaccagtaaaaactgcaattggtgcagcagcagctgcagcctgacctggatttggtgcactatatacgaactgaaatgaaatagggtaagcagagaattaacttattgtcttgtcttgaacagtcctatgtcctctatttatgatgtgtgttcaataaggtgactgcctaactaagtaactcttaaattaaaaatgctgtctagcatgctgcaagtaaagttagtctagtgcttacccttcgtatacccttgtaaacaataaatgagactgcagcacccatcaatggtgaaatgacccatgatgaagatactcttgccaaggagctccagaacactgcatttacgcctccaaatactatcccaaaaccaaccatggccccgacaatacaatgtgtagttgaaacaggccagccgtaggaggaagcaacctagaaatagcaagcgttaattcatattgactctgagaaatgttaatatgctatgctcagataaccgtaaaagggagcacacaattggatctttggcagaggcatttaattttatgttaaatatttctttgaggcatgatgtatgcatttaaattttcccgcaatcatgaaaatatcttaattccaatgattaagcagatgaaacattctcccgcaattagagtcccaccaaaaatgtcttcatcaaaattgtgcatgcctagttgtctaatgattcaagattccattagtctatcccttgtaaaagttgctatatttctagtgagcattgtctttaattgtctcattttgttgcttctgtacttctgctagttgggattgttgataagatagacatcaaactctggtaattgcaagtgagctgcacaacattcacggatggatgttacacaacatcctgaaactgcatataattggattaaaatccttacgttaaaagacttcaacaagtttaaagctatgctgttaagttcctttcccttttcagttttcacttcctaccatggaagttgtttaccgtattgtggagtttatacctcaaaggaaattgtgtaatatagtacaatcaactcatagaaggttctcatgcagtaggtttcactgaatataataaagctgctacaacttactgctatcatttatttctggggcttaacctagcatcttcaagtgcaaaggtctattgattttgccttgctaggtagatcatgctattcttgcatcatgaatgtgtcgctgatggaatgtcttaaatattttgtttcatatactgaaacttgcagaagtctcagtaattatgtactgctaatggcactacatgattgcatcctctgatcgtcaccattccagcaaagctcaaaagggcggtaactgataaggtgatctaattggaatattacctgcaaccatgttccagcagcagcgagggatgacaacaatccagcgaagagcagagagtcctttccttggaagacagatgcgactaggatgcccttctgcatggtgctggtgacatgggtgcccataaggaatgcaccagagaactctagcaccgccgcagtaagcactgcttgccggagtgtcaaagcaccagaccctactgacgtccccatggcattggccacatcatttgccccaatgttccatgccatgtagaaccctgaaagcagtgtcagatatgccagtgccttcattttgttcgtcccatggaagaccactgactgcatcgccagtggcacagtgagcgctgcaaatgcaatcaccactgagattgacattgccatccggggcgatatatggaatgccttggccatctccgacagttcagattccccgttctgctcctcctcagactctgtggcatctgcttgcccgctggagccattatcagcattggcaaaggaggatattgtggcatggggaaggctcaggtgtgagttcagtgtcttggcaggtgacacaatggctgaagggtagtacctcaggccatgaatccgaggtggcagctgagcaacagggtgacggagcaggagagcggcagccgcagctcgccctcctgctccagcatgtgctcgggcaacggagaagaaaggggaagattgagacatggagtggcagaagcaaagtacaggtttgagcagagaagcaccgagaagaaaaagatgagattaagggggaggagaggaggaaggtgaatgagaagcggtggccataggtgtttgtggaatgaagtgagcattgttttgtggatggaggaaagggcttgctttctgtggtggcccagctcgggctgagatgaacgagtggtggcttggaatgagtggtggaaggggatacgagcaagattccagcctaatccataacctggggttgcagctgaccacttgactgttttcagtctgcgttaccatcagggccacccttccctccatcgtcttttttaaagatctaactgttgtctgtttctgttgttttgattctccagtgcaatatttagcatgacattaacatcttgcatcagtttaatatggaaggcttctgaagatacttgcgtctgtggttctaaagctgatgccatctactgtgcagataaatgaaactaatacagttacatgtgaagttctcatgttatatgtactgttcttatgacagaaaaacgtactgttcttatgacacacaaacggtgactcttcagatatacagtcggtgttagtaatcaagattttccatgctcagaaatctatttaattgcagaggaagtcaacactggtctggcttctcatgggtatcagggtatgcatatttcctcttgttcgactaataaatgtttaacaagtgaacgcagctgtggtccaagaataagattgtaagcatgcttatgcgtttgcttcgtgtttctttttgttggtgagatggaccggtggttcccgtttggcagtagcgattggagcgctgctggccaaggaccacagaacagaaaatcaacttgtgtgctccaggccggatgctgaagagaagaataatcagcgtctttgtccctgtatcaggtatggaatacttgatcttgtcttctacgatcactagagattggccacaatttatcaggtatggaatacttgatcttgtcttctacgatcactagagattggccacaatttatcatttagcagacaccgcactagacacattttctgctcatcgagttggccagggctcaggtcgacattttttttttccctgcaagtcgtgtgttgtggatgaagtattgtgtctttaaagcgtgcacagtttcaagatttcttatggctgattctccttttgccgacttcactttcgaatctgtagttaggtataagaatcttcctgtgatttcagtttggtgttgcttctgaatttgtacgataacttaaaaacaaagatactgagtagtagtatacttgtagctccaaatggagatttgtaactcgaccaaattgcagggcaccactgagccatttgcaagttcgacggccgcaaacaggagagatagaagcatacttatatatataggggagagagcgcaataacataggaaaaaaatgattgaaattacgtgaaaaatgtggtgttatattttaagcaaaccatgtttatttatcggtttgattttgagatatcaaattttgacgtacaatatttccttgaaagtctaatcaaattatggggagtaaaagtggtaactctagatttatgatcaaaataacatagtgaaatcccttcacaagaaatgactcagtgaagtccatttaatgaataataatcttggactcgaattgttctgcgattttgctatatctcacttgaaagattttttctttatctctcactcgattttctcactcaaatttacagtgtattttcttgtaaattatagtgtaatttatgaaacttacagtgtaatttttgaatcttcgcatgtaagttttgaaatttatattggatttggtctttttcttaaagatatggtcatttagtatctattatggtgtttcttagttgctttttgccttttactatgtctattggattttaatccaaagattaaaaatttatatgatatgatcatagaaatctttcgaaagatgcataggtactccttgttttggaaggtaacgcaaatagccaatgaaagcgttttgaaaacagatcagtattcgctgtatgtggactgtggtggtcatttcatgggcctgaggcccttgggatcagcctgtgctcgcaactctatcacctgggccttgtgtagccgaccattccaagtcctacactcggactcaaatcactcaattgtcctttcctttgcagacattgatccttcctatggccggctgatttggaaaagcaaagtacccggacattgtgaattgtttgtgtggctcatccaatcaagcgatttcaccaatgtttaaacggccgttgtatgtgtaatctttgtacatcatgtatacttaactagacgtcatgtaatttgccttagaaagtaacaaagccttctctaaataactatttcctctggtcagaaagtggtgtttcgaaatgtgtgtaattaacgttattaaactttgacacttaagttctctttgaatatttcaactgaatatttgaaagtgatatggttagagttgtcttaaaatagttcaaaatatgtagagtaaatttcataaattccacctattattatggtccaagttacacaaaatcacagggattttgacatgtggcatataaacccaggtattttgtactaaagcttcacaaaactacatcgttaactattttgatatattcctatttgaaaatttcaaaaaaagtaatatttatatgatggataaaatatttataaatttgagatgtgattgtagaactcaaaagtatagtagatcaaaatcaaaatgatcaatgatcaatagtatggttttgtaaaactttaggatcataatatctggggttatatgtcacatatcaaaatccatgtggtttgtgtagcttgaaccataatatgtgaggttttatgaaatttactcaaatatgtattatacatttcatttaggttttatattagtaattatagtaattaaacatgtggattggcaactgtgtcgcggtctatgcgagggggtatgcttttacagtagggtagaagactacttcgaatgaatacaactcagaatgaaactcagaatgaagactactctaggttcttatattttggaacgaagggagtattaggttagaaattctgtgactcattacgtgttacagcaaccatgatgacaaaagcagggcaacattgtaccgtagatttacatggaaaccgtcaattttacctcaaactagctagctaagactgagaagattgttatgcgaacaaacgcacacaagcttaccgcgcgtatatgacatcctttctcttttcgttacaaccgtatttgcttttccgactatcctaacattttacgtgcaacatatcttgtcaggagttgagagcctacacgtttatgtgtcgtagcttgtttggctgagttggctcaattactagtttggatcaccttaagacaagaatacatatacttttttattatttaattcaagaattagttttaagatatttttgaaaattcaagtatcattttattcttgtacaaagtttttgaatataaagtttttattcgtgatgaaagtttattaacataaagttatacaatttagattttatatggtgaaaagtcgtttactttcatagaaactagtatggtggcccgcgcagattgcgcggctagcatcattatattttctctcatataatagcatatatgttttctcattatattgttcaaatatattaaaatgacaacataattttaaattttgcaataactttaaaaaactactaatgtgtaatattcatattatactttatatacgtgttagttattaattactttttaatatcaaattttagttatttataaattatatatattcctatatggactctagactcgtcttttaatatttctttttttttacttccgatttttctgtaaattgtatttctatatagactttatactcttcttccaatattatttatttttatttctgaattttcaaattatattttatatacgtgttagttattaattatttttaatatcaaattttagttatttgtaaattatgtatattcctatatggactctagactcgtcttttaatatttctttttttaaaattccgaattttctatagattgtatttttatatagactctatgctcttcttccaatattatttatttttatttctgaatttttattatttctaattgtatttctatgtggactctaaactcatctttctatattctttaatttttaatttcgaatttcaattacttctaaattgtattcctatatttatattcctatattgaccttaaactcttattcccatgtttttcttaattttgaattttagttatttgtaaattgtatttttatacggactctaaacactacttttaattttattatatttattctaaattttagtaagttttaaattcctatatggactctatactctacttctaatattccttattttttagttctgaatttatatttttttcttaattgtgtttctatatagactctatactctacttctaatattccttatttttaattccgaatttcagttatttcctaattgtatttctatatggactctatactcctcttctaatattccttatttttaattccgaatttcagttatttcctttttctattcctttaattataaaatagatttgctaggtaaactatctttaactattgtagaaagtttgtgtataaagatttttctcctgtagaaagtttgtaaatatattttttattcatgtagaaaagcttatgagcagaatttttattcattttgaatagactttaataggaatggaaaagtttaataatctagtaactatttgataaagttttgctatctaatattctcttcatttgtgtttaatagacatattagctctgaaaaagttttctattttgatcatcatctttttcttttgccacacattcttgggtttggatgctgtcgttgctttgttttagtcatgcatgcacgcagtaggtcttgtgaatcgaatgttcacccattccaatcatatgcagccacgtctcccgtacaaatgcaactacttgtggattcccctatgcaccaatgtcccgtgtattgagttgcgtttttcttggtcactgcgttagactcaaataggtcaatcatacatgaatagaaggtgtagaacattcttctagaaaacatgagaccctaattcaattcacatgttaaccccgggtgtgtttagttcacgtcaaaattaaaagtttgattgaaattgaaacgatgtgatggaaaagttgaaagtttgtgtgtgtaggaaagttttgatgtgatgaaaaaattgaaagtttgaagaaaaagtttgaaactaaactcggcctatatgacgcggatatcgtaccggaggagtgaacagtagccacacatgaagtgatcatgttaattacatgacgaatagtccagtcaaccaatttttttcgttaatttaacactcagtcagccaccattgtctaatactccatccgttccaaaatataagcatttttagtatagcgccaagtcaaactttttaaatttaactattagcaacaaaaacttaaaaaaaattaatcatgtaaatttgatattactatctttatcattaaacgaactataactatttttatttaaaatattttacttttatagatattatagatcaaattaatatttcgaaaaccatatcgaaaactaaaaataattatattttaaaacggaaggagtaataaaataagagactgagcgaaataccaaccaaacaaaacaaaaaccccccaaacccctcctcctctccgctcgcctctcgcctcgcctcgcgcgcgcgcggttcggaccctctccgatgggcgccgcggaggggtgctgcggcggcgccgcgatcgccgccgccgccggcgtgatcgaggaggccgaaactgtggtgccgccgcccgccaccgccatcgcctcgtctaaaggtactcactctccttgaactccctctctcttcgggtgcccccctttgctggattgggcttgtctgcggaaaatgttagcgcctggtcggtggcgttccgtttatgaactgcttcaggtgtgagtgaccacgatgagagatcagattggagcgtagggaaaatgtttgcctaaggtgttttggttgtgtgctttttttttttggaaagtttctacgagccagagtgtcattgtgttaggaattttgtgtttgatcttagcgttgtgtttgtcgaacgagtgaatcgatgctcccccaccaaataaaaggtctgaaatattatcttgtgttagctaacagaacgatgccattctgccatttagaatggaaatgcttgatcaatataatcaaaagggccttttaatggttccatatgcaatttatctggtgggcacatgcataattgagaaatatctgcgtaagtgtgtagctatcttttacagatacaaactttgtgtcccttactctgtaattaaattgcaaaagaaaaaaaaagagtcaaatgttttctatgatattccctttgcctgccacaatttgtgtatttggatagtttaatattttctgttcaatttaagcatcagtacatagctatgctatatcacaatgacttgacgttatgcgggagaaacatttcaggaatccggatcatgacgaggacacagaaaagccaccccttagacccactatctgctgctgaaatttctgtggctgtagcaactgtcagagcttctggaagaactcctgaggtctctgtccatctactacctttcatacaaaattatgtactcatgttccaaatatataattaagtcactcccgaaattataggttcgagacagcatgcgttttgtcgaagttgtgcttctggaaccagaaaaaactgtcgtggcattagctgatgcatactttttcccaccattccaaccttcactgcttcccagaaccaaaaatactcctatcattccaaccaggctgccagctaggagggccaggcttgttgtctacaacaaaatgacaaatgagactagtatttggattgtagagctctccgaagtgcatgctgctactaggggtggacattagagaggcaagctcatatcatcagaggttgttccaaatgttcagcctgcaatgatatatttccactttctatagatttattgggcacaattttcttgattttgaccattttattcaaactatttaacacttaatgagattatatgtagccaaatttattttctaatgagcatgtggttctaaattattgctggtgtgctgtggtatttgccactaaggccctgtttctttcagcttaggattattataatccagattattgggagtaagctgaaagaaacagacaacttattgaagtagcttattataatctggagcccagcttattataatctgataaactcatttaggtgagcttttccagattattgggtgaaaaattacccaccatgccaccccactccctctttagacttgcaaacccaataatctaggctctaataatctatgaaagaaacaactaaccgcttattctactacagattataacaatctagcttatagtaatctaactcaataatctagattataataatcccaagctgaaagaaacagggcctaaaacaatcagcggaatcacagaaacttagtttgatgcttactttgatagttaagcacttagtgaatacttatattaggtcaattactagatttatcttgtagtgcttgtgtgtattacaggatgccatggaatatgctgaatgtgaagctactgtgaaaagtcacccccctttcattgaagcaatgaaaaaaagaggagttgatgacatggatcttgtcatggtagatccatggtaagcttggtctggttaatttctgtagttaataaacgctttataaaacattcggggtttgctgtcattgtcttactgacgtagaatccttccctcattgaaaagaaagattcactcaccaaataattcttcctttagccaactgcacttctaccgtctttctccatgtctttgatttgtaaagaaacttgtaaacagtttttttagttgtatcgatccagtcactcactaattgatctagcatgctgactaaacaaaaggatttccctacatccttcttctcgtcctcctccgattcttgttgcgaaacaatagaaccttgaaacatgacctgttctagttgaatataggtgtgcaggatattacagtgatgctgatgctcccaatcgaagaattgccaaacctctgatcttctgtagaactgaaagtgatagccctatggagaatggttatgcgcgacctgtggaagggatccatatcgtcattgatgtgcagaataataccgtgatagagtttgaagataggaagtttgtccctcttcctccaccagatcatttgagaaactatactccaggggaaacacgaggtggtgttgatagaagtgatttgaagactcttatcatcaatcaacctgatggccccagttttcgtgttaacggttactttgtggaatggcagaaggttaactggttatcttctgtttcttgtttcaattgttgagcacttgagctactattagataaaactgactcaaaaaatctcacctgttatttctattgaacagtggaacttccgtattggctttactcccaaagaaggtttagttattcattctgttgcatatgttgatggaaaccgtgggcgtcgacctatcgctcacaggctgagtttcgttgagatggttgttccttatggagatccaaatgaaccacattatcggaagaatgcatttgatgctggagaagatgggcttggaaagaacgcacactctcttaaaaaggttatttttgttgttccctgttagtagtgttagcaaaaggaacacaggttttggggctaatttaatttctattctccactcaatcaactatggctggttggatacatatatataggctagtggcttacaccataaggtataggctagtggcttacatcctaagaaattaggagtggcttacatcctaaggaaaactaggagtggcttacatcctaaggaaaactactagtggcttatatcctaaggcagccaactattattccaaaaatagatgttaaaagcatatagtaaaaacaagacttaatctgtcattctccccctaagtcttgtgtggcgccttttggggaatttgaaccattccaatcctggcgcgaaactcctggaacttgacccgcccgagggacttggtgagaagatcggcgagctgatcctgggtgttaatgtagctggccttgatgctcccctcctccaagcagctccgaatgaaatgatacttgatgcggatgtgcttgctgcgctcatggaagacgggattctttgccatggccaaagcggacttgctatccaccctgagctccactgcttcagcgtctctgcccaagagatcacccagcagccgagccaaccagagagcttgagttgaggcggttgtggtagtgatgtactccgcctcgcaactggacagggccaccacttgttgcttgactgactgccaccacttgttgcttgaccgactgctagctgatcaggcacttgccgaggaagaacagcgtgccactggtgctcttgctcgtgtcgctgtcaccggcgaggtcgctgtcgctgtacccgatgaagtgctgcgcaccgggacacctcgggtagtgcaagccgtagtcggtggtgccctcgacgtaacggaggatcctcttgacagcctgctggtgctctgtcgtcggtcgctgcatgaaccggctgacatagccaacagcaaatgccaagtctggccgcgtgtggacgaggtagcgaaggctgcccacaatacgccggtactgcgtggcatcgacctcctcagccgtgttgtcgcggctcagcttcaacctttcctccatgggagtgtaggctgggttgcagccggtgagcccgcccaactcgacgatgcgcttggcgtaggcagtctggcgaagggagatgtcagagctgtcctggtgaacctcgatccccaggtagaaagagagaaggcccaaatcgctcatctgaaaagtcgccttcatctcctccttgaacgcctccacctcagcctccttggtgccggtgatcaccaagtcgttgacgtagacgcctaccaacagggcattgttgtccttgccccgccggtagacaatagcttcgtgagagctctgctggaaccccagttgcttgagagtggagtccagcttggcgttccaagctcggggcgcctgccgcaagccgtagagggccttgcgcaggcggagaaccttgttctccttgccggggatgacgaatcccggcggctagtggacgtagacctcctccttcaggtctccgttgaggaaggcggtcttgacatccatgtggtgcacacgccatccttcctgggccgccagcgcgaggaggagacgaacagactccattcgcgcaacgggcgcgaaggcgtcgtcaaagtcgactccctcctgctgaacgaagccgcgcgccaccagacgcgccttgcgcttgatcactgccccggcctcatccttcttgagcttgtagacccacttaagggtgatggcgcggtggccggcaggaagatctgcagcacccacgtccggttccgctcgaccgcgttcatctcgtgctgcattgcagtgcgccatgccacatctccattcgcctctgcgaaggagcagggctcgccgtcctcatgcgctaggtgcagctcggcctcgaagtcgcgcgtcaccagtccaaggacaggctgatcactgaagatgctgtccacggtgcggtagcgcagaggctcgtcgtcgtggtacgcatcaacacgatcctcgtcgttggacaacggagtggcgaactccaccggtggtgtgggcgccggtgtaggagagcggggcgtagccggtgatggaggagtcgctggtggtgtaggtggtggaggactcgccggagctgatggcgagccgggtgccgaggtggatgagctcggtgaagatgagctgctagctcctctggctcccccaaagtggacgtagtcgacgacgaagtctctgagcgtcgaagtcgagccgtcgtccaccgccttgtcccaagcccaacctcgcccttcgtcgaacacgacgtcccgagaaatgcggacgcgctgcgtcgcagggtcgaggatgcggtaggccttgacgccctccgcatagccgatgaagactcccggcgagctccggtcgtcgagcttcccgatgtggttgagctccttggcgaaggcgagacagccaaagatgcggaggtggctcaccaccggcttgcgcccatgccaggcctcgtacggcgtcttgccgtcaagggccttggtgggcgagcggttgaggagatggacggcagtcatcaccgcctccccccagtagattgctggcatccctctttgcttgaggagggcgcgggcagtggccaccactgtctggttgcggcgctccacaacgctgttctgctgcggggtgtatggcacggagaagtggcgttggatccctcgtcagcgcagtacgccgcgaactcagccgccgtgaactcgccaccgttgtcggtgcgtagcacccgaagcttgcggccgcattccttctccgcagcaacttgatggcgcttgatggtgtctgcagccgctgccttggagtcgagcaggaccacccacatgtagcaggacacgtcgtcaacgagcagcagaaagaagcgccggcctccaggtgtggccggagtcacggggccgcagaggtcgccgtgcacgagctccagcttctccttggcgcggaaacttgcttggcggggaaaggggagtcgccgctgcttggtgaggatgcaggtgttgcaaaactgctccacgtgctcgactcgcggcatgccctgcaccatctccttgttgccgagctgcttcagggcctcgaagttgaggtgcccaaagcgctcgtgccaccgccatgcatcatcgtcgcggccgtctgcaaggcagacgggctacgccacctgtacatggagaacatagaggcagttggcgcccctgttcaccttgacaagaaggcgacgatggcgatcccaaacccgcaagaccccgtcctctatctccacgcgcgagccgttctcatccagttgtcccaaactgatggtggagttcctcagcgcggggatgtagtagacaccggtgagcagccggtgctcgccggtcttggcggtgaagaggatggagccgacgcccttgatctccacggcggaggcgtccctaaacttgacggagccttgaacgctggagtcaagctcggagaagaattcccgccgcccggtcatgtggtgagtggcaccggtgtcgaggcaccatccgtcgatcttgtcgccgcaggatccgttgctgaggaagacgtgggcccgcggctcgtcgagttggaggggcgtggtagcgtcctgtgcgggagtgaagtgcggctcgatgcttctgtgtacgaaaaacagagccacctcgtcaccctccagcgcttgagcgacgtgtgcttgaccgccgtgcgtcgcctgccggcagtccttggcccagtggccggtcttcccgcagttgtggcaggtgttgtcgcggctgcccttgcgctcgccatcggcgccgccaagagtgccactacgcgccttctcccacttgcgtggtcgacgcttgcggctactcgacgatcctgaagccgaagagcctgtggcctcccccttcttctgctcctgctggcgggcgagccactgctccttggtgaagaaaagcttgccaccaatggtgatcggctctgagggaggtagctgcttgcggttgtcgacggccttgaggcgacccgtcacctcttcgatcgtgagctcggtgaagtccagcagcgtctcgatcgacagagccagctgcgtgtacttctcggggacgacgcgaaggagcttctccacggctctctccttgtcgatggtggtgtcgacgagctgcgccaaccgctgctgcaaggagttgaagcggagaacgaagtcgtcgatgtcctcacccggcttgaaggccaggttctcccaatcctgacgcagcttctgaagcgtggacctgcgggcgcggtcgctgccgatgcgtgccgaagcgatggcatcccaggcgtccttggcgatccgcttgttcacaatggaggactgcatctccgtcggaacagccgcaaggagcgcctccagcgcccgccaatcttccccgtagtcgacgtcgccgtaccagaccgcgtcccacatgtggcgcgcctgcaatttcaccttcatcaccatcgcccactcgacgtagttagtcttggtgagcatgggccatgcgccgccaacatccttgacgacggtctgcacaacgggaggagagccggagggtccacggcgaccacggcgcctgtccggggaaggggaggcgcgctgcctgcgagggctccgtgcgccaacgtcccgtccaccctgctcccggtcgaagtccagttgtgcctcaatcgccgctgcctgctcccggagtcgctgggcctccagggcgcggtctatccgaggatcgcgccatggatcgcgccgctcctcctcaccgcggtggagatctgctcctccgcgatgggggctgaagtcgcggtcgcgtcgacctgcgtgtcgatcccggtccgcgtcgcgtcgcacgcgggccgcgtctgcccgctccaggtcacgccactcctcctcctcctcagctcgcaaaacagcagcagcagctgcagcctgcctggctgcctccgcggtgcgcgctgcttcagcttctgccgccgcgagacgcgccgcccttgtggctgcctgcagccgcgcctccgcttcctcacacgccgcgcgtgcttcccgcgcagccgcttgcgcctcctgcgcgacccgcgcagcagcagtcgcatcgccgtcgccctcagcgtcagccgccgaccgcctgctgcctcgtccactggaagtgcttgaggcatgggacgagagagagggggaacgaatggagtggagagacattttggatggggaatcgatggaactcagataaaccttgctctgataccaattgttagcaaaaggaatacaggttttgggactagtttaatttctattctccactcaatcaactatggctggttggatacatatatataggctagtggcttacaccataaggtataggctagtggcttacatcctaagaaactaggagtggcttacattctaagaaaaactaggagtggcatacatcctaaggaaaactactagtggcttatatcctaaggcagccaactgttattccaaaaatagatgttaaaagcatatagtaaaaacaagaattaatctgtcaagtagtacctcagttaatatactaggctgagtctaaggtgcattggaccggcaactttcttgttctacgtgagcacatttcccgaactgcttaatgatattctttttttcaaaaaaaggtatataaaaaagtatcttttaaaaaataaataaatccaatttttaagtttgtaataattaatattcggttgatcatttgcggcttgtcttgcttctcgtgccgctgaaaatcccaatccaaatgctagaacaaacgcagccttacgataaaatttcaaatcaacctgatttgtttgaattaatacagaagagtaatttacttgaacttcttccatttgcttattatttttctttattgtcttccaagaatttctcatttcatattctttaaaagtaattgaaattgtgttctttaggcttagtaatgcttcatgttgcacctaaaagctgatgcccagaatttttcgtatggttgcacctaaatgctgatttgacttaattttgtttgtttttgaaaaaacttaattttgtttgttatactgtagggatgtgactgcttgggtcttataaaatattttgatgcacattttacaaattttactggtggtgtggagaccattgagaatgttgtttgcttccatgaagaagaccatgggatcctctggaaacatcaagattggagaacaggattagctgaagttagacggtcaaggaggcttactgtgtcatttgtatgcactattgctaattatgaatacgggttctattggcatttttatcaggtgagtagttcaccttttcagtggaatgtctacagacacaattatactttcgaaaggaactctagttcctgatatgtttttttgttggttgcaggatggcaagatagaagcagaagtaaagcttactggaattcttagcctaggagctctcatgcccggggagcaaaggaaatatggtactactattgcccctagtttgtatgcaccagttcaccaacatttttttgttgcccgtatggacatggcggttgactgcaaaccaaatgaggcctacaatcaggtaggctgcttatcaaccatgttgtgtgggcttctattttactgtaattttgacttcaaaatattgccgacttacttgtccacctgcactggctgcttctagtacgatattgttccatgcctttgtactttgtttattttcgtcttactattacccgtctatattatgtataaacagctaagcttcctttacttttctgagaagtatgttagtttattctagtccacgatttcatgaagtcctccatttctttgcattattatatagtaagatgtgatactgctgcctccttttccattccaggtggtagaggtaaacgtcaaagttgaaagtgcaggcccaaataatgtgcataataatgcattttacgctgaagaaaaaaaatttgaaatctgaactacaggcaatgcgtgactgtgacccttcatctgcacgccattggattgtaaggatttgtgtgagaaacattgtatcgtcgtgcaaactcaaactttctgtgtgactgacactgctggacgcatgtttgttcaggttaggaacacaaggactgtaaatcgtactggacaaccaacagggtacaagctcgtacctggttcaagctgtcttccactggccctgcctgaggcgaaattcctgagaagagctggatttttaaagcataacctttgggttacatcgttcaaaaacgatgagatgttccctggaggagaatttcctaatcagaacccacggattaacgaaggtttagcaacatgggtaaaaaaggataggtccctagaggagaccaacttagttctctggtaagttgtcaccttctaacaattgctgtcgatcttccatgttcatctgattttctagcttaattatggcatatctgaaataaaaacatgtcatatgcaactacaggtacgttttcgggattacccatatccctaggctggaagactggcctgtcatgccagtggaacgcatcagcttcatgctaatggtatcactttggccttcgtttctttctccattgttctttatattacttagatggttttttgctgcgaaaagatagtattcttgtcctaattgcttcagataacattacgactttacaactcatctgaaaatggaagctatatatattggtttggttgtccagcctgatggactcttcaactgctcgcctgccatcgatgtgcctcctgggcctgatgtttagtcgcagaaggatattcaggctgagctgatttcaaagctgtgatgtgctgcagcttcctactgtggtgtggtgttttagcaagcgaacttgtggtgttacgatttctttgctgtggctctcgtgctgtgcgaatgtatgattgctttgctggtatatatagctcaatatttctgctggtcagttataagtttgtaaaaagtatttttggtagacgagcgccctgtcgtcctcgcgcgggcaaccggggcgaaccctagcccccggccgccgtcacacttcactccccttccccaccttgccgccaccgaagcgtgttgccggaaaccgcgcggcctgccgggatggcggcggcgaggctcctatccccggcggcacggctgtctctacgcgaaggggcggcgcggaccgtcgggaaggctgcgcagcggcgagacgttgtggcggcggatccggcgccgccaccgatggatctggcactcccgcggctggatccggcgtcgccaccgccggatcagggccatggccacacgggcgcggcgttggtgcgatgccgacggccggcgaaggtggcgaggcgcggcgtcggcagcaaaggcgcgggcgacggtgatagtggtggaggcgcggtaggcgcgacggcggcggaggagcgggcggccgtggtagccgcggaggcgcgggcgacctcagtaggcccggaggcacgacggttgtgactgtggcgtgcggctgtgcctggccggcaattggccggcaggcgcggtggctgtggctagctggcggccaggcggcgtaagacatcggcgtggagcttgtggcgactgttgcgacagcggctggatggcggcgaggtggctggccgtgactgcggtcagcagcggctgcggtgatggtgaccgtgattgtgattggaggaggcatggcggtctcagacggctagccgagggcgtggcagacggccgcacctggctgcacggcagcgattggaggggtcggaggccggcttggcgcagagaggcacagccgatggcagtagtggccggcaaggcgcgagaggcgtggtcagtggcgaggaggccggcttggcgcgagaggcgcaaccgatggagggaggccggactggcgcgagaggcgcgtccggtggtggaggaggccggcgtggcgtgatgaggcgcggccgacggtaaaggtggcgaccacggtgcgaggaggagctgccagtgggtgtggcgcggtcttcggcacacgaaggctggctggcagggggtgtcggtgcagtggtcccacatgtcggcagaggttgagcgatggtggagcatcgatgtgtcagccgtggactcgcaagtgatgagcagccggtgaaaacccagcccggctttggccggaccgacaacgatggttcattccccctcccgagggcgttgtcgtgccatctcatccctcaagggtggttgcctggtgaaagtccagtcttggcacttttgagcccctgacggacggcggcagcagttttccgctacttctctccttggagacgtcgttcaggcatccccttaccgaaaccactcgaacgattagggcaatcacgctctagatagagttgggctttgtgttggttgtaagggcgtttttttgggcgttcccgtttgtgttccgttgttcgtctagcggcggtcggtccggtattagccttctcgcgattatgtgtgttggcgctgtcggtgtgtgggtggtataatttttttttcctttatcttggttacgacctctcagggttgtaatcttataattttttttctgctctatcaatagaacttcgcactgtctcgtgcgagtcgttaaaaaaaagtttgtaatgaagataagctggttcagattttgtgtaagatcatggtaatgaaccagtatatgttttttttccctgtctgaatcttagcaaaatgttcagtccattttcttgccagtgggtcggcaacttgactgggcatttcccccagctgcccagtcgacaaaccatctggctacatgtccccgaatatgtaattcttaaaaaataagagctagcttctcaagaaaataagtagataaaaaaaatcgtatgttgcttaagatgcttattgcgattgtttatccagttattaatataaacaaaattgctcaagatgattgagcacttatgcgtcttcatttttgctcgaatcaagtgcaatcacccaaatacaacttttacagtggtatttatcctctgtttttggttctttaaatttttatatgtatgcagtaaacagaactacttaagcacaaatttgctctgctttagaaagtagttcctggtggtggctaatcatggccgagttgctagaagattgcaactttgcaaggcttttagcataaagaaggatagaaagttgtatcggccatgaaacgatggctgggaaagcctgggattgcctattggatgaagcattgcaattggggaaagcagcaatgggatattaattaaccatctactctctcgtcctatattaagtgtagtaataggttccatatcgtctgaccgtccattttatttgattttttataattaatatttttttattgttattagataataaaatatgaatagtactaattattttttttaatttttttaaataagatgaacggttaaacgttgaacacagaaatctataaatgcattttaaatggaacggagggagtacttagaaatatccttaagtggcaatccatcaccgttagtggtgtactgtttattggtatttaggtgcatatcatccagatatggaccttttaaatggcattggcttgttcaccttaggctagttatggtttgtggtcactagatgaatgctatcatcatcatcatgctcaatgaagaacgtatttactctcattcagtcgccttctcactgattgtgttgggttttctctggcttacctttttttttcaggtataatatatctgatgttgattatatttattttcttttgctttatcccttctgtgtgctgtattcctccacaggggcagacggctaccattactttattccaattggggtaggccaggtagtcaggtacgtggtgtgtgctttgcatcaaggtagcgctgcatcatatccgatttgtgccgcactatacctagcaagcataaacttacctttgcatccttttcgtgttaccatcattttatatctgcaaatgtttttgaccaactaccaagccagcccaaaattaattgttaccacttcataggatgaagacactttgaagccactactctcttcacagtacatgctatttttaatgggacctataaatattatatatttccgtcccttacatttttatatcaacccttgtttcattttaatttacatatgcacgatagagggtgatgtggagccgcggagccgcctcactgatgcggcaagctagagccagttaccatagcggtatattgttcatgcacctacatctcttttttttttttggtaaaaatggtcgctaacaacacgagccaggccgtcccatactaacaaccaaataacccttatgtgccatttagactccgtaaccctcctcctagttctgtcaccgagttcgaacactctatggacttggaggaatcactctagctaaggctatgttctttttagcctattcactaaattattagattattgaagcagattatttactctacctttcgagaaatacatttccttaagaaactttattttactgtattgcttagaccgtttgttttaaaatatttgctaagtttatttcaagatttttagtttagactacctccgtccttttgactacgtatctaaatttgttggcagtgccagtatatatataatcgactagatgatctgtggtaaaatttcactcaatcatatagatcaaacagaacgttacgaggccaacagatcgcctaaacaggctaccaaaaggaaggacagaaagagaagcacagcacaaaggtgagcaccactttgtgatgtgatgcccttgttcagttctttgtggcgtagtgctgcagctggtgcgaagcaacctgccaaataaaagcacgcaaattggctccagccgcagacccaggattttcctttgaacttgttctcgtgggatcatgctcctctaccttcaaaggtaggtgtctttatcactgacacgtgcacctaataaaccatggacccacttatcagtgataaaagtacggtgtctttgaaagcagaggatcccaatccgttctcgtgatgactgttcgtctggttttttattgaggatactcgtttggtttaagtccgtaatatcgtgttgtgtaagtatatttagttggatggtttttagtgtaattaagattttgtgcgaggaactaattcacatgttgatgttaatactgttaaaagaattttttttcatcaaagaaatatttacatcgaagtagaagaaaatgttctcctaaaaatgctctacaatacaagagatatataacattttagagtttatttgaggctctgtttaaaggaactagatattctaagaagtaactaatgaataactagtttgtgataagagatcttttaaggtgcttgggaggtactcagcgtacctttcaaactattgaatatcaaccgttgattgctaaatgtgaatttagaaatagaaaaaacacgacgatgggtaatttagtaattttttctagtcctaacaacttctaacttcttcctgattgtttgccgctagcccctactctattgactgttgctcttgtattacttttgctcactaattctcatctctcgctgttgttgcttacattattactttttttttgcagggacattataatagttacttattaggagataggaatattacataaatctatggtcattcacagtatcacatctgctagtcttttgaaggcatttttcttctctatctttcggacgacctgagcatgccggtgtcgaccacgtcttaattaatccatgaatgagctaccaaaacttcaaataatatgacattccccgttctgtgtagatcaattttcataacaaaataaatccgtaattgttcacaatttcatgtaatccatattagaaacttcgtaatgaaacaaattcgagaagaatcgaagaacttatatatgttatagtcatttccttttcatatctgttagattgatataataccaagggacaaaattacctatataccctcccacttaatctctatttttgtacctggcccaccttttttaagtacctttctatgggcaccttgtatcgtaaaccattggattgtacctaatcaacggttaacgtgattttcaagtaccggaaaaagtctcttgtgataatatggaaaagctaagtttcacaactttcagctcctagttcatttaatctaaagttgtaggtggcggaacctcggctaaacagggccttgagtaaaagttacttggtactagtgtcaatccatgattgcactgtcagtactcttgaggacgatgtgttgaaaaagatgatacatacatgtagggtacatcaccaacctatccagatattggatgtgagacgagtcggaactcaggaagcaatagttgaatgtttggatttaactttttaaaatgataaagatggatttgtattgatcataaattgcttcaaaactataactgttatatttttcatagttttatacttaaatagtttgtaattaaactagtgtcctggtgagtgtgtggtggttcaaaacatgacctatttgtgaccggagatggtgtgcattatcggctctgtttgtttaagtcatggctgataagccgtagaaaaacaatgaagaaaaaataatttataggtaaaaaaccctatctcttttaaacaaattttaatgtagctatactatgtattcggatcttcaattggaaattttaaggcattaaggtatgctgggtggtctataatattgaggtttcaccttaatttgttttgcaacaaactagctgacgacccgtgtacctgtaacaaatgttttaagagatgaaagtaaaagcaaaaactacaagtttatagcattgttagtcgattaagcacatagtgtcatctccgaaggtagccatactgaaatatgttgctagaccacctctttttacccttgtctattttcacaagctatacggttgaacaatacaagattggattcatctatgtgtggaaggtgaacttgaaggttttgtgtataaccctttactatttctataataagcaattctagggccattcacgttttgtagggaccttatgcttgtagtcccacgtgtctgtttatggtgttgtagataatctcggccaccaccactaacatcatttaaaatagtatagatatttactatatttttatttcatttttttgtgattatgcactatgaatgtgccccttaatatatgtccaattatgctgaagttgaagtgctcttattacggttgtatcacctttatgtaaccataattggttgagtttaataaagtttccattataaaacatatgttcaaagagatgagcaccaataataattttatgatcttgctagaattatataaaaaaacatatacaagtatgcaggggcatagacaagcctaagataattaggcttgtgtcccaggcttgtctccttattcccttgtaaattatttcaaaaattcatagaaagtttaaagattgccctatgtttagtaaattcatggcttctccttgcatgtatgtgtgatcatgggaaccgagaattggaccctatccagtgaagcatacctttttttttcattgtggttatagcaaattttctttgcaagtttgttataaataaataccgatggatattaaaaacgcgtaagacgtccgatgacaaagaaatatcaaacacactctatgtcaggccccgccaccccttctctctctcttcccctccctctttccattgaacgcatcaagcccctttgcccctcccctatctctctctctcgccatttttcgttagcctaatatacaggcgcagggtcgtctaccactatagccaaaatcttcggcgagagctctgacattgttgtggtgggaccctggcctccatccttttcctcttcctcatctccgctactggtcccctccatggaggaaagtttgacaggacagcgctaggccgtaggcgatgatgactgtattcgaaggagttggcaaggcagcggtagggctcccatgatagaaaatcagaagctcttgcagcaagggaggcaaatccattggttggggtagaagaatgtaggaggtaggcatttttttttctttttggagtttttttttcgggggggtgttgcgacctattgtttttcatgttgcacattggtgtacttgaagtttcactctatttcgattgtatgttgcacacttcgattcttgggtgttgcaactagtttgtttgaatgttgtatctggttgaaacatttttctctaagtggtgaaacagttttttttatcaaatattgaaaaatcggatacatttttactggaatttttttcattgagcggtaaaacatatataatatttttgtacattggatgaaacgccatccgataatttacaaatcatcgtgtgtccccgtagctatgtccgaatatcaaaggatataattaattgaacgacaaattattatagaatcatgacacagcgcaaacataattcagtggaccctagtctaatagcccccaatcagaggaactagttgttactttcatcaaagtaggcaagtattagccatattaatgctacagtgacacatcaccctataattttgtcacgtaatgactcctattcttggtcgtgtctaatcgataagaggtagtgtttgtctcccataagcgaagaatagttgataagaagtgtcaagtgaataggtggcacacagctggataacatagtacatcacttctaccttgtagaagcaaaggaaaaaaaacaagtagttacatgggggaagatttcctggtccatgaaaactaatatctccttctgaatggagaagttttagagaaatttcatatgaacggaactaatttttatagaaataatataaaatatatttgtcccagagggtgtaaacttgtatcccttattaagaaaaactaattaaggttacgctcacaagtgctggttgtggctgccaggtgttacaggaagcaagccacattttttctaaccagctagttgggctgagctttttagggggatgcgaaacgaggcaagcctttaatgcatgattaatcagtttaaattattataaattcaaaaaataaatttattttaataaatttttgtgtccaaaaattttgtatgaaacatatcgtttagcggttcgaaaaatacgtttacgaagaataagaaaagtagctaatctcaaaatcattttagaacacactctaagacctcaggtagcctaataaactctccaccgagcataagactagtgtgacattatgcttccaaacaaaaccctgaaacttgtagctagagctgctagtttcatggcacgagaagtatagatgcaacctgatctcctctaccttgcaacaagctagtgccagccagccaagttgccaacacagcccagatcagctgaagccaacagaaggcagcagccactgccagtgccaaggcagcggccaaagccaatgggctgaggaggcatgggtgacaacgccacgtaggacaaagtgcacaaacaaacggcgccatgagagcaaggctaaaaatatagccgagccgttggctataaagttttttgtagcctttttttagcttatccatagaatagttagctcatccatttgtctttctcacagattgtctcgtaatttaacagaccgttttttttctctctcctctgttttcttctccatctcaacatttagccggcttatagcctactctgactggtccgtacgtatctttgctttcagcgggctggaggtcactacctcctgcacctgaatcctccgaccacccaactccgtagccccatctgtgtgctgtcctgcttgctgctctttgcccctcttttcttggctttcttcgtgcgtctggtatacatacacacccgctaatagtatccattcggagatatttatttgtccccataacatggtcaagcctcatatgttgtgatctttctcaagttatgtgttatgtatgtcgatgatttctgttaattatagggttatctattttctatggttgataatagaatattaatgtatcaaaactactttaaaaatatgccccgcgtcatcacgttgtagaaatttattttatcgagtaaaatatgtggaaggcttcgcggcgcgtcacattgagttcccctttaccaaagtgtcataaactgagcacttcactaaaaattttataacctaaccatatggtttcaagttcaatgaaccttgtttagaaggtaccaaggagtacagtggtacaccacaagggtactgatgcgctgtagcactcgtactccttatgacccaaataaaaacaaacatcaccaaacgacgaaattgaacaggcggagaagatgaccatcggacgtggtagggatgcctcaataagagcaagttgaatagtatagcccactactggctctaaatcatctatagccaatataatagccaatttatataatagtttcttactatactattaatacctagtcccacatgtcatacacatattacatcttggagtccgtgctacagctagctatagatctataatctgctgctcttctctcttttcctttcttttttttaaaatatgtttatatctggcctgctatcgtaccggctctgagcagagcggaccaattaaggccacagcacatgagggcacagtggatctgcacgctgcaagcgacaatggagtcctccccagtacacgtggagggaggagagtgaaaggagccaggcttgcctgggccactgtgctgctggttgatggactctttgcctagtgaagcctcttcaattcctccattgatctttctttctgctagatcagcatggtcatggccatgctccaattagagtgctatacactggagtacttgcggaaatgcttcagcaactgggaagttaattaagtgagcatggactcaatggactccactgtggagataaaaaagagtggcgcttacttgcttatactcaatattatcttggagtggagctcatgatcaaccagagtgatctaaatctaatcttgtcgatgcctagcttaaaatgtgggctagaggttggacatggcaaatttgattgacatgctaccggcaagattggggttataaatgggatgggacttggccaccaaatataggtgctgcacaaatgatttatgcaaggcgcagatcaccacttttaatttgtgtgactaaattttaaattcctaaaaattccatgttaatttataattaatatagcttatgtaattacattgtttgggactaatttgatgttagcctagtcgacaactcatcatctaatttgatgtcctaaagcaaattttgtgttgcgttgtcgatcggttcgtctaatgatgattgtaagccgtacaatttactaaaagataatttatgggtcaattttttatgtataagtcattagaaatttaaaagataatgctaaaaaataaagtacaataaaaaaagacataacaacttagagcaagtataataataggttgtaggccggctaaatgctgaggtggagaagagaagagaggagaagcgggctgcaaacttacaaccggcttggacaccagaaccaagaaactctgtgagagagacaagtgggctctgtattaattataaagagctaactattacaaatcggctgtattattagccttgctcttgtaagttgcagggcaaacgatgggggaggcttaaaatttaatggtgtggacaacctttaagtaacatggtccaatttcaactacaacagtattctccctaacaactcattttaatccgatctctcctgaaacaaatcctggtgacatgagacaatccctatgcagatggtcagatttcaacttcaacagtataacccctaatatcactcgactacattttcatcctcttagaattttcaaaatgcaaaacaccgtgttagtgacatcccactatcccaatcgatcaaaaccctgcctccttaacctgctccatcagcgcaccccacacgcacttcatcctttaaaagcacacaccacccctctccagggagaagaaaaatccccaacaaaaaaacaaaagaagagcttgatgccataggagagcacaagagctcaaccacacacacacacacacagagattttgactattaattttcatcgtctttggttttaagttggtgtgtgttcttccatggccggcctgagtgtccttcttgagacacacaagaacgatcaccaccccaacatgaggcctccccaaatcatcagcaaggccaccctccatagccacccagagacgatgtcctcctcctctccggcgactgcgacgacggcgacgatgagctccttcttgcagcgctgcttcctctgccgcagggagctcgccgacggcaaggacatctacatgtacaggtccgtccgtctccatccatggcatgcatctaagctgtctcttctgttgattactctgtccattccatagtactataatagattttgaaggacatattttaatactatgaatttagataaacttactggttagattcacagtaccagatacgtctcgcctcttcaaaatttcttatattttaggacggagtattatattactgctgaatattgatgtatatggctatatatatgcagaggggacagagcgttctgcagcgtggattgccggtgcaagcagatcttcatggacgaggacgccgccgccgccggcggcaactgcgccgcggtgcgcgccggccggcggcgggcggccgtaccgcgcgagcaaaccggcgccggtggcttcgcgtactgatcgatcgaatcatcgatcagcccagccgtacgcgcgcgcgcacgtagattaattagcacaaatgaaacgaaaagcagaagatatcaagcacgacgatttggggaagatcaagatgcttgattcatcatataataataataatttattattcactcgccaatgaaaatgtactggttgattaattaaatccctttctttggagaatggattcaaatcgagcatggagtggagtacgtggcagctcatctgcgtggggcccacgtgtagatatgtgtacatacgtgtctcctctcctgatcctctgctggtcctggagtagctgtaaataagggataagatgggccaaggctgggacactcttggaccctctcctcttgaagcggatcatgaccgtaattaacggcgacaatgctcttttttaaaatactccatgtctttgttgattactctatcttttttagaagagtatataattttagcttaataatttatctccaaaattatagttttagagtggtctactagatatgtttaacacaatcaataacactctcttctcctcgtattaacaaaggacataatagtgcccaccaagtcagacacttcttgcataccctctgcggtctccctgacagcctaggggaaaggatgcctgagaaacacctacgctgatagtgctcctacgtagcgcgtgaattcgtctacgtgatggaaaaagcagtggggtctatagctacgttgggttctccgtatctcaacaaaggctgtgtttagtttagcacaaagtttagattttggttgaaattaaaaatgatatgactaaaaagttatgggtatatgacaagttaatatgatgaaaaaggactgaagtttaaagtttagatacaaactttgaatctaaacacagccaaaggaacgaacacctcgcgcaaaaaactctggcacaggacccacttggtgaggactcggtgaggagaagagttgggagatgttgtagcgccgactagtgtggccgccgttgttctcccaagctggtgaagcctcatccaagtcccccacctgagaaaatccggcggcgctgatgcggccgtcaccgtcaccgctcggaacgagggagttccggaccgccaccgctctgcgtcgagatggccccttgctgctccgctcggcgcttgctgaagatgccagaggacgctgtcgctgctccgtgtcgagaaggcccgcccgctgctccgctcgatgctcatcgccgcgtcgccgggggagctcctcgaccgccggccttctaggcttctccg

SEQ ID NO: 62970 - DNA, 5364 bp, Oryza sativa
  unsure (1)..(5364): unsure at all n locations
cgtcgacaacgccgccggccatcgccccggttgcggatctcgagcggcggtggcgtcntcctcccacgtcgctccctccagatccgcgccgccgccgccgccgccgccgccgctccagatccgtgggccgcgtcaccaccgcttgaagcaaggacgagcctgacgacgccgcctcctctccgcttgggctcaacaccagtaaaaggggaaaatgggagagagaagcaccgggaaaggggaaaggtaaaaaagtggttggcttgggaatcccgtgaagtcacttgcatgagaggagtggattctatgtgtatttgctctacgtggcatggggcttacactgctactgcctaatagggtgctccttgggttggcggcaccgaagtcaagctgatgtcgtatcggtgtcagatgcatatcaaatggaaatatggcgatagagagtcggccgtctcctgacgggattcctccgacatgcttgtagtggctgcagttttgctaggctcagcgccacggcctcctgcacgagagggcgtagcgcgcagccaccccgcacatgtctcgtacggatagcaagtgtcctcgatgagtttaatggactaaggctttgtttgatttagcttaaaattattataatttgagttattagaagtaagttgaaacaaacaaatagcttattatgatatattattacaacctataagccagattactataatctaataatccactataagatgctttttttagattattaggtggctaacaactaacaaataactaataatccaaagaaataaacatctaacaacttactctatgtaggtttattataatctagtttatagtaatttggctcaataatctagattgcaataatcttaaactgaaacgaacgtggccaactcgagtcttagagagttgagtcgagttcacttttaaaatcatttttttaacaaatcaagccacgcaagctcgtcgattcattatgaggtgagtgttagccaaagcaaaactgagaagagaagtacattgataacaaaatatcagcatggggaaacgtcattttgttcataggaggcaacaaaaaggaacaacacataaataacatacccaaatattaggtcgatccattcatgcaaatgagcggagacatgatcactctcaagagctttcctgtgtttacatatgaaatcaacagggttgagaccaaggaggcaattccacggagcctgtaatacagaatgaaataacttacatagctttccagaaagttgagttgaccctaagtcaaccaaattcacattagtgtaactcagtaaggtaaaatatctctggaatctacagaaataatcaccataattaggttccaccaaagattctgattagacttccgtgctaagcaatgcacaatataccacagtgaattgagggcacagtttttaacaaaactcactaacttttttacattattcatgtcttcaaggacactgttccatgttctgttgatacaagaaaacgtgtgatcatattgaccaaacctgccacattgctgctgaatagaaagggccgtaaaaggctctatcctgacaagataatataacacctgcagtagatgcttatgtcaacaaccaatagcacgataacacctgaagggattgtcattgatgaacagtagagaaccgattaatcaaatgggatgacaataaattaatctaactccaaacaaaaggggcaacacacaagcaaaatgctgacacaaaacatgcataatctaagaaaaggtaccatgccaggacaggagcaatgtgaacggtaggtgaaattttgggatgattgggtcgttgaaactagagtaatgttcttggggtttctccagtcatgcaggattcagagcgccaaccggctgcattgaaaattttgaagtatcactatcagcagttattgaacaagatatcatccccagagtaaatgaatggaaaagaaaaaaaatgcacagaagaggtccaaattggcagcaaggaatgaggtacagaatccacttttggaagatctcagtatgcggacgccagacagatcttccagatccaaaatgttttggagtggtaatctgctaatatccatggaaaaacagggtattgcataaattactagtgatcatttaaacacagtagtagatttattagatcagaaaatgagagttatgaagcaaacatgcatgtgcaatgtcgttgtaactgcgcccagcaagagtgttcagttccatcaggtagtcaaaattgctaatctgcacaaaaggacagatctacttaaatcttgaatacacttaacatgttgggctgaaaaggtggttgattgcatatcaacctcccatctagcccagcactctgtcaattgcaacttcttacatatttactcaggtctcaaataaaaatgcaattgattaaaacttccagtaagagcagatttcaacattgaactttgcagaagaacaccaacctgggtagctaggaaaatgttgttcaaataaggaggttttgtatgaatggttgcccgataaataagcatgtttacatgctttctgtatcctagataaaaatcatatgcatctttaaaatatttaggcagctgtagtgtgctatatgattccaacaacgcaaactagagtatcatcaaggatgtacctcgaaatcgaagaaatttgacctatctaccatgaatagctctaaagcactttaccgtaacaaatacctgcacagttcatttaaatcagtatgacacacaagtactataaatggttactgctgactcagtagtccataggtatatgagaagggcacagctaataaaagcgcaaaagttatattagctaacactaaagacagtgcagcaacaagttcagtgtacaccttcatactagataataaagaatcatttaccttctataaatttgatgaagtggagatatgaagcagctccaatctttatcttgctgatcatattggccagtagtagatgcagcatcatccatctaactgtcactatcactaatatgctcatcaattataaagttaagcatcttctaaggaaaaccattactacctccatcccaaaattttgctacctagtacgaaattggacacccctgtccagttttatagtactaggaggtgtccagttgagtactaggtaactacattttgggatggaggtagtatacagtatacactagggcttaatatatccattcccatattacattggagatgaagcagaatactaccatcaatgaatataaatacaaaaaaaagaacttctaatgtcaaaaaaatcaacatggcaaacataactagtcactatacaaaggtgacatgatgaggggtgaaatcagaatcgcctgtctcctctgcagatgaggggacaccattatagttagttgccctctgttgtgcctgggttttcctgttcagcaactagtttgacatctgtgtcctgttgtggggtagatgagccagtaacttgggtggttggatcgacatttccattgactgcctttgctacttcacaattctcctccagtgcctgagctgacgggctggatgagagcacattgtcggaatcattgtgatccacacatataggttccaccatcagttcaatctggtccatttcattaggattttccagatgtccatcttgatcaaaatcagtgttctgctgtggaattacagagtctggagcaggagtggctgtattacactcatcgatggctggtgtagctaagtgacaatgttcctccaactccagtgaaggacatggacagatgacattgttgaaatcattgttctcctcatccataggctcaagggtcattgttgcatcatccaccatgtgaagctcttcctcttcctggtgttgagcttcttgatcggcatccacaatgttctgttcagtttctagcaaaagtagaggcatgtcttgagtggcagctgattcaacatgtggactagtagctgaaccaccattttccttgatctcgccaaggtcgtgaagaacatcttgaaagccatgcagaaactcaaagaccaaggcttgtgtggttgtatcagctgtggacgccatggctatcttggccttctttaccataccatgcagtttatcaacctacaacaatcagcagccttcaagttaaatatattagttaaattatgcatggactgcttgtaaaaactatttgaagtcttgcaaaagacagcacgtgtatctgaaacaaatttaggtccaattaactttagaaactgatcgtaggaactgaatagataatatggcttactgctttgcggatcataggagccttggcttgataatgaagattaatggagtcatcaggctgtaatgaagatcctgcttccacatcatcactgattgatggtacaagataccgccgtgtagcccctgtgtaccaatgcaggtactcctcataagaagacgggtcatactgctctgactctggaaatatgcgctgtcggcgggcttcccattcctgaatgtactcatgatgtgtctcttcccagttctcacgttctctgccacgtcgactaatacgatgcagcgcctgtagtgtaggccgaaaaggtggtggaatggattggcgaagcccaaattgccgcatcactcgctcaggcaaatacatctcgactattggaaaatttattagtggagcttgtgtaagccacaagtcagcattttttgtacaaagcagtggcaagcttgcagactcaatgtgcaagtacggctcccacttcacctgatctgctcgctgcagattcagttcatccctgtactgcttaagacagcgtgtagcattctcactttgtgtgcgagcacctacccaacgaaagccaactgggagcacatcctgtggaatgtctgtctctgggcacacgggagaccggaccaacggtctgccaacatgggagcgctcccagctccaaagctgcaagagaagcaatgaaccaccaatgttcttgatattgtgggaggaagcaacagaacaaagagaacggtataggaaggccagcactgcagatccccagctgtatgtcccaacaagagaaagatcagcaatcagtggaagatatatcagactcatccgtcctgttccatctggaaatagcaccccacatagaaggctcaggatatatgctcgaacatgcctctccacagtctgatcatctgtcccttctggtaattcatagaaatgcttctttagccatttgtagtgcagaaaagattttccaggcattgatggtcctcttggatcatgacctagacaatcaatgaccatctgcgcataatcatgatcag

SEQ ID NO: 62971 - DNA, 28683 bp, Oryza sativa
  unsure (1)..(28683): unsure at all n locations
tgcaaagtttattcttcctacaagaacttgttactcatgcaactatgacaaaacttaattgctcttagattaacctgatcaccgaagattgcgtccgatcggtggttgatctttggattgagtaatgtgttggatacatgctctactgatgggcttacaagacaaggtagtgggctttgctgcggagtaaactcaacattgtcctctttatcagaagtagtacttggggaagaaggtgtggaggtttcatgaaagtccatgtcattttcagccaaagcacttctcccacggccacagccacgaccacggcggccacctcctcctctctttgaagacatgatcctgtactgttctagtatttgggaaattcatgagaccagtcagggaaaaggcacagacgttgacacttgacagtaaaaaaaacacaagcatatgttgagaatttatgcagtggtgaagccctgaaagctgcaatgggtgtgcacactttagtagcgagtctgaagtcttgaacaatgcagaggggggtctctccactaacctgatcacgaaaaaagagggagaaaaggggggaaaacatgcatattcctctttatgactcgcttcgaaaagagaattttcaaaatgaattctgcaaaatcatttcatttcgagtgtcccagacgagcctacatcgattgaacttgctatattgatctacatatgcatgccaccaaacaaacacaacagtggattccattttcgtagtatgattttccagtgacaaccaaggaactgagacttgaagagtgagaatctacgggaagatgacattagaggattgtacctgcgccttgtgccgagacgcgcccttgaggacgatgtgcctagctctagcaattcagttcgccggccacccacggctccgtccccctgccccctcctacaagtgtggctcttcggcttgctacgcccgttgctcgcccctccaccccatggccgctggtggcgaatcaccgatcacacacaccctaggactcaaaatcaagctataaccatgaccggcactaaatccggtggccggaggtggaagacgagacaaactgtggatataccaagtaatgacaaagtaaaagttcaattatgttgacagtattcagcaaatgtaaaacatcagaaaacatgctgctgtgtagagtgagcagcgagcgacctagcttccactccttccatgttgatactcaccagatcaagattcatcaaagaagaactacgagctacaactgttccatgttaatattcacaagatcacgatttcgtcaaataagaactacaagctagaactgccatccaaggagctagcaatccgccgctgcaagcaaaccagggagtgaggtcccatgtgtcaccgactcaacgcaaccctaggaggaggaggaggaggaggaggagaggaagtggacgaagcgaggagcacgatgcatcctcgaggctcttctcccctcctgcatcctcccgcttcctccgtcctgtcactgcggaaccctggagaaaagaggagaggggaagaggaagaagaagggctcacctcggatctcgagaatggaggcgcagaggcggcgtctgagggggagggagaggcctggatgagacgtcttgccggaggaggaggctcggcggcgccggcggtggcggtggctcacgagagcggcggcgccggcggtggcggtggctcacgagagcggcggcgccggcgtcgaggggaggcggcgcgaagaagcgacggaaaaaaaaaaaagaaaagaaaatcccgacctcccgagcagtgtgcttgcctacttggtaggacggcccaagtagcaattctacattgcggcccaagtagcaattcactctgcggccagcaacagtaccagcaaaatttatatcaattgaaaaaaaaaaacatcagttgcgtatttgatcctattttaaaagctaaaaaaaactaccattcgattaattttttagattaaaaatttactttatatttgtctaaattcacacaatcactaaagtaataggtaaggaatcaacatgatgcatattttaaaacattcaaactcacttttgacaatagcatatatccaaatttctccaaagcagacgaggcgtggtagggaggtccgggtccctacagcctactcatatctctgtgtcgctcaggtgggcctcccgctgcgaccagcccattaacttgtccaggaccagcaacgcggcccatgccggtcggaactgcccgaatcgcaacgctagatcgaacggctgtggtggctcgggagatgcggcacggttggcttgttgactttttccggcccggattgacgccgcaagccgaatccacgagtagtgggctgcggaattttgttttgttttttttttctccccatcccatcccggccctgacgccgccgcacgacggccggccgcggccgccgccggggaggtcgccgccgatgagccccaccgcgccgtcgcgtacgggtcgtgctctcgcccttctccctgtcctggtgctgctgctcctcgtctgctcgccagccgcgtcagctggtacgggacaatcgccaccccaccgcgactcttcttccgatctcggtgctgttcttgcttagttttatctgtagcttttgttggtcgttagctgtatgtgtttgtttgttacttggacggttcgtggtgcccttgagtggatccttgatgcgttctgtgcttggtcgttgaaattgggtgtgtgtttcttttctacccagagacagtagcgtaggtccctgtgggctcgtagattgagttaagctgcgtggaatttggtgtatggtaaacgccgcctgtttgcattttaggaattactgcttaggaatttttgtttgtacttctgatggatgttatcagtcattaccagcctttactaggggaaaatatcacagtttcttcaaattgcatcctgctaggagtaggatgagcaatggtacctggacaccaaggtggtacttgagtgaaatctatagttttttatgaacattgtggcttgagatcgaatggagtagtttatgttaatgaatttaggcatgtttaattattgtttgagcctctgcaaatgaaaaccatggtagtcatacttctatgactaaaatcattattgtctggcatcacaggagaacagaaaggtgtatgtgtttcgcctggtggacgattccctgccttctcatctgaaggtaagcgtcctggaagagcagctaaggggcgcagagatctggcactatgtagagtattccggcagaacacgtgttgcgatgtgtcccagacattttctgccctgctctcagtgagaaagcttgcatcgactggtgaaggtagtcaagaatgccttcatctgtgggaactgctcgagtgttcgatttgtgatccacgggtgggtgttaggcctggacctccagttatatgtgcatcattctgtgacatggttttcaaagcttgctcagaggcgtacttcgctatcgatgtgaaaacacaggtaaagggcatctctttaagctgtgtctaaataaaattttcttgctataccgatgtggtactttacaaggacagttgcagttgccagattatacttgctcatttcataattcatagtttgatctagataatattaggtgaaatttgatcatagataaacagttattaatcgtgcttacaccaatatacatgccacgggagtttttaagttaaagttgtggcatgttaattgcttttgtactttcttatagctacggtagctcctctctttttttattcctttgcttgcagaactgtaagtagctgtgcctctgctttcttgtgatatttttgttggatattattttgttgttcggttctgatatctcccccttgctgctttatcaggcattgtctccatgtggtttaggtgacatcctttgtggcaaagcacataaatgggtctctaatggcacagagctatgtcgctctgctggtttctctgtgcaagctttggagaccacctcgggtggagtggatgacactttctgctatggtgggaaagcaagttttgatgccatctctagttcatggacatcttcaaaagagcgtccagtattaagtgatgtggcctcttggaatcttgaagattttcgcagatgggcaagagaaatgcctgctagtgaaagagtttcatgggcaattggaggaatggttcttacagcaggccttatatttatcaggttttatatctctttcttattttcatattctaaataacaggtataggagataagtgtgactggtcggaacttgatacaatatctgaagaattggttcttttcatgcctatttcaaacaaaaatatcttatgaaagatcacacaaaactttggattatgtccgtgtgttcgtttaaacttgcaattttcttccttggctctctagcttaatgccatacacatgccatttccccctttcagatgcttgtgttgttacaaaaactaattttttgtagtttgtgcagtaaacggaagagctacattcctggccaaaagcaagctgctatcgcccgcaatgtgagaaagctggaatcaagagttaacccacagcagcttaggcgaaattaggaatgcgtaggtagcatggattcctatttccaccactttgtgattcttatatttgaatctgcaatgaatttactgttgaagatgtcctctacactggtggtcagatagatggatggcgtcactggttacaacctcctttgtcatccttgcgtagaagagcagaagagatctattaattcttgttcaggttatttctgtctgcaggatttatagatttgcttgaacatatgtatatagttttggaatggaatcttcagagattttcttcatactccttcagtaactcttgcattctgtctatttttaatcagcacgagttaaagcactcgttcaaatatgttttgctccagatagcccttaaaagaaatcatgtttgctccaggcagccctaaaagaaacttacaaacatagggaaagacagtacgttccgtgttctgataatttgaagaaaacaaagaacctcttaataattgcatgtgttttgtctctctttggttcgtgtattcattcaagaatttaaaatttagtttccatgtccttttcagattataatgtaaaatgctgatttttgtagaaaagctccttgaacaaactgagaacaggcacagcagctgctttccccgtagggcaaccacgagagttgtaactttattttgtattgagcttcatccatactttataaaagcaaaataaagaagttacagagttgcctaattacaacaaaatcttttgaaattacatagtttgtaccaatcaagagctaagaatgtttgaaaatgccatccatctacaactatgtaacgattaagaatgtttgaaaatgcgaatacgggtggggaatgctcctgcattacaaacagtaagaacaaaatccgtggaccattctatcttacggcagattcaactgcagaaaactaagacagattcaatgcaagacaggaacacttttcctcgttgaaaaataataaaataagattgtcagcaagtgaggttacatatcgcaatctgaaattgatctatgcagatcaaccctgtattacaccctcgttgctcaggaatgccctggcaagtttcatttgtagttaaggagacaaaataatcatcatggggagctcataggaaccccaaaatgaacctaaaataacccgccatccaacagcgaatatgaagatcttaatctttatgtgaatgcgccaggtattggcttgtgtacttgtccaccttcggtccagatgtgccgtacttcgcgtcatagtactctaccattgcagatcccactaacgctgctagtgttagggcttgagcatgcaacctgcaataataacagttatattaattaagtatgtgggctgtcaatttgtagcatgattgactttagtcacaactcattggtgtataatcatatggaatgtagttaatcgtacataaactgcctacatacatgaaaaggtacaggcattcagatccaaatatctgatattgccacccaatgcgttagatggggttaaggtcgtgccaattttacatctacgaggaaaaacagaacttcaaagatttaatacatgactcagtgcattactcattgactgacttcaaaaaagaggtggtaatatcgctagtagatgcgttggaaaatagcaacttagaattctaaccctctggtctcaacaatagtaatcaaaccgttcaaaaataaagaaggtggtccgtatgtacatggcttctatttaggtgtcattgctttatgcacctatctaatctagcccaaaaaaaatggggaacagaacagagaaaattatgagggccagcagtgaagggtgcacactttcacaggacaaaaatgctacaaggtacaagctatatatggaattggacaatgcatttctgctgatctaagttttgacttgctggatcggatggactagtataattgtaagtgcactatacacaaaaaaacgaagctattgttgcagaccaaggaatctttgaaaaccagtccataataatactgatacacttccaaccttagatatcttagtgacaaaaggtcacgtgaattacttcgtacagctagcgacatataaaaatagtaattacaagcaacgttttgtcataaaattatatatgcatagccacctaggtagaatatcaagttaaacagataagttactaaatttcaagtttcctgcgtttcctgcagaatggtctgcattgcaaccttaaaggataactaagcccttcagtgttgaatgtaatcaacaaaatcaaataattcaccaaataaataatggtgcattcttaagtctaccctttttttttgaaagaagggcaaaaactttgccacttttgtattgataagaggaggagaaaagcctcaacagtgaacctttacaggtcttatatctacttgcttggcgggataattgtaaacgaacaaataaaagacctactgttcaggaagaacaaattatgaaccccgtggactataataatatcctacgtggtttgattatctctagtggtccccggctgcctgctaataatcactagcttgtagtcccaataaaaaaaacaagtacactctctacaattaactggaagtaaagttcttccaaaccatgccaatggaataaaagaaggatccatagctccatattcaactacagctggcaatggtaaatggtagccaaactgtctatagtctgttgaacaatgctacactatacgttgaaaccttcctacaggctcatcgatgacccaattggagcaattctgtctggtttcagttgaaatcgaagttgctcaagtcacttcataactcagaatcaatctggaaggcatgtgcaacagaatcacttttctattgtgcaaacattatgttcaatcgaccttttaattatcatggcaaggttcaaaatccttttatcttattgtgctaatgttcacaaatcacaatgcctacaaagcgttctcaagatgaataatccgtgtattcttaatcatggtaagacacgagcctgaagctaagatagatgagacaaaggcacaaaccttgcatggatgatcttgacgctagtcttcatattgggcctcgaccagttgtacgcaatcgagctgctgatcccagtaagccataggcaaccttcactcacaaacacataacataagcaacgtaaaatagttagaaaatatccaaaaacacgaggggaaaatcaatctcaaaatttggggaaaaggggaatcctaaatagaatacacaacataatttttttcgcaagattgagagataaaatcatataaagaaagccgatgaacttctatcgggaagacgcatggattggggatttggtggtgacgcatgtagcaaatcgtacatcagaaaagaaaagaaaaaaaaacaacagaaaagtagcagatccgcgcggaggagatcgaaatcccaggaaaaattcacgagatattttacctacggcgcggagcttgtggtcgatgacccacttcctcatggattcaatcttgcccggggcttccgccatttgcttcgccgcctcttcccccatcttcctctccgatttctctcgcttctctttacgcgctttgtttttcttctttcttttttttttcgagctcttttcttctctctcgttgcaaaattgcaattggagaaagccagcctgcctctagttatatcggaggacttgtttgtttccggtcctcaatgaattcggaaattcgtttagtatccgggtaaattatttggattcctttcacatgtcccagcttgttgttgctaatttgttattctccacttgcaaaaagaaaacgtttttgtttcgttaagcatgttctgtatttcttgtgaccgaagaaagagagagataacggttgcgatatattctttggaaataaatcgtcctaataatttttaggtgcaccctctgtgaggaagtggaaatgactttatgattttgcgaggaaacagggatatgattacaatcttgagcgagaagctaggacacactccctagagcctgaaaacgccacaccgtatatggcatataatttgaaaaacccatatgacataaatcacactctgtcgtgtgatttaaagagacgtaactctctagtattattattggaattctattaaagtatacttatatataatatttgcgagtaccaatatattagaatcgtgcaccggccacaaccccgtactatagcgctgtacttcccgtgatgatttaatttaaactcattatagattgagaaaaaatactagaaaaaggtaaataaaagagaggctttactcaatgaaatacacaagaagacgcatgcatcactgtaaaagcttaaagatatgaatgtcataacgattaatatattcgatctcatgaaatttgtactgaatcacatttttttatacgtaatatttatagacactaaatttaaatattgataagttaagtcatgcaccaacgactacaaaattttgtactcacaataacactaagaaagttaggtttttactggtggtctctgaaaaaaatggatttgctaaaagcccccgaacaattgtcatattctactcgcgcagtctaaaggccattaagataatgtttccaataaagttggagagagaatttgactaaaatggcttcgctacccttcttactaattggcattatttctcctctccctgtcttcctcttgtttcttcattcacgcaagatggcattgatggtgagcatgacaacaatgttgccatatctagttacctttgagtcttctagtgctcgatttgccgattatcaaaatccgaactctaatgcttgaactagccctatcgtggctcggtgaagagaatggtctatggataaagctggctttatagaaccagtcactactccatcctccctaacctaagagccaccacctaagaaccactttgacatcataagacctgctcctataaggctactccaccactaccgcggcaaacacaaggcccactcgacatgaggcggtgcccaatggctcaaatcagctccatcgcgactggtaccccttcgcaagaggaatattagaagaatgaacaagaaaggcgaaggtataattttcttgggttttgtcattactaaggtggtgttttaatctcctgaagataaagattaagtgtttcacgcaaaacgatgtggtaataatgtgcgactaattgagttttaattattacaaacttgaaaaatgaattaatatgatattttagaataactttcatatagaaagttttcgtacgaaacacaccgtttagtagtttgaaaagcgtgccacaaatatccgaaactttatcctctccttacggtggattcgaacggggcctaagtggatattgtattttagtactcacgatgccctgcagtaaattgccacactttttagatatcattagacaaattttcccaaaatggcaagcaatataatgtgtatgaaactagttattacaaagataatataaggtgtatgaggaccaaagtacaagatatagtcatccgtttaactaagagctttagtatatatcttctcaaagaaagtccaaacatcggtagatatagtatatactccgtattaacgtcccgaacaacaaaacaactttgcagtctctgaaaaaaaaggtacaactataaaaatatttgctcataaacgacaatgcatgagtaaaattgcaacgtcgttcttttcctcctcataaaaaaaaaagagaaaaagaatcaacgttcacgcccttcaattttgtccggctttgcaaaactttttgcagccctcgccaacgcaattcgtacaaaccggaagggggtgggtgtgacagcgcagaggccaccgaatccaacgcgaaaacggcacgtttctgccttggacggcggccgcgcggtcaaacctcggcctccccctccacgcagctccacctgacccggcggcgactcgtgagtcgtgacacccccccccccccctcgcggaagtggctcggcaggtggcgaggccacggcggcatagttggattcgccacgtcatgttaaaggaaaaactttagtcaaattatacataggtatcacatcactcaaataagatgataataatatggaagaatctcatttacacttgttttgtaagttagaagatccgttgtactcccttcgttctaaaaaaagaacctacgatgtgacatagttttgcggagagagtatctggttttcctgtttaagaatgaaaattggatttaagggctatttactttggtgctaaaataaaccatactaaattttgacaataccaagactttggtaaggttagcaatattgtcaaattttggcaagatggctattttggatgcgttcattttgttgccaacatacatgctactcacacatattgctgtgcagttgctaaattttagttattactgtgcagttgccaaatttctgatatatttatcaaaagttagtaagaaactaaacatatgcaacttaaaaaaaaatggtatgatttaaaatgacatcaaagtgaaagttaagggatctcaaatgagcttattcccgttccggtttggttggcgtagcgaatttgtcggccgttcgacgagcagctggctgggccggctcactcacaccagccgcatcgaggcccaactgagaggctaatgggcctcggccctcgggacggtttgcctccggctccggctgcggatggccaccaccaccaccaccatcatcatcggtgcccgccgcggaagaggaggagaaagggaaaaaccccgcgctgtgtagggttttaggcgggtcgaggtggaggggggaggatggccggcggctcgtcgccggcgatacggccgatcggcaagtcggcggtgcaccggatctgctccggccaggtcatcttcgacctctcctccgccgtcaaggagctcgtcgagaacagcctcgacgccggcgccaccaccgtcgaggtcaccctccgctcctacggcgaggactccttcaccgtcgccgacaacggcaccggcatctcccccaccaatttccaggcacgaatcccccctcttctcctctcccatttgctgcttcgctctcgcgatttagttgctgaccgccatgtgcgcttctcaggcgctcgctctgaagcaccacacctccaagatctcggacttcggcgacctcgcctccgtcgccaccttcgggttccgcggggaggcgctcagctcgctctgcgcgctggggaagctgacggtcgagacgaggaccaaggacgagcccgtcgggacgcgcctggagttcgcgcactcgggcgtggtgaccggcgagaggaagatggcgcggccggtcgggaccgccgtgaccgtcgagaagctgttctccacgctgccggtccggagcaaggagttcagcaggaacattcggaaggagtacgggaaagtgatctccttgctgaatgtgagctgcccatcttattagtccatgttcgttttgcgggcatttcaatttgcgtaaagctcatgtatgttattagaatctagttcatctcctgatacacatgtttataccactctgctgttttactctacacatgtttcgttctggttctgctaagaactgtgatttattttttttctttccctaattaggcctatgcgttgattgccaaaggggtcagattagtttgcacaaatactgttggcaagaattctaaatcggcggtgcttaggactcaagggagcagttcactgaaagataatatcattaccgtatttggtctgaacactttcaagtgcctgcagcccttcaatgtgacaatctcagaaggctgccaagttgatggctttctttccaaacctggacctggtagtggtcgcaattcaggggatagacagttcttctatgttaatggcagacctgtggatatgccaaaggtttccaaacttgtcaatgagctgtacagaagctcaaatgccaagcaataccctgtggctgtattgaatttctgtattccaaccacatcttatgatgtgaatgttgcgcctgataagagaaaaattttcttctcatctgagcatgccattttgctatctttacgggaaggtattgagaatctgtactgccctcaacaatgcagtttctccatcaacagcgttgaagatcctgggaaggaaatggacccagccatcgatgggtctgatgaagacatgtgtttaacagaaaaggagaatgtttcagctcctgaaaatgacgatgacatggatgaaacagatagtgatgatgaggttacaccagagaatcagaaagtgccttcttcagtgacaacaagggtagccactggatctacacccaaagatgtgagccccttgtcaagaggcccacctgctcagcttgatagatctactttgctttcagcctaccggtatgaacaacgagaaaagacgcctacacgagtaaaaagttatccagcacaagcaaatcatgttagaacagggcttgctgcaaagtcttctccttcaagtgctgttcaaccttctattatgaaatttctatcacaaaataaaaggaaacacgaagacagttgcaatcttatttctgaagctccagtgctgagaaggggaacatgcttggagcaagtgaggagaacagatttaggagtgaattcaccaactgcactaacctcaagagtatctaatattccagaggttaatgcacctcaaggaacaaatcctttgcggcaccattccctgcaatcttttgtacctgagatgccagaagattcaccacagcattctgaaccacctaatattgtttctcatcgtgatgaagtgcctcagttgcgtccatgtgatgttcacgctacagaatctgaagtggtaaggtagaattttttggagtgaattcttcaattttctccattatcttttatttttattacttttattgctttatttgccttgactggttgttctgggcattcttgttaagtgtgtatgctttgtgatcttatcttttaaagaagttcatggtgaatttctcatctgttgtcacaagtcatcttcaatctactcttagctattttaacttctgcttaatttggatcactaaacaagtactccaatgtttgtagaatagctttttttctgattggctaaattgtgattgggcatgtgtccagttcaaagaaaagagaacctagtttaaacatatgttgatgagatttactatacaatgaaatgctgcaatcctcgcaggataaccagcatgatccatgccattccaagtttggtgctcccagtcgatgttcagaagtggaaccccaaaataaactgacaaatatttccttgcctgatgctcattatgatggtcatgacactgcagcacattctggacaatcatcttatccagttatgcaatttacacttgctgatcttagaagaagaagaaggcatagttttatgatatcacatgcaaaaaaaggaagttttcctgagaaatcaacaaggtagcacttgaaactatttttatagaaaagttatgttttcaccaggcgctgggctttatgaattactagtttatttttcctacctaggtgttataaagctgcgacactggataactatgtaccagataacgaggagggaaaatcgaattctttagctgcagccaccagcgagttagataagcttttcagtaaagatgactttggagaaatggaggtgcttgacttaacttcaaatttgaatattatcagttttctaaggttccttgtgagattatactgctaatatactgtcaatgaaagaacacttgttatccaagtgataatgttgcttattttccctgcgcgagtgttttcctttttgtcgtttaagtgctatttcaaaaagaactcttttatagttatatactcagtagctcagtgcttcggaggaaccccaatgacttttgtcaatcatgaaattaagttgtaccaatacattttgtttctttagtgggaccagccagctatataactgttatttgttgtataattttggtgctttgatagcttgcttctgttcatggccctatcaagtacgataggtcgtgtgattcttgcaagttcctcgcaagacatatgttgtcttttgttaattttatctgaaagcattttattattgtgaacatttgttttttacttgagtggtgtgatttcattgttctaaataggatgaaatattaaaaaaagtgctgtatgaattctatatttctatttgcagtactttgctaaagaagtttatgaacactaaataactagtacaccttcaggttgttgggcagtttaatcttggttttatcattggaaagctggaccaggacctatttattgttgatcaggtatctctctatagtctatacatattctattaattgatgtcatagtattgtataaacccctggatatctgggttgcaccttcaagataccttatgtagtcatgtctggtgattaatgtttttttcttcttactagcatgctgctgatgagaagtacaactttgagaacctttcacagtcaacaactttaaacatacagcctctccttcagtgagtaagcaaaacttatcatttccatctgttattttggtacattgaactcattcagtacctattaaatggtagggtgttttgtggtttgtattcagaatgttgaaatcaggtttattattaccttttgttatgtatctctggtactgtatatctgattgtattcaaatacagaccactgagacttgacctatcaccagaggaagaagttatcgtttctatgaacatgagcactatcaggtattacatttattgcgtattacaactcagttctgtctactaccttcggtcacaaatatttgactgacatttaggacaagatttttcaaacttttgaaattctgacattgataatttctcaaatgcttagtgtaaaaacaaaagaaatggtgtacgcagatttgcctcaaaaagtactactatcataataccataaacttattagattttatgaacctattctagtcatataaaattgacggttggaatataaaaagtttaaccaaatcttgtccttagcatcaaatattatgaccagaggaagtaattaacatgtcggtcagtcaattgtttcccacttagtgcataacacctggaatcatgcacgatttgtttttttctcactcaacaatactccctccatcccaaaatataaggcacaactaccactaacgcataaacccaatgggatcactccaataaatacaatgcatgcacccaatgggattagagattttaagggtgggtgattttttttttaaaaaaaaagaaataaagaggagagggatgtgctagttaattgcatgcatgcatgcatatgcatgcctaatattatgaaacatcgaaaaaaaggtggttgtgccttatattatgaatggagtgagtagttgataattaagagtgagcaaagctttacttgctattttttttatctgtcagaaagaacggttttgttttagcagaagatctgcatgcttcaccttgcaaccgctattttataaaagccgttcccttcagcaagaatattacatttggtgctcaaggtatcacttattctcatgtctgaaatgtacatttttatgtgcgttgaaaagtggtttaattctaatttcccttgatttagatgtgaaggagttaatctccatgcttgctgacagtcaaggtgactgttcaataatcagcagttacaagctcgacagaactgattctatttgtccttcaagggttcgtgctatgttggcttcgagggcttgccgaatgtctaccatgataggtgatccattgacaaaaactgagatgaagaaggtaaccacagatcaaattgttttttaaggataatttttggagtaaattagctttcgatgaagtaacctccaaatgagctcctataaaagaagtgcaaaccttgtatggtttctgtctattcagaaatttaatgtcatgatttagttgtgatcagtgctcactactccctagaaacaattattcctttatatttaagaacctaactcaatgaagccctcttgcatttgcactccagatacttaagaatctaactcgatggagcatttttcttttgcacttcagatacttaagaatttgacaggattgaggtccccttggaattgccctcatgggaggccaacaatgcgccatctagcagatctccatgctataaaaactgaaggtaagagattgtcggccaacactcatattctctagtttacatgcttgtatatgtctcatctatatctgaagaaaaagagtgaagttttcttgtttcattgcaactccaagtagttcgagtcattatcatctgcaaatgtattgttctaagttctaaacattgtagacaaggttgtatcagatcatcactgttgtaatttcttgaataaacaaaccactcttctattttttcactgaaacaacaagattgaaatgtgttgccaagttcattgtgttacaaaaaccttctagtgtaaaaaaaaccccactaggtttcagaaattacgtcagtcagaagctcacaatcgtttctgtattttttgcgttctattcttttttttttcacaaaaagtggcatgattaatactcttaaggattttagtggcaactcccttgaattatccagtttacagatctcatttcagtgttgcaaaatctcgcaggatcgaaggcaactttctcatgatgtctggcagagtttaggttgggtttatgatggatgctcttgcctttgcgctgctaccattccaaggaaattaggcgctccatggccaacattccttgatgtgtatagatgccagtctctcccacctgtttgagagcctgtgtgacctattcgtgtactaacttacatatgtgatacatacatgacatgcgtgatagtggagaaccttgtttctaagccttcgaaatgggatgcatctccttgcccactagaatccttttgctcggagactaatgccggaagcgaaatactccaacacctttgcaaggatgacgagcaacaaaggtgacatcaggttatcagggaaagctatctggggaaacataaactgatgcatgtgcttacctttattgtgtggttaaaatccagacaagatgtaacttaggtacttgtgttgaaaatgcctcgagtttctgagttgtatgcaacaaagctcttggctgtatttagttgcaggcttgcatttttaacgccttaccttatctataaacagtagacacttgctctcagggtatggattaccctgtgctatttatattatctttttgagcctggaacggctggtagatcatagagaaaatgttgttggaatcagatgccggaaattggctctgctgtccctagatcatacagagagatgagcagactagtcactgctctggttgtttcgtttgctttgcatagaagctactacaatactgtagccgtaagcaacgttgcagtacagctttcctgcgctgaagaaactactagactgtttacatccgtagcataaattctgcagataattttgtctcttgttgagctcactccagcagtctagcttactgatatttgatccaggaattctgtccctgagttgactttagtttatttcaccgttctagaaactggcgataagtataaggccctctttgtttgtttaggattataagccaacttataagtcaaaaagtctaagactaaataaacaagcagcttttttgtttggcttttttaagccataagccactcttacactattaagccaaaagctaggttggagaagcttttttggcttatataagatagatgtatgactccaccactaaacttaggacattaaatttactggcttataaatcatataagccaataaactgacttaaaagtctaagccaataagtctaagcctaaataaagagagcctaagagcctttttggttcccatattacctaataagtcaaaacggtttattatgaaaaaaataaattatagataaaactttatatatttcctcgtaagcaaatgctaaaaggaaattacgttagaaatatcttaaattcaattttaaaaattcaaattctgacttttgtttgacttattacgtcaattgatggggctccagaggtttgagtactagcagtacactgtttttctagctttggatagagaaaccttgagcttcataacagcgtgatgccttttgcagctttcttagcgacatctttacgaagttgcttgattccaatcacaaaaacgatagagccataatgttataaaacctcctaaatttcaaagactacctatttatttatgcaacaattttaatccctcgtaccaaaattttgccctttttttccctctaaaacctcttagtatatttttaaggtaaaatagcatacgggaaataaatattgcttatgtgttcttttgtgttgaataaaatgaaacaataaatgaatgatttgtgaaattattcgaatgtgcaaatgaacgaaatcaactattactaagttaaaaagaatatgttctaaaaaggtttttcaagacctggaaagtttttttatttttaaataggagttcacgaaacatgcatacacactcgtctcaaaaataagtttatttttcactcctcctacacatatcaatataaaacaaaaaaatcaggatacagtcactttctcaaatcccaaaatatagttattactctctttatctattgccaatacattttttacttttacaaactgatacataatgattaaaaaaaacttaatttactacatattggggagcaaaaatgaacttatttaaaaaataacgcattgaaaaaacataaggtgtatatataatctatgggcatgtttagttggtaaaatgaaaattttttggtgtcacatcggacgtttgaccggatgtctgaaggggttttcggacacgaatgaaaacactaatttcataactcgcctggaaaccgtgagacgaatcttttaagcctaattaatccgtcattagcacatgtgggttactgtagcacttatggctaatcatggcctaattaggctcaaaagattcgtctcgcaatttacatgcaaattgtgcaattaatttttctttttatttaatgcttcatatatgtatccaaggatttgatgtgatgtttttttgaaaaattttcggggaactaaacaggccctatatattcatccgttaggtagaaaagacacaggtgaatttctacacagttccaacacgcattaaaagaaaaacaaagaaagaaagaagaaaaaaaccggccattcttgtagtacctctccaagagcttcttcggttcttcctcccgtgtgccacccgcttgccccttcaccgcgccacacgtacactaaccaacaccggccaggatccgacgcgacgcctttggaaactggaatatccccccacccgtaaccgtctcctccccagctccaaccatttctcccgtcctcctcctcctccgccccgacctcgctcgcccgcccgcccgcctccgcctccgccaatggcgacctccacgcgggcgttgctcctcctccccctcctcctcctcttcctcctctcccgctccctctccctccgcgccgatcccggcgccgccgtgtccaggatcgccttcggctcctgcgccaaccagagcgcgccccaggtgctcgacgaaatgcgcccccccttcgccaccctgatctcggatcaatgatctgatgggatttgtgtctgtgtgtgtgtgtgtgtgtgcgtgcagcccgtgtgggaggccgtcgtggggttcgacccgcaggtgttcatctggctcggggacaacgtgtacggcgacaacaagaggccgttccgggtgttcgggagggagaggacggtggggccgtggaggaacgtgccgcggttctacccgtcgacggaggccgagctgcggaggcgctacgagatggccaaggccaagcccgggtacgccaagctcagggagagggctcaggtgagagcttgtgcaagactcgctgccgctctttctttgttttttgttttttttttgctgcattggtaattgcgcgttgaaacctcgagctttgtgtctggtgctcgtgatgacatgtgggatcttgtcaccggtgttttacaaacaagtataggtgctcatttctcccatgagtccacgtccttgatcatacaggcgcaggagaattaatgaatcacttccatgctagaaaggatcataagatccaactgaggatgaatggcaaacaagagtgcttgttcattttgttacttttatcatgtttgggacagtttctgtatcatccaaactgagattttgcgacattgttatcatttccaattttaacagctcctcttttaaaaatttagtggttggaaacactatgtcaatatcatatcattcactaaattttgcaggttattggaacatgggatgatcacgattatggactgaatgatgcaggaaaagagtttggtgggaaggtgacctctcaaaggcttctattagattttctggatgaagctgaagatagttcacggtatgtacttgggaatatttgaactgatttttattttcctaatgttcatttgttatgttggcatttatttatattattgtattctaaaattgcctttattcttcttattgtgttaaatttctttctttcttttttgtttttttttccacaacatatatgaacatacctgtgtaggttctacggtctgaatacatagttgtaaaccatcagaaatctcatagcgctctctttcttgtttatttaggaggcagcaagctggtgtttatgcctcctacatgtttggccctgaaggaaaacgggtaaaggtaaagttatatcgtgtccaattttttctgccaattttgtttttcttggaaaccccttgttcaagcaagcatccccatgcatgaatgtatcagttctcctttccatatgtggcatgttcccctgttaaccttatgatttgcaaccatgttacatatcaatctcctagatcacactgtgaattctgcacttgccattcttgttctggattacaaagtgccctgtgctgcaacttcttgttaatcagtagtctttggtttgttgtttcagctccttaaatggaattcatagcatcttttaaaatgtggtagtatgtgatatcaaggtttacagcaacttggtactatgtgaatactgaatacagatgtatattgtgtctagttgatatttgttttcctatacatacagatttaatgttgggtgaaactattcagttcaaatccatatagtgacgcaccacaacaaatatataactagtacatgagttgagaagtttcacccatttgcagaactggttgcaggcactgctccattgttactttacatgtattaaaagatagccatacattactataggtaattctgttggacaccagatatcacagagaccctctatcaagtgatggagctgtactgggagatcctcagtggcaatggctggagagggaactgcatggtcctcgatcagagatcaccatcattggatcttcaatacaagtaagatattgtctgccttgtcctaattgaaagagcggatctagaatactggctaaaaaatggatctgccagagaacaatgagtaatcatagtgaatgccataaactaacatcatacataaagaaaactggcaatatgataaaacttgttatcttgtctggggtttgcaaacatagccagctgtccatcttggacaatttcgtggcagatgatagtatcccaattcccagctaaagttatgtatcatttgttacatagataatttttgataaaatcttcgatctatagttgctttcgattgaatagttgtaacaatactatttttcacctctttgtatttatgttttgcctttgattcttcatcttgcatgtgatagaattgtttcaaaataatacaattttcttcctatgcactgcaggtaatatcaaatctatctgccaccactggacctttgttctatgtggagtcatgggcacgctttccaagggaaagagaacgactgttcagactgatcgatagcagtaaggttgcttactttactttcctatgcagacaagctattccttgattctaatctttactgaaaactcagttctcctttacctgtgctaaagtaaaattcattgatttagtagtagctggcgtacttcctgcattatttttagaaacatttttttatcaacaattcacaatatatggcctatgtagaatgcgaaaagaaaaaaaaattctcctggcaagcaggtgcccttttcttgtaatacactgtgaagtttagttaccttttctcttctatatagctgtgttaaatttttttctttttgcgatctatcaatagacaatactccctccgtcccagattataggacggcctcttttcaaggaaaatcaaaatcggtaaattttgactaacaatcatactaaccatatatatgctaagtattatgcatgttatatcactagatttatattttaaagtactttcatgtgatgctaatttcatattatttcatattcgttaggaaaataacatggcataaattaatggtcgaagtatgtcattgaagaccgtgtaaaaaaataggccttgtaatttgggacagagggagtatcatctaaaatggatacttatcttatgcatttgttatttctatggaacatatgttgactttgtgcagagaaatggagtgttttttatcagcggtgatgttcattttggagaaatttctcgttatgactgtggagctcaatatccattgtatgatattacctcaagtggtcttacccaatctgttgagaattccgtgccatcagtatttcaaccacttatgagacttgtggctttgttgacaccaactaccttgcgagtctttagccctaactgtcactacaaatcatgcacatatggtaagctttcctttcttcgaaacaaataactgaataagtatcaagagggcagatttacccatgagcataataatgtgtccatctaatttatttcttctgtatttgatctcacgtgtattactttatcaattggtgttttgctgttgcatttatcaggtcaaccaaactttggagcaatcgaaatagattggaatgcagtgcctccccagattaaactcgaactaagagatgtagagggaaactctgttggtggtgtggagtttcctatatctgaactggatccatcaaaagcacatgccattacaaaacaagggcattcgtaccaacggcattgcgctctcgaaacagagcttccatggctagtgtggcaccgtcttgctctgttgttgtttggtacaattgctggtatgctgtctatatctatctcaaacttttcagacatctcttttcttcatactccctccgtttcaggttataagactttctagcattgcccacatttatatagatgttaatgaatctaggcacacatatatgtctagattcattaacatatatataaatgtgggcaatgctagaaagtcttataatatgaaacggatgaagtacataacaattgctcttgaaatcatccagtttcacggtctatttacgaattatttttgtgagatctagtttgtgttgatatatttcttgttttttttttgttctgtagttcttgtcatagccgtggtgttgctaggaattacctgcttatcagctgctaatattttcaccaagaaatccaagatggaatagccataaggtacagaggacagaagcagacacttcagtctaactacagatggaaaagctgatcacaccgtccatggacgttccagtgcctagaacaaccatgagatttcaataccaatataacccattgcgcagcctgttacgcatcacaagttttatgaatgtaactaacaatctgtatacgtgtatagcatgtttagaaatttctcatgtcaatttcgttgctttatggtgaataggatgactgttgtctattctctgacccctcttacatcattgaagtaggctccgtttgaacatgcatctgtttctgtttgaacattgaagatcattcgttttgtccgtttagaaagacatgaaagagctggtagcctggcatgtcgtccggcttcaaatctcaaatcccatagtgatgtctattatcgtcttctgcgaaagtggagaaccgaaagtgtggaacacgttatcatgtcgtaacagacagaagcagcctttgctcgctgacttgtgctcgtctgcatttggagcacacggattcagtgcccagacagcgagtgctaactggtcagtacgcggcgccaataaggctgtgtttagatataaagtttggatctaaacttcagttcttttccatcacattaatctgtcatacacacataatttttcagtcacatcatcttcaatttcaaccaaaatccaaactttacactgaactaaacacagcctaattcggttcattcgcccgcgacagagcacatcatcaagtcgatgccgtggacacccatcactctccatcagacgacgtgaacaaaccggcgacggcaccacgcacgcgcagggccgtatggcggcgaagatcccggtgatcgacctgcggctcgccggcgaggcgcccggcgaggccgcgcggctgcgcgacgcggcgcggcgcctgggctgcttccgcgtgtcgggccacggcgtgccgcgggagctccaggccggcatgagggccgccgtgcgcgccctgttcgacctccccggcgacgccaagcgccgcaacgccgacgtcatccacggcagcggctacatggcgccgagcgccgccaacccgctgtacgaggcgttcggcctctacgacgccgcgtcccccgccgacgtcgacgccttctgttcctgcctcgacgcgccgccgcacgccaggtaggtaatttccgtcgcagacagtgtagttgtggagattatgggtaccccatacccacacggcatggttatccgactagttataggggataacttatatatatgaaatatgtaacagatcatgacttgggtattacgtttccctgtatattatggaacggcctaaagtcctggtttgataagattgtaaagtagatttaggaaaccgataccgtattggttatggtttctatcttgtaaccctgccccccaacctatataaggagggcagggagcccctctaggggcatgagacaacctgatcgtcagatcaatacacactcggcggattcaaatccccaaacaggagtagggtattacctctcattgagagggcctgaacctgtctaaatcctttgtctctgcatccatccactttaggtctcgtacgctacccccttttattattgccgaattcatgtttcgacagttggcgcgccaggtaggggttgcgtcgagtttcctatcaacgagcgcgatggaatcaatttcatgagtcgccgacttcgttttcgctttgggagttttcacttcctttccgtcgaccacttcttcaagctcctcttctctgacttgatccaaatcagtcagggggaaactcaatctgatttttatcattatttatcatattgatttttaatctcagattaatctcttgctattttttgttgttgttcgcatataattacgcggcactattgaggcgattgatgctggtcatggactcgaggcgtctcagctttccggtcgatcggccgcgagtccactctgccggcttgtcttcgccaccaccactgctgataacaacaacgacttcaccgccggcctgcctccgtcgccgccgactggtgtctccgcctatatggttggttggtcacaccaccgttgttgggcgtctacgtcttcaccaccggcctgcctccgtcgccgccgactggtgcctccgcctacacggctggcctattatgccgctgctgttgggcgtctacgacttcaccgccggcctgcctccgtcgccgccgagtggtgcctccgcctacacggctggcctattatgccgctgctgttgggcgtctacgttttcaccgccggcttgcctccgtcgccgccgagtggtgcctccgcctacacggctggcctattatgccgccgctgttgggcgtctacgacttcaccgccggcctgcctccgtcgccgccgagtggatcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttaggcgtccacgacttcaccgccggcctgccttcgttgccgccgagtggtgcctccgcctacacggctggcctattatgccgccgctgttgggcgtccacgacttcaccgccggcccgcctccgtcgccgccgactggagtcctcgcctatacggtcggttggtcacaccaccgttgatgggcatcgtcatctacaccgccggcctgcctccgtcgccgccgactagtgtcatcgcctatacggttggtcggtcacaccaccgttcatgggcgtccatgtcttcaccgaccggctggccttcgtccgccgccgactggtgcttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcaccgctgccgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactataccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacgtatttataaactgcctgaatttttctcgagtattatatttacatcagatactactcatcctatatgtttgttctgcaggatccaaatccagatatgcataaaagggattcatggctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62972 - DNA, 912 bp, Oryza sativa
gtcatcgcctatacggttggtcggtcacaccaccgttcatgggcgtccatgtcttcaccgaccggctggccttcgtccgccgccgactggtgcttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcaccgctgccgactggtgtttccgcctgcacggctggcctattatgctgccgttgttgggcgtctacgtcttcaccgaccggcttgccttcgccgccgccgactggtgtccacacctgcacggctggcctattatgccgccgctgttgggcgcctacgtctacaccgccggcctgcctccgtcgccgccgactggtgtcatcgcctatacggttggtcggtcacaccaccgttcatgggcgtccatgtcttcaccgaccggctggccttcgtccgccgccgactggtgcttccgcctgcacggctggcctattatgctgccgttgttgggcgtctacgtcttcaccgaccggcttgccttcgccgccgccgactggtgtttccgcctgcacggctggcctttatgccgccgttgttgggcgtctacgtcttcaccgaccggcttgccttcaccgctgccgactggtgtttccgcttacacggctggcctattatgccgccgttagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttata

SEQ ID NO: 62973 - DNA, 2960 bp, Oryza sativa
  unsure (1)..(2960): unsure at all n locations
tcgtccgccgcccgcgtttcgtcaagtgtgcagcagccccgtcgtcgtcttcgtcctcgcctccgcgtcgtcaagcctcgtgccggctgtgtctcgccttcgtcccaggatcgccgccgaagtcgttccctcgccgtccgccgcgcccgttcgtcgttgtcgttcccacgcctcgtcgcgtggtggtaaggatccgtcctctcgctgccccgtcctcgtccttttggtgtcgccccgtacccgttgtgcggtcgtcgaccccggtacccgtgtaccggtgtcggtagtcgttcacgtgtgcgggtggtgaccgtgtagtgtccgtgttagtgtgttcgctcggtagccgcgtggtttccacgtgtgcagcccgcgtggtgtctagtggagtccgtttgtcggctactcgcctcggttgacacacggggtccgcttccgtcgacctgtggaccgtctctgtgtacctggtctaccgcggtcctttaggttgacatgtggggtccgcatgtcaacagcgcagccttcctgtcttttccaggctagcgcttccacatgttttattgttgcaaagcttaattataataatccgcaaatctccatataacagcactaaacttcggatgatcatatcttggtcatacgaactccgaatcgacccgttcaagtctcttaatgtttgttataacctaaagaactgtttgctttctttttatgtgttgttattgcttctttataggcttgtagctttgcttgtgtgcttcgcgtagctttcgtcgttccggaggttcccgaagtgtggttcgcggtcgtcgccaaaggttcggaaggccgttctctctgagcaaggcaagtcacatcatccttgagcatattgaatcccagtttataaaattattttgatttaaattaatgcattactgctttatttaaattcccgcgttatcactgtttatttagccatgcctatttatcattgttaagacattattattgctattgttattattaccttgttcaccctaggaaaataaaaccccaactagtgggtactctatttatggttccactagtgtgaacttaggtagatgcttcgctggttaaataggcaacattaggtggttttataactttagactttgggaaatctcatatcatttggacattatggaatggttggcttatggtggaattggacatacacctctcttcctctttcaaaacccctaaaacctgttttccggtggggtttgggtgcatgccagttgtgggaagtagcaccctggccactataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggctggtgtcctgctgctaggggctcaatcctgcctacctgtctcggaggttccggccgtaggtggggttgggtcggtactcttgtctatggctaggatgggttggaaactatgtcatgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaataactaaaatgtggaatggttggcctgggttggcttgggacgagctgggacccagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtactcccttgcattaattatgcatctgccggtgtggcttgctgagtactgtggttgtactcattcttgctctatctttctccccccttcagtaagagaagcttcggagaagatgtcttaggtggagtcctggcttataccccagttgagcgcctgtgaagatggagccgtaggcccgctagtccgctgctgtttatttttgtttgtcaggcctgaagtgccttgtaataatgtatttattatcgatataataaagatgtgccttttatatcatgtttgtttggtgtaccccggcttttcctgggacggggattaatacactagcgttcgggaaaaggcaattttctcggtcgcgacaagctggtatcagagccatctcgactgtaggataagccaagggataaaacctaaggacatattttataaataaaactatttgcgaaagttcctgtttcctcctttccctaatgctatgtcacgtcctgataaattcatcccgaaataaaaatcattttttaaaaggaataatagaattaattaaaattcagaaagaaattggcaaacactaaaatgcgtacaagaaaaattcgaatgtggcccggagaatttttgttaaattctccttggtttaaaaggagccctcaaattttacttgaattttcagagcaccggaaataattattaagcaacaaaaacaattatcaaagtttagtaaaaagaaaaacctaaaaataaccttccttcctcctttgggccaagtttggctcaaagtccactctctctctctctcggcccgcggccgaagtccctctctcctccctctttttctctccctctccctccccctcccctctctctcccgggccgntcctccctcccctcccggcctgcccggtcccgggccgccctgccccctcccgcctgggccg

SEQ ID NO: 62974 - DNA, 1040 bp, Oryza sativa
cagagcggttgccttgcttcaactcttggaattcccttttcttaagggccatgactccggcgggcacatgggtcctccggaaagcggcggtgaagcgggcccaagtaataggctgtccttctggctgcgtagcctggaagtggtcccgccatagagatgcgggcccctgcagttggtgagcggcaaagatgactttctcctcatcgttgcactgcacggtgtctaactttttccccacggcatgcaaccaatccaaagcatccacggggttattggagctagagaaggtaggcggacggatgcggaggaactcggcgagtttagagtgttgcgggggtggtggtggaggtggagcattatgctgtggcggattttggatgtggtggaggaaagcagccatcatgttggcctgctgggcgaggatttgggtgaggatggagttggtgtctggtggtggtggtggaggcgggggaggaggcggaggtgggctgccatggttgttgtggttgctaccttcgggttggttgccatcaccggtagtagcacttctcctggttgtcaccatctgaaaatcccacatagaaccggcaaacagagagagctgactattaaaactaaccacccacgactaccataattcttgaatttattactgctattaaattggttcattaaggttcaagttgcttaagcaaataaaataaagacaggctccgacacagttataccacacaccggtataaccatgccccacacgactctggcagaaaaacaaacgagaagaacacacgcgcaagcctactaactgctcgtctacttctgcgacgggccagggcggaaggtgagcagcagcgcatcctccgtgctgccaacgccggaggctccctcctcctgaggaaccacaggcgcgggctcggcacgaggggtctcgacgaagcaggtccacgccagggactgacgaacagttcgggcctggaggtactcttgcgggcggtgatcttcaggctgcggcagacgcgacggcgcttggggcgacaaac

SEQ ID NO: 62975 - DNA, 1239 bp, Oryza sativa
cgtcagcgcttatcatttcctttggaaaaatatttaataattgctcaataaattggtattaattatagaaattcattaaaatggctcaaaacttctaaaattcatatctaattcattcgaactccgaattgggccattcaacttgcaaaattcatctaaaattgagctctacatgtttgtttactttttatgtactctttgcttggtgtttattagagttttttttctcgttttgtgtgccagcgagtagattctgttgtttcagaagttcgcagtcacaaggatcagagttcagaagattgttgtgaagaagcaaggcaagtcacacattccccttgagcatgttgatcccaatttataaattttttatcgtttgcaaataaacatgcatgttttgctaattacatgggatcatggttttacctatctgcttggttgtgccatgtttacttgatatctgtcctttgtcaacattgggtaataaatcaactagctcatgttacttatgtgacatagctagaactatatgcttagccatgcttaattaccactagctcagttgatgggatgattgcagtattagacctttttagcaatagaacgagctgcgtgctcgagacacctggccatgtttcagtggtcgtaattatacaactaaaatgcgactgaatagtgggctgtgggtgcatggttttgctagtcgcaccctggaagaatttctcgtacttaccacaagccagcgtgggcaacgactgggcctgtagtgtagctttcctctagctgacgcatccaggcaagggtgggcatgatggagcggggcgggccctgcgacggcctctatcgcttccggattcacctaggcatgacaggggactgcccgttgcccgctggggacgggggtcaaacctgaggtgtggtgtgcttggctagagggggttatgcgaagggtcctgtcacggcctctttccggtatgtcgtggtggcatgtcggcgcatggaaacgtgtgatgtggctgtgtcttgtggttacagttgtacacctctgatcagagtaaaactattcgaatagtcgtgcccgcggttatgggcggtcgaccagattcaccgtgattagtctcacacttaataaatcgacgcaatgcactgtagttcaggtgggttggttgggcctgttcaacgtggtgtagcgttgatcagtggagatttaatgttactttaattacttaactgggctgcagg

SEQ ID NO: 62976 - DNA, 739 bp, Oryza sativa
taggaggatcactatgactatagcccttggtagagttactaaagaagaaaatgatttatttgatattatggacgactggttacgaagggaccgttttgtttttgtaggatggtctggcctattgctttttccttgtgcttatttcgctttaggaggttggtttacagggacaacttttgtaacttcttggtatacccatggattggcgagttcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctattcaatttcggccttataatgcaatttcattctctggcccaatcgctgtttttgtttccgtattcctgatttatccactggggcaatccggttggttctttgcgccgagttttggcgtagcagcgatatttcgattcatcctcttcttccaaggatttcataattggacgttgaacccatttcatatgatgggagttgccggagtattaggcgcggctctgctatgcgctattcttggggcaaccgtggaaaacactctatttgaggacggtgatggtgcaaataccttccgtgcttttaacccaactcaagctgaa

SEQ ID NO: 62977 - DNA, 721 bp, Oryza sativa
ctgcagccctctgctttagtctaagtttttgacttagtaataaatgtgaatgcaagcgtgccatgtttggtctctgccgagctccacatataaaccttagagtaggaatcaaaaaggcatcatttggtgaggaattcaaattgatacacttagagggactaagtgaatcaattgaggaacttggttttcttttccaaaatcatttgaaaacttccggaataagagttgataaagatcgggtgattggtgctctagttgttgttctgtctttcaaccgcccaaggcaaggagaagcagtgtctcgtgggaatcaggggtaagggtaagccaccgtgccaaagattatttaatctgagagagaatacatataccttgcacctgtatctttgagatatgcagcatagtagtaactcctgatcaacaaccaagtctttgtttcctttcgtccttcactcgggacaagcaaaggttcaagcttggggggttttgttgacggtcgttatcgatcagtttcgaccgtcaatattactaaaacaggagtgaactagtgatgcttgcaatgcatatatttgttagaataataatattccactagtattaggtttactaaccttttgcagagaatgatcataaagtggaggagaatcgacatcaacaccaacgataaatcaataaggcgatgtcgagaaccagacttatgcatgaatgggccacgaactca

SEQ ID NO: 62978 - DNA, 67672 bp, Oryza sativa
  unsure (1)..(67672): unsure at all n locations
aattcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactagtaactgtttttgctaggcaaatctgtgagttgagtgattttaaggaacatatactctttgagcaagtttatagccaatttagtaaaaatctcacatcttatttacattcttacggggatatttctgtgacagacattatattggattatagaaggaatcaaagagatgctagccatgacctttcttctcaggaggtgatgcttcccttttaccagtgacattttctgctttatgaactacagactgagggggagatgcagcagtagcttcccttcctacttcaactaccaactgcactaaaggatccaagctagaaaaaatttcttccttggagatatcatgatctatatacttggattgaactgagttcatattaatgctaccacacctaacattaataaaaaagaaggtgtttgtttttcaagaagaatgcatgtggtaagtttggtacagagtagagatcaaaacagtaaacagcagctgtgatcggttgggcaggcataaacatcttcctaattataattagttaaccatgcatttttgaaacacggtttctttctagaccaagtcaaactctgacccaaactaactctttggattattttagttattaaatgtagaaaagctatattaaataggtagttgcctccctactttcccagtgaacattgttaaacccacaagtcaaacatggatcacccatattttgttaaagaaactatgcaatttagcacgcttgacctaagaagctaagaccaatccttgataatactaacatgcctaaccatgctcctaatgcttaccactccaaattcaagtatgaaagctattttgttatgtaacctaaaaataatttcgaacttgagaatcatcgatatcgacactagaatacaagaagagagaagcttataaattttaagtactaattatgactgtcagaaacaatcagaactaattactgctctaattttcacaaaggaaggatcaataggagaatggaaaaaaaattgctaatcactactccatttcaagactgattcacacgaaaaactgtctacgagagaggttgtgaatcctgcaaaactgaatcctctactcgtcgtctttatctcggctacaaatcactccagcagcagcagcaatcaagcaccaacagaataccccaataaaccaccagatctggtgaaagcaacacatcaaccgcacggatccgcgaaagccagcatctcttctaccgatttcccaactcgacaagggagatgttaccctcacccagatcccgacgcgccgctggcctgctgccctgcacccttgccccgtgccgcgtgcccccgcggcccgcgccacctgcccgcctctcgattgcaagtcgccggccgccgctggtcatcgtcatcgtcatcgtcgcagctagcgtcgccgctgtcgtcgccgtcgttgcagccactgtagctgtcgtcgccgcagccgccgccgccgtagccgctcgctcccgcctacctaagcccgccgccgccgctccggagggcggaggtgggtggatccgtgtgttgccggtgctcccgctcacgccaggccgctcccgagtacggaggccactggattcatgcgccgccgtcactcccgaggacgggaggcggcgaatccgctcgccaccgtccttccctggccgggggagcgacacggggaaaggcgaagaggtggctgggggcggcgcgatggattgaggaggagagggatgttggcggtgggggaatggatggtggcgccggcggcatatggatttagttttggctagggtttggggaagaggttatatggatgagaagcaatccgacacgaatttaccaaactgtccctggtatgtccacagtagttacgaaattgtatgaacaaaatggacatttcaccttaaatttatgagaactttaaatttaattttaggctgatttttgtgtttcaaatgcaaaaatcataaacaacaaaattgtagaactcatcaagatctacaactattatattggtcttttttacaaagaagttcatttgaacgattcaaattttgaattttcaaaatttgataacgtcaaacaaaaattgaggttaataaatgattcgaaatggaaaagtcaccaaaaccaaagttgtagaactcatcgagatgcaaaatttttattttggtcatttctccatctgactctaattaaataatttgaaatttgaaattcaaactttgagaacttcaaatagattttttttattagtgaacgacttcaactgaaaaaatcatcaacaacaaagttgtataattcatctagatcaaaaatttttattttggtcatttgttcatccgacaaagtaattttagtattgtttacaaaatttacatatctcttatatggttttataaactataagagagatatgtaaattttgtgaacaatgttactatcactttgtcggaagaagaaatgaccaaaataaaagttatagatattgatgagttatataactttgttgttgatgactttttcagttgaaatcattcagtatttgaaaatgttgtttgaacttgtcataatttgaaattcaagttcaaattattaaaacaaagtcatatagccaaatgaccaaagtaaaagttatagatattgataagttatacaattttgttgttgatgactttttcattcgatatcatttagtatttaaaaatattgtttgaagttgtcataatttgaaattcaaattcaaattattgaaacaaagttatactgaaaaatgaccaaaacaaaagttgtagatcttgataagttatacaactttgttgttgataattttttcatttgaattcatttactacccaaaaagttatttgatttaagagaagggaggtaaaatgtacttattggtgaggggggagcaaaagggcttggccggtggcccaaagagggaggaggagggagagagaggctgcgggctaagggatggagagagtaatacttgagccgaaaaaggcccaaggacagacagaggaattttaatttgtttttcatttattttaataggttaaataaactttgtggtattaaaattagttattgagctccaaaaattcacggaaaatttaaaagaataatttagaccaacttatagccattttagtttgtttttttaacttttttcattcaatcataaaatgaaacgccataattttgtttttttattcataaaatgagactagagatgacttcaatcctaaaatcctaaaatgagatattagaattaatgtagacaagaagagtccacctaggaaaaacgattatggtctagtagcaatgtagtataactagatttttttttgtttttaaaaaatataatagttctatattttatgacgatccattattgtcatcgtgctatcgtcacagagcccatgcagagtatactgtgacgatgattatgacagatacacggtttggtcataaacaactgtcaacctgtgaacaatcgtcataaacagcctctgtttatgacagatatgtgttccgtcatcaggtaatcgtcatagaagcccatatttgttgtagtgccagggcgccatggcatggacccagcctttgttcgacccatccatggtggcacaccaagcgtcaccgttcggagccgggcagccgaacactgtggcccaacctcacgcgcaaatcatgacttcgccctttgccacgccatatccaaagccaaacaggccttcgcagcaaggtgccgtgaacaaggcaggggcgaaaaggggctaccgctgagcgggggaatcaagattcgtccaatcccactccagttcaagttcccacccgttccgcggtactcgggcgaaacggacccaaaagagtttctgtccatctacgagtccgcgatcgaagccgcttacggcgatgaaaacaccaaggcaaaggtaatccatctcgctctagatggcatcgcccgttcttggtatttcaacttaccagctaatagcatttactcttgggagcaattgcgtgatgtttttatccttaattttcgaggcacctatgaggagccgaagatgcagcagcatctactcagcattcgccagaggcttggggaatcgataagagagtacatgcgtcgcttctcacaggcgcgatgccaagttcaggacataaccgaggcgtctgtcatcaatgccgcttcggccaggctactcgaaggcgaacttacaagaaagatcgccaacaaggagccgcagacactcgagcacctgcttcgtatcattgacgggtacgcatggggcgaagaggattccaagcgaaggtaggaaatccaagccgagtacgataaggcttctatcgccgttgctcaagcccaagcacaagtacaggtcaccgaacaggctctccctaccattcgtcaaccccagccggcgaaccaaggacagccgccaaggccgaatcaagctcccgtaacttggaggaaattcagaaccgaccgtgcgggcaaggcggtgatggctgtcgaagaagtgcaagccctccgcaaggagttcgacgcccaacaagcaaacagccatcaccagcccgttcgcaagaaggtcagaaaagacctctactgcgcctaccatggacgctcttcgcacaccaccgagcaatgccgaaacattcggcagcgcggcaatgctcaagatccaaggccgcaacaaggagcagttgtcgaagcacctcgcgaggttgttcaagaacaagcacccccagccgaacagcgccaacacgtgcagcagagagtaatccaagtaattacaagagccgatccgccagctcaaccgacaaaacgatagaagaagatgcagctgcgaatggcgcacaacatcgcttcggtgggcgaaggggctccacggtacttgaatcagcaaatccctttcgggccggaagatattgaaggagtgctgttcccgcatcaagaccccttggtgatctcggccgaggtagctggctttgaagtccggcgaatcctggttgacggaggcagttcggtcgatgtcatcttcgcggaggtaccggcaaggtacggtgacaagggctgggggcgaaaaggagttgagtccaagctggggggccgcgaagccagcctagcctctggttccctttcgccacacccacgcccttcaccacagtacccgcaacgtacggcgacaagggctgggggcgaaaataagttaagtccaagctaggggccgcgaagccagcccagcctctcgaccacttttgccacacccacacccttcgccacagtacctgcatggaatggcgacaagggctgggggcgaaaatgagttaagtccaagctgggggctacgaagccagcccagcctctggacccctttcgccacatccacacccttctccacagtacctgcatggtacggtgacaagggctgggggcgaaaatgagttgcttccaagctggggggcctcgaagacgcccaagcctttggacccctttcgtcacacccatgcccttcgcgacagtaccggcaaggtaaggcgacaagtggtgggggcgagaaggagttaagtccaagctggggggctgcaaagccagcccagcctctggacccctttcgccacacccacgcccttcgccacagtatccacaaagtacggcgaaaagggctgggaacgaaaatgagttacttccaagctggggggccacaaagccaacccagcctctggaccccttttgccacatccacacccttcgccacagtacccgcaaggtacgacgataagagctgggggcgaaaaggagttaagtccaacctggggcccccgaagccagcccagcctctggacccctttcgccacacccacgcccttcgccacagtacccgcatggtacgtcgacaagggctaggggcgaaaatgagttgcttccatgctgaggggccacggagccagcccagcctctggaaccctttcgccacacccactcccttcgccacaataccgcaaggtacgacgacaaggcaaaggggcgaaaaggagttaagtctaagctgggggccgcgaagccagcccagcctccgaacccctttcgctacacccatgcccttcgccacagtaccggcaaggtacgatgacaagggctaggggcgaaaatgagttgcttccaagctagggggccgcggagctagcccagcctttgtaccactttcgccacaaccacgcccttcgccacagtacccgcaagatacggcgacaagggatggggcgaaaaggagttaagtccaagctggagtgccgcgatgccagcccagcctctagacccctttcgctacacacacacctttcgccacagtaccggcaaggtacgacgacaagggctgagggcgaaaaggagttaagtccaagctagggggccgcgaagccagcccagcctctggatccctttcggcacacccacatccttcaccacagtacccacaaggtacggcgacaagagctggggcgaaaatgagttgcttccaagctggggggcttcgaaactgccctatcctctggacccctttcggcacacccacatccttcaccacagtacccgcaaggtacgtctacaagggctggggcgaaaatgagttgcttccaagctggggggccttgcctatggacccctttcgccacacccccgcccttcgccacagtaccggcgacaagggttgggggcgaaaaggagttaaatccaagctgggggccgcaaagccaggccagcctctggatccctttcgccacacccacacacttcgccacagtacctgcaaggtacggtgacaagagctaggggtgaaaagaagttaagtccaaactagggcaacgaagcctgcccagcctctagacccctttcgccacagccacgcccttcgccacagtacccgcaagttacggcgacaagggctgtgggcgaaaatgagttgcttccaagctgggggcccgcgaagccagcccagcctctggaccccttacgccacacacacgcccttcgccacagtacccgcatggtacgtcgacaagggctgggggtgaaaatgagttgcttccatgctgggatgccgcggagccagcccagcctctggaaccctttcgccacacccactccctacgccacagtaccgcaaggtacggcgacaaggcctaggggcgaaaaggagttaagtctaagctaggggccgcgaagccagcccagcctccgaacccctttcgctacacccatgcccttcgccactgtacccgcaagttacggcgacaagggctgtgggcgaaaatgagttgcttccaagctggcgggccgcgaagccagcccagcctctggttccctttcgccaaacccacgcccttccctacagtagccgcaaggtacggcgacaagggctgggggcgaaaataagttcagtccaagctgagggccgcgaagccagcccagcctctcgaccactttcgccacacccacaccctttgccacagtacccgcaaggtacggcgacaagggctgggggcgaaaacgagttaagtccaagctggagggccgcgatgccagcccagcctctggacccctttcgccacacccacggccttcgccacagtaccggcaacgtacggcgacaagggctgacggcgaaaaggagttaagtccaagctagggggccgcgaagccagcccagcctctggacccctttcggcacacccacatccttcaccacagtacccgcaaggtacggcgagaagggctggggcgaaaatgagttacttccaagctggggggccttgcctatggacccctttcgccacacccccgcccttcgccacagtaccgacgacaagggctgggggcgaaaaggagttaaatccaagctgtggggccgcgaagccagcccagcctctggatccctttcgccacacccacgcccttagccacagtacccgcaaggtacggcgacaagggctgggggcgaaaataagttaagtccaagctgggggccacgaagccaacccagcctctggacctctttcgccacacccacacccttcgccacagtacccgcaaggtacggcgaaaagggctggggtcgaagatgagttgcttccaactggggggattcgaagccgccctagcctctagacccctttcgacactaccacgaccactgcaaaagtacccgcaaggtacggcgacaagggctgggggaaaaaaggatttaagtccaagctgggggccgtgaagccagcccagcctctagacccctttcaccacacccacacccttcacgatagtacccgcaaggtacgacgataagggctgggggtgaaaaggagtaaagtccaagttggggggccactgtcacgtcctgataaattcatcccgaaataaaaatcattccttaaaaggaataatagaattaattaaaattcaaaaagaaattggcaaacattaaaatgcgtacaagaaaatttcgaatgtagcctggagaatttttgttaaattctccttggtctaaaaggagccctcaaattttacttgaattttcagagcaccgaaaatatttattaaacaacaacaacaattaacaaagtttagtaaaaagaaaaaaactaaaattaatccccctcctccctttgggccaagtctggcccaaagtctccctctctccccctcggcccgcagtccaagtccctctcccctccctttgtttttctctctttcctcccgggcagcccactccctcctcctccttcctcccggcctgcctcggcccagcagtccggcccaagccaggccgagccgagccagccgcgtgcacgcgcgccgcgcgtgcgctgaccgcgcgcctgaccggtgggtcccacccgcccggtcgtcgtcttcctcccgcactgcctcctctctctcccgtgaaaaccctagttcgttcctccctcgaatccgcgcgatttaagcgttggattccaaaattaattgaggggaattaatcccctttccttcctctctcttttccccctaatctcccctttaatcgtgcactattttgaccagaacggctgcgccattcatggccgccttccatggccgccgggcgccttttccgccaccgttccccgctcctcccgtgctcggctcgcttccctccgctataaaatggaacccactctttgcgttctatcgttttagcaccctcccgcgctctcccgtggcctcaccacctctccccgcctcctccttctctttcctcggtgccggccaccctccagccacccctaccgcctcgcccacgcgccgtccggccgtgccgccgccttccccggcgtcgcagcagcctcctctccactggcctgccctccgtttcgcacggagacccctggaggtgcgcccccgccggcaacagtggcgttgccaccactgttccacccccggccgcctctgccgcgtctcccgtgcgccggccgacgtcgccaccacctctcccggcaccgaaacgccgtcctcttccccagccaggccacgatgtcgcccgtatttcgccggaacaccgccgtgccgcgccggcctctccatccacctcgccggaatttccccggtcgaccgcgtcgccgtcttctccgtcgcagcggcaaggttgtcctcggcatcgccttccctccatccgaaccccgccggtgttcgtcgtcgtcgtcatcgttcctcctcaccggctcgttctctcgttgcgccgcctccgtcgtcggattcgcagtggcgtgatccacgccgtcctcgtctccgtgcagccgctgccggctgccctcgtcgcctcctcgccggccccggtcgtcgtcgtcgtcgtcctcccgtcgttcccggtcatcgtggcgttcatccctccgtcaagccgttctcgtccgtcgtccgcgtccgtcaagtgtgccgctgcagccccgtcgtcgtcttcgtcctcgcctccgcgtcgccaagcattgcgccggccgcatctcgccttcgtccaaggatcgccgccgaagtcgtcccctcgcctttcgtctccgtcattcccggccgtctccgccgcgcccgttcgtcgttgtcgttccctcgcctcgtcgcgtggtggtaaggatctctccttcgctgccctgtcctcgttctttttgtgtcgcccagtacccgttgtgcggttgtcgaccccggtacccgtgtaccggtgtcggtagtcgttcgcttgtgcgtgtggtgaccgtgttagtgtgcccgctcggtagccgcgtggtttcacgtgtgcagcccgcgtggtgtctagtggagtccgtttgtcggccactcgcctcggttgacacacggggtccgcttccgtcgacccgtggaccgtctctgtatactcggtctaccacggtcctttagttgacatgtggggtccgcatgtcaacggcggagccttcctgtcttttccaggctagtgcttacacatgttttataattgcaaaactaatcacaataatccgtaaatctccatgtaacagcattaaacttcggatgatcatatcttggtcatacgaaccccgaatcgacccgttcaagtctcctaatgtttatcataacctaaagaaccgtgtgctttctttttatgtattgttattgcttctttataggcttgtagctttgcttgtgtgattcgcgtagcttctgtcgttccggaggttcccgaagcgtggttcgcggtcgtcgccgaaggttcggaaggccgttctctctgagcaaggcaagtcacatcatccttgagcatattgaatcccagtttataaaattattttgatttaaattaatgcattatcgctttatttaaattcccgcgttatcactgttttatttagccatgcctatttacctttgttataaccttatcattgttgttattgttattattaccttgttcaccctaggataaacaaaaccccaactagtgggtactctattcatggttccactagtatgaatttaggtagatgcttcgctgattaattaggcaacattaggtggttttataactttagactttgggaattctcatatcatttggacactatggaatggttggcttattgtggaatcggacacacacctccccctctattcaaaacgcccaaaatggttttaggctgggctcgaggtgcgtggttgggttttgttagtcatacctcgggtactataaggattaagctcggacctctgttgcaaagcactaccatactttcacatgtctagtgggtaaggcttagtttgtggttcagtctggttataaacaaaagtacacggatagagatggatgaagtcgggggtcgatggacatctctaggacaaatgaaggttacacgagctgcggcccagtagtcgagatgtcatggcacagggctggtgtcctgctgctaggggctcaatcctgcctgcctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtaggaagatgtgtcttgtgggtaaagatgtacatctctgatcagagtataacctattcgaatagccacgccctcggttatgggcaagcctagcaatgtacccaagttagtgttttaattcttaaaacctgcttaacaactaaaatgtggaatggttggcctgggttggcttgggacgagctgggacccagggtcgggttgccagttcggtctgaatcatcgtaggccttaagttaaggcaggttcgtgagggttcacggccttgattaataacactgtgtagctctaggatcgtctttataaaatggctttgggcaactaagtgacttttaaaagctgtttactgcaaaacttaacccctatattattaccccttgtacccccccttcattaatcatgcatttgccggtgtggcttgctgagtactgtggttgtactcattcttgctcaatctcccccccccccttcagtaagagaagctttggagaaaaattcttaggtggagtcctggcttataccccagttgaacgcctgtgaagatggagccgtaggcccgctagtccgttgctgtttatttttgtttgtcaggcctgaaatgcctttgtaataatgtaaatattatcgatataataaagatgtgccttttgtatcatgtttgtttggtgtaccccggcttttcctaggacgaggattaatacactagcgttcgggaaaatgcaaattttctcggtcgcgacaagatggtatcagagccatctcgactgtaggataagccaagtggataaaacctaaggacatattttataaataaaactatttgcgaaagttcctttttttctccttcccctaatgctatttgcaaaaggtttactcccttcttccttcttcggatttcaactagtactagatggtcagctcagcgaagaagaagaaatcgtcagttgtctgccgaagctccggaaggctgttggatccgttagcaaagtggaggaagcagtgaagccagctgtgaagaagcagtgaagatcttggagaacctgtcgcagaacctaagccaccctctagtgtttcgtttgtcgtgtgtttccttgcttgtgtgtgtagcgcgtggtttgcatcggtgggttgtgatgtaaccatgctaggttgtttgcttaatcaacttgcagaataagcaaaacaaacaacacatcaacaaaaagagttagttcctttaaggtattgtccctagttctggtctattctttccttgtatgcttcctctctcaacctctcccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacaacatttcaactattacagaatcggaacaaccccgcaggggcaaccaacgttcaagtacctacagtccagcgacagtgcaagttatcagaattcctcaaaactgatcctccaacctttgccattgccgtcgatcctatggaagcttgtgattggttgcgcacagtcgagaagaagctggggttgattcagtgcacagactaggagcgggttgtcttcgcaactcatcagttggttggaccagcttcagaatggtgggatagctatgaagcatcacggccagaaggacataccatcacttcggatgagttttcagccgtgttcaagagatcacatgttcccacgggaatgatcacactgagaaaacgagagttccgctacctgaagcaagaagatttgaccgtcacagagtacctgcacgagttccatcgtttggctcactatgcaccagaagatgtggaaactgatgaagacaaacaagagaagtttctccaggggttaaaagatgagatcgcagtgcaactactcctagaggaatatgaagattttgagaaacttgcggacagagccatacaactcgaaagtgagcataatcggatgaagaactgcaagagaaggattgtcagcatcccagtatttccatgtggtaaccaaagacagcgcactgagccacttcagatcaccggatcttctgttgcgcatcaagaattcctgccccaagaagatggacacaatgcagacaacaacattagcaatactaatgatgaggataccaccaacaaccgtgcttcttgccccattagtgaccactcgaatcaagcgtgcaatgtcaacatcattcaccaaggtgtcgacgatagtatcaatgatggcacccagaatgacaaccctagcaattgtgactctgagaaagactccaatggtgattgcaactatggtaccaccgatgccaatgttagcaaggatttccaaccatcaattccaactccaagtcagaatgatcgtccccagacggacagctcagtaaagaagacgttgatttgttataactgcaaagaacaagggcatgactcgagggactgtctgcaaccaaggcaaagtcggcctccacattaccgccaatttacatgaagcagacatcctaatcgtattgtggtcactggagcaaacgccatacctgtgaggcctcgtgttaatcataacccatagcagaaacaatgtaccaatgctaagcacctttccttttaggcagtgcttagtattcattaataagggagaaatgtgtaatacagacatgttctatgaggattcttttggaagatgtggatatgggattatgtgtataattgcttactaataaaggagacctagggtctcgtgtcagaggaactatattctaacctcgagttaataaccaacctgttgatggaaaagaaaaccaattaaactgtgttagattaaaaagccagtgagacagtagttggggataagagtttggatacgccttttacggatcaagataaggattgttggatgaaacccataatggtacctaccatgcctctacattgataagttcggatatacctgcaaacagttaagaagatccaggagacatcaatatttgagaacatagtagtcgatggttggtaattagtctatcaggtatcagaaaagggtcaaaggtgatatggcagaagaacaatttggatgctccccatctcgaggaaacactaaagatgatcatcggcaattaaaccctagtggcatagatacagatagcaagcaatgtatttccctgaaggtagtcagtgcagctttttgacgaaccacttcaaggtttcactgaaaggcagcaggccaaaggacctcagttctctagccagaaagaagtaggccgaaaggtgattgataaaggataatcagaagcatgctttgcatcgctcgaggaagacccctgatcaccctgcaacagtcaccttgtcattgaggtagaaaaaaaaattatgagtaagcaagatgacctaggtaaaagtgtttctatgaaggcaaggagtgaaatcttcaactcggtatcagatgctacacggagtgaaaagtgtaggcaccggttaccaggcaatgccatgtcttggaagatgatccaatgggaaggaactcatcaaggtcgaaggtgtaaaggaatacgttgaatgctaaatgatgacaacatgaagataatagtcggaagtaaactgaatgtaaagaaagtgaatccgagctgcttgttcgtgggagctattcccagttatgaaccaagtgatatgttcgaagatagtctacagaggtcagattaaaatcacatctaacaacgaagcttcagatttggcaggataacgatcagacaataaaaagtccagcagtaaagccatttgggaagacgtcaaagcatgtcaagtgggataagttggttcggttgagaaacataattcaaaggcaaagttatcgaccctcgcatggaatagcagaagtagctagcacccggagagcaggaaagctaatatgaggcagttggtggcaagttagaagtaaatgacaagcatggtattctcatgatgacaagcatggtatcctagtaatgacaagctgatatcgacgcataacgtgaagtgggtaacttgtatgaggttgacgccaaagatatgaattataagaagttctagaactgaagccccatcttcaagtgccgcaacccagtcgaagtcagctaaaggttcaaccagggacaagtcaggtgaagagaagattccatctgcaacaggagatcgagccaggcagtaaagagtggagaagttttgctaggcaagtttgttataaaagacgtgacggaagaagttagacaagaagagaagaccacccaacctatattcttgctagcctcctcgaatctcggggacgagattcctgtaaggggggtggatttgtcacgtcctgataaattcatcccgaaataaaaatcattccctaaaaggaataatagaactaattaaaattcgaaaagaaattggcaaacattaaaatgcgtacaagaaaatttcgaatgtagcccggagaatttttgttaaattctccttggtctaagaggagccctcaaattttacttgaattttcagagcaccgaaaatatttattaaacaacaacaacaattaacaaagtttactaaaaagaaaaaaactaaaattaatccccctcctccctttgggccaagtctggcccaaagtctccctctctccccctcggcccacagtccaagtccctctcccctccctttgtttttctctctttcctcccgggcagcccactccctcctcctccttcctcccagcctgcctcagcccagcagcccggcccaagccacacccaccaccttagtcacagtacccgaaaggtacggcgacacgggctgggggcgaaaatgagttgcttccaggcttgggggattcgaagccgccctagcctctggactccttacgccactcccacgcccttcgccaaagtacccgcaaggtacggcgacaagggctggaggagaaaaggagttaagtccaagctgggggccgcgaagccaacccagcttctggacccctttcgccacacccacttccttcgccacaatacccgcaaggtacggcgacaagggctgggggcgaaaaggagttaagtccaagctgggggctgtgaagccagcccagcctctggacccctttcgccacacccacacccttcgccacagtacccgcaaggtacgacgaaaagggctggggacgaaaatgagttgcttccaggcttgggggattcgaagccgccctagcctctggactcctttcgccactcccacgcccttcgccaaagtacccgcaaggtacggcgacaagggctggaggagaaaaggagttaagtccaagccggggccgtgaagccagcccagcttctggacccctttcgccacacccacacccttcgccacagtacctgcaaggtacggcgacaagggctgggggcgaaaatgagttaagtccaaggtggggggccgcgaaggcagccaagcctctggacccctttcgccactcccacacccttcatcacagtacccgcaaggtacggcgataagggctttgggcgaaaatgagttgcttcaaagctggcgggccgcggagccagcccagcctctgtacccctttcgccacacccacgcccttcgccacagtacccgcaaggtacggtgacaacggctgggggcgaaaaggagtttagtccaagctgggtgccgcgaagccaacccagcctctggaccagtttcgccacacccacacccttcgccacagtacccgcaaggtaccgcgacaagggccaggggcgaaaaggagttaagtccaagctggggaccgcgaattcagcccagcctctggaccccctatcgccacacccataccgttcaccacagtaccgactcggaaaaacattttctgccgattcgttgtgctgatacagttcattatcgacaataacaagcggtttgactccgagaagtccaaggaaatgtgcgaggggttgaaacttgaaatcaagttcgcatcggttgcacacctgcaaacgaacagggcagccgaaagggacgaacggcaaaaccctagttaacatgctctgggccctccggacaacgtcgataaaacccaccaagctcttatacggcaatgaggctatgacgccaagcgggctgggggctaattcaccaagggtaatcttcgctggaggtgaacgaagaaagccgacaacggttaaaaacggtcgaagtacctaaaaaagaccgaaagccggtaacggttaaaaaggtcgaagtgctaaaaagaccgaaagccggcaacggtcaaaataatcaaagtacctaaaaatatctttgccaaaggaaaaaaggggaaagtacaagccgaacagccgtaacacgcaccacaccccatttatttgccaaaaaacacaagttatagataaatttcattgcccgccaaaaggcattcggactttagatccgatgcatcagcaaaagtagtcctcaatggcgaaggactaccccttgagcatcttcttaatcgcaagttgttagatcaacaaaaaaaattttaagcggtgaagaaggaaaaacggggactatgcagtgtcgacgctgggcaatggcaaactgacgctcagtcatataaaattcatgggtgtcttcgtcttttttctgtgtatgatatttcgtggaaaaaccccaaagcaaacgcctgatcaacgaaaacgccaggggggtgatacgaatcggccaaagtactgctcgccgaatgttgaaaccgcgacagctcgtttttggaaaacacaccgatcgtcgctacactcgacttatgcaaatacttaagcatttctgaacgtgtatgccaaaagtcgagagcgaatgatgagggctgaaaagtcgacatatcttttcgctaaattacgcaaaggggccgacatgtttcgacctaacgaaaggacgaaagtgactatgcaaacattagcaaaaagaaatttgaaacacacacataagctccatcaggcgaaagcacatacattacaaaaaaaagggagctacagcttcgccataaaaaggcgaaaaccaaaagatggttaaccatcagggcagccaaatgcaagtgtcaatttttttgcaggtactaaagaaaggtttcggtaggaacatcggctgaaagggggcgcctcatgccataccacataatttgcatggtctcggccaaagctccctactcatccttgcccatgaggggcttgttggaggcatgtcacgagggccttcgaccggacctgtcgaaaccaatccacaagcgaggaatcaagccagaggcgtcaagttcaaccgggacgaagccatatgacaaaagccgtatggcgaaagccgtatggcgaaggcgcgtggcaaagaacaaaggaccatgtctatgcctcgcaaccaagaggaccacattggcgaagggcgcatggcgaaggccatgcggcaaagcacgaaggcttcgcccaagctggagccgaggcgaagaaggaggacaagagggccgctaggcccatgggggccccttccgccataaccaggctggcctagttggcccatttagagcacataagtgtaaatgacatattgtgccctcaataatgtccctatcataagggtatccatgtaaattcccctgtaaacataaaccctagaagagggaagcttgcaatggggctataaatagccccctagggccatgtaatggggggtcccaagaaaaatcttaaattactacatctactgtttccaacactgttgagtgaccacgtccttcgacgtgcacagttgtcgcttcgacaccaatcaccacggccaatttgttcatcacaaaacatcaatcatggaaatgattttatatcatgtttatgttagaaatttggtcataattcggcatattttaatccaaaatattaagataataaacatgacatttgcaatttgagttgatctagtaacagtgctagttgtatacaacatgagcatgcttaaggtgaaataagcatcaacatttacatagtaacgtaatgatgccattgcgaaggatattaacaaacaaacatctagtagaatagggagaatagaagtataccccgagaacgtcccactgctggattttgagatagcattgcctctgttgatgaccttcacttctttgtctccaatcttcgttgacatgttagcgaaggtgccgatgcagcagcagtagtcgtgaagaacaggaacagttgcgcttgaagcgctccccaaaaacttgatcgcccgcctacccgtgcaggttctcaagcggacggagttccggaggcacctgctcatcccgtacacctgtacacgcaggtgaacagaactggggaaggattatgcagcgcaggaacagagggaggaaccggaggaacttcggaaatgcaagagatgggaagaacagaagaactcgttattcttctgttcgtccttctggtcgctgcagagtatatatatgcgagcgcaagagtaacgttcggggtcatcaaccgtggtgtttaattccgtaaccgacgcgctcattaatacagaatcaattcatggcgtttaattccgtaaccgacggaattaattcacggcgtttaattccgtaactgacggaatcaattcacaatgttttgttccgtaaccgatgcgctcattaatacggaatcaactctccgtgtttattaccgtccgttatgagagagcaacagcagcaacaacaacagccgcctgcctgccttgccccgccccgtcccgtctggctatccacccaccatctcaaccggtcaacaaagactctctactagctttgtatttcacttgagaccttttcacttagatttccaaggtagtattattacccatagcacttaatgtgggccaatggaatttattaggatttaattgggcctagcccattaatctaacaatccctaccaaatttcatggctcacacgaaatgctctcgattctgatcatgtttgttataccagtgtttcggtggagactgttaagttgaacttccacctaggaaaagagctacactagaccacaactgaacaatggactatgccttgaattattagtcttgtgcaatcaggtttcactcaaacccttaaagggtactgggctgccgtttgcatcccctctgtttggagcgtttaagtcataatcctggccttttcatgaatatctagagatcaccaagatctcatagactgtgactagcagtcggactcatataggtgtattccttctatgatgttctgtagatcaacatctctgctttatgagaagtactcagatcacattaaggtgtataccctccttccatacagaatagaagagaagtgcatcatgaatataagcccattttagggtctcttctctcagctacacaatagtttgtttcgccatccaaattcacgggatctttgatcacaatggacaggtttccactattgtgcaactctaagtggatctcaagcccatcttccttaatgcaaagtctatcacattacatgctagccccttggtaaactgatctgccagatttttagccgtctggacatagtccaatgctatcactccgaagtttttcggctttctgacagacttcagtcttctttttacatgcctggatgacttcatgttgtcctttgaactgttcactttaataatcactgtttgattatcacagtttatcaggattgctggtactggtttttcaaccaccggcaagtccaacaggagctcacgaaaccattcggtctcaactgtggcagtatctaaagttgtgagttctgctttcattgttgacctcgttaagatggtctgcttgcaagacttccaggaaacaacgccacctccaagcgtgaacacatactcacttatggcatttatctcaaaagcatcagatatccagtttgaatcactatagccctccaacatttttgggtacccggcgtagtgaattccatagctcattctcccttttagatagcgcattactctttcaagagcatgccaatgatcatctcccgaatttgaaacaaaccggctcaacctgctcatagcaaatgaaatgtcaggcctcattgcactagctaagtacatcaatgaaccaatgatctgtgagtatctcagttgatcccttgctactcttcggtttttccctaatagcacactgggatcataaggagtaggagctgccttgcagtcactataaccaaagcaactcaggaccttgtccacatagtgagattgcacaagtgtaatcccaccctcatctcctctcagtagcttaatgttaagaataacatcagtcactcccaaatccttcatttcaaagcttttggatagaaagtccttgatcaatatgtcatcgacatataaacacaagatcactccctctcccccaccatagcgatagtacacaaatttgtcagcttcattcacaacaaagccagcagatgtaagtgttttatcaaacttctcatgccattgcttaggcgcttgtttgagaccatacaaggacttcaacagtttgcacaccattccctcttgaccttctagtacatacctatctagttgatccatatagatatcctcctccaactctccattgaggaaagctgtcttaacatccatttgatggacgggtagaccatgagaggctgccgaagtgagtaatactcgaatcgtggtcaagcgagcaaccggtgagtaagtgtcgaaaaagtcctcgccttccttttgggtataaccctcggccacaagccttgccttttactcttcgattgtacattaggcctaagctttttcttgaaaacccatttgcatcctacaggcttgcatccatatggacgctcgacgacttcccaagtaccattagacataattgagtccatctcactgcgtaccgctgttgatgcggaaaacacacactggcctaggagatctgcttagctccagtgcaggtccaaaggatgatgagatgcgagcgtgctagtcagtttgatcctgcaactgacaagatatacaaataacagatcaaatagccgatcggctaaacagccgatggagtaatcccagtcgatgccgataccagccgatagcgatagggtttaagcaatcggctatatgtccaatatagataatgatataaaggcaatcggctgatgatgatataataaaataaaaatatgatccagtataaactaatcggctagcaatgatatgatagaataagcactgatccgaaggttaaagcatacatcggctggaggtccgatgccataaaatccacaagattagattaaacagtgaaacctttgttgcgatcggctaaatccaacttgtatgtatatgtaatccttataagccgatgcaacgtccagataacttataggctagcaccctgatagaacattagcatgaacctatcggcttaacaagacttatattatcaacaacaatctagtaggtcgaacctaaccgatgcagcacgagattgtatatgataatctaatactcgatgagccgatagatctgtctaacgtgatggatatagcaaatctatctagaacgacattgtgattgtagagatatattggctaagacagaagatcggacctaaccgagacagttctaactaaaccgatgagtctctaaacacaatgcaattaaagatagaatcgagatatcaggtaggtacatcaatcaaccaaaccagagcaatccaagatatcagagcgacgcagccttgaacaacgccgacgtagatgacagattcaccagggcccgatggaacgtaggacttaccccttcgccggagatcgaaagccgatgcagcctcgcatcaggtgcccaaatcccgccgaaagataagtaaaaacctcggtaaagagggtggcgatgcgccgagagtattattgattgagagtgatagattacgtacatagaccctaggtgtacatatttatacccatgggttgatacaagtccttgtcggataagaaagaaattatcctaaagataaaaggaaaacataaagtccttatcggacactaaacatacttttctaaagataaaaggaaactaacaaactattcctaattaatagataaactgccatgccgcatcctctttgaactcgattgcttatggataaactttctttattagattgatttccttaaccgaatatagcagggatccgactattggcaacttgataactcccatcggctgattccgtgatgctgcagccgatagtgattttcagccgatgatgactttagggcttaccaaatttcactgttaacaactgcttccttccaatagtcagcgtcaggagatgaatatgccccttcaatggttcttggagtgccatccacaaggtatacaatgtagtcatctccaaaagactttgcagtcatttgtctcttactctttcgagttgctacaatgctatcctcctcaggattttcctcatgcgtttgatcaatgtgttctatcggcgtaaagtgctcaggggataaaataggttcttgactagaggtgctaggtgcatttttcatatgaaattcattctaaaaaatgtggcatctcaaaaaaacttgatagatccttttcggtagttggctttgctgcatcactaaaaccacacgctttcgatggttcaaactataagagatggacatcacgtgcacttttgtggttgacagcgatgcaatgtttctttgtctcacggggcaaactgagtgaaccgcctctctctcctgaggaggaggctaagttcaaggctgcggattgcttgttccctggagcattgataagtgtgctcgccgataatattgtggacgtgtatatgcacatccctttagggaaggacatgtgggatgctcttgaggccaagtttggagtttccaacgccggcaacgagctgtatgtcatggagcggttctatgactacaagatggccgatgaccgttctgtagtggaacatgctcatgagattcagatgatgccaaagaaacttgagaacaacaactgcgagttgccaaacaagtttgtggcaggaggcattattgccaaattgctaccttcttggtcggactttgctacttatctaaacacaagaggcaaaagttcagtgttactaacctcattggctctttgggtgttgaggaaaaggcgagagcaaacgttggggctagagccccagctacatgccggcagaaacccctgccctgcatgcagagcagcagccacacagcgtcaggagaggagcagcgtataacacaagtgcagaacaaccaggtggcaaggaaggaggagcaaacaaagacaacatggcgtggtccatggatgattaagtggactaattggctgttaggccttccttattaacctattagtttttgctttttttttgtctactttaatggatggaacgatcaggggattagggaagcgagtggtttttactcacaaagtaatccaacaattatcaacaattgtgttattaaatttgtggttgtgtctttgtcgtattatgtcttctatcatgggaaagcgttttcatcccttcaggagatatcccctcgttttgtacatgtcatctaaataatcataaaaaaatcttaaaaaattgattaatatgaaacatatcactccgcagacatgcaagttaaaattcaacttctacaagttgcaaaaaaaatataattgtgaatgtacgataactattttcaatttaatttgttaattttgttgcaaattgtagaagttatatatttgcagagtgatatatttcatatcaatccatgttgtcaaatttttttcaaattgtttagaactatttagatggcatgcaagcttccatcatactttgtaaaacacattagaaaggagcaccccctatatttccattctagattcgccactgagatcaagggagattctagcgccaatttggtgcaaaagaagaaccctcatgcatcccacaacaacaacaagaaagtcaaacctgacgtcaaacccaaggctacaacacattttaagaagaacaggcaagggaaaggcaaaaagagattgctttgtgtgtggcatgtctgggcattgggccaaggattgtcctaagcgcaagaacaagatgtctgcaaacatggttattagtgagggcggaggaacatcgagttatggtaaatttctacctacagttctttccatatgtcactcacctgattggtgggttgacactgatgctaatattcatgtgtgtgctgacattttcctgttttcttcttatcaggttgggagaggttctccttgttgatggaaaatggatcgcttgcggctgttcatggtgttggtacggtcgatctgtagttcacttcgggaaagaccgtgcagctgaagaacgtgcagcttgtcccttcaataaagaagaatctagttagcggttctctactgtgtagagatggttttagacttgtgtttgaatccaataacgtgtcgtatctaaatatgaaacttttattggaaaaggttatgacagtggagcttgttctgcttttctttggatgatatgtgtaataaagttgtgaaccatgtaagcaatgatgatgataagtccaatgtgtggcattcgcgactgaagaactgaaccatgtaagcaatgatgatgatgagtccaagtgcaagagacgggaagaactgaagaactcgttattcttctgttcatccttctggtcgctgtagattgcatatatgcaagcgcgagagtaacgttcagggtcatcaaccgcggtgtataattccgtaaccgagcgcttaaccgacgcgctcgttaatacggaatcaattctcatgtttatcaccgtccgttacaaaacaagagagttacaaaacgagagagagagagggagcagcagcaacagccgcctgcctgcctcgccccgccccgcctggctatccacccaccatctcaaccggtcaatagagactctccactaactccgtattttagttgagatctcttcacttagatttccaaggtggtattattacccatagcactaaatgtgggccaatggaatttattaggatttaattgggcctaactcattaatctaagagtttactccaatgcaattggcatatggaatatgggaagtacatgacaagctgcaacatatcccaaaattttgcacaaattttgacaatttgaccctttacaaaaactatttttacaaatgaaccgccactaaaacttatttcaaaaatgacccttttgttcagcaccaaatcgtgtgacgctgaacttagacacctcagcgccaaatagcgtggcgctgaatgttcgttggcatgttgacttagcctcctgtccgcagtggcacgacattcagcgccagtcgacgtggcgctgaggtgtctaagttcagcgccagatgatttggcactgaacaaaagggtcattttttaaataagttttggcggcggttcatttgtaaaattagttttttcaaagggtcaaattgtcaaaaattgtgaaaattttgccttcctgaatcctgaagaagaaagtaaaacagacctgtccttttcttgttcttttttttttaatagaacaagcaataggtggtatttatcttatcttctttcccaccctttctgctgtcaatgttcataaattaatctcattcccacaaaatacatttgaacctaattttcatggttcgaaagtagggatttgagcagtaactccccatgttgcctgataaaacgtgcgcgctgtgatgcttcggtaaggatcttgctctctcttcctcttcagataagacattatattctccacctctgacttgatgtccaaatataattggtttgcactctccctatccctctgtacaccgtccattcctttcatttcaattggttttccaaatagatagtatagccgacctggtaatttaggtagaacagcaggcaagtgtaagacctgatttccttcctctccttttacagtactcctgaaacaaaactcacaaaaggttgcaccctaaaaaaggactcaaaataggttcgtcattaacagggcaacgtatcctatgcacacacctatcttggtgcactcatgcactcggtcactgtcggcccttcgattctaatccaaaggctaaaaacgcaggtgcggcatttttacagaaagctgcccgcaacacctgtgtatgtttgcagaaaacccctcacttcccttcgtcttctctggtccaaacctcctcgatccaggtcgatccccaaatctgctctatcaccttcggtcggggccggcgggactcgtcgtcggcgcctgcagcatggctgttggcgattttgtgtccatctacacgcagctgaacatcgagctggccgagcaagcagcacagtggcccgtttggccggcaagcagcgacatgactggggagcatcgtggtgttcaatcgaggaaaaatggcagcgaggctgccatatcaataattaaaataggccatgtccaaccaggagaaaaacaagaagagaaatcaacaaataaacatggacattatagctgaagaatcgagagaaaaaacacgaagagactcgccggaacgacggcctccatggctccatgcggacactatagatggagacgaaccattcagcgagcagctggacagccacgccggctgtgaaggacagcgccgaggcagccgcagcctggcgtgtcggccgatgctagccctagcagcaggattcaatgaaaatcgagatgaatcgtcgttctgttcagccccatcgcatggagatgagatctggatcgaggaggtttggacgagagaagacgaagggaagtgaggggttttctgcaaacatacacaggtgttgcgggcggctttctgcaaaaatgccgcacctgcgtttttagcctttggattagaatcgaaaggccgacagtggccgagtgcatgagtgcaccaagataggtgtgtgcataggatacgctgccaattaacagtatgctttcctttattttttttaacaaaaggaagaaaagacaaagtacagagatctgaccttactcctggacaatcttggttgaacgactctattgtttctctgatataagggatgttctttagttcattgtaatccagaactatctgtgaaaagtacaaacaaggtataaatacattatccctaaaaaagaacagatacagttttatattccactgagcaccgatcataaattccacatcataagaaagcatatatgctatttggaaaccatattatttcagatgatttactgttaaaagccagagcaaactacctctaacatgtcatcttctcctacacaaccgaatggtatgacagtaactccaaactgtgctgccattcttacaaattctggttgatctggccaaaacaactggtagtcttcatcctgcccaattcagcagaacaaatatattgagaaggaaaagacatcacaaaagtgtagttgataaatgtaaagtttcaagcaaacctttctatgtagagcttctcgaataccaccaggatagaggagaacaaattcatctctctcaaataacctatatgtattaatcggactgacttgtactcccccatacaatgggactacgtcaaaaaaagatagctcctggcgcaaaatctcataattccccacaaaaaacactggatgagccaaagttcgcagaactgctttcttctccctcaagaactcttcagccattgaagtgatctccattgccaacagctgatggtaacccaccaacaggacggggcctttgtcaggaacaccggcgaggccgcggacgattttgccgtttctcagagtagatagcatgactgggctcagcaaatggtgaagcagcctgcagaaattcccagctttcttttgatcaattcaatctgtttaacgaaagtacaattgatatttgagaatctgaatgcatacttgaaatcttcaccaaatgttctcttgaattcacttattgtaggtgggaggaaatcagtgatagtgtccctttgtttgccctggcggtacatgctggctccttttatgacagttagcagattaaagctgctctcctgtggaaatgttctattgctgagattttctaatggacaacacaacagataaataatagtacatatataatttctatacataattaagcactggaaatgaccaatgaagtggagaaatagaagcaattgtgagaaaattattaaaagtatgtaccatgagtaatctatcgctggaagtcctgaagtatcgaactttgcaacttttcagtgccttaaacagtcgatctgcttctccacttggaggaagattgtcattgccactgtaaacccagatatatatcaaatatttatagttcaagaataaatatgtaaatatctaaatacaacaaagagtagaaaattgccaaatatgagatatttttataggaagggcacctggcaagaagcagaatttctgcttgtactgcattaagacgagagtttgtatagtctacacctgacataagaagcttgagcttccacacaagagtatccattcgtacgatatgtccaaattcctgagaattatcaaccatgaagttcgaaagactaatatgacgatctgtgttttcgctgatttctttcattcagtaggatatcaaaacaaggatgggatgcttcttcctactttttatgcaaagattatttgcacatgtgataaaaatatttaagacctatatatcatatttatagaacaaaataaattgctatgttacacaaattccaatgcttattgtgcaaatgaaaacatatataaaatgaaaaaggagaaggaaattatagcttactgaaagtaaaggtagcattgaagaaagactgtctgaaaaactttccagagtatcttgaggagaggtattgttctgaatgctaaccattgccatcttaagaggatcacctatttcacaacaagaacatcttaaaaaggttttgatttctcaagttgactaaaccagctaggcagatccagagtcaaccattgattaacattttagcaccaaaataaaaaagaaaggaaaaaaaaactatacttcaggagctgagctagagtggttcacacatggatgaaaaaataaaaacttaaagaattagaaaatgctgtttgttgagactattttcatttatatttctgcttctattctgctaaactaaattgtatgaaagatgtttattttacatattgatgacctttgcaactcgggataattgtagaaaatgcagaagaaaggcaactttgagttgtctgtaaacatggacgttttacagtatgaaataagtttgagcatgaactgcaaacaaaataattgaaatattatatcttcaacagtttactttgaacataaatctatcaatatcattattaaaacacagctggagttaaaaggtaaaagttctgccatcgatttatagggactagtattccaaaagagggacaaaattaggaagacaagaaaatataccaatcaaatatctgagaaggtgagggagagtgacaggaaggttgcttggcaccatttccaaaagaggcaatattgcctgcaacggagttttcgcaaatgatgttgctgtagaaaacagattaatatattctaaaatctatagtgtaagaaccatattatttttggattgctatatgacactgaaatttaatgttgagacgaaaagggtttcacctgcctggatttactagtataagaaccaaatcaatttctggatttcgtgatgccaaagaaagagccaaacatccaccaaaggaatctccaatgatatatattggtctgtttggtgacaaattgtgctcatatttgacagattcctccataatttgtaacaaccctgtatgaattttacttcaaaacatgttagtgaagggaaccttgattagtgctcgtatttcctttcttcatacctgaatcagagaatactaaattttactgtgttgattttaatcattaatatgttccctatttaaaaaaaaaagatgaactgcagatctctgacttcaagaagaatgagaacttgcacccacaagaccatgacaatgaccacaagcaccatggagtccacaccatatatggcataccacttggcaacattatgctctgctcccctatttagggtaagttatagttgtagcaagtacatatagtcaagtatacttgtcaggacatggacatgttaatctgacgctgataacatatctaaaacaagacgtctattattaccttcatatggtgtacgatcattgaccggtatatgcaagcagcggacctcaaataccctgttgataaaaggagggaatgaaattaaattatttgcacttctaaactccaactttaaatttcaacttcctcattttcgctagcacgtttcccaaactgctaaacggtgtattttttacaaaaactttttatataaaagttttttaaaaaattcaaatgaacccaattttcatttttataacaattaattaattatgtgtaataattaattaattaattatgtgttaattgcttgctccgatttccgtacccctgaaatgctcgatttttatgctgcatcgaacgaagccttatttccctaagagccaaaaaagttggatataagacacagttggcatacgtgaactatctactgtaatttaattcagtgaaactacgtaaagcttgattgtcagttatttagtactacttagctacacgttctgaacatctaactgaacttgtctgaaacttaggagtaatttataaatgtacgaagactacctatatgacaaaaaaagaaaaaagaacggacatgcaaatgtaagtgttttcaccctattatattttgcagatattcaatgatttagcacagtatgttagtaaaataaattgcaatattatattttggcatatcctttagcagtaccattcgaacaaagaaatgcagctaaagtttatcttgaattgaaaaaaaaaagtcttaatccaaacgtgcacaatgaaaagttaaaatgggtatatcttacacaagaagggaacgcacttacttgcccaaagatttgtgctgcatgataagttccattccaacaccgtcgattcctgcaattcagtcaattcgaataacagcgttagtacaaacacattcatgaacacaggcatatgacaaaaccttttaattttgtctatggatttctaacaatcctaaaaccctgaagaagagtgcagcacagaccagccacaactcaaaactgttaaaatcagtttggaacacgaacttgtcgcatcggaaattcagaattcgcaacatgaacatgaactgccattgttaagctatttccagtgtaaatgaaagtaaatggttattttttttgtttctgtgtgtgttgtgcacacaaagtgtttgtttgattgtgtcaccgagcgaatcagcgaaagcaaggagagcggcggggccgtgaccgagacctggcaagaagagcagcagcggcggcgcgtggaccgccggcgggccgcactcgacggggcagaaccaccgcggggggccgccgccgccgccgccgtcgagcggcgtggccctcagcgcgtcgaagtagtccctgacggtggcctccccgaagccgtcgtcgtagagggcctccagccccacctcctgcaccttcttcgctctcctcctcctcctcctcatccccgttccactcttcctgtccgtgtcctcttgccccttctccccgctcgctggcgcctccgtcgagctcgctcggaggcgggtgggccgccgacggggagttgcggctgcgggggggaggacggcgtggagcgcgatggacatggacatggttagcagcgtactacgggcatttggtgagagaaacagggtgagttggagaagaacgagaggaaacaggggaggaggaacaggggaagaggaagcagagccacgtatattgggggtggatcgatggagaggggagcgtgatttgaattgtggtgggaacgagaacgagaggtggtgacactactatatagtggatgtgatactatgcgcaattcgtcccaaaataaatcgatatacatcaataagaaaaatctatataaaggttatattttaaccattaatttattttgaaacaaaaagagagtaccgtggccatttttttaattgccatgagttatatgaaaaatacggtccgtcaccctaaaaatattccaactattatgctgatggtaaaatctgattaaaagtagtgtcgaatgctatttgtccatgttttgcataagcattattcttaataatgttgtctattctgattggtttaggttcaatctctttgttaccgagctttaaatattcttttccttataaatactcctctgttttgtattatgaaacattttgattttttttcttagtcaatttattaaatttataggaaaacaaaacaatattttcaacaacaaacggaaatactattcaaatatatttaacatttgatttgatgatattaatttggtattgtatgatgaaatgaatacagttcaactatgcagcaagcaggatgagtaaaatacacaatgacgcacaaacctaggtataattcctcgtccatatatgtgtgtatttcacgtaatcagagtaaaatataaacagtatatcccatactgacatacagtgcgtgtgtggtcatggaaagcaacggatttggttggatagtcatacaagtaaaatgattttgatttgcgcacaccgtattcatatcattatcatcaaaaaaataaaatatgcaggtatcatatgcttatctcttactgctgggctacgtgtatggaagtggacttctgaacttcctttcagagtgatctatcgatctctgccacgcccacatgcgtgcggtactgcggtatatatgcatttcgtttttgggtcgaaacctcttgaggccgacgtgcacgcgatcctgaccgtccgtgtggacagcattttacagtcgacgacagccagaacgtacgaggagtcctgtagagtaacgctccagaattctgcacgtggccggtttccactccccaacaaaattggagcctgtatcgctacgagatttcaacgctacccatcaagaaccatcatatatctacattggccatatcgtaacttccgagcaagaattgctctatcagagcaagtttaatagtatagccaactactggctccaaatcaactatagctaatctaatagcccattcatacaatagttaactatccccgcaaaaaaaaacaatagttaactataaaaatatactataccattaatatccgatcccacctctcatacacatataacgtcttgaagtccgtgttgcagctggctacaaatctgtagccgctttcttctctctcttctcttttcttctcgatatgtggttgtgctgctctatcaccatctgtattttttttcagatccaaaagtgatccacaaaagtatcttacgctagtaattttatagtcctttaggaggaggtaccaaaaatttaatgtaatttttggtatctcatagtacctaggcactaaaaggtactaaatttataatagaaaaaagtggtacctcatggtatctctttaaggactgtaaaattgctcatattaggtagttccttttctgaccgataattcggttaaccgagctatcgggtcggtctttggtcttgtttgagtttaaccgaacatcgcagcggctccccaaagcccaggcaaccaacggcaggcagcagttcggaggcacacatcggagccgaacaagcaggaatcccttcgactgggatgacgagagcgttcgcagggaagacaacaacaagtggtcgaggcggaaaggatagaggcaccaatgctacctcccggaggctagaacgaggccctgtacgcagggaggctggggagccatttgccgtcttggaggatgacggcgtggtcggacactcggatttgatttcagtcgtatgtcgccatggctgtcaccattagcagcgccgccacacacctaccccgccgcgatggtgcctcgatgggattccccagtctcgagccgaagccgttcgctctatgatgcacagatgtcgtcgagtcaacgagtcatagagatgaggagcagaggtgttgccaaggggataagatcttggggaatataactatttgccactgttaggtttaataattatccaaatacccttcttaaaattgctcttgttattttcctctaaggtggtggcttgttgactatttatcatttttgctcgcatggcatgccaaactggctacctagggtagaaaacagtgcaggacccaatagtcagcctctcacacacccttcatctccccctccgggcctaaatattatcttcatcaggcctaaattagagactgtcaccgatgagacgtatcggtgacgggcttaagataatttttgtcgagcctaaacatgagcctgtcaccgataggtctcatcggtgacgggctcgaaatacatgcatatggataatgtttgtacgagtatatctttgtcggtgtttatttcccgttagagatgatggcggtgtgacggtccgcatgcccccgacacgggaaatgccattacatattagaagttctatactagtgcacggtaggaatataatttataaataactgatgttcggaataaaaaaataaggacaagaaacatctagaacacgagatcaattaaaattcaaaatataaaataaaataaattttaagattagaaaaatatgagagtacaaggaggaataatttattaaattaggaataaaaaatattaaaagaactgtagccgtagaaaaaacaagattaaataaaattaataataaaatataaaatacattccaaaataaaaaaaagagagttcaaatatgaatacaatttataaataacaaaattcaggaataaaaatgaagaatattgaaagaaccgtctgtcttgaacataacagtgacaattgacaataaagagagcagcagcaacgggcaagtggtggaagttgatgtgacatctaaaaactataaaacaaaatcccaatgatgattaagtttgattttcacaatcctaatgacaattaaaaagggagcaacaggcatcgttaaataacatggtcccgacggttgatgggacttctagaaactaaaaaataaccaacgataatcaggtttgattttttaaatcccaataacataaagagagagggttcacgggcgtttgatgagacttctaagaactataaaaaggaacccaacaagacaataaactctaaaactataatatctgatttttaaaggtgccaagaaggatggatagaaaccgtggtacgtcggacaaaaaaataaagaggtgataaagaagcaaggggtggcggccagtgtaaattttaaaaactataaaattaaaaacacaataatggtagattcaatgtttttaagtctgaaacaacgagatggctatttaacattttttaagaaaaaaaatcatgtctaaaagattgataattttgtatggggctagccgcgcaattgattggtcacccagctaattatttggataattatcaaacttaaaagtgacaaatagttaaattgccataagatctaggtctcgtcctcactcctgatgtatggtgcccccccccccccccgggtgggggtgtgggctggaggcctggaacaacgtgggtgtttggtttattcggttagctggtagtaacaatccaagttgatcgtgtgattgaaagaatgaccgaagaaggggaattcaggtttttcaggttcattatttggtcctcggttcctaatctataattatgatctgtgagatcatgatcagtttaacgaaatagtactctctttgttttatattacttgttattttaatttaaattttatgttaaaatacctattgttggctatgactcgaatatatagtcaatcctatttttgataggaccgattgacaattgaattcaaattttaccattagttgactatccataatagcgtggaaagaaagcctggaggaagtgtggcccttgagtttctcgccactttgcattaggatttgttaattctctttctcgaggggacagggaagggatataacacagcagtagagtgtcaccttgagatggtggaagttcagtcgtataccgtcacaactgttattagctcatctgctttggaaaactacttgggatgtatttaatgagggtaccatgtattctgtcacatctccttggtttatatcagatttacaagaacaacaaagataacaatgcctaaaagtacacccaatagcaaaatgactcccgattcataccatcacatatccaaacttaaagattatgtatggcctactcaatgaattttgtgacacgaaactaaaataaattgtttgttccatgtttgaatctagatcttttgaggtgtgcatccatccatgcatgcacatttcagctagctctgctcaaggatcaaacgatgggatttcagagtcgtggccgcaaccaagctggtacagaatcctggggaggatgctcctgaacttgtcctcctccctcttctccagcaggtaggcgatcatggccttgacctccgacttgacgtgcaggtagagctcgccggcggcctgcttgtccgtcatcacggcctgcatccccttcgtcgggatcggcttcccgaaccggtagtagaacctgcccgggatcttcagatacacccccgggaagaacacctcgtggtcgatgtccctgcattttttttcagtaaattaatggttcatggtttggtcagatttgggatgaatttagctgttactgttcaaagttggaatgaaatcggtgtgaattaccttagcttgagatggttgctgtatgcttgcatgatctccttgccgaagggtgcgttcctaatgtcctcgaaagtgcagagcagctgcagaagcaaattaatcctcaggctcagtgcatcgcgatcatgcaaatgcaggtctgaattgttagctgcagagcagtatgatttttttctaagaacagtagagcagtatgatgcgtgtggattcgcttacttccattaggtcgtcctctccgacgactccgaagggcacaatggtggcgttgaactgcgctgccatcctcacaaattcagtctggtctggccagaacagtctgtgctcttcaccctagatagattccagagcacacataagtgcatcatcagttggaaacataattgttagacttggaccaagtaaggttctgctaattatttttttaaaaaaaagacaatattttcgtctggaagcacatcttaaacccctgtttttttccaagtattttggtctaaaattacgaatcctgctatcaatactcaaatcacaaccaaccaattgctaaaattgaacttaaaaatgtgatttgtttatgaactttgtagggttcctgaacgcaattccaaaagataacaacaaatacaccatgtaaatattattcctgccgtttttcaatatacaacaccattgactttcatcctattaaaaaaatatataattgtttttattttgctatgacttgttttataaaaaatggtacaatattaacatatatttttatatttttatattaaattttaaataagacagataatctttgtgcattaaaacccgaggggactaactatatatttatcgataaattttattctaaaaatttgacagatgtaattatagtataatcgtagtaataattacactgtaacttgtatgtaactacagttacacttgtatttaagtttcatgtaattttgaatcgttaaatctattacaacatttgttctggtgaggaagaaaaaaatcacagcacacacatatgtgaaaggatttgttcccacgacctctattttactgaaataacatagtaccgagagattcttgaaagttacatacaagttacattatagttacagtgtaattacatgcaagttacagtgtaattacactacgattgtactgtaattacatctgacaaatttttggaggaaaatttgtcacaaatatatagcaaattcgaaacccgagatagtacatgccagcctaggtagttaataaggggaaaatggtcgaattttcagccatatgatgatgtgtcaagattcgtgtataagttacgttgtagttacagtatatctacaataattataatttattgcaactacgctgcaactacattataacctttatataatttagatataaaaagttacatattttttattatttttatatacaagttgtattatagttataatatagttacgatggaattattatattatagttatatttttgacaattttctaattaagaaacttgcggcagcattttaagatagtctttatatataataaatgacctgaaaattttgggatgaaggcagtagtaaaaagaaaaaagtttgtactgtactaccttgcagtggagtgcctcgcggtggccgccggggtagaggaggacgaactcgccggcggcgagcagctggtagatgtacttgtaggtcatggggacgccgccccagaggttgaggaagtcgaagaagtcgtggccctcggaccacgtcttggtcttgttggggaacagcagcgggtgcgcgatcccccggagcaccctccccttccgccgcaggaactccgtcgccagcgagatgagctcgatccccagcagcatgtggttccccaccagcagcaccggcccttcctccggcacccccgccagcccccgcaccaccaccccgtcccccatcgtcgagaacatcgccgggcacgtcctcgccctcaggtcactgctttttcatccatcccattttcatccatgttcatggatgcatggtgagccactctactttcttactctcaatatttaattacatgttcagagattcagaaatccagaagtgaaccttttcaattctccaagtacatgttcagagattcatagtgatagtaaaaattcagaatttgttttatgaaaagagaaaaaaaaaagaacagtactgaacttcaggaattcagtactgaactttcaagtctaaacaacacttgttcagaaatttagctctgaactttcaagtcacaataacacatgttcagaaatacagaatgatggtaaaaattcagaaattcagctccgagctttcaagtcgcaacagcacatgttcagagattcaaagtgattttaaagatttagaattttgtcttttcttaaaagaaaaaaaatcagtactgaactttcaagtctcaacagcacatgttcagaaattcatagtgatggtagaagtttaggaattcagcaaaactttgaattgttacctgccagctttctcgacctccttgagctcagtggctgatggggggatgtagtcgaaaacccggtggtaccgcctcgagtggcggtaaaggctggtgcatttgatgatcgacgagacatgaacaccgtactcctgaattttttattgagttttaccatcagcagggtttccttcacttctacattttgttcttttcagttgaaaaaaatgtctttctaaatttgcatatggctgctgaacctcaccaacagtaagctgtgcccatggttctcgaagaagaacactttgcatttaggtagcattctctggagcctgtcagcttcagatttgcttggaagtaatctgtcagcacagctgaatgcaaacataccaaagtacgttttcgatcatcataacagaaatgtagttatcgagatccaacagaagcaaaatactcatgttgggatagcttgactgaaactatgtccaagaacggtgaaattgaaaaggtagaaaaccagagataaatgggttgcttaaggtagcaagaaacctgactagcagtagcacttcagctgaaactgattctagacggcaattagcatatgaagcagcctgttggatcagcttcattttccatcctagagtgtcctccggtattttatttagtatgttctacagtgaaattatagaatttgaaagccacattaattaaatataagcagaaaattaaatcatttctactgctcgtccccctttctcctggcttgataaaatgggacatagtagcgggacgcacaaaaaagaacggtacataccgaatgcttcaggaatgatgatatattacttgttaatctgtttagtgcttctaaaggatgtcttccacttttcatgctactcaatgccatgtcaacttcattgtctgccctcatgatcaggaagaacagaagaagcggatgcagagttattaaacaggaaatgtgacaacttatggcaaagtacagaaattaaatgatgaaaactggaaagcagtcctgtagttatcaggttatttcagccaattaaatgtttcattatgcttggttattttcgttcttacatatctttttctaaatcttctgtgctgcaacttaggaaatacttaccaatattgtagttcagaagagatgtaattgcaatccgtgcacgatccgacaacgggctggaaaccgacaggagctgttttatgtctgatttctcaaatgatgttgcttttccagggaaaaaaggaaaataaagttaggtatcacaaattttattcatgcaacagcagatttatttggagatatacctggattaaccagtaccaacaccaaatcgatgcaaggattacgagcagctactgcaagtgctatgcatcctccaaaagaagtccccaaaaggtagatgggcttattaggtgaagtggcatgctctgctctcacaacatcctctaccatttcaacaagttctgaaaatgaaaaacagctaaaaccatgcaatctgagaacttcacattatctgttattcgctctaaataatgaaataagtttaaaaattcatgtatggatggaaatacttcaaacagaaattaattcacagatatgttgataccttcaaatggcgtgcggtcgtggaagggaatgtgcatacatcttagttcaaaaatcctgtgaattcaaagacaacttgtctagtattattacggaagtcgtaaaaattgaacccatgtagtatcattgtaatctaaattgcctataatcaactcctataaaattgtgagctctcatcatattctaagagaaggcctgataaaaattgcagacaagtgaaagtatctagaagtgatctcaccttccaagtgccttgtggtgcatgaagagccccatccccataccatctacccctgaaaagtttccaatccaaatcaaatcaaataaaggctaagctgcaggacaaaactattgaggattctacaacacaaacattcggtataactgtaccgggtaaatacagcatgagtggagcatcctcaatgggtgagccggcatcaacgggacagaacaagcgtggcggtccactgtcatgttctaccagctctccaagtgatctgtagtaataatccagatccttagccttctggtacccatcgtcgtaaagcgtttcaagccccttgtagctcacttgcaatctccagcctgcatgcttgaactgatggcagctgctgatcctctcaaacaagtcgtgtcgtcgtcgtcgctgtcgccacagagctatctgggagtggagaggaagagaaagagtagccattgctgtgaagctacaaagctctcattgaggtatgtatgttcatggtcttttttccaatacctctgatggagttatgcagagaagcatctgcagctgtgtgtaacagaaataactgaactgaattgaggcgcaaagtgtgtgagtgtgaccattgcatgacagctcacaggtttggctaaagtagtgaacgtgtgactagatgataattgttgtatcatgaacagttatgcttaggttgttatagtagtagttggcgttttcttgttctttcgtgtggaaacacaccaacactttgatcacacgataactatgttgttggttttcttgttaaaagtactcatattttctgttggcatatgattgttcttcaagtaatcaagtgtgtgagggcacaatcatgttgctgtgtttggcaaggttgtctttcgtctttgtggttcaaataatccattagagatggaaactaaaagagattactcgttcctgtcttctgtgatggatcaaagcgcactactcactacttcccttaaaccagaaagacaagactgacaagctatgtttatggtttagtccatttgcaaattttcttggtcatgggaggaagagagtagcttgagactggggttggagcttcactggtgggagagggacagtagaaaggcgaatcagcgaccgtgaacacacaggctatgatgtagcctccaaaaagtccaaaatgcctagatacatagggtgtgtttagttcatgtcaaaattggaagtttggttgaaattggaaaagttggaagtttatgtgtgtaggaaagttctgatgtgatggaaaagttggaagtttgaagatatattttggaactaaacacggcgatagtataatgagtgataatgccgccataattcttatactaaggaggttgtgtatatccacttataaatatatagaggccggatttatatctactccttgcgtattaagtctacttttatatatgaatgtggataagcttgtcaagaatctatagaagtaaatttatttttgggatagagggagtattatctctaaaaagaaatatgttcaagactcgggagcttacaaaaggggagaaaatacatttcctgacatcaatggctggtaaaagatagtggaagttgtgttttttatttaaggtttgttctggtctaacaaatggtacaccagatacgtacctagaggtaccaaatcaattatgatagtccgtttatgatgggcaggatgggtagcgaccttgtaacaaaagagagaatatatgctgctcatttattttcctccacgtgtcatgtgaggtccgtgcagcaccgaagtcctttccccacctcatctctctctctctcagcggcgcatatatctcacagcggcaccggaccgcaacatctccccacctgcgctatttgtcgtgtggccaccgccaccatttggtcgctcaagcgatagccggcgcataagcggaagcagaagaggattctgaagcaaatcggcgtcgctgtcgtgtggcataatgaggcacgagatgggaagaaaaaactcaatgataacaaaacttgataaatgtcgatccatgcaaattgttttataacaaatactacaacgaaaagagcatcgtcgaggaacgtggcaagggtggtggtggtgagagaagcattggtggtgacctcagcgaagataccaccggcgaggtctatgacattgagtaccgctacagcgagaagagtgctgccaaggagaagggtggcagcggcaaggtctacatcattggcggcgatctcagcgaagatacagccagcgaggtccgcggcattaagtatttctgcagcgagaagagtgctgccgaggaatgtggtaagggcggcggcggtgacctaaaccctagcatactcgaggatagcagcaagcaaggagactgatgagcgctgtcaatactagggtttcacatcgtttgtggttgatgtgcttaagccgattcagtctatactcttgcgaaattacggcggctgctcttccacgtactagtccaggtgtgacaagactcatcggtctcgatggtaccttgcagcactatcattttttattcattggagattgaggagatccaacggtccatcttcagtactgcggcaccccgctgaactgcaaaaaaaaaatctctttctagtttatttagaaggtgatcccataatttaaaaaataactatagataaacaatgcatgagaaagcagcttctgcttacatgcatggaataaaaaacaagttagtccctagatagtgcacatgctcttaaggggcacacttggaaattttaaaaaaaatctacttaacctctagagtaatataggatttgcctacttaatcccaaaccggtttaaataccccatgtagtggttttgttaaaggtattgcttacatggctgacgatattgcttacatggtacacacatgagcccatctggcctaagttaacataaccgattcatttctctcactaatctgcgagcccgagaattacatatcagcatcaatatgcctcttctcagagtcattatgcttgttaaagaaatacttaacacatgccattgccatgtaatagtcaatgtggccaaaaccacttataaaaccgctctataagtttatttcaactattttgtatacttaacgggatagaatatccatttcataattcagaggttaagtaacatgtaatagtcaatgtggccaaaaccactcaataagtttatttcaacttatttgtatactttacgaggtagaatatccatttcatagttaagaggttaagtaccatataatagtcaatgtggccaaaaccacttataaaaccactctataagtttatttcgattggtttgtatacttcacagatagaatatccatttcataattcagaggacaagccttggtgcatcagaataaacaagatttaggagcggctgtatggacaggtttgcctcccacccttcagatcgagtttctgcggacgtgttagcctctttcccaattgattttcctccaaatggccgcggcttttttatgggtaagtgaagagggcgattttcagcaaagactttttgccagcgagaggtagaggaagaggccgatgagattggagtgagttgttgaagaatatctttgatttcggagaaagtgagaagtggggggaagaggccgacaagattgggacgagttgttgaagaatatctctgattatgtagaaacccgggtcgctcttatccttttttttttcacacgagtgcaactgtctctttttttcacacgagtggagttttgccaccgaattggctctccccgatgaacgagatttttcttgtcctacaaagttaaagcttagcttactcttaaaggctagttttttttccaaacatatagccttgctatataagagcaagtctaataatagagctgactatttactccaaaacaaacacatgaacaaaaactattgtttaaatataacttaggaagtgctcgatctatgtactattctttaaagtactattttttcttgtcacaatatattatcactcctgacttgattggcagtgagttgctcatctgcctaggagcacacaaagcgtcgataagagcaaggataatagtgggctataagcaagctatatacttatgtggaagagagagataaaaaaaagtggggagtgttggctctcatgcaagagctaactgcatacaaactccaagaaatatgtattaaattcatggtgagagaaagagagaggatgaagaaaataaagataaccttatagccaatctactatacatgttaggtttaacattgactaacagtaagtagtgagctctactattaaacttgctctaatatagtcgattaggctcgctggtgttttctctcacctctacgtcactgctacagttgatatgaaaagcttatagtcaattattgtacttgctctaagtataggcttgcctgtgattagtaaccaaactggccctatatttttcagttggaagaacacatagttgctcaccggtttcagttgaaaagaaggggagaaaataaaaagctcaccggcggcttctctcctctcgccggtcgacggcgcgatgctgcgcggattccctcaggcccggaggctcctcaggtgatctccatctccccttgttcttcttcttgtcctgcgcaaccgatgggcgggttcttgatgcgccgtcgctctgggtatggggggttttggtttcaggaggatggggttggagaaggaagacgcctacttctggaagcagatgggcaagggcatgctctgcacctacgcgctcttcggcgccgcctggctctggaacgagacctctcccctcggctggtggacgctcaagccgcgccccaaggtaatctcttcttgtagttagggtctagggatgcatatctgaagatatgatttaactggaaccaagcctatacaatcagtttcttggggggttttctttttcagaatttttgaatacagataactctgagcatggaggattaggtattttgcagatgtttctgtaatgttgattgcacaatcgaccagcatattttccttagtgatgtatgatgacagttttatacaaggagggcctgtaaattctcatttggttataatatttactgttgataaaaacagtgagttgcactgaaaaatatgcgacatcattgggagtccaattaattgataacgagaaggaaaaaccctaagcataatgctgatcctgcaatttatctatgaaaactttggcagcctttttgatctgtaaagacgacgtagaagttgaccgtgcagtgttgttaattctgacattcctctcacagtttgttttcctatctcctatacatcttaatagtgttgttgaatctttcatcttatgtttaggaaatttctaaatcttatttactctgttgaaagaagtaccgtaagcacattgagatattagcacattactgttgattagggaagcttatttatttgaatttattatcttaggtagaactcacatagtcgcaccgatatcccctgtctgattcttcttgcataatactagttgggtgtgagaactctgaaatgagattaattaatagcatgtgtatatttttcaaattaaaactgaactctgaaatctgacaaggtggaaacgaactgatgtggcattttgttttattgtaagatatatgtgcagagaaataaattcatcctgtttttatacccaattactgaaacatcttggttaaggaccaccagtagctaatgccaattcatcctgattctgaactctagtcaagtattcatctttcttttaagaagtcactgttgattttggcaaatcaattgatgagaagcatgttctgtattttgatggtatgctattcaatgaattttctggctggctggatgcatgaaacatagcatacggtagcctcctaatcgtccatatgccacattatactttactgaaccaacaattatagatcttcatttgcaattcctaagcacctctgatatgtatcgcctatatccatctcaattcccaaccatgaaatggtaggatgaaacataagtgcataaacattagaatgatatatctttttaaaaaaatgtattatagttgtgtagaaacaaatagtttgccattgagatctcagaaagatataggtatttttgttaccacgtgagctaaagctcttttgaaacattgtggctaacagcctatggccatatatgtgctaagaacctaacacttctttcggcttactcttattcaagttatcctttctgatatgttatcttccatgtttctcaggaagaaagagaaatggcccacctttacgagcgcaggatgtttccatacccaggtgatgaagaggcagttgaggagttcataaaaagtggaggtgctctaggcaccacaattggacccaaaggttttgctgattccaacatggactctgataacatgcagaaacaattgcagtcaaaaaagtttgaccaagaagcacagaagctctggtttcggatgaggaatgaggtcgtacaagaactccaagagaagggattcgatgttgaatgaaattttacttctacataaacagaaatggagtaaagctgaagtatgtgcaaattgtttcagcttgttagccgtctaggaaattaggagcttagaatgcacgcaaaatgttaaaacacctactttgcaatctggagatttttttttttaatttgagaaagcaatctggagaatctagagagtttactattcaacttcaatttggtcttgttgggtcattgcattccatcagttacagattttgtaccttaaagatatggtatcagttaccagtatctcctcgcgtttcagttttgaagatcatattgtctggtttctataaattttatgcctggatgttcatcaaaaatttggtgatgcttaatcccccccctgctgcaatgtgtacaatccaatggcaaagccgcaaaggtggtcttataatcaggtagttacaacaggttcagctggcaactggacttagcaactccttagttcagagcccaagaatatcacttttgtattatagaaaaaaaaaagatggaacccttatgtatgagcaagaattccattcatcagtaactagtctgtatatcaatcactatacattggttaaaatatataacaaaaaaaaaactgttcagatatatctgttctactttactatacacttgtataatggcctatttgggggtatgttccatcaaaatgtgtaactgattcaagagttgcaggcttgcagccagcctactgaaaatgctatttacttccaacagataataccccctttccatgtttgcttcggaacacaagattgccgatgctcattcaatcacagtaccacgagatcacccaaccttcatggttcaaatgttgggacctctgcagaagcaccccaagatgcctggtacactgcacgctgcgctatgcttctgtaaggatcttcctccctcttcctcttcagatatgacattaagctctctacttcggatttgatatgcaaatacacttcgtttgcacttttcctatctctgacgacattatccatacctttcatttcgattggtttgccaaataggtagtagaaccggcctggcactttggggagcaaagcaggtatgtgaacgtcttgatttccatcctctcctttgacgctatccctgaaacaaattatgtgaacacataatgaacaaataaaagtgtgctcttttgcaatcccatcactttgtggcaagattcttgtagtaatattcttacttgcactatcatgaggttaagttgtggcaaactgagtgatgtttttgtcaagctttgaattttgtagtatttagccgaagttctaaagtcatcgtgatatggggcgattacccctgttgagaaagccaaaatacgaagggatgatagaaatcttaccttactctttgggcttctcggttaatcgactcaatccattcccgaaggtagggaatgttcttttgatcattgtagtcggcgaccaactgcagaaacaagaatgtttactcgtcatagaaacaagatggataaccacaaacagaaactgcatcaccaccacacaagatattgagcaatcatgcatgtgtggttatttgatgactctgcttcttgaagaaaaaaaaggaaacagtgctaagatgcatggcatccttgtttttcacacaagaactgatagagtggtattttgcaggaggtcagcaaaaatcacaggcatatttgcaacatttctccttttttagagagagaatcaaaattttcttctgaaaaagaattagtcgcacatctgaaaattttagatatatggtggaggagaaatagatggaagtttacctctaaaacatcatcttctcctacaaaaccaaatggtatgatagtaacaccaaaacgtgctgccattcttacaaattctggttggtctggccaaaacaacttgtatgcttcaccctgcaaagtacaacagaatcattacagtaagggcaaaagatgttttttttttctatgcagaacactgacattttttcatgactgacaagatcagtacatgtgcgatttagttaattctgacttgatatatttatgaccatatatttcatatttgtcgatgcaaattagagatattaaacgcaccttcctgtgaagagcttcccgcacaccgcctggatagagcaaaacaaattgatttctctcaaacaacctatacatattgatcgcagtgactggtaatccaccgtacatagaaattgtatcgaaccgagacagctcctgtcgcgaactctcatgttttcctccaaataaaattgggtgagccataccacggaaacttgttctcttctctctcaagaactcctcgtacaatggactcaactcgatccccatcagtgcatgataacccacaaacaagacaggaccttggtcaggaacaccagtaaggccacgaacaatcttcccattcttcagggtagacagcatgactgggctcaatgcaaggtgaaacaatctgcagaagttttagttcgctaattactgattcatttatatggcaaaattacatgcaaaagtaaaatagaattttgaattctcatagtgcgttaacatacttgtgatcttcatcgaatgttttcttgaactcactcaatgtcgggggaatgtaatccgtcacaggatcccgttgtctgccacggcggtacatatttactccttttatgactgataaaagattaacaccgtcctcctgtccaaaatagttaggtagtgcttgcatgaggagattcctttggtatttttgtagattctgtttcctaaggatctgaagccaattccccaataaaacaggttactataaaattgaagtgtgatgcgtcataccaacagtagtgtatggccattgtctttgaagtaccgaactctgcagtttttcagtgatttgaagagtctatctgcctcttctccacttggcagaagattatcattgccactgaataaaagtatttagtgtttcagcataagaccgaatttataggattaatccagattatagaactacagaatacatgctgtagtgtcatgtatcaggcattcaggctacctagcaagaagtagaacttcagcttgtacagcatgaagacgagagttagcgtaggctgctcctgacttcagcagcttgagtttccagaaaagagtatcccttggtatgatatctgccaattcctgagaaataacaaaaaggaatgaaaaataattagatgaaatgttttctcaaatagtacgaagtattatgtatctccttgagaatgcccaaattgtagctgatttcagctgcactacggctaaaagaaagagctaatttggttttttttttaaaaaaacaaaaagagctaaaagaaatacatgctgccccaacatttcacgatgtgatctgaaaaagcattactttgtaaaagcatttctttcaatacatgtattctgccattggagcaaaagtttcaaattacaaaaaacttagttatttgaaaatgcttatctggatccatagataaaagtggcaacatttagctagtaatgttttaaaatttagtcattacttttaagtttaaaagcataaaaatgtagatattcctcatgcacatgttgttgtttatgtaaaaatgagtaatagatagaaccagatgaggaaatgaaaataaggtatgataataacatactgaaagcaaaggcagcatggaagtgagactatctgacaacttctgcagagtttttggaggagaaaggttgttctcaacgctgaccatagccattttaagaggatcgcctgttcacacaccatctttagatcaattaaaaaagatacaaaaggaagtgttgagtgttaattgtaaatatgctgagatagaatcctggatgaaaatactaagataaatttccaaaaaaaaaatgtaaaagctaatatgcttttatgtaaaaactagtatgcttcatactagagttgttgatcagtgacccggcatgaattttccaagtttaaggctaccttttggaacattggactaccaaagaccgtttcccaatataataagaaataaatgaacagtaagcaataaaaagatgctttggttctcaggctggatcaaaaaagtgtattgcattacaagcatagcaaatcatccgattggccaaaacacacaaaacaacaaagctagaatgaatgtatattaacgaacttacaagctaaaaagaggtatacccatgacaaaactgagaagatatggaactgtgacatgaagttcacttggcattgcttccaacacaggtaatatcggctgcaacggagtctttgcaaaggacgttgctggcaacattgaaggttgtttgttactacaactcaaacaaatttatgagaaggaacgttaccaattaaaatagaactaaagaaaatttcacctgcctggattaatcagtatgagaaccagatcaatttgtggattacgagctgccaccgaaagtgctaggcatcctccaaatgagtccccgatgagatatatgggtcggtttggtgacatagcatgctcatatttgatagaattttccacaatctgcaacaaccctgtatgcattgtattcacacgcattagcagtttgatttaaattcaaggtcataatttcgctttgaattaatttcctaaattctaataagcctttgggctttgttagcccattcccaacccaatgactaaaatagtgtctatagcattaaataagttgccacatatgataaaaatgatgtgtcaagtgaataaataaggaaagaaaaggaaaccatgtcatgagacatgatttctacataacattcaagacatcctgtgagataagtagcattaaatttaaatatgaaatagtgttgtttgcattggaaaattattgtctagtcctagtttcttgatgacgtggagtttatgaactatatctggtgtcttagattgggaatggccttacatcatgctgaaattaccacggtgcacgaaaattcctaaattccatgcagatgaatagtttttcaccgttgtaatttttttttgtcgaccaaaagatggcatgaacgtcggaggagtctccttcctccgagcccaacgcggcggcgctcgctacctctgctcctggtcggcctcgcctactgcggcggcggcggcggcgtggcaccggcacggaggagggttctggctgcacaaggcgcgcgggcagcatctcctcaccaacccgcgcgtcctcgacgccatcgtcgcgcacgccgcgctccgctccgcccggtcgacgccgtcacagccctcgccgccggcctcggcctcgcgcacaagctcacggtccccgcccacgcgttcgacagaatgcctcaaagaaaaatgaagaaaaaaaaaacgctgatcctctcttcttctcccgttgccaggtgaccacgggcgactccatggcgatcgagctccccaagttcgacatctgcgtcgccagcatcccatacgggatctcgtcgccactgaccgcgaagctgctgatcggctcccaccggttcagggcgcggttcgcgcggcggctgatgggcacgccggggcacggggagcgcaacctcctcgccaccaacgcgcgcctggtcgccgacgtgcggctgctcatggacgtgagcaggccggagttctcctccctcgtcgagatccgccccaagcagacccggcccaaggagttcgccgccggcgtcgagctccacgagtggctcgcgttcacgcgcgcgtgcaccggacagcacaagctccagcggcagcatcagccgccgcccaagaagaagaagagcaagaagaagaggaagacactcggcgtcctcttcaagtaggacgagatggtcatcgagctgctaaggctagcccaaggacacgccggcggcggcagtgaagatggcggcgtcgtcgtcgtcggcaacaatgaggatgaccgcgacggcgacgtcggcgtcgcaagtggtttcagcagggaagaggtcgtggcgttcaaggagaggatcgccggagcattgcggtccgccgcgctcgccggcaagacggcgtcgcagctgcccaacgacgagctgctcaggttgcttcggctcttcattcactgggggatacgcttcggtagaggcgtagaaaacatcaaattcttaacgcaaatagggaaataaaataatacaagcttatgcatattctcttttttctttatgagttacagcttttacttaaacatttaattatctatctatctatctatctattatatactaaaagtccattaaacatcctataaacgctattaagccaccacatagcgctcctataatcgctcctacatcgtcacgtggcatttaattatttagcggtcgatttttactaatataccgtggatctattattttctaccattagatttatttatgtaaatagaaagagataaaaagaagtgcccgcatagcattcgcctgttgcgaacgtctccgatccgtcgaatccctgttacctaatgagcaatgctacacgtaataaatttatatcctaattagcgttaattagcactcatcagttaattagtactgtgtaattagcatacgtaggtgttattaagaaatttcagctccatgcatacaaaagtagcaagcccaccatatttagtgtggtattttttttcagtatttaatagcaacacattatattcaataatttatatcctaaattttaaacatgccattcatattaaagccctattcaaaatttttttaaaaaatatctgctcataaactttgtacaaaaataatcctttgtatccataaactttacatggcaaaaaaattctattaggaaactttcttcggtaattaaaaaaaatcaactcatgggattcaaaaaataaaaaaatgtaagattaaaaaaatccattcacaaactttctatggaaaatgtttatattcataaactttaggaaactttctacaacaattaaatatttattaataggactttaaaaattatacgcaaaatgcaccattttattatatgataaaatcactcaataagtagaaattataattatgactacatccgcatgcaaaattattttatataccgaaacatgcatgtatttccagcttgaaagaaagggacatgtatatatcatatttttttcagatcagatagacttgcatgcactcttctagaatgagcccagcccacgtgtccgttcgtgcaaactccttctcgcacacgtccgcgcaacagccatctcggcccgcatgtcccacccctcccatccatacatgtgcttgcgtacgtatgtgcctcccccatatatttcatttatcttctattttcccttttagttagatagaaaaaatatttaatgatttatacaccgccacatactatttctataatcgctcctacactgccacgtggcatttaatcatctagtcgtcaattttcactaatatactgtggacccattattttctaccattagatttatttatccaaatagaaagggataaaaaggacgcgcatatcccacccctcccgtccagtaggtgtgcttgcgtacgtatgtacctcccctatatatttcctttctcttctattttcctttttagttagatggaaaaaaatattttatgatttatacaaatacaaaatgataaaaaagggcccgtataccctccctgcctgtccagtatgcatgtgtacttacctctcccatatattgttttcctcttttagttacatggaaaaaatattttatgataacaaattttaaacaattatattatctaaatcatatagataatttttatttgcgcacactattagattatttactataaaatttaaaattgaaaatctaaattaactatattattaaagaaattcattattttagtcatatatattctacgaactatagcttttgttcactaattcatatatttttaagaaaaaatcataatagattttaaaccttctgattaataacatgggtggacaattttgacaacaagaaacctaaccagttgaactacgctcactttattatgttggacataaaaacaaccataatttttaagctacattttttaaatactcatatgccttttaaaccggtagaaccactatttctaatcattagatctatcttatatatgaaaaagtgtttattcatggtacatgacatttcaaaaatattactgtgcaatgatacttcgttgttatagtattcctactaggttgcgtggagtctctcatccacactacatgaaatgttcatagatagatcgtctctcaaaatatatcaatcatattaggctatataattaaacccatgtatttcgtggagcttcatgtcccacccaatacatcttttaacatattatgataatatattatacaattaaaaaaagaaaacaccttatttttattttacacttattttactttcgttgacatattttctaaagaaaataaatctaccttcttttcaaatgatgaagaagattataaataattgcttatagatattacttatatatgatatatataagggtaataggttaaaatattattaaacaattaattaatgctgacaaaaaacaatttatggagaaatcgtggtagatgttctccggttaatatctcgcttttataaatacctcaaatttagcgtacacgtatgcccgcgcgaatcttcctagttttgttaataatagtgaagaagcctaagtggataataacataatttatttatttattaccttcaaatggcgtacgatcattcactggtatatgcaagcagcgaacctcgaataccctgcagattcgagatggagggggaaacaattaaattgaattgtggtttttttattcagcaaaagactacagctataacttggtgtagaggacgattgagtactggagacaagtgcacttatataaaaatataaacaaaagtagttttttgtactacagtactactactacaacagttactggcacaaactcagaataacctaagcagaaaaaaaaaaggaagtgtttatatcaaaataatttaatggaactttgcagaaaggaaaccaataaagtcggcaaaggaagatcataagctagttaactccaaaagtgtaaatatagctagagaagtcgttgtgtctttatcagaagaaagaagtcaccttcccaaagacttgtggtgcaaaatgagccccattccaacaccatcagttcctgttgtgcagtcaaatctaatcagaaattgttaacacgcaatactctaatttaaccactcaggcgacagcctttttgggagatcttcctttgtttcttccataccaggatcctatgtcttcaaaatcacggtgattttatcgctgacatgtggaccaagttagaacttactgtatttattttccaagagttttgacagtagtattcctctgtttatccgagttagcatatcgaaatatatatatattcatagctgaacactaccccaggaaatgaaaaaaaatatataatggtataatactgatatgaaaaatgaatatgtggattatgatcctgcagggacatggcaattgtctcatcatgtgatttgctgctaagtctggtttttactctgtaatataattgtagccgcgaacaaacagtaattagctgtgaatatttggacggaagcaacgtaattaacgtatacctggcaagaagagcagcagcggcgcgttgtccaccgccggccggccggcgtcgacggggcagaaccaccgcggcgggccgccgtcgtcgctggagacggccctggccgccgcgaagtagtccttcaccgtgacgccgccgaacccgtcgtcgtagagagcctccaccaccctgcccgtcctcacctccgccgcatcctccctcctcttctcctcctcctccacacccacctgccgctgctgctgcgtctccgcattcacggacaccgccaccgacgccgtccccacggagctcgccgcccgtagcgtcgcggagggccgccgccaccgacagccgaggccgccagcggcgacggcggggagcgtgtggagcgcggcggacatggcggcggaatgcgcggcgcggctttggtcggagaagcaggggggaggagaggagaggagatgaggcgggggaatgattgattgatgcgcgcagagctttttgaggggcgcaaaaaaaaaggggggggcttaaagaggtgacgtcacccgcagattgccatgtaggagtactacaggtgtagcgtggccgttggtgcttttcattttttttttggttgatggtgattctgagtcgtggttggcacgggagccactattaaaagtattaaaagagagaggggaaaaaaagaacagcaatgagaattttgtagtggaaacctcaagattcttcagtaaaaagtggtgatctttcaggatggggtgttggcttggcttggcttgtggctggagaagataaactactgtaaagcattttgtgccgttgcacaaatggacagataccaaatggggggtgcacgtgctttgcatagtgtggtgggctggaatcgtcggtaggactgcaaaaaataatactacgcgtgtgtttagtagtttgggtgtaaagtttttaagtatacgaatacacatttgaagtattaaacgtagattgataacaaaacaaattataaattttacctgtaaactgcgagacgaatttattaagcctaattaattcgtcattagcaaatatttattgtaacatcatattatcaaatcatgtcgtaattaggctcaaaaggtccgtctcgcaatttacatgcaaactgtgcaattatttttttttcacatttagtgtcctatgcatgtgtccaaatatttgatgtgatatttttttgccaatttttttggaatataaacaaggcctatgtgtatttgatttacctacactacacaaagcatgtaccggagaggtgttgtagtaattttagtttccaaaaacaattactctctccgtttcatattataagtcattttgattattttcctaaacaaacttatttagatttccaagtttatagaaaaaatagtaacataacgtatatataatcaaaatatatattcaatattacattaaaaaaactaatttggtgtggtagatattataacttttttctacaaacccaatcaaatctaaaatagtttgactagaaaaagacaaaatgactaataatataaaacggagggagtactatctcaaatgaaacatatgtcgtttacttttaaaactttgaccacatatttgaaatatttgttaaagatgatgaggggtagatttatcgtgaaaattactttcctttccttttcttgataatagttaaaaaaatactttcataatctcatagacttgttagattttacaagttaattgtaattaaaattccgtggttaaagacccgtcctataatggcaaaatagaatatacggtatatatttgtgaccagaaaaatgtaggaatgtcttctttttagttagataattggtaggaatacctggttggtaaacggaaatgaaaagaaaagggcgaaattcaacctcgtgtagggtaaggcacggccgtggaggtgacaagaagcgtggcacagcaccagcagcatactagtactgtacttttgtggtgggcaagccacatctcatcacatgccggcccacgaggctgttgcgtcccacatggcccacggggtcatcgtttggcttgtttgcagatgaaaaataattcctgaataaaacttttacatatgtgtctttagcaatctaaaaataaaaactgaaaaataaattaagatgaaaaataaatctcagaatcaactctaaatttagaattaaaaatttaaattttagtttataagtaattataggcaaaaagatgacaggctagtcgcgacgcgcgaccgtttagatttagaatcgatcgtgtcgactcgcgcctcttggtgtcgatcggttgcttagctcacttggattttgtgcccggccaactataccagcgcagatgccatgtcgacgtgtcactgtcggctacgcggctggctccgatcgatcactgatactgatacttggcgcgagcgtgcgggccacccaacagaatggccaccgcctagttcccatgccaatctgccgagaatgatgtttttgaattgatgttataatatatcctattgaagtaaaaattattggcaatgcctatattcaatttggcactaatctagaatatttttctctattatctataccatcaatatttggcatcatattaaagcaatccaagcatatgtaataaatctctaccatatacttatacacataaacagactctcgcgtcgcccctcccccttggacgatacgggaggcgacgaccccgccggcgtgcgtcccccctccttcctcctccgcctcgccgaagcccgagcggccgtcggcaaagccatgcggccgcagtgacggcggcggcggggcttcattttccccttgttgcgctcgggcaggggggctgcgcgggacggaggaaaccgcctagatctgtgctgctcggccggatctggcggcacggcggtggcatcggagtttgggagtgctggcagcggtgggaaagtccgccagatccgcatttggatctggtggggaggcggctggcggcggcgcacgattgtggtggcaacggcggcagcgacgcccgatggtggcggtggcgggtgaggtctggcccacggcggccggatctggccaaacagccgttggcgacgacaatgactgtggctgagcgacggcggcaagcagcgggcaacgacgacggttgacggaggtgctggaggctgaggcaggcgcgacgtgcgcggaggtgcatgaggctgcaacggcggcggaggcgcagaagggccacgatgacggctgagacccgggaggcagcggcagacgcaacggcggcgcacggaggctgtggatggctggcagggattgcggctggcatggccagctcagcgatggctcagccggcaaccagcatgatgagcgcgtggagtgtggccggcggtgccggtgtggcacgccaaagtgcgcagcaggaggtgaagctggttgagatggagaccggtgaggtggcagcacggggagactggccagcggggggcgctggtgcagtgaagcccatgcgccggcaaaggtgttgatggcggtggagcaatggtgcatttgtagaagatcggcaggtgatggacagcgggtgaaaacccagcctggccttggccggatcgacaacaatgacgttcgagtgccattcccctccttagagcgttgtcatgccatctcacccctcaagggtggctgccaggtgaaagctcagtctcggttctctttgagaccttgacggacggcggtggcggtttcccgtcgcttctctccctagagacatcgtcgaggcatccccttgccgaagcccctcaagcaattggtgcaaccccgctctagattctagtccttttgtggtggcgttctagtttctacaagttggccgcgtaggagggcctagggggagaggagttacattcttctctctcaccctcaatccctaaatcgtgaagacttggatagagtggagcgttgtgttgattgtaagggttgggttttgggtgatctcgactgtcttcctttgttggcctagcggcggtcggtcacgcttagcagcggccggtccgtgctaaccttctcctagatatgtgtgttggcgttgtcggtgtgtaggtggtggtatactttttccattttcctggttatgaccatctagggttgtaatctcgtaattttttcctgttctatcaatagaacttcgcaccgtcttagtgcgagtcgttcaaaaaaaataaatctctaccataccaaagatttggtagtgttaaaatatgccaaaaatttggtactaccaatgatatcattggtaaggtagagaaccaaacggccatatagtacttcctttatccaaaaatcttaaatcttaaaccaatgttcttttctcctggagataaaagataaagatgaaaattaagtgttttacgaaaaataaggtggtattaacatatgattaattaagttttaattattacaaactagaaaaatagattaatctaatattttagagcaactttcatatagaaaattttcacacaagacacactgtttaacagtttgaaaagcgtgccataaatattcaatattttatccactctttgtagtggaaacgaacatgatagtctttatacatctataagtggaggagttgtccttttgttttacaatgctaaattaaattgttaactggaactcgcaggccaggttctcagcgagcagctccggtgccacactcctgaggttggcaacgcttaccgtattcaccaggccgttgattctcttcctcagggtgtcctagctgagacgctggtactcggcggcagaggcagcgctgtcgttggcctccctcgtcgccatccgtgccgtcatgtggaagggcgggatgtagatccctttggccattcgctaaccggggatcatctccggcagaagtggtggtggtgggggcagcattggagttgtcggctaggaataggattcagctccttcctattaggggttcacccgcgagtaggggtgggcaaagaagaccgaaccgaaatgaccgagaccgagaccgaaaccgaactaaccgagaccgaaaaattcgaatcagcactttctacaaaccgaatttagttcggtcaaattcagttttagggctcggttaaccgaattgaccgaaaaaaccgaaatatatcactggattaggcccaatacctcttcctccaaaaaccagaaaaaaacttatcctcacccacgaccccccagtagtccacccccaccaacctcctcctctcggcctctccatccacccccttcccatccccatcccctcctccccagtgcagccatgctggtgaccgacggtggagctcccggatagcctcccgcaggctgttcctctacctcccgtgggccatagcctccgcgccgccgcttccgacgccagcgctacctgctactgctgctcggtcagctggtgactggtgagcggcgtcaggaggaggatgaggaggaggaggaggggggggggggagagcgccgacgagggtaggctcgcgccggcagagagttcgaacgacggcgttgagaggaacagcatggccggcgcggcggcggcagggtgggccctgcctgggattcctctgctttggtggctcgcgtcatcgtcgtatccgcaccccggtggatgggatctggagcttctggtagtcggtagaatggtggagatcgacgggacccaagtcatggcaagatcgatttgatttgatttgcttcttttttttttctgaatcatatgcggcatcatattgtagttcttcatccgacttacttcgattcattgatcttgtatggagtacttatttttgtgtgattaatttttttttgttgttcatatgctgttatggttagttcagtctatgaccgagaccgaaccgaactaaccgaagaccgaagtgctcgaagtgctcggtcttaagttttcttgaaaaccgatcagtcttgtgattctgaagaccgaattttccaaaagaccgaagaacctaaccgaatttatcggttagaccgaatgcctacccttacccgcgagagagtatgcggcgcagcggcggtggcggccggggaggtgggagacagcggggtggcgaatagccgcgacctacgaggacaccacgtcacgacttacgagtgaaaagtcgaaaacttgtactacatacctttttttattgaaacttctggccctaattttttagggtgaaaagctttgacgtattacgttggatatacggacacacatttgtagtattaaacgtagactaataacaaaacaaattacatattccacctataaactgtgagctgaatttattaagcataattaattcgtcattagcaaatgttcactgtagcaccacattgtcaaatcatagagcaactaggtttaaaagattcgtctcgcaatttacacgtaatttctttgcatgcttgcaagcgaccaaggagggccgcggggggatgacttcagtgcgagcaccattaaagagcatgatggcccaacaagtgtcggaggggttggaaaaattcggtgttcgtggccgccttcacgtacggaatccggactcccacctaggggtgcaagtggggcgggctttttttatggcccgcagtcccgccccacaaaaaagcccgtaaatttgcgagcgggccatcccgtatggaccttgcaaaattgtttggcccatcccgcatagcccgttgggcgccaccacattagggcacgagactgggtctctgggagacacgagacaccgccgcagccgagacaggagacggcggcggtgagacgacgccgcggcggtgctactctcgtcttcctcgtcgcccatccatcttcctcggcgagacgacgccgcagcagccatccccaacccccacgtgtgttcggggcgagcctgctacgctacccgtgctgctgcctccaactctctacccatcactggctccatcggcctgggagactgggagcaggtaacttcgagctgccatggaagagggctgcagttccaattggccggccacaccttgtgccgcagcgacgacggccggtcaattgtttttcctccttcaagatttgtttgttcttcaagcagcaggggatttgtttgatgagaagtgatttctactcatttggattattgaataagaacttcagattaaataataagcatttgggtgagatttggttttggatcaagtcgctaagaatggttagcaggccaggactggcttggactatacttgttatgtcattgaaaaatgaagtgttgaacacatgttaatactaacatccttatgtaccagtttgatgttgttaatcacttgtcaggtcatttagcattattagtgtttgtggctctgctgaatctgtgagttctcttgcatgttcttgagctagtacctctgctgaatttgtgagttctctgacatgtttcttgagctagtagctctgaatctgtttcctgttcactgtcctcttgatgttgcaattttatattttcttccctctcttggtaggtttaatctgcaattttatagctttattccttctcttgctaggattaatcctagctaaatttgggacagggagtagttctgtgcttgtgtgaatattttcacgtgaaaatagtacagttttgtttgctgattgatgaatattatgccaatgtgggctgtccagtggtgcccgtcgggctgaaaaatctgccaagccgtgcggggcgggctgccgtttgcccgcatagggagtttgcggctggtgtggggcggggcgggacggcccacaacccatcccacttgcaatcctacaagtcccacccgtcgccgccatcacctgcaagctaaactgggtgctgtgtgtcggctgccgccgacacgtgagcacagcgtcgccagagatgctgcgggagatgggctgcgtgttggaaatatggtcataattcgatatattttaattcaaaatattaagacaataaacatgacacatatagggtatgaactagtgcaattgataaagtgaatcatcatgagca

SEQ ID NO: 62979 - DNA, 1323 bp, Oryza sativa
atgctgggcaggaaaagagagagaaaccggcaagaggaatagaggaagaacaaaagaaccatgcactattgaaatcattccctttggcggagtatgtatatgcgtgcgcaagactaacgttcgggaccatcaaccgagtgtttaattcagtaaccgatgcgctcgttaatatgaccaatacagaatcaattaccgtgtttattaccgttcgagaccatcaaccgcgtgcttaattcaataaccaacgcgctcgtgaatattatcgtccgttataaaacgagagagatcattccctttggcggagtatatgcgtgcacaagagtaacgttcggaaccatcaactgcaagagtaacgttcgggaccattaaccgcgtgcttaattcggtagccgatgcgctcgattactgtgtttattaccgttcaggaccatcaaccgcgtgctcgttaatattatcgtccgttacaaaacgagagagaattcccatcattaaaacagaatcaattaccatgtttattactgttcgggaccatcaaccgcagagagaattcccaataaccaatatgctcattaaaacagaatcaattactgtgtttattaccgtttgggaccatcaaccgcgcgtgcttaattcagtaagcgatgcgcaagagtaacattcgggaccatcaaccgtgtgcttaattcagtaagcgacgtgctcgttaatattaccgatacagaatcagttaccgtattttctcaaccggtcaacaaagtctatccactagcttcatatttaagttgagacctctttacttttaaggtggtattattactcatagcacttcatgcgagtcaataaaatttagcccattaatgtaacactgcgttagcgccgtcgggaaagctctctgctgcgtgggcactgggcagccgaatccgacccagtcggagcttgagtcgttcagtacttgagtagcctatccgattgacggtcccagagttcatatggtcactataatctctttttttttaatctaaaatatacccgtacgttacaatgggtgaaggctattttacgtcgtattgtcttaaattacatatgtaactttagtgtatttacaatataagttttaaaattacatatgtaagtttttaaattacatatatatatatatatatatatataaatatatataaaagtagtgtataatttaagtgtaagtactatatagtatactatatatatatatgtgtgtgtctatatatatatatatatatatatatatatatatatatatatatatatatatatatatatatatatatatatatatatagg

SEQ ID NO: 62980 - DNA, 4606 bp, Oryza sativa
  unsure (1)..(4606): unsure at all n locations
tgatgaatccctcatttacctttttttaccctataaataagatggcatatccattctttagtgatgctttaccaagaattagttttcaccagttactgacatttcaaacttctttaagtaccaagtgcacttttttggatttgctatctactccacaatgtcttacctcatcagttagtgctaaagataattctttgtttgtttttctagctctcttcaagtatgttcaagtaggctagcgtgaaggttctcaaggaggtgaccaagacgaggaaggtgcctgtgctggaggtgcccttggcgttgaccaagatcaagaaggcaaatcttgagacatcctcattctttgagactcttagagggacagagttcccggtcaggacatggatgcgcatctttgtgaaggttagaaatagatgcatgattgcttgcaagagcagttgatttggtttttctaaaaggacttttttttgcttgcttacttgcttagttcgttgggtaaaaatgtcaggatcagctgaagaaagggtagtgtacaatgtttttatgctgcatgagctccttaattaatcatgttcttcattatttgtcatggtagtgaaatagtgatgatgctttagcagcccagttgccatgggcattcctgacattgagaactaactgttacagtgtattactgcaccctgtttgctgaacactgcaagaactcctgaattcaaactgtttgtgatagtgtgatggccatgcgatattaaccaaaacaaggaactgacatacctaattttaaattgttgtgtaaggctttattttagtcggaataaacaaatgtttggaaccgtggtctgctatatattatgtgtttatcatgcccaactcctaaacctgtatttgaactaaatgaatttgtattcttgtattgtttatcaccacagaaagaggattgagaatggtgtgtatttgtgtccttaacctttaaggggagactcatgaaagaagaaaaagattctagactttatggcctttctgtcccctcaatttctgccattgtttggatgccatgggaccatcaccagttcaaagctactgacagtgctctttgtagtggttccagacgttaccattgtatatatgtatctatttacatgtctaacttgatgcttatagagattatatttgttgtttatgtattttttttgtgagttattcccatatcaaactaatttagttgcgactttggagttgctggtatagtagagaattgaatggctctgctttttgtaagtgcaagcaattgtgttctttgggttttatactaattctcgaacttgatgatgttgggccggtcgttcatgactctatatttgctaactcaatacaactcttttatgttatatcatctttattcccaaatttttgggtttgtaatttctttctctatgagcaattctggtactacatttacgaatgtaagagacatggtcctaattcgtgtatgtctagggaatgggaattggttggaaaaaaaagttactccatggacctcctttttattaggctcatgtttaacttgcccagctggtagtttcctaaaactttcgttaatactgtgaatacaccaaacttgttgcccatttttattgtgaatacaccaaacctgcttcccctcgggtagtggttgccatttttattgggattttctgatttttatcaccatgctgctgctcttgttttttaacaaaaagaggttgctatgtatgtatgggttttcagttcgtagtgtgtgttgatttctgagttgttatatcttccgtactttctgtttgctttgacctgttagggttattttttttcgcgtgagttcctgattagattggatgtttatttgtacactgaattaattgtttgttccttacccgttcctgtatatatgtattgtgtgcttgtccatatcaattaccatataatggataaatgcgcaaacccttatacaagtattaacaactcgctgtaatttcatttggtacatgatctgcatagtaaacctattggttatcattgctaaacccatttacgactaaattctacttttcgaaccaatctctgctgtcctcgcatgttaccgcctactttctcaaactgtaccatttttcatctactcttagatggaaaaaaaatgtaacacagttcttaaaaaaggggccccatataataatctgatgttaaatcaaattaatatgcacataatatgccactccatgtggtcaaattaaccttaattacgtgtagttctaaccacgtaggtgttagcgtgcgaggcgtggcgccgcgctcatatttctagtgttatgtcaaaccttcaccgttattccaaactctgaacttggcctgaaattcggcaggccatggagcgaacattatcacgaatgcagggagatcttgactcgagaggtcaccgtctgcacgtcgaggcagtagagagcatcgatgagatgcatcctgagagaggcgggtcccttggcgccagactccatcccgatctccccggccaggccaaagacagcaagggcgcacgccgccgcggccatggcgtcggaaggctcctccaccaccgcgaggaaggccgcgatgagggccgtcgcggcgcagcccgtcgccgttatcttctgcatcatggccacgccgttgctcactccgaccacccgctcgccgtcggtgacgtaatcgacggccccggacaccgcgatgacggcaccggtggaccgtgccagtgcttttgcatcttgaagagcgtcccctgaatcatgtgtactgtccgcgccctgcaaaatcgatgggaattgattggaacattgtacattatatactagtatcaatgtactagtaaattgttttggttagtcagtcagttttgattcttgacagaactgaaagatcaatctgacattagccatcaatctgacattttggataataatcagtcatggaacggtctgaactctcgagtaacaaaaacaggtgcatcgattgggattcagattgtgaggacagaagagaggatttattttcctcatcacaatccatttttaatccattttctaaaaaataaatcacaatcaagttcagaaaattgttaatcgcggcactctttttctttccagtagagagcacgaggcagttcacaatcaaaccaatccatctcaatcgtatcaatcaagatttttttttctataacttgttcggatgggtaaattaaagcgaagacaaaatggttgcaataataagcgagcaaagctagaaatggtaccttgaaggtggtggtggaggaggaggaggaggcggcgagcgagcgagaggcgagggcaaggatctccgacgcgttccccctgacgacggcggggcggagggcgaggagggagaggcaggcctccatccggaactcggaggcggcggcggcgacggggtcgagcacccaggggcggcccgcggaggcggcggcgcgcatggaggggagccagccctcggacagcgtgccgacgttgacgcacacggcgtcgcagcgcggggtgaactccgggacctcgcggagggagtggaccatggccggcgacgcccccgcggcgagaagcgcgttggcggcgatgtccatggagacgaggttggtgacgcagtgcacaagcggcgcccgcgcccgcaccgccgagaggagctcccacgcccgccggccccaccacgccgccgtccgctcctcgtccatgttcctcgatccggcgcgaccggaggtggggagtctctgaggaattcgatggaggagaagagtcgaagtgggagcggcactaggcgcggcggcggcggcggacggcggcggggtcgaagaggacggtggaagcctggaagaagaaccgtcgagttgtcgtgttcgcggcgcggcgcatcgagagacctcttttgcgctcaagtgggggatggatggatgcaagagagccacgcgtccgaatccgggtgcccagctgccaatccgacggccaggccaaaggtcagggtttataaagaaaggtaaattggtttctatgaatttcgtggcttctatccattactttagcatcttaattgtttgtttgacacatgagcatttgactcctaggtgggtacctttttctgtgttctatgaaaaataggtgtaataatgttgaacggttgatggtgctaatctaaaggacctatgggctgtttggtttgctgttcaaaccaactacactgagaatttgcctacatatcaaaacaatatattcacatgtttttttaaaaaaaaattggcgctgccaacattaaacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 62981 - DNA, 1116 bp, Oryza sativa
catttgaattgggtatatactcaatttcaacaatggtgcccgggcaccatggagcaccaaacaaatttactatatatatatatatatatatatatatatatatatatatatatatatatatatatatatatatatataggagtaactcttttctttgcctaacacgatgggtaattaaatggtcatacatgtcgctgtttgcctaaataaatatgatgaattcatgttgatgggtaattaaatggtgatacatgttgctgtttgcctaaacaaatatgatgaatgtatgttgtgcaatgttcaatgggcatggcgcatttccccgcaaaaaaaaaaaagggcatggcgcataggagaactacgttagcggcaccagaattatgtcacctggtgataatcgactgtaatctggtgataattatgtcaccagaattatagcaaatcctttttcaaagagatttcttatacgactcctcctgtatttccaaaagcgaactaatttaaaacccgacttaaatagggacctgtatttccaaaagcggacgaacttaaataccgactcatatacggatgacgtaccaaagtatcggtaaaaacatcttcaatttttataatagtagagaagagatgcgctgccacatcggtccttctcctccgtttcatattaagtcaaaattttgactaatttataaaaaaaatagcaacatctacaataaattagtttcattaaatttaatattgaatatattttgataatatatttattttgtattaaaaatgttattatttttaacaaacttgatcaaatttaaggacttttaactagaaaaatgtcaaacaacttataatatgaaatggagcgagtatgttttttaagacttacatgtggatccatctttttaaattctaatttttattttcttattgtgatgccaggtgagtgccatgtcgaaataaaaaccaagttaacctgccacatatgcaaccacatgagccaaaactgatctcaaaactattgaagaggttgatttacactggttttaccagttggaagagatacgaaatacctggtcaagggacgtaaaatgatccatagatgagggacgtaaaatgaac

SEQ ID NO: 62982 - DNA, 6022 bp, Oryza sativa
aatcatgtcgtccaccggtcgatcgcatccatacacctcggtaactaggattcaatgaaacatatactccgatttttgattaagatatgtctcatcaaatttcaggtaattactccctcccaaaatataagtgtgtccagattcgtagcactaggaagtgtttcatccgtctaaaatcacttattttttaaggagggggtaagtatattttagataaagaaagtactctagtagtagttaattacgtgtacatgctattgtgtttgcttaccccccctattgtggttatctaaattacccccttaaactctaataccagacatttgataatctgaacttgtaaatccggacgaatcaccccctttacttaatccggaacggttttcagccaatatgacagcaggttctcaaacagcagcatatccatggattatggatagagtgtggttcttgttaaaaaaacaaaaagctcttcaaatgttcagttacgctcattgagctggctgaaccaccatgcagttgtatgaaggtgtagattggcagatcaggacttcaggatgaacaagtatcttcctagtagttcttaaaacagttcagcaggggacagttgctttgccatttagagcacccatctgaaaacagaacggtgttcccacagcaccactgcaccagctcgtccaatgatccagtccatgtagcaacagaaaaattgttacaacttctaagtatccatgataggcataaaaccttaaagcttcagcttccctttatgccgcctgtgaagcttctgcttcttctaggcgcagcttctggtaatcgttagcatgcattatgtcctcatgattgattgcactctgagaaaagtagaaaaaaggtattcttttcagaaacaaaaattgacccaaattattcgtgttagagatcataatttattttcttacatgaatgccctgagcacaaaaaagactcttcaaaatgttggatacttcatccatgcctagaagagctcagctcagtctcagaggttgtcggcgcagccaaagctgcacatggctgatcttattgcttcatttggaatcccgatattgacatcttcagacaattggctgaaaatatttgatgtttcagttcaatcattattgtcatcgtcttgcagttcgaacaaatccttcacatctttggctttaaaaaaaatttcacctctgctaaatttttaagtttagtgagtagttgtgtcaactacccattttgttgtaccagaaccgacccaagcggctgtgggatgccaccactaggtttctagaactctttctcggccaatagtctgcgtatgcttttttgttgaatgcttcttgtgttgtatgcctttttgtttttgtttgataatgcttgtgcgagctacaatatggttatgaaatacattagatctattcacggggactactttctcatttgttttcctgtaaaatgctaattttgtagagaattactgttgaaaataaaactacatataagccaaaattcagtgaataaatgacaaagcattactatgctagcctagcagtaagggaatatcaaaacagcaatgtatctcctctccaaccctatcttaatgtttaagataattggctgaaaatattggatgtttcagtcaaacatttactgaaattattggatgatcagtctatatactatcacatctcctctcccatcatataataatgttttaagacattaagcttgtctctgcttaagacacggttttctgattattgtgtgcatggagtatgttgtatggaggagtgttacggagtaatcgaactattttgcaattggttgaattatcccatgagtagcaatgtcaacagggaaaaaaaatctaatctacaaatttcaaaaaagcaaagcgctaatgtctagcgctgcctccaaccgagagacccgactgtgtgcctctagggcatctttacttcttttttttttatggatgcagctgaccggcagggggtcgcctgccgtgcccccgtaagtagggggatcttttcactgctcctctttttttttttttgcagctggccggcagggggtcccctgccgtgccccgtataggggatctttacactgctcttttttttttgcggctgaacggtaggcgggtacacggccctaccgctgcccattgcagtcggggtgggtgcctctagggtggcgatggaatagaatcaaatcgagctaataaacaggtcgtgttgtctcagaatcggcgatatggtacaaaactaattgccggatggattcagtccgagccaaagaacagcgcgcatatcgacctaggagtagaggcagaagcatacctggtctccacggaagccggcggcgaagggcgccgtcgatctaagccggtgctgaatcttcgcgccgccgatgccggcatgccgcggagagtacatcggagatccagatcctcctggagttttgacggcgcgtccgcagccagctgctcgctgccggagccagaattggggaatcggcggcgtcgggggaggagaggaagcaacaaggtgaggggggagatcgagggttcccatcgactcaagtgtcgatgcaagccctatacgggctaggcttctctcttcaggcctgggcatcgagcccaagctgctgcaggcccagtccacgcctgtttttcttttctttttctttttttctaaaggatttttgtttgtgctcaaattggtaatgcggttgtttggttttatagcggttacaagttgaaataagtaagccaaggatattgatttgttcacgcagccatgtatcctgcccaaaagtttggcagaggacaacagagtttgccatttatagagtacccgtttgaagactttggcccttccctgtttgaagtttctggtggctaagaagggtctatttagattggtatcattttaaaccataccattatttaataaaataaacaaatatatagttgcatttagttagttatcaaatattagtaatgcataggaaattttggcacaacatatttattctcttctactaaaatttggcaatactgtcaacttgctaaaaatttggcaataaggtttattttggcagtaatctgaacatgcctctgcatcaggctattgagtgttgacttcaacctaagtttccaactcactttctcgttttctatgcacaaatttcccaaattgctaaacgtcttttttttgcaaaaaaaaatatagggaaattgtttaaaaaaatcatattaatccattttttgagtttctgatagctaatactccctcaccaaattgatcatcatataatggaatccaaaacttctcaaattgaacatcatataaccgcattaacatggatttcatcggaatacaattaatacaatatgggagaagtgtgtgcacgctacggtgtaattgacatgatgttttaatcgatacatgtattgtgggaggatgtgtgcatggtgtcttgattaatgtgattttcttggtcttagtgtataaatatatatgatgatcattttgagataaagagagtggttaactaatcaagcattagttcattgttctgttttgcgtgtgtaggagagtggttctaacttctccaagagaacccatcaagttcaagaacacagaggatggtaggtgcctcacagcagcacaaggtcttgcggtccatgtagcaacagaaaaactaccatgatttctgagcatccgtgattggcgccaagcttctgcttctagctgcagcttatgttcatcgtagcattcactatggcaacatgattgatcacaccgagataatcagaaaaaagaaaaggacatcattttgagcaataaaaaccgaggcaaattatttgccttagagatcatatattgttttgattccatgaattgcctgaccatcaaaaaggatcgtcaaaatgttggatccttcgtctatgaatggatgagctcggttcatattgaaccccggcattcgcatgttcagacaattggttgagaatattcgatgttttagttcaatcattatttccatcttcttgcagcgttaagaaatccttttacgtttctggcttaaaaatagggtctttcagtactatgtttctcctctatcggtacacctctaatttccctagttttccatgcgcattccctagcctactcaacagatgatttaatctggtatcgttattagatactacaaatgaaaatttgcagagaaaattactgctcactttatattttaatgtatgatgccgttaattttttaaccaacgtttgaccattcgttttattcaaaatttttgtgcaaatataaaattatttatgccatacttaaagaatatttcatgataaatcaagtcacaataaaataaattataataacataaattttttgaataagaaaaatagtcaaatatttataaaaagttaacggtgtcatacactaaaatacggaggggtactttacatttgggtatgatccaaaccattcatctgccagatcatctgtcactagcatccaatcgaaactcggcaaggtggttagaaaatttggcatcttcacagcgaaattgctggcagaaggttagcaacacagcaatgtatctgctcttacagtcttagagcaaggataataatagtagctataaacaaactatatgcttatgtgaaagagacaggtaaagagaagtagagagtgttggctctcatgcacgagttagctcaacacaagctgcaagaaatatgcattaaattcatagtgagagaacgagagaggatgacaaagataaaactaaccttgtagctaacataacatattatacatgttagctataatattgacttatgataagtagtgagctttattgcttttatatcatgtgcacgagtatcagagtatgttgaatgtgagtatcatggagtgcttgaactagttatccaaaggaaatttggaattggtagattaataaccaatgagttcaacaacaaaaaattcatcaacatatttttatccaaaggaaatttgaaccggtggattaggattagccaacgagtttaagaagaaaataactccatcttacaaatttggaattggtggagtaaccagttagatggtgtttgaatctcctaaagataaagattaagtttattttgcaaaacaaagtagtattaacgtatgattgattgagttgtaattattacaaacttgaaaaatagattaatatgatattttagagcaattttcatatagaaagtttttgcacgaaacgcaccgtttagcagtttgaaaagtgtgccacgaaaatcttaatcttcatctaactcttattgaataaaaagaacgggaccttaatgcaaccggaaaaaaaaaagaatttcatctcacaatttttttaaaagccaagcgctatgtacacccctagcgccctctgtagaaatatttttttttctttcgttgtattccatttcgttcatgccaccgattatttaggattttaggggagagagaacctgaagctgcatacgatagtttagatcagtaatcttttcaactaactcatggacagattacatctctgcaaacatgtttcttgttatttctaatcccagctctctccagatatatttaacatacttacatttgaaaaagaggtgtccctgatcctcatcaagcctcctgcaaacatggcatctagtatcaatatgcatcccacgccgcttcagatttgaggattacagaaaatgtccggatcaaattgtgtcccttaggtgtgtgactggtctcgtaattcctcttattagtaaccatggatcatcattgcaaatattgatgctttagccattcccaactctccaaataatgccctctttcagcagctcaacaccttttacaatacttcgctatgtgtatgacatattcccgatcagatgggcagataggatatcagcagtagggaaataccttgctttaaggatcctagcacacagag

SEQ ID NO: 62983 - DNA, 17326 bp, Oryza sativa
cttatcttttagatactcaagagcttcagctctagattttctaatctacattggaagccccagatatttctcattttgtgtttcctttgttatgtgcaacatttgcatcacctcacttctcttctgatccctagtgttcttgctaaaaattacagccgactcgtcgttatttatcatttgccctgaaggcagctcatataattggggagttccttgcaattgtgttgcatccttcccgtttgcacgaatcacaattaaagaatcatcggcaacagcaggtgagagatgcatggtgctccttggcaaattttaaccccaccaactctttcttcattctttgccttcagtaatatagcagaaaagccttcagcacagagcaacaaatatggtgataatggatcaccttgcctcaatccaaatggttctcctcgtatacggtaaacaaccaagtccagctatatttccatgagaaaaaccatcaggatagcaattagtaaacaatgtttaccacatatttagcagtagttgacaaatacctagcactgatgttcgaagaaggatagcgtagtatatgggaattaaaaattcactacttctatataagagcagagacctgaggcaaaaaaatacgaaggatcgatttatggaggcaaataaccaacgacctggacaggtactgcatgtaatttgaagtgcaattcataaccattacataatcgatttatgagagaaattcaagcccaactgattgaagtgcagagcaaaatgtttgctatagaattgatgctacatgtgaaggcagaccataatattagaaagctgtaaaatataaacatggcgaatactttttccatttttagataaacatggagaggaattatgtaggcagggacaaactgtacaaaatggttgaaacatcaaaagtgaataataagttcccgcatgggcaatcagaaaaaagaaattaaaatgctggtactagtcagataatgtttgcctaatatcaaattcaagtagtgagttcagttacttcttgctatctcaaagaaaataacaaattagagggattttacgatgtttgcgaggtacaaggaggtggggcgacgtgagccgttgatctgcgaggggcaaggtatggaaagaaaatattgtaataggtggcattaatgtaaatatgatgatattagaatgacaaatgtgtcttttacacatatgaaaaggtatgagaaggtatcgatggaattagcttgtagcctgttgcgttgcatcgttcttagatacgttctattcgtacgtaaggtttacgtgttcttcgataagttgaaaggtggagaattgagggctggcggtgaacgtgtggccggaggcggtggttggagggaggggcggcggaggaagaggacccggaggaagtggtccaggactgcctatgttcgccggagctagaagcggccgcatggtctcgatctgtcagacgattggtttagtttttttcgcaaatcttcctcattgaacttgttttgttcttgttaggtgcgtaaatcttctcaatttgttgtcctttcgatctttgattacattcatcaaacgatggatcaccaaattgctatgaaaattaatgactaactggaaataattatcaagatcatgcgaatatgatatgtaccacgtgaatcggaccaaagtttggaaaccgacgcaaacagaacgactgaagattggaaaccgaatagaagagaatgtaatttttgtccccaccacataaatcatattttacgttacctttaaaaactacttacacggtaccttgtggtaccttcaaatccacttacaccgtacctttcggtacgtccatacgttgttagacataattgccctgttatcaattaccttttaatccttagtacctttctacctctgatacctttcataaggcacctttcatcgtgagccgttagatctatactattttagaaatgcaaacactgtaaaaggtctcagcaaattaagcatgatcagttaatcattctgttgatatacctttttcccgtgtacactccataccaggttcccataacaaactttgcaccaaatttgttggagctcgcaacctgacaaatgagaaaagaacgaatttgaaggaagtattaccaggacatgcttcaatactgtatggcattgaaagctgggaaagaacaaaatgtttcagtcctccagtcaataccaaatgtttgtattcgagtatgtacctgtcacctacatcttcttgtttcagatttgtccttcctacaaaaagaaccagctagccattccacaaggttttaagaagacatgggagacatttcctctcaatcaaatttgcatgtctcatctgaatgaaattaatgtttgcagttcgctacactaaccaaaactttgctacggtcagcttcagctaaaattactggcagttattcttcagcacccatgtttcaccttttgcatctctttgcgacaatgctatttccttcagcatatttatgtactctgagaaaattaaaaaaaggacagtcatttttacaaacaaaaattaaggaaaaaaaatcatttgacttaaggatcagaaattattacttacatgaatccctgagcaacataaaagactcttcaaaatgttggattcttcatctacctgatcagaactattgctgctatggtctatttttccgtttctatgcctggatgaattcggttgagtctcagcggttgtctgcaactctgcacatacctgctcttgttgctagttatttgcatccttggtaatcacatcttcagacaattggctgaaaatattggatgttccagccaaatctttactgccatagtcctgcagcgtaaattaattcagatataaatgcaaattttacagagaaatttactattaaaaatagaactgcatataagccaaaattcagtgaataaatgacaaggcactactaatactatgctaaccatcgtatctgcagagtacgaatccaaaattattcatctgccaagtcatctctgaccggcatccagtcgaaacatggaaattcagtcggttagaagttttgcgtcttaaggcgaaactgctagtagtaagggcatatcaaaacagcaatgtatagaagttttgcatcttaaggcgaaactgctagcagtaagggcatatcgaaacagctgtatgcaattcctctcctactccatcttaatgttttaagactttatttaagcttctcttggcttaagacagactaaaaaaggatgcaacagaaaaaaaaaatccaaattttaaaaaagctaaggcgctagtgtctagcgctgcctccaaccagaggaccgactgacacaaccttatcgttgccgtattgaatcttttcactgctccttttttttcttctttttacagctattaaccggaagggggtatataaacaaacatgcccagccgatgcacacaggggcgataattttcgctgtattcagtcggggcgggtgcccctggtgaggcgatgaagtagagtcgaactgaccttataaagaggtcgcgcttgatcagaatcggcgatgtgggataaaacgagttactgggatcgatcggcaccgaagcgcggcgcacggacagacctaggagtagaggcgggcatacctggtcccatcggagaccggcggcgagggtgccgtcgatctggccgaagctgaagcttcccgctgccgtcgccgacgccgcggagactacacccgccggatcgagagccggctgctcgccattggacgttgggaagcggcgccgtcgagggagagaaaattgtgattttgctatcgcaaaagaatggttttgctggaatactatcttcaaagtgattcattaaaatgctatcctaaactaaggggtattcactgaaatacgttttttggttattagaaacgattttgctctattttaatttttgtctaaccaaaataccctcgacgtggtcccacctgtcatactccctcctctctctttcccctcttcctcccctactatcccgatgcggtgctcgctccaacaagccagcgtctacgccaccgccggccacctccacggcgcacgcgattggcgccttcctccagcagggacgtcggcatcgggacgcaggtgggggagcggcggaggcaggcgccggcaccagagccggagccgatgcgggggcgccggcgtgatgtttgcagcggcgacgccgccgccgcacgcaggcacagcaccaccatgggagcaatagacgtgggctccgacggcggcgaggcttctcggcagggcgtggaagagagtcgctcatgcggcggcgggtgccctcgatcttcgccgacgttgccgtccgcccctgctgcagcggcacggcaggccactctcgtcctgcttgtgctcggccgtggcgtctagccggcagagcgcatccctcttcagcccgcctatagccaggtgtggcgccggcggcgccgcgcgtaggccaccatgggcgacggcggcgaggcttccctcctcgagccgaagaggctggatgagatcgattcgatctggtcaaacaggtaaaagagacaagggtattttggtcaaaacaaaaattaaaatagagcaaaatcatttctaaccaaaagacccaaaatagcatttaatcactttgaaagaatagtattccagcgaaatcattcttttgcgatagcaaaatcacaattttcttgtcgagggaagtcgggaggggatcgatgaagtatgaggcccaggtcgcatttgggctgctttttttttccaaacaaccgttcatggtaattcatttatccttttttttctgtttgacttgcgatgtgtttagattgtgcatcgctccttccattaaaaaaatataataataataatacgatttgtgacttgtaatcgtctcatattattatattattaggatgtgtcatatttggaattaaatttttaaaaatactgttcattgaaaaaatttctaggatatttgggatgcacaatttttccaaaaatataccgtcgatttcgtacaaccattgcacgaaaatgacgtgggcgtgacgtcgcgggtggtattttaaaaaaaacttggatgaacagtatatttttaaatttaattttttttatgggatggagaggttatgttgtatggagtactagaataatgctacattcatcttgaaatataaaatataaagatattttaactctaaatttagacaagcgctagttagagatattttagtggtacggatatcaccactagtatcgttttcaaacgtgttaggcaacttcggcttagttctttttttagaacattagcccataaattttccctcaaaccttgctatacacataaattttgcctcgtccaaatagttttgatcgtgagttgacttgtactaatatattgaagtgtaattttccttcaaaatgattatggctgcgttccaacctatatttggggtaaactgatatgttccacacgaaacaagacaggaggttattagtgaatgattaattaaatattaacaaatataaaattgaaaaatgagtattgttttaaataaacttgtatgtaaaaaggttttgcaaacacacaccgtttaacaatttagaaaatgagatcacgacaaatgatagaattgcaaaagctaaacgaactttcaaactgagcctatgttgcccttatctcatacttatatgctagcctatttgggacaacaaaattctcaatgcaaaaaaaaacacttatttgcaaaataaacaaagatggtagaattatttgatcacaaatttgacaactgaaatttgaatctttaaataaatttcagaccaaaattgatggaatgcagacaatacacatggcagcctagccagcaaaaacaaaaaacaaatcagtggagcccagttgtcaatgctgcaatttttcccctccccttatctgcttttcttgctgacatggtggaggcggcgaacactctgtcatcctagtcgtcggggtcggcagtgtggaggcaaccatacaagctaagctgatgaccgacagcgacagcggctaccgttaagctggagtctcatggcgccgacaacgggatctgccccttctccctctgttgcagccagatccaccaccagcacctcgagctctgtgtccacccatcaccaccaatcgcacccctagctccgcgtccgcccatcaccactagatgcacgtctcgagcctctgccgccaccctgagagagctcgagatcctcattgacaaacacaaccttgccggattagctgcccgtcgattacaaaatcacaaatcttttggtgccatcgtcgctatcgtcgacgacaccgccacgtcctcatcctccttgcagcaaatccagatcacctcttcttgatccccatttggttctcttgaatcggcgatggctagaaaggatgaggcggaagggctcaaggcaagactgtcgctgcccaagtcaaagaggtgtggggacaaaggcgacggcggcggagggaggaagcggaagaagacgtacctaaatgtccttggtgtgtgctgctccaaggagggcgtcgaggtgctaatgtggctgccggcaccggcgatggagaggctggtggcagaggtggcgagagggcttgtcggtggcgtcgatgcccacgctagggatagatggggaggtagaagagaagaacacatgagatatggagcactgataggtggacccattattttagaaatatttttttccacgttcaaaatgccacatcaggcagcctagccaaaaaccattcaaaatagtgctggagggtgtaattcatccagattgaagagttgagaattaaaatgtttggttttttcgagtttggggggttaattcgatcgaccacgatatttttaggtttacatgcacaaggtcattcgtactttttccttgtgcttatgtgcacatgaaaatatgtggggcaaaccatatatatattgaaaacctgaaaactacccttaaatcgaaaaatagacgtcagagactcgttcatgtcaccatgagtaaaatttttatcataagtaaatttacgagtaaaaattttactcatgataatatggacgaatatcagacgttcatttttttaatacaacaatagtttttagatttttactgcacatatatacttttttcgtttcatattataagactttctagcattgcccatattcatatatatgttaatgaatttaaacatatatatgtgtgtttagatttattaacaatacaaatatggacaatactaaaaagttcttgtgtgtttagatttattaacaatataaatatagacaatactaaaaagttctaaaacggatgaagtaattcctaacggtatattttcgtaatgtgcacgggcctcaccggatgctgcccatgccgatgccgacccgccgttttgcgggcggtgatagttggtcacccccgcgctggatggctcgatctgatgttatacgaggagcttcctatcgcgccgccgcgtgcgtacgtgtttgatcgcgtggttgttgcacgttgtacgcacgtacgtacgcgtgtgtccgtgttcggcgccgcgcggccgtcgtacgtcccgtacttcatcgtcgcaccctgaaattaataagtatgttaagataatgctacacacgtcagccgtttggcacgacactggacgcccgccgatcgatggtgttatccttcttcgattcccacgtggcacaccgacggcgcgatcaaacacaagggcagagatgtgagacgatgtgcgacggaggcactggagaatggagatcaggaggtggaggagaagagcggagcatctccaaccgcctctctatctcctctaaattaaaacttagtaatttcggataaaaacacactccagcagactagcatggctatccagctggccaaactcctcctcgcactggccaactttagccagctaaaattgcctagccaatcgtgggccccacgccttttcccctctccctctttcctcccgtctcatattctctctccctccgggagcaacatccccctcctcctagattgaccacgtcagcgctgccccttgtccgccacgccgtcgaccgctgccgaggccgccgccgtccactgccttgtcgttatccaccgtcgctcgcttgcatcctctgcccgtgctcgccatcgtcgccgggtcaagcgcctccatcgctgctcactcgcatcctccgccgtccgctgcctcgtcgttatccaccgccgcgggtcaaccgccggccgaccagtgcaacgagcggagcggaggcggcggcgcaacggtgagggagggagggcgcgacggcgagggagtagcaagggaaggagggaggctatatggcggatggctgtcgaggaagacgaggctagcaaggaacggatctgccattgtcgtcgcctcgcgcgcatggattcgacgtcgccatagtcatcgctcccaccggccttcgctgcctgtgccgctcccattgtcctccgccacctgtgtagctcccgtcgtcctccgtcgctcgcgctactcctgccggcgccacctccatagccgtgccgcactgcagagaagagaggaggagagaggtgggtgaagaacaacacagagactgacatatgggacccactattaaattggagagtgtaatggacatgttgttggagtaaaacgtacttggctctctaaatttttggtaagttgccaaataggacatttggagagtcaaaaatagccacttccttagagatgcttttatgttaattacatactatctctgtcctataatataagaaggtttagagttggatacggttattaagaaagtaggtataattgaatagaaagaggttgtgattggttgagaagtggaggtaggtgggaaaagtgaatggtggagagttgtgattggttgggaagggaatgttggtggagaaatcgttatattttaggacaaatcctgagtgctaaaaattgttatattttaggacggatggagtacttgttagaattgaataaaagaggagggtgtgttaagcaaagcatgttgtataagatcttacaacaatctttatgatcaccgggtttattttaatgaaagcatatatataattcataaatatactaatctctattatttttctcgctataataaattaataatcaagcataataagtatacattttattccattatcaaaaataataataaatatttatgaagtacttccaattaacatgccatcaaatcgtctaagtggtgggagagaggatttatcatcattttccccgttctaaaatataatcaattctaacagaagatgcgtcaaactagacaatcaacctcatatactccaatcatatgaatatatgatacaagttccttaccaagtggcactagaaaatggccgaaacagaggagggggtggtgcgggagcagaacggattcaatccaatcagccacaccgtcatatcagtagaaggttcagcgtcatggacagacaaagaggagtcgcactatatttgtacgagtttttttaaaagcgggggcacacaatcaagtgtgaggaggccggcaaggcatggaactgggggacaaaggagtgtatatatcggaaggatcacgaaaagacaggtttagatttatttcatgttggtgcatctaggctctagaacctccatggacgcatgtttgcttgctttatgtaacatcgatttaatctctacatcttttgtagaatttagttcacaatgacagcataattaatagaagtaattaaaatatataatgccagcaaattatgattcatttgtggatttttttaataataatgaagatatcccaatcatgctgcacgcaaattatgcatgaaggtaattgcattcattctccacaccatgtgcacgcttattaggcatgacacccgaactcattaaatcaacacatcacatgcatacttaacactccaatcagaatctagtttgtgttagtttgagtaattcactttagtgctttgctaaaaaaaatgtattttttctccaaatataaacaaatgtaatgctaaacaccattacaatttaatttgttggtgatttgttatctaaattatagtagtcatcagggataacaatgggttgggttaggcttggccagagcatgaacatgtttgatttgagacctcatacctttcagttcaaaccaaacccaatggtgttagcgtcttagagcacatatataatggatgataccaacttcctataggattttgtaatgacatggaacaagccaacgactaatttatcgcctggttgtatggcgcatcctaaggttgtgggggcatagatggaaaagaaactcggctgcctcctgcatccgccatggatgccaccctcactagtgttcatcgacaattgcgaccatcggagtcctgtcctcatcctgctcggctgccgccgtctctcacgtcctccgcacaaacgtcctcatccagccctggtcgccgccgccgcatgagcgccctcgtcaagcctggccagccgcaagatcccacaccatctttgatcgcaggagtcatcaaaggtaagaaagagcaagttaaatagtatagtcaattaatagctctaagatttaaccaataaccaatcttatggactaagtagtttgcatataaatatatactatacgattaatacctggcacaactctcatacacgcatgatgtcttggaacccatgttgcagttggctataaatctgtagtttgcttttctttttccccctcctctatcctgtatctaaacatagatctgatggatatagtttttaaagttcgctaattacttcacttatgggaaagtgatttcatccctcgaggagaaatccctcatttcgtacatgccacctaaatagtcataaaaaaatttgaaacaaaatggtaagatatattaatataaaatatatcactccacaaatatgcaagttaaaattttacttctacaagttataataaaaataacaaatatatctgcgaatgtacgataactattttcagtttattttcagtttattttgttctttttgttgcaactcgcaaaagttaaatttggtcttacatatttgtggagtgatatatttcatattaatctatgttgttaaatttttaattttttataactatttcgatgacatacaaacaacgaggagacatctcctcaagagatgaaaatccatttctatcgcttattatactcgctagaagagcatcggtatgatagtactcacatgtgagggtaaccataccttggaggtgataccacctctctgtaccataaataccccacccaacaacaaaatcttgtgtacatctacaccacaataccgtaccctacatctctcacacaggtagcagtagtacgtagccagccagtagttacacacgcgctctgctcctctcgcctacccacgattccaaggagaagagcgcctcccgcacagcggagcgcggcaaccgctgaccgcaccgcgcgccagcaatggagtcgtcgcgggggaagcccggcctgaacggcagcggcggcggcgccgccgccttcgactacagcagccgccggggctactacacgggcgccggcgcggcgctgccgccgttggccgctggttccagggcgccgccggtggacccgtgctgcgtggttctgcgggtgttcgtcctgctggggacgctggcgtccgctgtggtgatggccgccgaccggcagagcaccaccgtccagatcgccgccggggaggagctcgcgccgccgctgcgggtgcccgtcacggccaagtggacctactcctccgccttcgtgtaagtctctctctactgctccattgatttccatccaagcatgtgcatgaacactgatatatgatgcgcctacaaaattagtttctcaattattccagtacactgccgctctttaatcaactgcagccactccttaattcaccatatcagttgcagctagcatgatcatttctctcttctctctactacatccttcttgtgtttttgttctcttttgttctgtctgttctttctctcgtgtgtgattactctactttggtgatgcaacagtagctagccccagtgacacactcattacataggacaaagtatacaaggagtacacatatgtcatgtaggtttgaaaaaaaatgggtccaaacaggcacatgcatgtcttgccaattacacatgacctgtattccaatttccaaatcccgatctacttctccctcacaattcgaaaacaaaacaagctctttcttgaataatttaagtctcattctccagcatagaacacaatcaaattaagcacacatgcatctttattattagagcaagtttaatattagagcaagtttaatagtatagccaactacttactcgtcaatttatacaatagttacctataaatatatactacactagtctcacttgtcatatacatattgcgttttacagtccgtgctacagctaattataaatttataactcgctactctttttttttctcttttattttttcaatatttgtttataggtttattttctcgtacatgctcttagcctctagtgaagtgttagcgtcattatgtgcctgtacggtagatctttccgggatcgattccgaggaaggaaggaagaaacggaatggtttttttgaggagaaagacgatgacacgcaagaagaaatgtctttgcatgcatgtcctaattgctagtactcctactactaccttccattctctgccgctggcctctgctttaattccacacgtccaaacaaggcgccttctgtttctctctttctcctacctaattaatggaaagaacttttatgatatgctacaacagacaaggatgccacaacagatactactatataattagggattttcaggatgctctactttcttttttatgcttggtagtactcctgtcggtttcattagtaatctgatggtgaaatttttcagcatcggaataatatatatatagtagaatgcatgcatgcatggcttgtttaattaattaatgattgatatatatctgtgtggtttcaaagttgtttccttgaaataattaaattatttatgtaaattacggttcttgtagtatactactgaagaattgatctttactgggtcggccgaaaaccacatttttcctaattatttcgctcaaaactaaagataaccatatttagtcccgaattcagggtcccagtttataacccgggactatagaggattgcaaaccgggacagaagaaggtttatccacccgtggtagtatttgatagtagtggacacactgattagctaaagaaaacccaggacagaattagacaaggacaacccaagcattgccaccagcagcctaccactagtaccatccacttcaactcctgttgccacctttaccttacacatacaaatcacgttctagcatcgtggcgaaccttgaaaccctatttttcattgacgtgttcatccatggatagacaaagagatttcgcaaatattttttggtgttagtgttcctactatttttgaaagtgatacacaaccatggcttattgccaatctatgcaaaattatgggagttggtcatgtggcactgtgggtgacattgtttgttgatagcagcagcagccacagaaaatttctttccttcacgaccgttgatttggatgaggagaggcccaaattaacgaccgttgatttggcctttacagaaaggcgagagaaatcgatacggatagagatttggagaaggtaaaatggatatgatgctttcttcgttatcaagatcaccaccgtaacaccgtttattcatccatccaaggaaaagaaaatgctctactatatcggaatatatataatatatatcctttagtacagtttaatcccagccattgcaaatgggtagtagtagtggtcgtagccatcgaacaatcgcaattactgaaagatgcatcttatccataaatttgatggagcctggactggagaacaggagaccgatcgacggtgtccgtccattgatcctcatcttaattgatcttccatcaatcatgcaagccatgccagttgagttgcgtgcaaatgtagcctacgttaattcggatggtaggagcagtgtttgctgcttgatttgggaaaccaaaaattaacaaagcgaatataaaccacccgtttataatttcccatagtttgcaaagctacctaattgtactactccctttgatcccctgtttcttcgagaaagtcttttacttgtgcagctagagatcaaacgtgcatgcacgagcgagcggtgtctcgattttgcatcgaaagcgtcacgccaagaacgatgttgaataaacgataaagcgtgactgtgacggttatctatcggccacatcttttcgtttatactcatacttatcaattaaattttaaattgagttgatttttagtttttttattgaagtttattttttaagtcaatacttttatatcactaaatatatatatatatataagttttattcacagattattttttgtttacaaatatgctctgtttggcttatttcacgaatacacggtggggccgtatacgatggcttcatgcgacgatggcttcatgcgacgaatgcactgaacattcgagagggcacgcactcgctaatggccgtcgatttcagaattcaggattccaaccccggcctgtagcggacgaactgtatccgagagctcgacttgcgaagcgtgcaagattcttcgaaaatttggccgaaaacatgaacaaatttctccgaattcacgcatgcaggtacttcgtggtggcgaacgcgatggtgttcgcgttcagcgcggcggcgctggcggcggtgcggaggcggagcgcggtggtgccggtgatggtgggggacctggtggcgatggcgctgctcttctcggcggtgggggcggcggcgcagttcggcctcctcggcgagcgcggcaacgcgcacgtgaggtgggccaaggtgtgcgacgtgtacgggcccttctgcgagcgcgccatggccgccgtcgtcgtcgccctcatcgccgccttcgccgacctcgtcctcctcatgctcaccatcctcaccatccacaaggcctcctcctactactagccatactctattttgctttgcatgggtcttcgatatggatgtcatgtgtgattaactgatttgatgattatattgcgattattagtcaattagaggcaacagtggtcgtttacctctgtcagtgatcaccgtgagatgatgcctgcttgccgtcttaatttaatcgttgacatgttcactgaagtagtaattgaggcttcatttattagctgtaaggtgaatttgagatgagtataaaaaagaactgatggattaaaagaaaataatacaaaatttacaatgttgtaaggtgaatttgaattgaggcttaatttagcttggggtgaatttgagatgattatgaaggaggtgtaggcttaaaactaccctgcaggaattgaaggctgaggaaagttaaaaaaaaagaatcatgtgttgagagtgggatttgaacccacgccctttcggaccagaaccttaatctggcgccttagaccaactcggccatctcaacttttgtgtctatgaatccaaaaggttatttagataccctgtgtctattattcacagcacctttttcaatttaccaaccggcaacacgataagtaacgtgatcctgtccaacaaaacattggaacatgcagtgattcggtcatctttaactcggtcaagaaacatcagcagcgatacatacaccacccattagggatggcaattatgcccgtttgcccgtttgcccgtttacccgcgggtaaaaatcctattagggttgggtttgttctccattttatacccatgggtatcttattggttcaaaagctatgcccgatgggtaaatgggcatgggtatgggtaatcactacccatgcccgctttgcccgtttacccgcgaaatctaacttacatgtaggctaggagtaaaatccactagaatacataagccacgttctttgttttctacggtttcccttttatttcccttattatttctctcctcttactctatcgccgacagaggagagacacgacaccgaggcggagaatatttgatgttttaagttcgattcgaagttagtagcttgtagactttttgttccactgcttttgttgtggcgggtaaacgggcacgcccgcgggcataaggcgcccgcgggcaatgggcatgggcaaccatccttacccgtcatgtagtaatgggtatacccacgggcacaaataatctcacgggcatgggtatggataggcactacccgtgcccgtcacgcccgattgccatccctaccacccatacacaattgtctttctttcaacttgccgaaaatactttatgcaatctattttgttcagcatttttctgttttggcatcacaaccgaatactcagtacagtccagaaagatcaccggtataattatacagtatacatggacaagtaacgatcaatctgatttttgataaatcatcaatcaataacttccctaactccaccatttttcttattttcttgaattttttttgggctatcttatagttttacacctcgctgctaatccctcctgctactcgcgtgcgcggggccaaccgcccataagcggtgcgccggttaatcaaaatttgggcgctgtggtggtgtgcatgcgtggcggttagggtggaggggctgctcccggtgagagggctgggaacttttgtaaaaaactcctcgtgttttcacggaatatcgcatacgtcctcggaccgcctgacatcccgttgtatttctttcatataaccgctcgtctttcaggaaaatacaatgcgaagaagagaaaattccgcttttaggggtagatatgtaaatataaaaactatagggggttttctgcaaaacgtcctacactaaccccccaattccgaaaccctctccccattctctcccttccctctcctctcctcccctcccctcccctcccacctctcctctctcgacgcgggttccggccggagctgccgccggagggcggcggcggctaccggcggtggcagaggtggctcaaggcggtggctgcgcggagggtggagccagcggcgggctt

SEQ ID NO: 62984 - DNA, 1321 bp, Oryza sativa
agcatctgatttggccctttgtgcccaggtatgctcagcccaagtgttgtcgttgacgccggattgcacgtctccttcctctgcttgtcgactatcagcaggtcggtttggccactgcaggtggagccgtgaaggtaatggccgccgccagccagtggaccaccttcttggtccccctacgacctgcgcgcgtcgatctactaccggggaacgccggatgcaggccgtcgtggctggatctaccagcgctggtgtacgacggcacgaagttttgcaatggcgtcgtgcttgggacaataggagttggtgcgattttgcgccttttgccacaaccaacctcaacatggtgaatttcgatgctttgcttgcttgcgcaaatcagcagatgtctttgatggtgagtcccaacaacccgtgcatcatcgaggacaaggatgatttggttgctgaggatacaaaccacgcactttagttcagttttgtactccaatttgattttttttttgaaacgaagggttttttttattattttttttacgatgcttgcagcttgcagggtacctgtgcgtgcactgtgtatttgtctctgagaagttactgtgaaggaggtgacatgtaagatgctctaacatttttcactcttcactgatcctacagttttatcttccaatgttctaagtcactggaacaagaacgacatggcagagaggataagaagagaaggggtgtccttttctctgaaaagataagaataggttagtgtaagtagttgaaatggtggtgctaccaattgcatcgctttgatgaatccctcatttacctttttttaccctataaataagatggcatatccattctttagtgatgctttaccaagaattagttttcaccagttactgacatttcaaacttctttaagtaccaagtgcacttttttggatttgctatctactccacaatgtcttacctcatcagttagtgctaaagataattctttgtttgtttttctagctctcttcaagtatgttcaagtaggctagcgtgaaggttctcaaggaggtgaccaagacgaggaaggtgcctgtgctggaggtgcccttggcgttgaccaagatcaagaaggcaaatcttgagacatcctcattctttgagactcttagagggacagagttcccggtcaggacatggatgcgcatctttgtgaaggttagaaatagatgcatgattgcttgcaagagcagttgatttggtttttctaaaaggacttttttttgcttgcttacttgcttagttcgttgggtaaaaatgtcaggatcagctg

SEQ ID NO: 62985 - DNA, 718 bp, Oryza sativa
cgaaatatgcgctaagatcatccgtacgtgcgtcagcggcaggagaccacgggatgcaagttctgattggttatttggcttcgacttcgaggaaacgttcttcagagattatacaatatacgcgcttagttggttggatgccgcgggttcgttacggatttgttcgtcgattttgcatatcatcactgcctcttgagtcttgacttcgttttgcgcgagctcatcgccgtcggttggtttcgatttcttccttgaattaaagttccgaagaaacggcccgatcaagagtacttttactattcttttcaagaaaacaaatacttttacaacaatatctacaaataacgagatgttttatgatgacctctactaatagtagtaagcggtttttcaatggtctttactagtagtaaggtgcttctataatgttatagtaaggtgttttccatcacaggcgtgtattaggaaggtgaatcaatgtgatgtttggactggaatactgcattttctttttttttcttttttttgtgggaaactgtatggttccatggcagatgcaaatggacacatgggtgtgttggcccgtgctctgattctgcagtctctaccgtgccaaatcacgcatgaaaagaatcctcgtcgttgtactcatagctactacctccgttttcagattataagattttctagcattatctatattcatacatatatatga

SEQ ID NO: 62986 - DNA, 33036 bp, Oryza sativa
  unsure (1)..(33036): unsure at all n locations
tgtattgtgccataatatcgtagctcttgccgttgccgctctcaacaaattctctgtcagaaacgtacgtcaaagttgtgtcggtgtcattgtaagtactacgatttgtcaatccgcagtcgacgtttaaaaaccctgcacagacacacatccctgtaataacagcctaaaacagacaccagatactgaccgatgctcatgtcgtgtgtttcaactgtttcaagttaaggttcatgcgagttcatcatacaatcatgcagctagatatttggtcgctaagtatacggggagtgcttacatatttattcttgggaggaagtatatgagagtgtttaattagctctcaagtattatgcactgatttctacttttctagagctgcatataatgaagtgatctgaactgtgcagatggagcatggattacaaagaagcaggctcgcagaggaaacagctctgataattaccaggaggagacacgccatggacttgtgtcgccgcgaccaggatgagcagcaacgacaatatccatgtcagcttggtaccagccgagcagctgtagctgatcaccatcaaatccttctgttttagcattggacgacggggccttcagccattttacaaattaatgaagtgtgttctatgcttgtatctgctacagatgactttatagctagcactgcaaagcagaaacaagctttagtaatatgtacattgacttgaccttgacggcttgatcgtacgttcagagataatcagctcggggtttgcagccacccgcaagaagaatctgtaacaaaatcttaaaacaaatgcaacttgccgtggaatttgcatgtcaatgatcttctcgccctataatttacggttgcgacgagaacgtaatcctaaccgcagtgatgacgaaattgcaaccggcgaaatacatgatgcaggtcaccttttctctggttatcgatcgccaatagtatattaacgcattgctgaaatgcatgttgatgtttctctgaataagtctgatcctgtcaaccatgccaaattaaataaaatagggacaaacaaaccgttgcgttcacaccatatgagatgatgagatggagaacatctgcaaattgcgaaggtgaaaatccagataaccccttacaagccattggtattttgaatcttcctctacaacttactacccctttcgggtctatcctatcctagataaccacattttgagaaagagaaggtaatttcttacaaaacactatccacaagtccattttcttttcaacttcccccctgtgtctagttttttaagtaattctcactacattcatcggtgatttctcacatcgtatggacctccagcatggtgagcgaagttaacacttatattctctgttattgggcataagatttaatacaacttatttaataatatggggtcatcttcgtgttttatcgccacacctttgataaattaaagcatacaaaagcaaaagcaaaaggagaactgcctttgatgacaagggtagcaatatagtgcaggcccataaggcacgagaaaataccggaaactgatagaaataggaagttggaagagaaaatgaatttgcgagaagtgttttgcacgaaattaatttgtaggggagagattagaaagatgagtgatttttaggagggggggggggcattaggattttttcctcccaattgcgaaatattaatcagagtgtagaaccccggaatgcgccaagttggatgacataagaggcaggggaagcaacgtatgcttccctgtcgcgatcaggtgtctgcatacagttttttcaaacgtgcactgtttgctttgtttggtcgcatgtcgaattctgacaaaacaaccgcgggccggcatcgtcgattatcctatggcgaaatatgcgctaagatcatccgtacgtgcgtcagcggcaggagaccacgggatgcaagttctgattggttatttggcttcgacttcgaggaaacgttcttcagagattatacaatatacgcgcttagttggttggatgccgcgggttcgttacggatttgttcgtcgattttgcatatcatcactgcctcttgagtcttgacttcgttttgcgcgagctcatcgccgtcggttggtttcgatttcttccttgaattaaagttccgaagaaacggcccgatcaagagtacttttactattcttttcaagaaaacaaatacttttacaacaatatctacaaataacgagatgttttatgatgacctctactaatagtagtaagcggtttttcaatggtctttactagtagtaaggtgcttctataatgttatagtaaggtgttttccatcacaggcgtgtattaggaaggtgaatcaatgtgatgtttggactggaatactgcattttctttttttttcttttttttgtgggaaactgtatggttccatggcagatgcaaatggacacatgggtgtgttggcccgtgctctgattctgcagtctctaccgtgccaaatcacgcatgaaaagaatcctcgtcgttgactcatagctactacctccgttttcagattataagattttctagcattatctatattcatacatatatatgaatgttagtaatgctagaatgtttataatatgaaacgaaagaagtggctaatttggagagcaagcggaacgacgcaatgtttggttgcacgaccagnnnnnnnnnnnnnnnnnnnnnnnncagagtcaagtgtgcatgccaatcatatacgaagtagctcggattggattagaggaaggcttcaacgatcgcgtctgtgagcgatcacgtatgcacgcgcttggcccagaacagtaggtaccacggcttcggtacggtctttttgctactaattattttttttctgtgttcgtgtcaccactcttgactttctctggcacgagcacgactgcactgagagctcatcggtttttttaagggagagctaatccgttggttagtttggaggaaactaccggcccaaacaacatatttaaaaaatatatgaaattttttttatatgtgttcttagtgatctaaaagcgaaatctgaaaaataaactttgataagaaaaaccttaaaattaattaaatttaagattgaaaattaaaatttcaaatacttatgtttatcagttaaaacttaaattttcaaccttaaatttgaagctgattttaagattttttttccatcgaagtttatttttcagcctttgctttttggacgctaagaacacgcatgtaaaagtttattcacagattatttcttatttacaaatatgccgtttcacttatgcttaaattcagccaaccgatgggtgcgacggattgatcgttcaatttctctataaaaattcggacggtcaaatattacacttagtccaacaagtaaaacactaaattatatacagacacagtcacataagtaatttatttttttaaaaaaagttttgcttctcgcagaaaagaaaacatgagtagttttccgttgctcggttgctcctccacccaagcgaagatcccgctccctgggccgagcaacatagaggcccgcgtgagccacgggagggcacgtggcgggctcttgcatgatgatggggccacgacgccagcacatgggccggagacgcgccgtgctagtatgcttttgctctgagtcgcacctggcccaaaccgcaaaacagtcgcttcgtccctctctgctcggccgcgagtgaaacgaaagccggaaaaagggaaaaaaatgtactaaaaactctgtagtacagtactgaaactaccgttttaaatggatgtagctcacgttatttatttctcaagttaaatttttatttttgtgacgtgaataaatctaaaatattcattttaaaagtttcaatgtatacatgatttacactacatattttctaaaaaaaaagttccggacaaaaataaaaccacacaaaacatatattccctccgtcctaaaatataacaacatgtagcctctataatttgtcttaaaatatagtaacttctacgccaatattctcttatcaaccaatcgtaactctttaccatttaaattcttcacctaccctcacttctcatccaatcacaaccctcctcacatatagttttacataatttcttaataaccgtgtccaactctaaaaatacttatattctgaagcacagtgacaagtcaaatatttttaactttcattattagtaataaaaagataaaaaagatgaatcatataaaattaatgttactagatttattattaaataaactattataatataattttttatttaaaacatctcttggatagttcgatctcgccagtctctagtctctaccagcgttcgagccctcatgtcagaactcagaaccccgggatctgacacctcagccgtcgccgtcgccgccgccgccggcggcacatgcgtcggcaccgccgctgaagcttctctctcctccctctccgggattggtgcggaatggatcggggatatacgggtttcttctcttcgtaaggtatgccctagctctttcctagtatcgatttcactcctgaactagttcgttctgcgttaaactacgggaatctattccaaatcgaaatgttccgattagtgtacatgcgcccatggtttaggcgtggacctctgtatagaatgcccatattaactcttgcgtaggatgcatttgatgcatatgaagcccttaatgcatttccggatgacatatgggataataaacaacgatatttccattatcttgaaaagatatgggataattaacaagtaacaacgacattttcttttacggacaagtcataggagcgagcaaatgatcaaaccatctccaaaacagatgcagtaaaatagcatttcctttcaccgtccagaaatgtagcttatttctgacatcccaccggtaggaccagactgtgaggaactgccctcgttgtcgtagcttgttgttgtagctccagaaatcatcaagtggaactgccgtggaatgtctgcatccatgacgttcttctcttgaggggttgatgtaaccgatcgtttctcacttgaaatagccaccgtaaacaacaccttaagcacagaaacaacctcagtcatgcttggcctgtcaattgatgtgttttcaaggcagttcattgcaaggtctatcacagtttgcaggtgagtggcatcgtattgatctaacagtttcttgtccacaacatcgtggatgcttcccttatcaatcttttgccgcacccaatttggcaagtggacggtttggggatccataaatactgggggttgaccagtgacaatctccaagaggacaattccaaaactgtaaacgtctgtcttaacggtaagttggaaagtagcatgatactcagggtcaaggtaaccaagggtgccggcaacaacagtagatatatgcgtgtgagctgcattaaaagcccgtgaaagcccaaaatcagatatcttggccaccagattcttgtccagaaggatgttgggtgtcttcacatctctgtgaactattgacgggctgcatgattcatgtagatactccagtcctatatccattgaaattcatgttttaaacacagtgcacacacatatgtgctaaaaaagttggatgtgtatttcaaaatacagaccttgtgcagcatcaagtgcaatgtgaagtcgttcttcccaattcaaactactatcatatcctgcatcaaagtgtgcgaaattagtactatagaaggccattcaatatgtgtatggttgtgcaaatactgctatatgtcatttggataatttgaggttatcaagggatgactatattgaaaaaaagaatagcagcacttggtgtaataatattccaatctatatttgtatgtatataagcagtcactttgacctttaaaaggataccaggtttccttctctttcgtagagcacctttttataaatttcaattaacaaggttaccaatcaactgatggaaaattaagaatatgtagctttaagagtacaacgccttacgattgtcgttttattagtcagctgtctatatatgtattgactggtaccaatagctgtctaggcaaccagacctttacattctatgctcacctacgtgctgtccatccagttttgtagaattagcagaagtttgcctcttacatgatactaacttacgagaatcttgcttactacttcgcaattccctatatctatgaccatacgtccatacattctctatatctacgaccatacaggttcaaagtttaaacaaactagcagtaatagactagtcacctgcaacaagaatatcccgttgacactggatttgaaaccctaactacttttatcgcatagtttttctttttcccctgtgtcaaatatgctttagctgattattcccaattaagcgttatgagcttgacatgatttattgttttattgttgaaaatttgaaaactactttgttcccagtaattagcgaaatctgttgatggctatgagttgttccgcaatgtgaaccttgaattgtccgacctcttttctgtttgaactgatttcaggtttgaatgattcagttttgttgagtcagaagtatgactgatcacagtagaaaattaaaataaaattggtgatcataacaatgtgcaattcagacctgtatgacttaactacttgagtcaactcttcttgatagaaatttcaagaaattgaaagaggaaaaaggcaaaaacctcctcttaaaagctgctgatgtcacgagctccggcgtaagaacgtatgggatatgaatgtgtgattggcggacgtggacgagggggtttggaggaacggcgacccgtgatgaacagcaagggatgagcaaatagagaataggaggtgagagaattagagattgaatctgcttgattaactcctccgaattgtgcctctaaataggcttacaactgattaaccaaattactgaaaacaagctaacaaactgataaggaaactggctaacagaacctatcctatcgcaatactgttgccgtccggcacggcggattacgtgcgctgcgctgcatctcctgacgccgtatcctgcagccctgtgcggcttctgcgttgatatgttatcccgaccatgacagctgaagatttcctctaggcatgaaatcataaacaagcgcaaggcacttcctgttttggcaatatcccaccaaagtgacaagattcttatgatgaactttggacaaggtttgcacctgcagcaggatatgccattcagggctgaagttagatacatatctttcttgaatatagactatatgggaattgctttagatggccttcgatctacttttgtgctgttaaatacctcagggaggaagtcttttgactctgctatagatgtctccacaagcaccttaacagctacttcatcgttattttccagtatgccatgataaacagtgccaaaacctccttttccaatgattgattggaagttgttagttatgagcttcagctctgcatatgtgaaccgtttgatgtcgatatgtaatggagcttcctcttcataaatagaataatcttcttgttctgctgattttcctgcaaactccaacctttatttacatgaaagtacagctattactaatgtacaccaaacaagcaatcattaaaccacccattgcattgattcaaaaggacttcagagactaatgttttattttacctttccagcacagcctccagaggatacaaaccagtacaaggagtaggagggataccacaggaactatcactgcgatgagcaagataggtgtgctgttcttatttgcgcagtacctatctttgacttttgagcatatgggattgccttctagtctaatatgccattatacaagttattagtcagataaaaaacaaatagaatcagctgaggaaagaaaaacttagctatatcaaccttttcaaatcatgattgtaacatgcttctgaattttagtgcttctgaacaaccatttctctaaaggcagaactattacatgctttataaagtgcatgccttcgctaatagatctattttgtccctgttttgttggaaatcatgtagatgctaaagcatttataatcactagagtctactacgtgcaatttacctttttcagttgtttttcgataatgtggtcgttgtttatgaacctttaattgattgatactgttgttctgtgataaccagtgttggttttagtcttttccttttggagtagttattttgttagattctttttttaatatcaatgaggagccatgcaactatgcaagggagtgttcccaaacctcaattcaagctgtcctgccttaaacctttgaagaatagaatccgggattggtccatcaagttggttatttgataggttgctgaaaagagtagtttaaatgattcatccatctaaaattctatatcaactaaagattaatttgaagcttacagcactctgagtgaattgagttgatagtctggaattgcgcctgtcaagttgttgtgcgataaatccctatatatgtttttgtgttcagtgtccacataatttcatttagctctggatgcaatgtggtaagaagaagcacttacaagttctccagtgatgccattttcatgaatgctatgtgtaatccacctattaatccgctggctgacagattactgcgaatgaacacatcgtaatacttgtcagataatttagtcatggcatcttaagacaataatacacatgactaggtatacatataatgactgtaatagtacatttaaaggcaaatatatttggatcagcatatattgactccaaaggttaaaatcatgatgacattatgaggttcggatttcagaatagatatgtactttacggttttgtcatgtacttacattcgggtgatccttggatttttgtttccattagcgtagtcgcaagccagaccttgccaggaatactctcttggggagcatggatctccattccagtttcttgtgtaactgtagtacttcttcacttctttcatgtaatcaactacagcaacagaaggataattaaatcaaacatgaatggaataaaggaattgctgcgtttgttgaacctgtgggcttgcatgattagttgatcagtaagttgtagacattcacttattgagtcgctagataattttatgatttaaatgttatctttaacttgtaattattcatttctctactttttcttaagaaaaaaattcatttatctgtttttagattaaattcatttctctgctagtagtctttgctctcaataaagctaatggattcttttgtagaccacatgctgccgtgcacgatgatcgtatgaacctgcgccataaatagcacacgtctaatttgtaccccaatctgttactgatcgtaatcgtaccgtcgtctggagaagtggtgaggttgtctgtatgaacaagcgagtacacctcgaatgcgttgatgagcggctggagctccgagctgggcgtcttgcgcagggtgaagttgaggcccctcttgcgcaagaacttaccactctgatatgtgctctccgctcggaacaggggtggtatgtagttgggaaacatcaggtttccatcgttatagatatcaaacgttctattctggttgttgcctccaatatcggcaaagtggaagattggtagcagctccaagctcctgtagtcgatgttgttgatgttgtcgatgtttttcatgttgtccggaaatatcacgctgacgttaaactctgagaaattgctgcttatggttgaggccttctgaaggatgggcatcggcacctgaaagtcgtcatttccaggaagctttgtcacgtcttggttggtggtcatgttgaggaagggaaatttgtagcgtagggctgcctcccagaaacgatcgaagggatcagttggatatcttgatcaccacaggagatacatggaaatgattgaaattgtgaggaagactatgattacaacgtcaatgattgaaaccgaaaaaaaaaacttttgaatcacctcgtgatgtaatcatcgaccgagccatatctttgtcgagccaaatggctgattgaaacagaaagattcagaaatgggaacattgcaccatccaattccctcaagtctaatgtagatacgaagggagttcctgatcccaagtttatcagacagacggatatgaatttgtctggagcaactgtgatcacctctttatacatcgtatctgatgaaccccagtttgtcaagttcaccgttgcccagaagttgacgccgatgtggagtccaaagagaaacagagaacccttctctgacgagttgagcccatcgtagtttccataagtgaaggtggctctgatgagatacttcttgctactgttggttggtaatgtataacagttccgttggccatcagggaagcttctcaacgttttttcttgttcatttgtagcatctgcgatgtattgtgccataatatcgtagctcttgccgttgccgccctcaacaaattctctgtcagaaacgtacgtcaaagttgtgtcggtgtcattataagtactacgatttgtcaatccgcagtcgatgtttaaaaaccctgcacagacacacttccctgtaagtaacagttttctgaaataaaaagtaataacagcctaaaacatatacaccagatactgaccgatgcttggtggagaagaaaattggtactacgagtgtttattcatgtcgtgtgcttcaagttaaggttcatgcgagttcgggcttgttcagattgaaaccgttttaaatcaaaccatcttttttttagagttaccaaatatatgtatccatttattttttttaccacacttcgataaatacataagaaatcatgtcataattttgaaaatattgccaaattactaaattttggtaagatttattttagttacaatcttaacaactccttagttcgatcatgcaactagatatttggtcgctaagtatatggggagtgtttacgtatttattcttgagaggaataaaacagtgttgtggaaaacggttgatacggccgtataaacggccgttcaatcggagacgatgagttgtctgtcacatttttacaaaacggttttcattagtcgtttgagaacgtctaattaccatcattgcccgattaatcaaccgtttctgactaatcggccgcataatctactgtgatcacaagacccagtacacagaacaactatccggcccattaactatattctgaacttagtagtatatagctagttgtgcagcctatatgtttgttttcttttctttccctttaattctctttcaaatctaaaaatttcttatgtattattgatcttattttaatcttttgtttaaatcttaaacagatgtgcacgcttgaagttcttttagtaggtgtacacctatgcgttatgaacgttatggatgtcctatttaaaaaatattataggaatatggtcaaacataagttgttgtatgcatttacatcttaaaaaggcaaactattataaactacatacatatatttacataacgttaaatatccgtcaaattccgataaatcgtccgtattccgattaatcgtttggcggtaccctctccgtccgtcaaccatattccgtctttcacaacactcaataaatatcaacttgattgttcttgctatgattatattaacttgatgatcagaaataataaacggcctgaagttttcatagtatggttctatatcaatttgatgtaatcgtttgagattaataaaagctttctttattaaaaaaacatatttattcttgagaggaagtactccctccgtcccattcggtaccaggttggttttttatgggacggagggagtatatgatagtaagtgtttagctatcaagtactactatgcacagatttctagagctgcatataatgaagtaatctgaactgtacagatggagcatggattacaaagaagcaggctcgcaaagaaacagctctgataattaccaccaggagacacgccatggacttgtgtcgccgcgaccaggatgagcagcaacgacaatatccatgccagcttggtaccagccgtgcagctgtagctgaccaccatcaaatccttctgttttagcagtggacgggaccttcagccattttacaaattaatgaagagtgttctacagtatgcctgtatctgctagatgactttatagctagcactgcaaagcagaaacaggtttagttatatgtatattgacttggccttgactttcatagttaatcagctcgggccctgcagccacccgcaagaagaatctgtaacacaatcttaaaacaaatgcaacttgctgtggaagtgtggaatttgcatgtcaatgatctcgctctataatttacggttgcaactagagtgtaatcctaaccgcagtgatgacgaaattgcaatcggcgaaatacatgatccaggtcacctttttctggttatcgatcgcgcgagtacttttgagtacagcaaatagtatagatcactgctagtctactaaatttttactaacaattatcttaaccgtttcatttagatacatataagttataaaaaatctaaatatggtcatagcatgacacatcagtgatagtaagaaaaagttagtacgtatagctttttctaatattatattagcacaatgctgaaatgcatgccgatgtttctctgaataagtatgatcctataaaaccaagccataaaatagtggcaaacaaaccatcgcggtcaaaccatatatgagatgagatgaagaacatctgcaaattgtgaaatattaatctgagtccgctatgatagaaccccagaacgagccaagttggatgatatatataagaagcatgggggaatcgaacgtatgcttccctgtcacgcactactagaaaaccatttttctagacgatgacattttttttcctaggcgggtatgcctcgtggagctaaatggccgtctgcgaaaatgacaaccgtgaggcgagattgttgtccgcacaggcggaccagatccgcctgcaaaaataaattttcgtagatggtaccttaagaggtatacctgcaaaaaggttaaatatgttaaaaacaccatctacccaccaaaatactaagtcagaacactttgccctcacacctttcccctccaacctctccctcggtagtccctcccctcccctctcacctctcctctcctagcacggggtctggtcggagggaggtggcggctacaggcagtggcggcgcggagggtggaggaggaggtggcggctccgccgggagggggagggtggtgacggtggcggttcccttccctcctcccagatctgacaggagagggtagaggagagaatggcggtggctaccggcggtggcgacacggagggtggaggagacggcggcttcctcctagatctggtggaggcgacggcagctccagacggtggcagcgtggctccaggcgatggcggttcccggtggcggatccactccctctctcctagatctggacggagaggggaggggcgatggcggtggtgggggcggaggtgggtacggtgaggaggctgggtgtggcgaggggggtgacgtttttttttattcacccaaaatattttcgcaggtgggtggatacgacgcctacgaagatagaggtgctgcctgtgaaaatcaactattttcacaggcttatgcgtacaggcgagccttcccccgtctgagaaaatgatttttagctgtctgggaaaacgatttttctagccgtggcaatcatgtgtctcaatgcggtttttttagacgtgcactgtttgcgttttgtgtttggtcgcatgtcgaattctgacaaaaacaaccgcgggccggcatggcaacgacatggtcgattatcctatggggatatgagcatcagcggcaggagaccacgggatgcaagtctcagattggttttaattcgaggaaatcttcagagatcatcgctgttagttcgttaccgcgggttcggtacggatttgttcgtcgattttgcatcatcactgcctctcgagacttgacttcgtttgtttgagctcatcgccgccggttgggccctatgtttaagcaaaaataattataaaacatcatatcaatattatttataggtatttttcagagcaacatattgactttcatcatgagctcttctacaaaagtgtgatgaagacattaagttaataaaagttgcatgtcgtaaactggagttaacggttatgcaacttttcgctaattttgtttggaggttcacaaatatgatttaataagttagtgctttattttttctattggtgttagtgccgatgtgtgcctctgtcagtttgaatgtgtcccttatatctttatgtcttattttgaggtgtgattgtatttggaactcttttctttttaataattggctatagttctatgagtaaagaccaagattctattccactatctaaaaaaaatcactattgattgctctgaggttaagatctggatttcttccttaaggctttgtttagccaatggagttggaaaataatatcccacctttcaaagggtaatattatatcctagccatcaattcttcatacctcatttaatccgccatgcatccatttttcatcccaatcccacctctccttaccaatggcggagccaacatcatcatcaagcccagacgacttaatagtatttttcagctctcgattaaattttatgagtgtcaataagtcaatggctatcaatagaggtgacggcaatggcagagcccaggcggccacttgacctgcccaggaggtggatccgccgctgctccttaccaatttgtcaaacacaccctaaagacttgaagttgcgaagaacggcttaattaaagtgtactcctatgttctttttccaaaaaaaatgaacttttattttagagtggtggtctctgctcctgccaacacaaaaaaaaaacaagatttgaagagagagagagagacactattaacatgttggggattgaacacggggtcttatggttgaaaccatacaccacttaccactacactatcaagtgtatctcaaataagaaatattataatactatgattctagtagttgttatattacgatgagacataggtagaaatagtagcaaagcacttttacggtctgtgtgttggtgctacgcgcgcatgtatttagcaaagcgccgctcaggaggcgaattggaagaagcgcgtttgctgggccaatcaaaattaattgaggctgccacgggagatcaacgttatatataagggcaatttcatttttgcccccactttcatctctaatattgattttgcccgttttcgtttttgcccccacttttttgaaccgaaaaatacttttgcccctgttttggatggagaagttaacggtgttaaataggacatttataccctctcccataactaatcattaatttcattaattgtgttttgcccccattatgcatggctttggaaaagtttttaaatatgtttaaaattaaatgacagattttgacattacaatttggacaaaatttgaatttgatggaattttgacaaaattttggcagcattttgacagaaattgaggaaaaaaatgacaaaattttaacaacattttacacaaccatatgaagtcaaaattacccaaattatgaaatggtgcatcagtaagaaaacaacaagatgcaaggtaaaatcaacattatgcagtacagtatatctttgctatgacttaggggtcggaaagagcagatgcaaagactcaccaggaaatgaaatatataggtcatcacaaatgcttaaaaaagatcatataagtaatatggatatgaagctcctggatggggtgttactggctcactgctttcgctgattgcaatacgtatccacccagaatggatggttaacacttaggtgcacaacaacacaagagattaccattacatgcattgttcaaactaaccaaaattgatggttctcataacatgacacccacttttttttccctatatatatatatatgttggattggaaaactgcatggtttcatggcagagcaaaatggatacagggatgttggcccggcccggtgctctcatctctgctgtctctaccgtgccaaatcacgcatgaaaagaatcattgtcaggctgtgtttagttgctgaaattggggagaagtttaagagaaagttggtagtttggaaaaaaaaagttaggagtttatgtgaataggaaagttttagatgtgatgtgatgtgatggaaatttaggagtttgagagaagtttggtgtgaaataaacatgaccatatactccagtttggaaagcaagtggagaacgacggcaatgtttgcttgcacgaccagttcgatccgatgcgtttcgtcccggtcgcaatcagagtcaagtgtgaatgccaatcatagctcgatcggattggattcgaggaagccttcgacggtcgcgtctgcgagcgatcacgtatgcacgcgcttggcccataacagtaggtaccacggacttcggtacggttttttgctatttttttcatgtgttcgcatcaccgctcttgagtcttgactttctctgccacgagagctcatcggttggtgcagcggtaaccagctctcggataggtcgggtagtcgtccgggcaccgtcatagacgtcttcaccgtagataaaatcgattttttagttttcagtttttctcttttttatcattttaaatcaaacaaccacgtaaatgtcacatcgatgtcacgtggaaataatatctagttaaaggagccacgtaggtgttatatgtcagctacttcgtttgcacttttttctaaagttggggaatgtgatccggacatccggtttgacgttcagcgacaaatttgagggaccgaaagagaacttattccccgtgtagcgcgcgtgtagtgggctcttgcatggtgggccgcgctccgtgatggtagctttgagcccgactcgtttatgggctcgtggaccaaatcgcatcgcgccgcttttgctcctccgtctctctctcggcttggaccgtaagaaaaagcaaaaaaaggaaaaaaatagggagtgaaaaaaaaaaaccccaaaagaaagaaatctccttctctctctcgatcccgtctcgtctcgtcagtctgcacccggttgcctccccgccgctctcctctccggtctactcctccgccgtcgccgtcggcaccgccgccggagctcctccctgctccctctactgggttggcggggagtggatcggggatctgcacgcaggggccgatttcttctcttcgtaaggtatgccctagctcttccctgggatcgatttcgctcctgatctagttcgttctggtctccgctgtgaatttcaggaaatctgttccaaatataggtgtttctaggggaattattccgtccaattagtgtacatgccctgcccatggtttaggcgtggagccccgtagatgaagaaccccctcttgactattttgtaggatgtttttttagttaagaatttagttcatttgatgcgcagtaagatcttctttcatgcattgctgagcgcagtatggggtgatcttctgttttgattgattgtgtggatgtggattatagacagctaatccttagggttttttcgtgttttcttcaggagtagataacacagaatagttgaagatgagcagcataggcacaggatacgatctgtccgttaccaccttctctccggatggtcgcgtcttccaggttgagtatgccacgaaggctgtcgacaacagcgggttcggtttaactgctcccctttctttccttccttttgctaccgcttcttcctttctgtgtgcaattatgtaatgacgttctaatatttgttaacaggactgttgttggaatcaaatgcaaagatggaatcgtcctggtaatgtctgcaaactgatagataaatttcaaagaggtgtattttttgtgctcgattgacatttgtttgttggttctttagggtgtggagaagctagtaacttcgaagatgatgctggagggatctaataggaggatccattcagtgcactggcactctggcttggtaacatcttgcttccctgtacatagatcctcaaatgtattacgatttcagtgtaaaaaaagtacaattgatgaagaataaagcaaggatgttgtttatatattttaatttctacctctatattctaggatataattctcattaatgttatggtaaaagaagttgttctctgtcggggcttcttttccccatctttgtcttccactcaccccataacacatcgtgtcctttaactataaaatattttttccaggctgttgctggtttagctgcagatggcaggcaaattgtttcaagagcaaaatcggaagcggccagttatgagaagtacgcacataaacttgtaggccatgtagacataattttatgattatcctctaatgctgtgatgtactagggtctatggtgaacccatttctgtaaaagaattggctgatcgtgtggctagctacgttcatctttgtacactctactggtggctcaggtaagacgttggcataattgttgcattattactggagacatggcttacatgatttaataaaataattattgttcggttagttgattctaactatatttacatgtatcaggccttttggttgtggagttattcttggaggttatgatagggatgggccacagctctacatgatcgaaccctcaggagtctcatacgtaagctaacactacagtacacaagaagtcaaactcgtcttaggctcttggtttttgtttttttcatctctatgtgaaccattattagcaattaaattgttcaatggatgcatataggagcattccacaccatatttttatcatagatatttttatagttccttctgggatctgagcatattattcactgagctgaatcctgaacagaaatactttggtgctgctctgggtaaaggaagacaggctgcaaaaacgtaagtttatcagcttcaaattgtattgggtgctctctttgtcagcactaatatcttctgttttaaaacaaagttggtgcaattatgaaaattaactatttcatattttccaagagaacacaggtattgttaattcatcgcaacccagcttgctgataattggaatatgagggagggtagttcctccattgtccataatccatataccatcttagcatttgtaatcatcagatccttacaatgtccatccatgttttgtttggttttaacatagaagtatgaaacgaccaaaccacattaacatactgatacaattacatgtttaacggttgttatgccttttgttgtattgacccatcacttaatttgtgtgaatcactggagtgttaatgtggatccaatgatccatgtacagatgggtgggattggtttaaaacccacttttcatgaaatttcaatatgtggttttggtcatctttacccttctcatagaggaaagagaatatgtgtttttggtcatcattacccttctcatagaggaaagaggtaccattaagccatatagcttatgcaaattaggacttgtttgatgagaactctcagcaatcattttagatcgacctctacagaacaagcctgtcaattctgtaattgtctatctgtgtgtggatctgatgtcttgttggtagctactgttgagcatccaacattagcttttgcttcgatttgcaccatcttggtcatcagaatagttctgattccaacttttcaaatgctgtctttcagtgaaatagagaagttgaagctttccgagcttacctgccgggaaggcattgtggaggttgcaaagatgtatgtattgaacaccctttctccaacaataataatataattgtgttcatgaattttgcactttgttttgactgaatgcatatcatctacagtttttttcattcatatttttctatatattatttgatttcacatatgtttgatgccattcttcgttctagtggttatacctgcaacatcatgcataagatttatttgctactcccagtaaatggcgttctagaacatgtgcagttaaaccttgaaatctttactcactaattaatgcaaaaagggtcagatttcatatgtggaaagtgacattaatagatttatcatcaaaaataaattcatgtagttgtatttttaataatatttaaaggtatgactagaaaggaacaatgatcaaacatgtgaatcggaaattgtgttgatgtcctagacatcatctaaaatataacagaggtagtaataatcatttagttatttctgctttaaaataaaagtactccctctgtcccaaaataagtgcgccttctagcattggaaagccaaattatgaggggagggaaatgacctagatacctcttagagtatgtacaatagcaagctgtaagccagctgcaaacatattttaaagagataaataaggagagagaaaagcagcgggctacagatttgtagccagctgtaacacggactacaagacgcagtgtgtgtatgacaggtgggaccaggtattaatagtgtagtatgtaactattgtatagatgagctattagattggctatagatgaattggagctagtggttggctatactattaaacttgctcttattaaacgagggatagttaggagtgggaagacgtggaggaatttgaatgggtggtgattgataggataagtagtactctaaaagagcacttttttgggacaaattttaatccttaaggagcacttattttggcatagtgggagtagttggctacataatcatattggaacattttattgtaggtagattcttcttttaaaggtaggttctagctcgcatgaactgtcgatgtcaactgatggtaatgaacaaagcagactaacaaaatagtttgggatgttttttctctaataatatttagaaatcctttttgaataaagctacttgtctgacaaaaaaaaaacagttctcactttcttataatttgttctgtgcagcatttatggagtacatgatgaagctaaggacaaagcttttgagttggaattaagctggatatgtgatgaatcaaatcgccagcatcagaaggtgttctgttgttatttaaaaataaataaactctgtccatatttttgtgaactttgctcacttggcatactgcatacaggttcctgctgatcttttggagcaggccaaggttgcagctcaggcagcgcttgaggagatggatgctgattaagaggagacccgactatgttctacgtttggccactgatgaaatctttgatgtcattactggcacacagggacatggccattctgtcggattttaaaacttcgcatgtacttatggtactaaattcatggaaagtttgatgctggacagtgaatggatatctgacttttgactgaacttgtcccttaaatcttgatgaattgctcgtttcgcgtttgccttttttggtgttcacccaagattgaacgactcaatgatgtttttcctgcagtatcttgacatttgaatcgcattttagcgaccttgcctccaaaactattaactgcaaccttacctgatgatatatttgtccgtcacattgcaaaattctcagcttgcaaagtaacttgtgaaaaatgaatacggttgcctgcataactatgtaacacatgttggctggacggcgacttagcaccgcaagagaagaatcgaatcgggaaataatttgtggcacgccatcagaagattgctgaatgaaaataggtatctgaaaaatcaaatgttccgatatacctgatcgcttttttttgaacggggattatcgctaatgaaacttgtgtgaagaatgaaagagagtaattttattaccaaaatgatagactaaaatttggtaatgtcaaattagtttgatgtcttcctaagttttgatagtatttttatgaaaggaaatttttagaactaccaaattctggaaaattgtatttagcaaggttatatttagttcgttaccaacctaaaatctctgaaactatcaaaaggtaagattttatgttataagatcatgtttagtttattgctgatccataatttggtaacactaaattttaatactagtgcttttctcaaatccagtttaatagtgttaattaaaatgataataaagtaaacacttccaaaaacaaaactgagtagacggccaacccaacggcggccggtctcgccaagtcgccaacgcgatccagccagccaagtccaaccaaacgcgcacccaccaacgccacccgaagcttcggcccctgtctaaactccgacccgttccaccgcctcgccgtccacttccaaacccaaccacccccaccaccgccgtgatcccctccaatcccttcgccggcgaccaccggccgccggcgactccgcctccgccgccatgccgccctcctacaccccgaccgcccgcctccgcctcctcgtcctcttcctcgcgtccctctcgctcctcttcgcccaaaccctagcctcgtcctccgcggaggccgaggtctccgacccctgcgccgcccccgtgtcggacgggggcagcgaggcccagctttgccccgtgcggtgcttccggccggacccggtctgcggcgccgacggggtcacgtactggtgcgggtgccccgaggccgcctgcgccggcgcgcgcgtggcgcggcgcgggtactgcgaggtcggggccggctccgcgcccgtctccgggcaggcgctgctgctcgtccacatcgtctggctcttcgtgctcggcgccgccgtcctccttggcttcctctgatgtgcgcgcgccacccgctacacctcctccctcccccctctgtagttgatttctccacatttatccgtttcgcgattatttttctaggttggtattagtgcgctgttatatgatctgagggatgttgctgcaacaatttgttgtaaacttgtaagtttggaggatttcgtcgagagatgtcacacgatttcgtcgagagatgtcacacaattctttcatagatctgtttgattggcctgggctctcatttcagagctgagctgtgcagatgggtcgtgatctgtagttgagatcatgttttgacagtttgtaaatgtatgctaacaattgcagcgatcagtttcatggttttgtacaaaatcgagcttcatggtttaccatttttaatgtgctctgttcgttttgttctatgtgtggtagttgtgtacatgcatgtgaattgtgatgtctggattgcttaaagcacttgagcaaatgaatgtttaattgaaataactttaaagtctcatctcttatctgccatagtgttgtgatggagccaactgttccatttttttctgaaagattaaagatggcagtagaagcaattacaactatcatttgattagtcattatatttggttcatatttctcatgtgaacatcagggggtaaactccatacttaaggacttggggttcatgcgacatggagggaagtgaactgatatagtatatctgatccccattagctgattatattgttcttgttttatgctttggcatcatggcatgattttagcagttatccgtagaatcctatgaaatactcaatgatttgtggtgttagatacagcacgattctcagttctctgtattatcatgtggatagaatgaatgtataactgcatactgtgggtctggctatgcggtaagaagtccaatttttgaaacattcattcctctatttgatacatagtttatggtttcctatcttgaataaaaggtcccagttcctttctgttccatgtgcatgagaagacgtgtgataatgagagaagaagaaagatgtgtggagtatttgcatacatgaactacaatttgcccagattgaagcagtatatatatcctagagctgcagaggacagtaagacagtactgcccatatggccctgcaacttatgatggacaactacctcttgtgttctgccatgaagggaagattgtctgtttactctggtgagtcatgtgcatctgattagctgctggcttgatgcaccttctgttatgccatttttgcttcttttttttgtgactcaaaatttagcgcctcacttcattcttatccaataaacattactcctatgcatgggtttgggaagattattgaagttgttgagcctgaaagagtaactaaatgacaaaaatattagatgtcttaaggtccacatgttatattatatagtgtttcaaatcatattatgcttttacccacgttacatatattgaggattgttctttattttttggctccgataataaatagagcttattctggtacttgaagttcttctttctacagccgttttgattctatggatttgaacctgagtactgtggaagtaagcaataattctctctatcagcaacagcttcttataaaatctaagtatcttatcattgttaataccttctagactgcgatcttcataggagagcaaggttggaagatcaagtgttattctcactagtctcaaggatcacctgagagatattcagcactgtagaaaaaattttgtttccgttggttttcatgcagctctggtgcattttaacttttccttgagtcagaacatctcctgcctaaatattttcctgtctcgccctagatatgattgtcatggtggaagttgcaagcgacattttagtgtttcacagttaaaattgtacattacgttatcgtttatagtaaatccaggcatacaaaagtcaaattacagcgataattatgatgacattaggattgaagatgtatgaaacttaaaattattgacactgaagatacatgcttaaaggaagccctttctgtatgtccatcctatctaccctgtttctctcggcaaagccagtgaggccttgaaacttgttgctcatccaaggcatcttgcaacatcagttacatcatcagtataaaatatggagatgtagagacggagatgtaatagttgcagcggttcatggtgacgtgttgtaatgatggtgccatgtgacggcagacaacgatgttatattagctatcagaatcgtgttttgttcagtctcactttgctcgagccgtttagccctttatattaaaagatcaataaaaagataatatcgttttctcatttggataacctcaaaagattttgagggcgaaggatgtagaaagacaatttatcgtcttcacatgtatgcatgtcttattacgaaacatcgaaaaaaaatagttatcctatattttacaatggaagtagcatcaagaagtaaaatggatcttgatcgcaagacgttcattgagaagagagaaaaatagacttgatgatccaatggtgcttaatgaaaaggttggcactctatggattagagataataaattgatcttccaggtacattaatgccaaccctttgtcatttagagctcttaacgcatctccaacagtatgactatcacactctctaagctaaaatttggtaactgtgaactataaatgatagcagacccgctaaccggatttctagctagccaaacttagacatctggactagctggctaaacctggttgccaatcgtgggccccacaccgctcctccttccactttccgtcctcgcaaagatcgagcaccttctcatcgtcgtcgccatcacccgtcgccgcctggatccatcggcctccatatgcatctacatgttgtttcaatgattggttgttcacccaacccaagtacccagcacttactatgtgaactagatttcgaaaatattgtgaaaacacatactatatagcaagcttttgatttttttaaaatacataggtgatccagatcataaaatgctttattacttctttagaaatgtgatgcataatctggatatagaatgtcgtgaaaacgttttattaacccagtaggctaataattctttagaaatattgcacgcgaactggatttagaatatagtggaaacattttattgcttacctagttacctgacatgctattgattcttcataaatacgataaaccatgtggatctagaatgttgtaaaattaatttattacttacctataatgctttacgccaattagatttagaatttcgtggatctctagaaatactttacgcaaaatagatttagaatatcgtgaagacattctattacttatttgacaggctattgaaaaacataatatgtggtttggattagaatatcgtgaaaacgttctattgctttccaatagatgctactactaattctttaggaatgaaattaattccaacaaaaaaatatgcaaaatttcttcaaagcattcctttccactcctgcggatggaaacgaggagggattttaattttgaataaaaaaaccgagaaaaaaaataaagaatgaccagaatgccctcttgatgttctctcctctcctccattgaccattgccttcttttctctctctcgctcgcttcctcggttgctcactctgtgtgtgttccctccttgtgctgagccgcggccgcggccggccttccgcctcctcctcgcctcctcgcgcgcgccgctggcgagcggcctcggagtgcgcggcgtgtgcaagtgctcctactctccttcgcgatcccactctcctcctccgcacctcagctttgctctcgcgcagggccagcgagctggttcggagagggcggtgtggctggcctccccttccactgacctccgtctcgtctcttctcgaatcgaatcgaacgaactgaaggtattcattcttctctctacctcctcttccgcgatgattcgtggggcggcgtaggtagggtatccatcctgacctgggattgatttctttccctccacttaacacacacagagtttttattttattttattttggggtgggaggggttctttgatgcatgttgcagtactgatctctattcgtttccgaaagaaataaaaatgaaaactttggggtttgagctgaacccccatgccccgtgttagtgttggcccctgcatctgtcaagtgtcaaagttgtctctcttttttttttttttgaagtgaattgtgcgaatagaggttagagaagtcgcatgcagatgctaaaggttgttcctttttttgttcattttggcaaacagtgatgtgccgggattaacctgtgatttgttaatgcagatagtcagctgatactagtgaagatgaaccgggaatcaaatttcatgcctactcctgatcaggatgttctggaagtcaagcccctgaggactttggctccaatgttccctgcaccattggggatcgatgtgcttaaccggttgacagccccaccgttggtatttgtcgcaccagctgggcagtttcctgggggttttggatctttgaacattcctgcggtcagatcgtttgccgctttcggtggtcaggatgctagtggaggcaagactgctggtggtggtgatcaggatgctagtggaggcaagactgccgctggcggtgatcaggatgctggtagaggcgagactgctgcttttggtggtcaggaaactgtcagaggtgaatttgttgcaaatgggactccaaatgtaggtgctagtgcaactgggccaattgacgccactcctatctcagcttgcaaatcaacacaaccaagtgtgatatcactggatgatgatgacaatgatgatgatgagccttacggtggtaaccaaacatcagcatctggacggaagatcaagaggccatcccatctcaaaggatataatgtaagtgatggtttgggcaccgacagctccaacggaacaaagaaacgccctaagacctctaataggaaggctgctactgacaatgagatttccttgatgcctccatccagcgatcccagggaggttgtggaagtgcttctcatgaccttcgaggcactgcggcgtaggcatcttcaattggatgagacacaagagactagcaaacgtgcagacctgaaggctggtgccatcatgttggccagtaatctgagggctaacattgggaagaggattggagctgtccctggagttgaagtaggggatattttctacttcaggatggagctatgcattatcggcttgcatgcacctagcatgggtggaattgattatatgaataagtttggtgatgaggatgactctgtagcaatatgtattgttgctgcaggtgtttatgagaatgatgatgatgatacagatacactggtctacagtggttctggaggtataagcaggaacagtgaggagaagcaggaccagaagcttgagaggggtaaccttgctcttgagaggagcctgtccagaaagaacgtgatccgggttgtacgtggttacaaggatccagcttgcttgactgggaaagtttatatctatgatggtctttataagattcatgagtcctggaaagaaagaacaaagactgggatcaattgtttcaagtacaagttgcagcgagagccaggacagcctgatgcagttgcaatctggaagatgtgccagagatgggtagaaaatccagctgctagaggcaaagttttgcaccctgatctatcatcaggtgctgaaaatctcccagtgtgtcttatcaatgatgttaacagtgagaaaggaccagggcacttcaactatattactcaggtcaagtacttgaagccactccgctctatgaagccatttcagggttgcagatgcactagtgtttgtctgcctggtgataccagttgtgattgtgcacagcataatggaggtgacttaccgtacagttcatccggattgcttgtatgtcgcaagcttatggtatatgaatgtggtgaatcttgccgatgttcaatcaactgtcgtaatagggtagcccaaaagggagtaaggatccaccttgaggtcttcaggacaacaaatcgaggctggggtcttcgttcatgggatcctatacgggctgggtcatttatttgtgagtatgttggtgaggttgttgatgatactaaagttaatttggatggtgaagatgattatctttttcgaactgtctgtcctggcgagaagacattaaaatggaattatgggcctgaattgataggggaacacagcataaatatttcagctgatacttttgagccgctgcccatcaagataagtgcaatgaaaatgggaaatgttgcacgtttcatgaaccatagttgcaaccctaacaccttctggcaaccagttcaatttgaccatggagaggatggttatccacacatcatgttcttcgcactgaagcatattcctcccatgacagaactgacttatgactatggcgacatcggatgtgaatctaggggtgtaggttctagagctaagaactgcctttgtggatcctcaaattgccggggcttttttagctgactgttgaagatgtgcattatcttatcaacatgcaaatatatttacctggtaaaaaaattcaccttattgatgttttcaactttgaccaccgtgcatactaataatttctctgctgttagaaattcctgcttgtcctgctcatgcattcttgttctcacctgatttccattctgcatgcaattatttctatgtccattcttgctgccatgcatgcttatgctgcgctgcctttcatatggacttctgacttggtcctaaaattaaaaataataagctgttaggctactacccctgtaggctgtagtaggtcaaccatcataattaactcaaaactaatctcttttattttggacgttttgtatcactcctcatgtcattgtgagtggcaacaatctgcagtgaatttcttttatgcagtaaggcaactatttgctgtaggcagctatatcctccatacagaattttgcccctgtaattaaaagctaggatttgacatttgagaacacccccccccccacccaaaaaaaaaaaccaaacccccttctccctataggtcttctatcatagcttgtttgcagttgaataattcgtacttccacataactgtgttctaggaatgcattgcaacttgcaaggatatggttactcatgtgaccctgtcattggagattctttattttcaagaccattattgagacatattacagcacagccacagtagttgttgatcgtttatttcaaatgactaatttgttttacttcattggttatctcacttatctgtcaacgtaattactgtcctgccaagttgatgtgagattcaaacttagaactttgctgttgcttctgattgtttaattactttgaatacaagaatatcatatctgaggttcactgtctctttcaaaacactgcattgcatttggcagcgtttacatgacaccagaaaggggcttgtgaatattgttaagtataccaacttgtcatttagcatctcagattgttaagaagggtgtacttagtacttactatgatttttaaactagctccttgttttcctctatttgtggaaaacttatcttgggataagctctcactggttgtcttgcttttgcagatccttttgcttttttggtggtactaggaagtggactatgttcaagactttagaagtatggagaagctggttacttcaaatggctaacctcgtttgccgctgtggaagtagtaatagtaaattagtgcaacatttgcaatgcccattctcgtggtgtctcttgcgatgtgtgattgtaggccttgcaagatcaattttgtaaaattatgtggggggggtgggggggggatgtgatgctgctgatctgactacagtcgatgatgtttgggtaggcaaagttgggactgaacccctcgcggtcagctgtgaattcagaagctgagatatttggatgaatgctgatatggtggcatatggttcttcgaaagtctctggatttgtcttgatttttctctataattggttcaaagctaggtacacaatgcggttgcaaactttcgagtagttgcagatcttttcgttgaattaactataaaaatacgatgcgccggtaatgctcgcttttacctacgacgtgactttggatttctcaaccatcacaagatcaggcaaaaagctactacctactttagcgatgaagagtaaagttcaagcaagtagaactgctagtcattccacaatatcactgaagcatgtgccaaataataaaaccttgattacatcagaggacatcttgttccttaacattgggtgtcatgcaatctgagtataaagtttctatcatcacaggatttggcacactgcatatctgcaagtcttcaaccgaagtattgttacaccccaattacacatgttacgggcaaaatggatcaaaactatgatgtgttttttcaagaacaatttacacaagcgccttagtgatcagaagcccgggcaagtaataactaaagaatcgctaagctatggaagtaggaaagacaaaacagaaggtagattcaaaacatcttcgtgctgttccccactctgcagtcgcatgtacatacgctccttgactctctgaccacgcgttgagaccgtcgaatatgcaacttgatgtttaccagcttaccagcaatctgcatttcaggttccataagtgggcatatgaattcattgaggggatttacataaataaaaatgcaactgcaaatgaaacaccttagctctttaaagcatgatgtgcatagagtgatgggaatgcttgtggtgttaacaaaagttgttgcaagaaaatctctcttttcatggcacagctacttaagtatctagggatgctacaaaggtttgaatagaattaccattctccatgtaagatcttcaggtccaagaggtcgagcaggacttgaatatagaaaatgtctagagtactgtaaatgaatcacaagtaaaattgctgtccacaaaattgaagcttccgaaaaacttcatgcaatatatgttaaaataccaagctaaccttcagaagatttgattgcatttgtctgatccttttggcatcaatgcttctcaggtacttcaccagccaaccaggttgaacagcgtcatttgacgaaacgaacaaagctatctgcagaacaaatcaatcattgcacactgcagttcattatagaaaatatgtgctttaaattgcagcaacacaaatgcaaatgcgaaatacatgaaaaaaccatcatgctaccataaaagactcgagtaaacatgttggttattcaagacatgaagtatccacagattgtgaagtatatgcagaatagcaaccaactgctctttagtttatagtggatcaatcaccgagggcctttatttaatttataatggaaaatcactgaggtagtttctctccttgttttttatcacaagcataagcacatggtgcaagtacacaaagtaaaaaaactcctgaagtatactgaactaataggcatgtcaaatttcacagaccccccccccaaaaaaaaaaaaaaaaggaaatcacagaaacttcagagacttaactggtgcagaaaagtagggttgctacaaatagcctttgtagaattgaatccagacctgtcaaactagctgacaacatggccattgagctaccctaagtctctgactattgacatatacatggccatttgttgattgtttggggcatgcaaatagaaagtagcacagcatcccgttcttcaagcaagacatcaatttttggagctccacgcagatatactccctccgtttcaggttataagacgttttg

SEQ ID NO: 62987 - DNA, 10144 bp, Oryza sativa
acttgagcagtttaactttgaccaaagtcaaaacgtcttataacctgaaacagagggagtacgtagtaaaacctttactaagatatgtggtatgagaaaacagtgcattaatactgcgataaatcaagtttaccttcctgtagtcaagtattccttcaaaaggaagctctagttcatcactgactataactggtatgcaaccactaacaattgcatcaaacagacgagcagaagatggagtatccccagccggattcaagcaaaagagagacctgccagtcaaatatattcagtaacagctacaatacaaataaaatagaattgtatatttacttgcgcatgccgttctgagctgctgctttgccgtcagctccagcagtcccttcttctatgattatgccttctgcatcttttagttctgtcacaagtttactgcggatcttgcctccctaaacaaaaaacagaataaagaattaagattcacataagccaacttgaatttgaagtattgcgtgcatgtatttcatgctgtcgaaaactggaaaatgacaagaagaagcatacagcattccttctcagtcttcctcgaaagaatagcaatgtgcttcttctagattgagtttctgatacacacttagaatcacaaagatcaacatttggaacatatggaaggatgacatccttttccaaataaacttgccctggtttatacctgagaaaaggggcgaaactgagtttggtaacacaactattgcacgcagaagctatttaaggcaaagcagcagacaattaataccataccagttcccagtagaatccatgtcaggcagaagccatatagccttcttcacaaatctccgaactgacttaaacgaccatgggtgatgaacgggaattacatgatctctgccttctgaacgttgccaagcaggttgatcagtaacccatttcaaagcttcctaacaccaacaaaacaacaatatcaatactgtcctcttgcaaataaacttgggtgaagaaatttcatgacaatatccttctgtaaataaacctagccacctaggtgaacaaatttcaggacaaagtccacttgataataaacttaggtgaatatattgtgcaacatgtggagaaatagatgaaaatgatccctacagtcaagtgaaccaagaaaagccatcacaaaaaatggtaagaaaactgagctcaggtaaagccttgccctattccagttatgactagagaaaagttcaactctctttactactgagtattgaatgccagactgccagcaggaactatcaaaattttagttgtaaataaacactagctagtccatgtgcataccctacaacaaacactagctgaaaaataaaccttgagagatgctcccacaccctataaagtgccttgcattcttgtttctccagcaagaagtaactgattgttgtgaagaatggtacgtagaagatgtctgcttcttcttgccgccgaaccctgataacattcttcaaaagtctttgtgattcgggcgcaatgagatcagcccacagccaatagtcaatagaatgctgcatatgtgagcagataacaaatcagagattggaaaaaaagaaaaacatactgccgacaagtgaaacctggttaattatatccttccaaattgagatagttattccaggatcttaaagagaacatcagaagctcgattgacacatgatgtacatcactaagtacggaatctgtaatgttaaaacaaaattgagcattgttcaaacttcaaccgctgtcttgaaacacaaatgactaccaatttgtacagactaaatagcaaatgtaacaggaatcacaaagatgtctagcatcaaaaactacatgtggtcactggtcaggaatatccagagctcacttctcacaaaacttgccacaaaaatcaaaatctaaaactactctatgaattggatccaacccagaagcacatgcacctcacaagatagcatcggatcccaaatacatcacacggtcgtatctaatcaatcgccaatttttttagaaaagaaaaactatggtaacaagtccttaatgggatcagaatatatcaacccactaagatctaatgtatacacaagcttgtagcagtaacatctccaaaccttccaaagcatcagagaatacttgcaatgtcgcatcatacagtagcacaatgcttctcaccccaaaacagcaagcaatccacatcaattttctcaatcttgtcaccatttgcgaacaaaaaaaattcaaacccaagcacgctccactctccacgactatgcagaaagcagttcgatctgacctgctcgacgagccggtgcacggggctcccattggaggtcaggttggaggtctcgcggtacgagtccctgaacagccgcagcagatcgtacgtgaacctgctcggcatctcgtacacgtagaccctgagaggcgccggggccgccggccaggcgccgcccccgtagagcctttcctcctcctcggcccggatcgcggcgtcgaggtcgccgggggccgcggcgggggccgcggagcggcggggcgaggcgaggaagcggtcgagggaggcgaggaaggcggtgtcggcggcggagccggggccggagctagggctagcgaggccaccgggcgaggagggagagaggaggagggagtaggaggcggcgaggaggaggaggaggaggagggcggcggcggcgaggaggccgcgcggggaggcggcgcgcgcgcgcgcgagggaggaggggagctgcttccccgccatggcggaggcacactggaacactggaagcccaagacgctggtgtgtttagcgttttgtggtagttaaaggtccccatcgtttggcttatttcctaataagtcaaaacggcttattaggaaataaaaatgaatttgtgagtacaacttttataatgtgttctttgtgacttaaaagccaatgttgaaaaagaaactatgttgaaaatatgtcaaaatcaatcttaaaattaagcttgaaaatttaaaatttggctttttctttggcttattaggccatccgatggggctgtaagtagagaggctctgaatttttcatttttttcgagacacagatgcaagcgctcgtaaaaatgcgcatataccctctaatcctctattaatacacattacccattacccacccattacccatataaatagcttcgaagatttagccgatatatcttgatatttaaaaaataatcttagaaatctaattaattgagttacgtttacttcaagactcaaagatcagaaccaaattgcattgcacatttgcagttcagaactccatatttcagaattcattcagacaataagccaaaccatattgcagttcagaacttcatatttcagaaattcattcagtccgtcatgtgtgcaggaaaaaaaattccatttgcgcgttcgaaaaaaaaaagaaaagaaaattaaaggactccagcagaatgattattttttctatccaccaaataaaactgtcataatctgatttattgagttaactaaaaagtttattcgttctatccttaaatccactagagattgtagtcccagttaataaacatctcatatcgtatagccaaaatagcctaccgtacaatctatcacaaaagcctgtcacgaaacttacagtataaaagactgtactcaaatttacagaaagataaaaaaaacgccaaaaattaaactgttgcacagaacagaagccattgccatcttcagtggtagaagatgttcttctggaaattaacggtggtagaagatgttcctctggaaattaagagcaccagcaccatctacacaaccatatgaatcgactcccgtactgtcatccataacaataccatctgcagtaactcccgtgctgaaataattccatgaagaaggaggaatcatatgcaatggcataggatccaccaccgccgccgccgtcgccgccgcggccgcggcgtctcctccggctccgggaagagaagagccagggatttcttggtgcgacgaggaggccgagccggattctgacggctgcctgatcacaatgccttggttttgtggctgttcctcctgctgtagcttcttcggcttcttcggcttcttgctgcgttgtggtttgaacttcttggtggtaactttgttgtccttgttggtaactttgcacaacacccagtcgttgagctatttataaacaggagaaaaagaaaaaaaaaacacacagtagaattactatactcctactaatcgtcacaacaactattttatcaaactttttaaacctctggctgctcatcagtttcataaaatacaaatgtgggtacatttgttttaaaagtgattctataagcttattctaaatagaaaatatatatatagtcatgcgattgatatgatagtagctaacccgcatgggctcctcctccgcgtcgaacggccggttggagttggaacacacgaactcccacatcttccacggcgtcttgatcgcgttctctttcttcaactttggcgtcggcatgctctcatcgtattcgtgataggtgaggcatgccttgtatccaatcaacatgttatcgctgagggcgtcaaggacggcctcgttcttggtagtcgacttccaaaaacccaattgaccggtgcttcggctaggccttttgcctttgttgtatttccggtttctaggtgaaaacatgtaccagtttccttcgcggctgggacccagcttactcgctagaacaaaaaaaaaagtgtgatgtgttaataaagtgtgatatatgttaaccaagaacatggaaagatgcataaattaagcggcaaacttaaaaaaaatagtgtgataggttaacactaaaaaataatgtgatatgttaataaacagaaatagtgtgatgtgttaacacagtgtgaaatatgctaaccaagaatagagaaaggtgcataaaattaagcagcaaactcgaaaaatagtgtgatatatagcaggttaattaacacaaaaataataatgtgatatgttaatatagtgtgatatatattaacaaagaacagataaagatgcacagtttaagaaaaaaacaaaactaaaatatcatagttatgttaatactaaaaatagtgatatgttaatatagtgtgatatacatatatatgttaacaaagaaaaaaatgtacaaattgaacacagcaaacctactaagttctttaggatggtcggagtagacgtcgcagacatgcatgtagctgtagctgggcagctgctcgccgcgtagtttcggccggaggaagtcaaggataagttctatatccgacggcacgaaccggattccgggcacgcccaaatatctacgcgtctcctcctgatcctgcagaggttgctgatcctgaagctgctcctgattctgatttttgaggggaagaaactgctcctgctcatgccactcctgatcctgatcctgctgcagccatggaacgggaacaagctgctgctcgcgatgatcctccgacgatggcatcagcaggggaagcggctgctcgagattctcgagattctcctcctccggccatgcagaaccggccggcattgtgctgctaatctgcagctgctgactctgctgcggccacgcagattcggaggattcagccattgccgtcgacggagattcaattcggacagcgaatttaccgcgatttaagcgatctgatgagtcggaggcctacaatttaagcgatctcacgcacgagatcgtatgatagtgcggcggggccgggggcattcaaaataaccttttaaacacgaacgaatagtgtccgtatttatcacgactgctgtaattacattattattattacgtaatactacaaggcatatgtgggactcgaataacccaagcacgcacgagtggagctttatttgtgagtttgatgggagtacgtatgatctgtcagccaatcagctcatgaccaggccccatatgtgtgttgggctgggccggatgtcaatgtgaattttacttgaaaataatattagttcacatgacatcccttaactttacatcaagtttgtctaaggtctctaaaccacaatacataaatctctacccctcaactattaaaagccgtgcaaagtaggtcctatggtagtatggaccaaaaattcctctgattttgctgacgtgcatatggtaggccccacttgtcagcaaattttcaacggagtgagctctctcattgttgtctggccagctctcggacaacagcgatgacatcggcggcactaacgcggaggttgataacggctccatcaccagtggcaagttcgtcacctcgaggcgccccccccccccgggcgacggctcggctttgtggcaaagcggcgtcggcccatcctcaaggcggagcgacgacgcgtctcaatagatccacatattctgtggtgtaaaatcttggtagtatttaattagcggttgtaatggatcaaggactatgggttttttcacaatcctatctactcctttaaatatattcctaagctaaaagtgtatagaaattaagctctcaaatttttttaggctaaaaagttaagtctattaccacccttatatttgagagatcatggacatatataagagtaaaaaagaagaaaaaaaccccaacctgtgagacatatatgcatgaatagatctcaccctttcgaaggccctatatggagcacactattttttccccttttctattgactaatcaccttgaaacgtaactaaagtgttagtatttcagtttgttcaatccagctcgcgcatgattatttctccctacttttgcactgctgcactcgtcacgtactcacgtagagtgttgtgtactgaatacgcgattggaggtgagctatatgagaggaaaacctgcatacatacatacgcatcggtgaccccgacctatgaaacgaacgaacgatcagccgccgccgcccaatgacgacgacgatcgatctcgcctcttgctgatgagacgaggtcgccatcggaggaaattattggtgcaatggggcatgcacggtatgtgcatgcaacaatcgaagagaagaagagttcccaattcgatcacgtacagcgaaagcagcacgcatatgcacgtaggcggcagcacgaacgcacgcaataagggtgtgtgtgtgtggatgggatatatatgcaggcatgcttgcgttgtgcaccgaaaattttgtagctagctcatcactttgggaggtcaccttcttttgttggctagtaacatcagcaaccaatgcattgttatttagggaaagcattttcatttctcgagagaatatataattataaaaaagtaacaatgtaaattaatacaaatgtatcgttacgcaaatatacaagttcaaatttcacaacaccaaacccttataactagagcccaggtgcaagatgttataggctttaatagatgagaccgttgattttttatatatatgttcaattatttatcatattaaaaacatatactctattgttatattaaggtgatgtgtatatatatatatatataagttaatattcgcgggaaataatcacgattttgcagatgtgccatccacatctaataattttgcagagaggtgcatagatacatatcaggccggatcgatcatctatatgtagagtttaccttgcttgtccatgtaagtactcatgtagggaaatcaagtagtagtaccataaaaaaagatcaggtccgcaaattgaatgaatcgaagaaactaagtggctacctagaatggctattttggttaggggttggattatcagctaccttacataacaaagagactgaggcttctctctctctcaaaaaaaaagagagagacagaggctccgtacatgtgatgcacgcgtagtacgtcgtcgtacgatgagggaaaaatacacacttagactttggtgcatacactgatctgtatatcaaagacaaatcaacatgatgatgcctctctttcaattcgctatgcaatgtactatatatatattcatgaactcatgcatgcaagatgcgtgtttcaacgcatcaaagcacacgcatcggccacaaaatgtcgcgtttgatattgagctatatatgacgagaggtgtgttttccttttaagatttgtcggttaacactggtgctggtacaattccttttggaactattgcgacgaaataaagtggacttcattaattaaaaggggtgggtaggactgtatacaatagagtaaccaacacaattgtgttggtatagtctttaggagtagtatttctgcacagttaacagctactagttagatgtccttttggtaaattatagtctgacttcacttgtaatgatgatgttcttttctcaagattttggtgccaaactaatgattatagtttgagtcctactcaatttgataattgtaatttgacgacactgaaagttgcttaattatatgtattgacgatttttatgcttaaaggtcatgtttgagttcacttaatataaagattaagtatggacatataaaatgagaaaaccattcacatatgattaattaagttttaattattttaaacaacttacctacatataatgtttttttaccagacgtatcatttagtgtgctaagttttttttaagataatggaatataaaatctcagtctttgctcaaaagagttatagtcaattattacatagtagcactcagagcgtaattccaaacaaataaaacataccacaaaggataacaaagaatccaaactaacgtaaggagatcacaatcattgaagtctatttgtaaatctctaaccataattgacaaaaagttgcataaccgtagtctataacttgcgacatgcaactttcagaaactcttcatcttcatcacacttttataattgtgccaaaaaccggagccaataaattgccctgaaaattacctgtatatagaaaaatgatggtgatttagtgtgctaatgaaaaccaaaataaaatttatatcttacttggaataagaaggaccaaataattgctatttcttctcaaacatggtcgtaagcttctctcatctaacatgttcacaaaactcgatcgatgtgatgcattcatacaagagtttgagaaaagtttcatcgatgtgagccgcgtttgaatgatgcgcatgcggccatcgggccattgttcacaacagatcgcttgtcctgcccgctaacccacgtcagatcgaacgaataaacgcgtacgcctatctacgtaggttgatcgatctcgccggcgctgcgcctagctcaccagtcatcaacgcgcacaagctaagctagccaatgcaacgaccgacacggccgcccgcccacgcatgcatgccaccactagctagctagctgcttgacatcagtctttcataattagtacttcctccgtttcaaattacaacttttttttactttgattaatattaaactactttaaaatttaactaagtttatagataaatagtaatatttgtaacaccaaattagtttcactagatcaataattgaatatattttcataatattgtcttatagtagtttgaacgactataattttttataatacactggtggaaaaatcatctttcgtcggtccggcaaaatccacaatagtcccggatccaaaaagaaccgggactaaagattgtttttagtcccggttataaaaattttgatctaccaaccaggactaaagatgatctttagtcccggtttatcccttgtcagatgtatgtcaggggccgagaatctttagtcccggttggtgtcaataactgggactaaagatcaccactttagtcacggttggtactaccaaccggaactaaagattaagataatcttaccaaccgggactaaaattaaacacgtagtatataatccctatcccttatcctctcctccacacttatcccctctcctcagatctaactctcttcctcatcccctctccaactcctccccttcctcctctccttcccttctccccttcctcctcccccctcctccccttcccatccggccggccgg

SEQ ID NO: 62988 - DNA, 21986 bp, Oryza sativa
ggcgggcggaggggccgcggccggcgggtccgcggcaggcggggccgcgctcggcggtcgtggcgagcggcggcagcagcggcattggttttttttaaaaaaatttgtgatgattcactgagatgtatttgactgagaagttataaatttgtgattcattgtttggatctgtgatgtatttgagtaatttcttaggatattgtgatgtatttgatttgtgtgtataagtaattttatgatttgtgatgtgggtttggtgatgtgaatttgggatgttattttgatttggggatttgcctacttgattcgggagaaaataaaaagggaaaaagaaaaagaaaatggggaacatctggtactgccgctattgtctctttagtcccggttggtaacatcaaccgggactaaagatcctctctctttagtcccggttggtggtaccaaccgggactaaagatgtatctttagtcccggttatttcaaccgggactaaagatctttagtcccggatccttactcccggttgaaaaaccgggactaaagggggttcccaaccgggagtaaagatggtttctccaccagtgatataagtcgtttgattttaatcaaagtcaaaacgacttataatctgaaacggatagagtagtaaaaaaagacatagtacatgagaattgcgcacaaatttaacagaatcaattaaactggtgtactagatcatttggaattaataacatggaaggaaaatgggcatgttaacctgttttgtggctggactgcagccgacaccaatcgtgccgcacgcacacggtgtagccacagccgcagctgcagccaccgcaaacagcttgccgaacaggccattgctgcagctactgcacgggctgcagttacaagccagcaacgttggtatgcagtgcctcgtcccacctgaaggctgcagcgcagctacaacaacacctgcttaacagacccaatagccgtgctctgagatgaataacctaactatgaggctggtcgggagagattgctacggtcgtgtagccgcggcagcagcaatcacaacacaattcaggagcattggctgcagctgctagccaaacagacccaattcgtgtagttgtagttttagagcagctagccgcagccgtgccgcaaagcagaacaaacgagcaaaagcctctatttagttgagtaaagaaagtgccgacttgggttggggcggcgcaaaccactattgtacgcacgtatacgctggatcgaccgaccgactatacgttgtgtatacggcacgcgcgccgctctccaggtacatccgtgctgacttccagtggtgaagccagtatacaattatagtaaagactaaactaaagtggccaataaaaattaaaacatgtctcatataaattggctatatttctaatacaaaatataaatatatgaagtaaaattttagggggtataacgggggctctaatagtctattagggggtaaggggcccctagcccccacgctgtcttcgccactactgactactgctcctttcatcttataaaaaactaaaccaacctaatacaaaatatgatacatcttagtattacgaatttaaatatatctttgtctgtattcgttatcctaaaatatgttacatctaattctagattcatgttttatggggagaagggagtacacagcacagcaggtcaagtgttccgccgcctgatgtactccagtcatcaggtcagcatgagcagctacgactgacgagatcgagcattcacacggtcacaccttaactttgcagttgcaggcacatacacataatttgcaccagaaccagatcgagcattgcacgcgttttcaaagtccaaacacgtacccaagtacgtatgccgcgccgctaccaaatactactagatgcatcgtgcatgcatgcacggtctctttgcgtttggtggattaattggatcggcaactgcacggcaatcatcggtaacacagatcggggcggtgaccggtgatgtgtgatttctctgtaccagtattgacttgcttggggggtttaccggtttactagcaccctgctcctgctgcatgtacgtacgtacattcgacagggcgaatctgaagacttcagcaggttaactaacaccgatctcagcatggcagtgaggcagtgagcctgctgatgcgcatgcacagtatttcctcttttccggccagccagctaggcgtcaagtcgtaatcgtagcacggcgaggcagagcagatccttgaccggtgcaacattcgaccgagtgtgttcagtctgcccacatgggaggtcggaaacacaccgatgtcgtcgaccatcgctcagctcaactgctaccaccaccaccacgcacaacgcactggcctgaacaaatagagaggccacaagtttcggaacataaaaaggatgttttttatagcttttaggaggcatttggagtttttttttaattcgtagtatcggaggtatcgaaagataccaaattttatatttaaaaaaactacttaagtactgtaaaatcacttataacacggtggatatcaccgtccgtgctacgttaaaagtccaaacagctgaagaaatcaaagaaaacagcatatcaaacatgcgtaatagaggtgggatttaagatcatggagttgaaagggaggtgaattcagaaagtgaaaagtgaattcatatcgatcgggcattcggcggcgcgagcgcgatggtcaggcgccacttgagcttgggagtttctacttgcgagagcttaggcggagagggagggtggtgggccccacacacccctggctccggtgggacccacgcctccctcccatgaggattgcatgttctggatttttcacaatttggttcttttgaaaaatttatttcgcaaatagacctctgaaaaaacttatcttgaaaatggttctttttgggcgccggcgccagtcactctggcaccgtcctactgccaccgtggtggggcggcgctgaggtggcagggggagcgcgccaatgtggctagcgccctccccccggattttttaatttttcttttatttttttgatttttttcactcttaagagcacacaagaactaaccataaaaaaagttaaactcaaatggacgaaatatgtgacatattttcgaaagctctatcgaaaagcttcttgcctcgaaaacataatcttgcaagcggaatttagaggttttaatttcaccgaacccgacaaagcggggaaaccaaccataaaaaaattaaactcaaatggacgaaatatgtgacctgtttaatttttgaaagctctaccgaaaagcttcttgcctcgaaaactttttctgtagatgtacatggatatattatttgcttaattccgagtccgtatgagaaagttacgcatgttttgtgaaattgacacctggatgtaaaaaaaacacaaaaccctaagttttttataggatgtaaaagatgtaaaaaaaaggctagaatgttcgaaatctaatctacttttttttattataggcaaaaccaaaacaacgaagagcaaagaggaggggggattttcggtatagcgttggaaaattgtacaagtcacatatttggtccatttgagtttaatttttctacagttagttcttgtgtgctactaagtctgaaaaaaaatataaaaaataatttaaaaaaagttgtacatttctctcctctaccggggggtgccagccacattggcgtgctctccctgccacctcagcgccgatctgccacgatggcaggaggacggcgccctagtagaaccattttcgggataagtttttaggaatctatttgtgaaattagtttttcaaaaatatcaaattgtgaaaaatccaggttgcatgttcgggtcggagccccgagttgcttgcttgcttcccgcttctcgcgaggagaggggatgtgggccccgctgcctcatctcctgcgtgagttcgcgacgagaaactctcatcctatacgccccaatatacgtacgtcgagcggggcggggcccaggtcgcgcccaagtggggcccacgctcgcatcgcgtggcgtgtattggcgtcgggcccaccccacgagcttttttcgtgtgccaaaactgcgtgcggtctcggtcggtcgatcggtcccggtccccggtccctgattgggtcggacgacatcggtgactcgcggaacgcgacgtgtccatgtctcaaaaaactttacagggattcatcaggtagacagggaaagtttcgaaaagaaatctgaacatatatataaacccgtcggtcttttctttaatcgaacttaaacccgtaatcaaattagtactcctcccgtttcaaaatataacaaattttagcctttataatttgtcttaaaatatacttcttccgtttcacaatgtaagttattctaacattttccacattaatattgatgttaatgaatctagacatacaatatgaatgtgggaaaatgtctagattcattaacatcaatatgaatatggaaaatgctagaataacttatattgtgaaataaagggagtaacaatttatccactagttattcaccattcaatttcctcacataccttcacttctcaactaatcacaatcttccaccatttaattctaggaaaagatacgaattaccccctctcctgaactatcgcggtcgaccgaattacctcatgaaccccaaaaccagacaccattcaccttgaactttcaataccgaacaaattacctacgcgatgtacgcgacatacacgtgacaatccagtcaacatattatttattaaaaaaatatggacccacctatcatactcctcttccccctcttcctctctctctctcgcgggtctcgcagcggcaggcgttcggcgacgcggtccgagagggagcagcgacggtgcgggacatggaggcggcggcggcggcgaactccgggagggagcggcggcggcgtcggacgtagaggtggcggcggcgaaatactcctctgggagggagcagcggcggcatgggacgccaccacctccttctcgacgccgtcctgcaggctcatgtcggcggcggctcggcgccaggcgcggggttggtggcaggggacagcagcgtgatggtctcgtcggagatcttctcctggtaggcgatgatggtggactcgcgtgcggcggcactggcgcagtcctacccatgcgcggcggcctcgcaacggttgcgtctgcggcggcttcttgctccctcctcccgccacctgctgctgctttgccagttgacgagatcaaagtggacggggaaaagcggcgaaggttgaggacgagatgcgtgatgcgccgaggcggtcgttcttcacgtgcgccgcggcggggaggtgggtgttcgtcgccggctggcatgacgaggagaggaaagcgctttagtcggcgggaacgacaccgaggccgacgcatgggtgccgctcccggacatggcgacggagcgggatgaagccagggggctttgcgtcgacggcatgttcgtcggcggtggagacggagctcgcttaggcagccacgacggcgccacctccgccgtgcacgccttgctcctcgctgcagcctccaccatgtacggcttcgccgacttcaacgcgccctccacggcatccgcctagcgacgcaacccggaggatgatgacgaagacgaggaggagaagtccggtgaggggcgtgtcctcgaggcctgggcgaggggcctagaggagtccgtctccgccgctggccacccgggggaggtccgcctccgccgtgcatgccttgcgcggttgcgcctgcgcgagagtgagagagagaagagagagaggaagtgaaggtatgacatatgggtcccactattattttaaaagaaaatgctaattgggttgccatgtgtacgccaggataaaactgttctggattcggtcgaggggttaattcatccggtataaaaagtttgggcgagtgatatctagtttccgggttcaagggtaattcggtcgaccacgatagtttgggcgggaggtaattcattctttttccttaattctacctactatcttaataattgtgtccaactttaatgtgcccatcggttggcttatttagcgaataagccaaacgatatatttgtaaatgaaaaataatttatgaataaaacttttatatacgtattcttagcgatctaaaagtaaaggctgaaaaataaatttcgatgaagaaaaacctcaaaatcaactccagatttaaggttgaaaaattcaaactttaggtaataagcataagcataagcaaaaatataaggtcttaaaacttcttatattatgggacggagatagtaatagactatagtacctgtttgaaacactgagatcctatatttttcttttcccgaatttctacagaacatagctgaatgtttaatatagtcctgcatgctgtttttttgagtcaatcgtgcacggctatagctgggatgtactactactacttaagtctggtttagttaccaaatttttttttcttaaatacgtcatattgaatctttagacgcatacatggattattaaatatagataaaagcaaaaactaattgtacaatttacatagcaatcgcgaaacgaatcttttgagtctaattagtctatgattagccataagtgctacagtaacccacatttgataatgacagtttaattaggctcaaaagattcgtcttgcggtttccatacgagttatgaaattagtttttttattcatatccgaaaaccccttccaatatttgatcaaacatccgatatgacgttcaaaaatattcttttccccaacagggccttagctaagctgtgttctgtggcgtgtgtgatgcggccactgatcaagtattagcccttggctcgcattcgctgcgtgtgatcggttttggtcgcaggcagctggagtttggtctcgccgaaacgatgcacgtggagaccaacccaatccagatgtaacatctctccatcaccgggtcggccgagaaattcatttacttctttttttagaacgagaaattcattcacctacacagcacaagttctggccaaacaccggttaccgaaatgaactactaccacgaagctaaacgcctgaacgggacggaatcttgccagaatatgttttttaccttccctttttaccttggtaccaaaagaagttttggcatcatattaagctctgacaagatctgtatgaaatcctactgttgcacttcagaatggacggcgtacgtgtacccgtagtcctcgttgagaccagcggtaagtcgacgcaaattaaccaaccacagtagtactcgcgcgaggtccacagggataagcatgttgtacacacatgacatattgacacacggacgcagagttaatgttcatctctttggagtgagcactgatctgattctgatggcctcgtacgtcggcgttgctgctgtacttcaattccatttgcaaggacttttcacacacgctatagtactgtatcgttctttgcgatgagctgcgatgatttacaattacagttattactgtaaccttttcttttccttttttagggaactagtgctgcaacttttcccaaagaccaattccttccttttaggtggtctaggtggctgggatactatacccatctttttagaggctcaaagacgagttctttattagagcatgcataatagtaggctataaaccagctaaatattgaggtagagaagagaaaaggggagaagcggactataaacttataagcagcttgaacataagaaccaaaaaactctgtgaaaaagacaagtgggccatatattaatagtaaagagctaactattagggcacccgcaatggttatctatagactctctaccagagatccatgtcagcatatttttctacttggaaaagattaaatgaagagagagagcaaagctatctactaagctggagatagtctatagagaaaaacgagacaatgtattagagagctatagatacccatgtagacatactattgaggtgttttactattaatctagtatattgctgaggtgtacatgttttatagagagcaccttactttaccattgtgggtgttcttactccctccattccaaaatataaggcataaccacccttaacccaaaagaccaagaaatagttattatcatcttgtagtttggatcatcctaataaatataatacatgcatccaataggattagataacatgtgagtggaggatttaaaaaagtaataatttaatggagaagatgtcatagttaattgcatgtttgcatgtatgacttatattatgaaacatttaagaaaagtggttgtgccttatattatggaatggagggagtatatatataggctaagagactggtcgactgtattattagccttgatcttagtaccaacttcatacgcacgtatatgtaaaagcagcacttacatccagacgtccagtacttacgtatgtaaaaaagcaggcacttacatccagtaggaattatatagtactagtagatcggtaaaagtgcttagagaacgtatggcactaaaatcaaacaacaattataagagaaaaacaagccatccgtgcgtgcactagaaaagtgttcggagcaattaacctatggagtttagggtagaggaacagcagaaatctgatatcctaccccccacgcacttggaattgcattcttttggccgaaaggatatgaagttgtagccttgcagcctgagaagcagtgtcatttcagactttcagtgccctcttctgcagactctcttggtactcccttcgtaaaaaaaaataaaaaaaaccaatgcacgagtataatattttttaatactatagtgaatttgatagaaatatgtctaaattaaatgtattaggaaatgctatattcgtgaaaagatttgtttttttaggatgaagggagtatatattatagttgactccgtttgtttgtgcagaattatagtaaacccatcggacaccaccaaaattgtcttgagcaggctaaatggtcatgtttagttcagcgcaaagtttaaattttagttgaaattgaagatgatgtgactgaaaagttgtgtgtgtatgataggttgatgtgatggaagaggactgaagtttgaaaccaaactttggatctgcgcgttagtgtgattcggcaggcgtagcgaccgagcaacgcatgtgcagtttcctctcgtagcgggaggccgaggcgcacggggacgatcacccgtccaccaccacgtgcaaacccgtcgtcccgaaccagcaagcggccgcgcgcgcgcgcgcgcgcgacccactgtgcgtttctcgcctcgtcacgagggcttcgcgcgcgtcgttgcgtgttttagccgatcaaaaaaccggggcgcaccgcacgcgatgccgccccgggtgcggagtacgcgactacgcgagcatgcggaagcaaccggacaaatatgcggctacttctacggagtattttcctcgtagatccggctacttttaccacggattgctcggttgctccgctcctgatccgtggccgggccggggttggcttgatctcaagctgatgatcagatcagttcatgccctgacatgggtctatctgccaaaatttaaattttcacctttaaatttaggattgattttaatgtttttctatcaaagtttattttctagtctttgttttttagatcgctaaaaacatgtatataaaattttattgataaattattttttatttgtaaatatgtcgtttagaaatgatggcttgaattgggagggcagagacactcatcagagtagtacgaaggggaaagcgtaggtacgtagaaggtgcgcagaatcggtgcggagatataagcggtaagcgaggagcgcatgagattaccaggtgtggaaaattctctggatttttagcataaaggttgcccttcgctttgggcaaattggacctagtttttcctctctctgtgtgtagaatgaggagagatcgagaggtgtctcggctttcatcaagcggtatattcatcatcatttcgtccatcttctagctgacttatactccatccgttttgaaatatttgacaccattgacttgttagcacatgtttgtccgttcgtcttattcaaaaacttttgtgaaatatgaaaaattatatgcctacatagaaatatatttaacaataaatcaaatgataggaaaagaattaataattacttaaattttttaataagacgaacggtcaaatatgtgctaaaaaatcaacggtgtcaaatatttcgaaacggagggagtatacgctaatagaagcactagagtgtataagtggaggcattagtagctcaagtggtatcgtcttaataatagaaaaacagagtagtcgtttgtttttaagttgtttttttttcttaaattcctcctgatctcgttcggaacttggaaatatcacttcacaagtgacagtttgatttcctcttgtgtttatgcattattttgtgaccgactaagggcgttttcaatattctcattttctaacttatactttctaatttttcaacttatactttctctttttttcacgtgtatattttctaaaccactaaacagattttctttaaagtttatgcagaaaagtttcttaaaaaattatattaatctaatttttggctaataactaaataatcttcgctaattaatcactttgttttacgagtgataaaatggttttcaaccctcgacaccaaacacagcctaacatgtgctactagtacgtgaaaaaaatatgaattttcagaattcccagaacacacgtttgttgtctcgagaaatgaataattaataaatacatgggacaaaaatataatcatgctagcaactaaataaaaaagaggaaataaaaacaaattcaaccccagagagagagagggagaggaaaaatggggtgcccatgcggccctgcccaatagcgttgctgtacctttcagctttataatctcgcccctcgcgagagagactccccccatcctgcagactcgccccactctcttgctcagctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccaggttagctcctgttcttgcggaattctggctctttttttttttggggtggagaggggatgatctgggtggggtggggagtggtggaattctggtttttttttttttgttctttctttggctggttttgttccgtggggattgaattctcggttctcgtcacctcaggagtggtgttcgcgctgcttgttttggttgatctgtgaattatgggggaagacaccaccttttctctcgtttcttgcacttaaaaatcgtctttggtgagctgttgtgcttggggagctcttgagctgagcaggttcggtttaatctttgattgggttctatacttcactgtttcggtgttcccctctgccgaatttgggaatcaagaggttctgatccatcagtatcactcggcttctcgtcattgcatatgtacaaaacctgcttttttcaatcactcatgtagtcatgtctaattggtttgtcttttatcatcttttggtgtaacttgtctgtgtcactaaccatgccataatttttttttcatgggtactatgtgatcgatttcttcttcttcttcttcttcttcttttttaaatttttacctgtcataattcaagtagtagcagtagtaatctaatctaaagcttccaaattttccggtgtagttgagacgccatgtatcgggtgaagagcgagagcgactgcgatatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatgtaagtcccgtcccccccccccggtgtttgatcccatttgctgtacgtatttgttcatactaagcagttgagagattgctgttcttactcctaaagatttcccctgagtcatggtcagttaaaagcttattataggtttacttgatcttttgcctaatctgatgatatgcgcagttcttcatccaccacctaacttgatgtttccagggagaattggtgtgctattagatcattttaattttagttccaagttgtagaattcgtttgtagtgattggttgattgcctttcttgaaggatacttttatgggtttttatcaagtgaagtattttgtttcacggattagaattgtattaaacattattttccttggtgttacttgtatgctctaaaacattaacttatatttttctagtgcaaggcagaaagttatcaagcttttggtttagaaattaggtttggtgatttttaaaaggactctcatgtagtacagtagcaacctgcatgaagccctactgctttcaatttccaaaattgatttacaattcttaaggttctaagcttagatctaagcataccgttcacttttacatgattcttctgtagctttatcttctcaagttcatctttgtcggttttactcctgcatggatgcggtcatgatcatatgggaagatgggcttaggtattcttcatgtgagtagcaaagaatacaaatagtgttcatcaccagctttgttgttactgagagcaagttgtgctacgtcgaaggttgaaaattgtttggtgcagttgtttgccttaaatctgttcattttggattgttcactgtgttagaaggggttgggaacaagcctagctaaattgtccgttgtctaggactctaaacagcatagttacaattcacaaggtaacataattgatatctatttcagtctgaccaagtagtgctattattcttcgcaagcttagagtaaccatctaaggcctttcaatcttgttaactttcatgattcacagaatcgaattaattttttgtcataatagtgtgaacttactgagtttctatgatttcttgaactgatcaaacttgtccacgtaatgatgtgagtgaaaattaggctgttgtctgccgaattatttcatatgtatcctgtgtatctaagtctttagagtaagcttatcatttatcctgaactctttgcacatattttctgtattttttcctctttacttacattgagcacatcttctcagttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccaggttggactctgaaattcctcatccctctttgatgtgattattcggttatttatgatgtactgttttgcagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctacagcagattcttggtatcgttcttgctcattgtttggatcataacttgaggaagatctcgtcggttgtaattctgcattgctgacagagtccttgatggcatgcaggcactatcagatgttctcttatgcgactagcccttttgtccaataaagtagtgcatggagataagccggttaattattgttttcttttttgtattagagaaccctttttgtcatctctattgcccgaattctgttggaaattcgtcatgtttgtttgaacaatgtaagaccaattattgcatttgtggtgtactatcttgttgagcatttaccacttgccaatcaatagcaatttgttactactacacaccctgtcacattttctttttctgcagcctgcaaacctggtactcaaagccatagctgtcttggagataaacatactttgcagtgcactgatgcattatcatatttaggattgtccatggaaagcagcaatgctgtgccctccagttttggcttttggaatctgcttgctttagctgtggtggctgaagagaaaaggggccataagcctcggagatgaatgattagagctgacatatggtttcatagttggaacccaacacaagctatcatgtatgacatgatcaagaagttgcgacgttacacaattcgcaaaacgatatacctaatttcctttggtgttcttgtgctgtttttgttctttttgtttcataataccagtttcctttctttttctctctctctgtaccgcagatgtgttgaacattcagagctgtggcattctggtacttttttttttcagagggtggcattctggtacttattgttattattatcatttcacaggaagtacttgatccttttctcaaacatcacatccaatccttttatagctactgatagttttcgacttctctccctgccaacttgcaatttgtcaaaaaatggtttcttctctcagacctcctttgaaacaatggaacggagtattttatttttattttgagaaattgcattgattcttagaataatcctataaaattattgcatttcaaaggaaccatcagcatatagttctattctatacactttcttcatcccaaagtagataaaaataatatgagatgtgatacattttaatactacgaatcttaaataaatgtgtcacattttatattagatttgtttagtttagaatgaaaggagcaagatacaagctgcttttctggctcaaagcagggagaaaaaaaaacagagagcagaagtatatgtatactagttatatcagcacacatgtatgcgtgcgacgcgtgaccaccgagaagatagcaactcacgcgatgtgcgtgcatgccatgacttcgccatggggaggccaaagccacgacgcgcacgacgtcgacgcatcacgcacgcacggttcggttcggccggcgatcgatcgagaggttttagattggattacctttatttcttctctctgcggttgcattgcatggagatggaccctcaaccagctagcacacgcagctgacacacacatacacacacacacactcacagcgtgcagaagaagatgtggtattagtggttgggtgctttacgctgctcgctggatctggaattatggatgttgggtcgtccatgaacgcttgaacagtgtcaccagcggcagcgatgacgcaaggatcggccaggtgtcaggccatacagagataggagttgtgatactgcaacaggtaaactttttatttttgataactcataaatttatcgtcaacaaagttcaaggggaactactgcagcaatttacgcatgaaactagtacagagataggtcgtccgttttttttttaaggcggagggagtactaggtggtgttcttttcttctgtatgtaaagataaaaattaattttttttacataaaataagatggtattaacatataattgaatgagttttaattattacaaacttgaaaaatactttcaagttttcacaggaaacgcgtcgtttaacagtttgaaaagcgtgccataaaaatcttaatatttattcaactcttgttagagaagagaacatgaccctagtaatgatcaacaatataactctccgtcgtggcagtaaaaaattctcacggtgagaccacgtgcagtaataatactcctcctccatcttataatataggagattttggatgaatggtgagaccacatgcaataataatactactcctccatattaatataggagattttagatgaatataatacattatagtataataaatctaaataaatactaaaatttcttatattatcggatggagagagcagtaataatcgcggtaatctggacgtgggaagcaaagacgcaggcagcaatcacggcgtgccggcgaccccctcggacaccccggaggagcagcctgacaacatgccagcccaccattctcaccgctgtcgttaccctccccggctcccgcgaagccccgggacccaccgccccaaaagcacaccgctgggcccacctgtcagccgccgcccaccaccaccacggtcagacgcgggaggaggacaactgttgccatatgccagcgaaaggctgaaaaagccggcagcttcttccgctttccgccgccgccgctttcctctcctctcctctccgcgatcgccatcgccatcgccgcccaccgcccccagccaggcaccgcagcaaaccaaaccaagccgcatcctcctcctttccaccgccgccgaaagtggcggcagcccaaacctgtactactactactactactactactactactactaccattccactgcatacgacactgatttgaccccgtgggggacgaggcgaggcgaggccttcttgctctgcctttctttttctcctcctcctcgcctgatcagccaagattttcggcggttttgtttcttctgctccttggagctttccccgatctcgcttgctggtgctggtgctgctgcctgacggcgaaggtatgttgttttgcgatgccgtcgtagtgaaccgagaggctctgtagctgtagcggatgggatcgagttgccacttctgggatgcgttgaattttgttgcttttcccgatcaattggtcgaactgggggaagatctgcctgccccttgcttgatcggcagtaaaggtggtggtagtggtggtgttgtgggtgttcttgctagatggttttgctgggatcagattttgcccctactctgatattggagtagtttatcagcttatgggggttcgaatcggaggctttagggatggattttggtgtgggcgagggctggattcttttgtgccttgagaagttctcagctaattgaattgatgaacaaagaattggttattgacttgccttgcatagtattcttatgctaagacactcctaacctaatgcaattatagttctctaatggatctgtttgtgcggttagtatgtcgtgaagtcgcgcaattggatttgcctgatccgttgtagttgtactagaactatctgcattagttcagatgcctaaaaatttgtgtaattaggatggttagatttacttaacaaaggttctcaaaattctttatatgtataaattaatcaaattctgtcacctttcttactgtaactaatcttgcttgtgattttcttattctaggtttgtgctggaggctgaaagagtgcatgccatggcccttgatacaaaacaagttgcgcgatgtttgaagaaagttttgaagtcctccattaaagatggctatagatgtgtttctgaacatccaatccttttgacattgggtgttttgctctatttattgtatagatcttcaccagggttatttgctttcctactttcttcttctcctgtaattatgtgtactactcttcttcttggaatcctactgagttatggggaaacaaacctgcctgaggctgatgaagataacaagatcactccagagatttcatccttaaaggttggaaatccttccagtgattttcactttgaagcgagccagagattaccagtgcctgaattgagggaaaatacaactggcttcaaagagagggaaactaaacagacggtttttattagagagagggctagtgagcatattgagctggaagataatgtcccccttctgagaagggttgagcatgaatacgatagatttgatcggcatgaaatacctgcagcgttaacgccatttccctctatggtcaattttcatcaaggttctagagttggaaacgacttgagctctaatcaggacatcaactccaaaggtttgttgtccattaaggataaggctgatgggcacactagcttctttgaaggtgttcggagtggtctggatgagaaagaggcaccctttggcattttttcgaccagtaagaatgttaatggacgtggtgaattggaggaaaatttgaatcaagaaacagtatttacagattcaacagctagcagagtgagagatatttctgaagagaaaccaacggaaggggaagctggaactagcaaatcagcttgtgccatttccacgcatcagagtaaaacacttgatgaacttaggattaatactagcaagggttttgaggacaatctactcgattcctctcttggttcaccatgggcaagagttggtagtgaggacggagttggagtgatgatggttcatctggttttgactctgatcaggctgagagttcttctcctgatgcttccatgactgacattgcacctattcttgatgagattgacccgctcttgggtgcaagctctactcatcctgatacaattccaaaggatgattcggacactgattcacatgtttcctcacaggatcatcaaactgatgatgatagtaatgatgaaactgacaataatgatgctaaagagaatggtgaggaaaagaataaagaacaaggaaaggaagctgcatttatttggacagcagatgatgaaaaaaatctgatggatcttggatattctgagatggaaagaaaccgcaggttggagcttttgatggccagacgaagatccaggaagaacataaggtttgaaatcgacaatgacttgataggtattgataataatgatggtgggaggggtgttgacgacttgtctcgcttccatgtacaagtaccacatatttcagttccaaggaggaatccgtttgatcttccttatgattcagaagaagcggcaattctggctcagcaccctcagttctgcatacaaggaaaaacccattcgatcttcctcttgatcagtccaatgatggtgatgtttctgcagataataatgtaaatcctggagaattagtgaaagcttctcatcgtgacatgttcttccgaaggcacgatagcttcaacattggaaggacagatgctaccctggagagattttctagattcaagccatattttgtccccgagacagtggaagggagcttaagtaatttccaaagacagtttagtgataaaagtgagtctaaattgagttctgttactgaatctgatttggcctcttcagttgccgatcaggaggaccacaaggacctcgatgaaaaagatttgcccaatgagcatgggtctccagctctgcagagacaggatagcgaccttgcggatgttggaagtgaatgctcggatggcatcaactccgtggatgttgaattagacaacagtgacattgatgatcgtgagattgctctacaacactttgtctttgaaagatcacaggaaagagaagcatatctttcctcaacaaaaggaaagggtcctgaagatgattacctgctcagttcagttgggaactccaagacacttcatccagtagctgacctgtttagctgggaagatggaaatggtaagaaaatctgacctcacagttaaacaactgaatatgtacttgacagctttatttgaatcatatttcttcagctatgtgatgttattttgtaatttcagctttatgctgaaacattttaataatggcatggctatgtccatctcatgatgtagagtcaggagttctcttcaattatctaaaaactaccttcttgtgcaggtgaaagcagccttggtgttaactcttcccataacatgtcagttgaattctcggactgggtttcatcccccaagccaattgcagagcatgattcaggaccagagaaccttcaggagtttcttaatactgaagttgcatcaagttcaaagacaattgttctaggcgcaagaaatccagctgaaaataatggaaatgttgattccatatcctattcaaacaatgaaatgccttcagataacttgggtcatgggtccatggagttcccatctgaattttgtaatgaatcactgccagtaatatctagggacttgcaccctatccctgaagagagggttgtcgagaacttcaatgtgcaagaaaagcatgaagcagtaatatttaccgattcagatgctgccttgactgggtttcatgtaattgaggagcactttgaagttggatgtgatgtaagcccgagttctgaagttgttccgtcatgccttcaagcaagtgattccatccaatctcgattagttgagaataaagaggtatcaaatccattcatttccatcgcttctgaaaccaacaaggtggatatgattgatttgaaggaagaaacagctgcaggatatccacttgattctgatgatgatgctgataaaatctatcctgagcccatggaggacaatgtaattgatgaaagtttcctatcagaactggatgcggtaggagatttccgggtagaagcaacaagatcggaccagcagatgcctgatgttgactcccatattgataa

SEQ ID NO: 62989 - DNA, 744 bp, Oryza sativa
aaactaacacagagatgaagccactatttgatgagacagaagcatcttttgtcaatgcaccaatagaagcaaacttggtagttggaccaagtaaagtggatgttgctaatgagtctgagttaactaaaactgatacaaacatgatcgttcttgatgccaattctctggaggatatagagacggcctttaaacaagcaagcaatggcgttgttgagtccaccgtggacaatgaaaccccacaggtttctggtgttgatattgacccagaatccatagagagttctgaacattggatgtcattgatgcaaaatccgtcgacgacatatatgctgctttaaggagcacacaactgctgctatgaacagttccttcgaagaaaacgaagacaagcatggatgcggtgatactgtaaaattcaccatgcatgatgagcttccagaaggaacacatattgaaggtaacacagttggagatggtaaagagcctgaaccaatggggattacaagcagcatggatgtcattgatgcaaaatccatcgatgacatatatgctgctttgaagaagcagtcaagtgctgctgcgaatagttccttcgaacaaaacgaaggcaagaacggatgtggtgatactgtaacattcaccacgcacgatgagcttccggaaggaacacacattgaagatagggataatacagttgaagatggtaaagagcctgaaccgattgggactacaagcagcatggac

SEQ ID NO: 62990 - DNA, 14869 bp, Oryza sativa
gcccatatcttagtgttttgtaagtctttaatcagttattgcccgcatcagggtcatggtagccccttccaccacaagaacatggcacctaaaatatcaattaatagggtggctaaatgcgcgcaaagaagcgctccaactcctgggtgttttgtaagtttagtcagttatcggccaccacaagaatatggcacctaaaatatcaatgaatagggaggctaaatgcgcgcaaagaagcgctccaactcctgcagcggccaccacaagaatatgtcacctaaaatatcaatgaatagggatgctaaatgcacgcaaagaagcgctccaactcctgcagcaggtatctcttgatagcaaagaatagcatttttgaaacagagttgtccagcagatttaccaagttatccctgagtatagtggacgaggaacccttctttcttcccaatcaataaggtaaacccagggtaagcctagcacaaagttagtagtaaagttggagaaaccaccttgacaatcaaccactttacccactttctccaagttgttgtgcacttcctttcctttgcttcgaatttacaagagagcagaaacaatgcaatataactagaaattgatgcacctatgctgaaaatcatagtcagtccagaacatgttttttttattatctggatttgtctgactctaaatgtcagaaactccttgatgaagctgattccataatttatttgaccacatcatgtggcattcccgccaatagctcttttatcagccacttcttgacaggcaatgacatcgagaaaagtgtgctctttaattcattgaaaagttccagttgattagtcacatctcgagcttcctgttgcccagttggcttcttaagttcctattgcataacatcaaatgacaaaatgtttagccaaaacatcaactgagtttgaaacctttaggaccacactgtgagcagtgtcaagatgtttagccgaaacaaccctaagatgcatgccctgtgacttaaaccagccatcattgtcttttagagcttggtgtgcattggtccaatcttgtaataccacgactgcattaggcccctcaatagcaactaatggtagctctccataaggaagaaatgctaacttgaggtgaatataatcaaactcaggatccagagagtgcacgaggagggttcgtagtgtggtgtcggcacctaggaggttgaggaaagataggtcgacgtcgctggtaggatgcactgttagcttggcaaggagggcatggagatcattgatttctttcatctttttcacttagaacctattggatggaaacctgaataagatccatattttgttggcatttaaggtagaaatttgaacaagggtatcctgagaaagggaataacattatactcattttaatttcttattcaatttcaatgtttaagtttgaactagaagaaatcagattcgaatgttttcctagttgaatgaattctataataaataaaatgcatctcagaccaataccatcatagttgagtctgtcaacagtacagattacatgtaatgatgaataaaattcaagctgttgttaatagactacctaaaagctctcactcaagaaggggataacaagatgaacaagtcaacaagagtagaatagaaataataaaaagaaactctacctacacagattataccggctacagcggctgaaatgccgaattgggaagaggcggagaagaggttggagttgtacctgcagctggtatggaaggtggcgaatgcagggtgcacacccaagacaaaatctatcttctatctattatatactaaaagtccattaactttcctacaaacgctctcaatccgccacgtgtcagccctacaaacactcctagaccgccacatggcactgtataatctcaccgtcgattttcacttaaattggtggatccgatattttagaccattggattagatctattatttaagaaaataatcccttcctctgctgtgggccagaaaaagaaaaaaaaactacgtacgtacgtgtgacttcgtataaccgtgggccagaaaaagaaaaaaaacataagaacgtagtacgctctccctgtctcttcctattcctattcttttatatctccatctctctcctcctaattcttttatgttatcaaattaaaaacgagttaagttgaccataatttaaatgtacatagctaatttatattctattaaaacgttgctctatttataattaaattgacaattttacatccaatgttttgctatatataagcaatttgttattgtggtatagactgtgcattttgcaagtttgcatgccatctaaataaattaaatacttattaacaacatatattatatatctatctatatatctatctattatatactaaaatatactaaaagtccattaaacttcctacaaacactcttaatttgccacgtgagactcctataaatattcctaagccaccacgtggtactctaataaattagaaaaaatatataacttgaactggtgagccaattggatttatctcataaaaaaatccttcctcaactactaccgtacgttctcatgtccttcccctcaatcccttctcctcatctctttccttttttctgtatggtagttaagatttttattttattacttaataattaatttcttcacttctatctcaccagaatggttgtggactcttgattgcatgtcccatgcctaaatatgtaaatgattaatgatttgatgcatgcttttataaataacaaatctatttttaactaaaaatttagaaaaaagataatagttacatagcaaaataatcataattttaaaaagttgctccctctatttcatattataagccattttaacttttttcttaattaaatttctttagatttgaccaaatgtataaaaaaattttaacaacatctatcacacaaaattgttttgttagatataacgttccatatatatccataatatgttttgaaaattttactatattttctataaacttggtcaaacttaaaattgactaaaaaagtcaaaatgacttataatataaaacggggccagtatatctgtttttatttagtttgtttgaacggttgtttcataattagacagctaaataatttaaaatcagtattaccaatatttcactataaaaaataaaatatgttatttgaactgccacctattctttacataacccaaataacatcctatttttaatttatttgaactgttgatttatgttactcatattttaccatgtaaaatttaaaatacgtaatttgaacatagaccaacaagcaaacaacactgaaacattaaaaaattgacaacatgtattatgtcatcttaatcattctacataataaaaattagaaaaatacaaagtcaccatgtatgaccttttagagacatgttaaattaccaagtgtcacattttaaaaattagtaaaatcttatatattaaaagaaaaaataaaacatctagctaacggttttcacctagatcgatgacctattaacattatatcactacacacccaatccttcccgtcactggctcaagctctacacttttcattcctcttacgttcctatttaactaaaatataaataatctataattataagtttcatgtctgatttctaatctaactattgcaatgtttataatcaaaccaacgatataagatccatatgcctatagtttaacacaatcggcctagcctattacttacgattatctcaaatacagcctacgatacatgcccacgcgaatgcgcgggctaccttcctagttgttgtaacttgcaagaccacgaagaggctgaggccaatgccgatgtcgaggcagcggggcagaggctgacagtgacgggtttctttcgcggtgcggaagaagccgacgccctggaggtggcgtggaagagcccgaggccggcggcgaggaggagcctgcccgaggccgacgtagagcgccgtcgtggaagagcccgaggctgacggcaattagcgacgctgagggcagcctacgacggagtccttgttcttatcacggcgccctggaaacggcggcgaggagcccgaggacgacggcgagcgccgcggaagagcccgaaaccgacgtagaaccgaggcggcgagggagaggtcgaaggcgctcttgtacttatcgttgtcgagcggggaagaatccaaagtcacgggagcggctaggagtagtccacggccgaatgcgagaggaggcgccggacttacgcgggtaggacgattttggtgtggtggggtttgtgaggtcacgactcacgacacatttattcaagtagtcggtggccagaacgtggaaatgaaataataggaactatagaaacattgattggaaattggtaatttggaaattcgaaactcaaatggaaatttaggatgctagtagtattgctatacaaagagcaaacaacagaaaatggggttgcattgcggtggacatttcatcattctaaacaggattgaagttgctctgcttgagagaaaaaaacaaaaatgatatatttgaagcagttgatagaaagacaatccactgcaactcaagtagactatctagaaaccgttcatctccagtagatatgttcgtctcttcatcagcgccttcacagcaaatctgaaaggttcatcgaatgcacttgaaacaaaagcttcagtttccttccgactgctgtgaccaccactgcctccatcattggagggtttgatcacaaccagggtggcaccttgcaatgtcatgccaccaggtagctcaaggtatggggcatatttcagcttcatgttgcaggctgggacctgagttctattggaacatgctgaggctgacagtttgttttctctaaactctctaagctgctccatccccatgtacaatgtcccttgcccatcggcatctgctaaaaccaagctcctcaacgtcggatggtccttgataattgaccggagaagatagtgtcttgttgatgcagcaatcaaagagctgatagtccacacgacacgaagtttaagcccgccattggtatagaaagattctggcatgcttccattatcctctaccgacgactcatgctctgcgcctataggcttgcgatcgaccagggtacctcccagaatcacacaattccgaagtgtgctaccatactcagccctccacttaagcagaacaccctcctcggtcccaacatctcccgagggaagctccacccggagattccagacatcagagaaattcctaagcacatgtaccggtgaatgctgcgcaagcgggaacaacggcctgcccgtgccattcaggttgcgcatactgtggaatggcttgacgattgtgaatagcataagcttaaagaaatgggagaagatgttctttggcttcgccgaagacaggttgagagcatcatcagcatcaccatctgtggccacgacacggtcaatcttgacatacacatcggaaaccagaggaacaagtccgctgaaccgcttcgacacggcagcgcagcggccaagcgaacgcacgtcctccagcttgttcagaatcaggaggacaactggatccggcaggcagtcgaattggtcgaactccggagccgggtctgcgtggattcgagccctgggatgcattgtccaactcaaaggtgagcacctctttattcccacgacaaatcaaggattccctcttctgctacggcttggtgtaaacacttctgctcttgaaatgaatcgtccagccaactgaacagcccgttcgaaattgaagcgatttcctgaaacaaacgcaacagtaaggtacggacacaaaattccgcagggaattaccatgatgaactgaataaatcaacatgaatcacacaaaatcgatggcagccaacgtgctgaacagacaattccccataccaaatgcttaaaattgataataataatgcttctgggcgaccagaagagctcaactgcaacagggattacagctccacagcataaaaaaaccaaagtaatccaagaaagtacctcaaggccaccacgagcctgccgtcgagcagcttcgcggcacccttcccagaaatcctctcttccgccggatccaactccggcgagcccgccgcagcttggaaaaaccacccccaagaagctccaggaacaccaccaactcccctctgggagacacggggaagcgaatccgcgcgagggggagggtttagaggggagcaaggaggcgtctcggctcgaggggaatttgtgcttcgagactcgactactcgagaggcggtttctatagcgtagcgagaagcgtgccgctaccaccactccaccagcagctcagctcgacgccgctttaatatacgcccttcccacggaggtaacggccgtctcccggactcggtaacggcgtctcggggagggataggctcgagaggtgggccccaccgagcagcgacccggtccgcgacttgcgcgtgcgttttgggcggctttgcacgccggctggtcggcaagtctcggattggttactcttctggttgttccttttttgtgtgtgtggccaattttaatttcatttttgtttggcacaacttgtggttacaataacgcttggagaaaaaaaaacgcagtaagactgtctctaacaagtgacccataaggacacctaaactcaaaataggtctccgatagtactatttcagtctccaacagagtacctatacggaagacccattttgcgtgctataagaggcataacctaaatttgagtatcctctctcctgaagagctatttgcagtaagagttcttttttaggttttattattagagaagaccaaaaatagatattgaactatttgacttgactgtagcgctatgtaaatgtgaaatgggtcttgtattttgggttttattgttagagatagcctaatgaagcctttggagtttggatcatcttacgacgacgtgcgcatcgatgtttttttagtttttatataagcttttccaccatgcgtccatttcaccaagcataccgtgcgtgcacagaaacgaataccttactcaccctcacacgtactactacttagtggttcggttcaggtccactctgtggatgattacgagtcggtggccgtgctcccatagccccgtgccacgagagccacaagatcaacggacagtggcaggggcaagtgaaccaccacccccaacacacgcgcacgtcaaggccgtagcatcacccccaccccccgtgtcgccacaccgccacggtggaagccggggattgtggcgcgtcgtgacggctttttgtcgcttcggagcctcggatggcgaagcctcgctttccgcccgtccgtcccggcccgcacgcaccgcacacatatgggaccagaatcccccccattcctccgtctccgtgcgacctttgcctgtcaattccactgtagctggggacaaccactcacccggtgcgtgcctgcctgccttggttggtgcatttttcctgcacagtgaacaccgtgacgacggagcggccagttgcccagttggatcgatcacaacccgcgtgcgccgcgcagtacccggcatatgatatgacacggtcttatagcatcccagcagctcctctatctagtcatccatctgatatttggagtatggaagagaaaaacagtgctccagtagagtctctatcacatactccattttttgaggtcctccaaacctagcccttcctaagccaaatatggaggttctctctcctcactccatcctcaactacccacttcccaagatttttttaagtggagaaaggtgggaggaataggagtaaaaatgtgtggtagttgaaaaatattagtaaaatataggatgttggtatatgtaggatgtaatatggatgatctgttagagtgaaaagttatatagggtgagaatctttttatatggctatctaaataggagtatggaggatgaaatttagatgagctactcggatgctcttagccgatacaacgacgatgacgaggccggcattacgacggcgagtacgagcgatcgagtgattgattgatcggtccgccggcgggccgcgaccctgctgcgcattattgcggaaaacgaccctgcccctaacgcgtcactcgctcgctcagccgtgtgtactctcctcgctcgccggctgcacatgctgctgccgccgccgccgatggcaggttgggtttgtgattgtactactgattaagtgattattagcctctgggaatcttaggacgacggttgtctacagcgagattaaatgattggttaagagactctctactcgtcaatctcacgccacacacgcacgcaatggatagtactggcgccactgcggacgcttatccaaccacaactactccacgtgagggcgtgaggccgacatcgtttagaatagtgaagaacataagggacatgatgatgatattaaaaagccgggattgtttcgtggagccaggcttgagctttgacgtcgttgctttcagaaacaacacacaggcggcgccgaaaagtgatgtgtttttttctcttctttttcttcggcggcccttgattttgttccattatatcccgccctgaaagtgaagctttttctgtctgtagtctgtacatttgtagtatatgagaaaaggtgagtacagttgtgttgtctgaatcttttgctcattgctgcacctctactcttttctgaatcttttcttttcttcgttttgggaagcaaatgcatatgggtcgtcgcgatcatggcgtcgatcgttatgcagtatctttgtctgttttttagcaccacatgcttctggatcgagatactccaactcccttcattttttaatagatgacgccgttgactttttctcacatgtttgaccattcgtattattcaaaattttatgcaaatgtaaaagatataaatcacacttaaaatactatgagtgataaaacaaattataacaaaataaattataattacgtaaattttttgaataagacgaatggtcaaatatgtgaaaaaaagttaacggcgtcatttattaaaaaacagaggtagtacttaattagtatggaagactctactgttacatgtatctagttgactgagtatgaatcgaatcatagtgcgaaaatcaatttgtcattgtttaggttgcagtgtctgcacagttcagggtttcaggctatcaatgattcagaaacagatttctgtgacatgccagtgcgttggctagatcggagacctcagacactatctgattagaactagtagtagtagtattctactgtgagccagtgagttaggctaaccgcaacatccaatccaaaaaaaaacaattcatcctggaaagcatgtgtctgctatgctatactatctcatggaagaaaggaacgaaacaccaacccttttctttaaaaatacacaacttgcagagctgctcctttcaatctttttagacgtcatgtatactaccgagtatttcaggtgtctctgtaccattcagaatttcagatactgtggatatgctggcaaaagttttaaaaatacaatgagcttacatgggcactactgaaccacagctgcttaactcagtctagtagtctcgcacgcacaccacgtcacctgcatttcccgtccaagctcttgcctgctaatctatacactaaaattcaaacgtgcagaaacagaatcaatcatagataaaaccttatctgaattgatacattcgatcattggttgatttgcagcaataatgcaatttccatgacatgtagtagtagtactgcagtgtggcatgcatgtcgagatgttgtcgtctcataggtgtcatgactcatgacaatgaagtggtcgtcttctcagtaactaatggagagtattctagtaattattagtattgcaggcaggaaaatttccatacacgaagtgtacacatcagggatcattgtcttctgctgagaatgatttttgtttttcctttttcttcttcccccgagagagatctccagacctctattatggcagttcttgtagaggaatcaaagtttccctgttgtgagactctgacgtgacaatttcactcttacagttcggataaaaattcaacctgtttcacagaattgatgacacgaattttaattaggacaagtacgaaggtcctgccatcttgacaagtcaactgatttgtgatttgcatcctaactagcagatttctcggcaaatattcccaggaccacatctcaatatcacagagatttttcttcgggccattgcacaaaatgataaggctggacaattcttcatggagccgcactaatgtcttgagaacaaatctgacaaaaaaaaaagagataatataagaggtacagattaaggaagagatgccgacattttctctggtatggtcgggatgatcagccggccaggacgtggaagacactaccactagctgtgcggagattacaacaactaattaaccagtaggcgaaaaaagacactagaaaaccgtggtctcaatgattacctcttctgatagtctgacatcacagacggaaatggttctgaatattcgatcattcagtgttgcaagagttaacctgcagcagcacacatctgagtttttcagcaattcacggcatgttgcagtgctcaggtctatacttgtgagatcattcagtagtgtttgtgttccattgccaatctgatcctattcagtttcaaccataaatcttgagtttatgtacgctggaaggagcatacgcgttgttacagttctgattgctgaatgttcagtttttttttttttgtcaagaatctgtgtgagccttcatggttataaagggcatcagcaatcaatgggattgtgtacagtactgctaatgtagtagcagtgtttattgccaaagcaggtaataagcgtgagcctcttatcagttaaagtaactagcagaaagaccacgtaatgtgactatgtgagtatgcaagagatgggaaaataaggtgggatccatcttcaaccaacctatcaaaagtcttggtgtgattaaaaaagtgagatgaaacccgtcataacatattttattttcttgctaccaacaataagattataagactgtaaactgttagtaaatatttgctgctctcataatatttgttacctggtaacaagtagtatatatttagtgcttactacttactttaacactatattgtgaatgtcctaaatgggaagcaatgccagagaaaaatattggatcatccaagttcacgcgacattcctgattgtgttcaggcaaaggcattaggcatacacaaccaactcacgcatttcatatgtgagaaatgcacaggaaaactacacattagcacacatacaaatccactcacattcaaccggtgagttatctttgaacaacatgcgcaaaaagagaaggcacgtatcctcgaggtacaaaaaaaccaccttcgaagttgaaatataaactctatacaatctgctttaggtagcactgttcatgtactagaagaacacaacaagtgccaaaaacttttttcttctcatttgtaaagaacacataggtgcaactcatgaacatcacaactacaacacgattttggcattaggatgatcaacattactctatcaaacccacgaacagatgatgattacagtaaaacatcattgaaaaagcacagcaagaatccattggtgccaaaaaactgcatgttcttcttctcctaatttaatcaaccgattactccactgttcttgcttcctcatcagtccttccagaagaggaaccgcgccttcacgcggcacgacttggacaccaccttggcgtcggcggcgagcctgtccacgaccaccgcgcaccgcaccctcaccggcacggcccacgtcctcacgccgccgacctgcaggcgcacgggcaccttgacgtccacgtcgaacggcaccgaccggagccgccccgccgccgcgatgtcgccgagcaggcgctccgagaaccgtatccccaaccccttcgccgtcgccaccagcaccgtcacgttgcgggggccctggtagaacgccggccacgcgccgtcggcgagcctcacgccgccgtacgacacggcgacgtggctcccgccgccctcgtagtgcacgccgatcttgccgttcgggttgtccgcgcgcacggtggcgtcgaactccggcgagaacgagacgggggcaggggcagcggtggaggaggcgttgccgaggatgccgccgaggccggacacggcgagggacaggagcgtgtagtccggctgcctgggcttgaacacgaggtagacgacggcggcggaggccgcgagcgcggcggcgaggaggacgagcgcgaggaggagccacgagcagacgcgggcgcaggagcagcgggcgcggcgcctggcgcggcgggtgtagtgctggaagaggcgcgcgttctccggcggcgggacgcggaacaccttgtccttgggcatctgcaccacgtacgtgccgggctgcggcgccggcagcagctgctggtaccgccgcgcgtcggcgggcggcggcgccgccgccgtcggcgggaggggcttctcgaagtggaagctgtagggcgggctggaggaggggtcggaggaggcggcggactggttcatctcgccggagaagtcggagctgctcgccgccgccgccgggtggacgcggccgtgcggcaccatcggctgctcctcgaggcgggcgtccgaatcaatctgcgcgttttatgcatgcatgcataagctcaattagtcataaattaaattttgttaaaaaaatactaaagtgatcgattcatatcgaacggtgtcgatgcgatgggtgtcagtgcaaatcaaatttaggccgtcgatgtaatactgtaccagtaccatttaggaatatcaacgaagagttttcacctaaaaaatctaaaccagaactattgatttaatttaaagctctccttttttttaaaaaaaaaaagcaaactgtctatgttctttccaccaataaaacgcagcaatataagagtattgaattttgcgaaggccgaatctgtgaattatgtgcatttctgtatagttgtacttccagattgaccatttcagttcctgcagtttttttgctcaaaatgactgttgatgcaagccatcgatcgactgcaatttaaggccatgcatatatacagtgtgcaagcaaaacactctctatgctctagctctggacaaaaacctttacccaacattccaaaaacacgagctttgatcaagagaaaccaatatatacatatgcagtacataaccacattcccaaagttcaaaaaacggcgccaaatcagatcagaaaaatcagaagcgggtagagaccaaaaaaaacgaaaaaaaattaaagccaaaccttgcacagcttgctggacgagaccgctcgtcgttctctcctcgatcgatctcgatgtgttccggaatttcttcaggattgtgattgcgaagagaggaaggaggagacggcggacgtgcgaggtggtcaggacagacgccggagagagagagaggcggtagagtttggaggcggaggggattatataggagacgcggaggtggggccctgcacgcggatctcgcggggtcgctgacaggtggggcccgcctcgggcgtgcgggtgcgtcgcttcccggggaaggaaacgggggttggaagttggaaccgtgtgcgggagacggggtttatggaaaaaaaaccctgtcgtctggttgtcactgtgggaaaggagtaaaacgaaatcgatctgcaaacgcgggcgaagcgtgttcagatcacagcagtagagagttgagtagaatacacggtggcaaaacgagaaaaccattaaaataattaattaagttttatttattactataacttaacaaatttgatttatttgatatcgtagaataacttttatatagaaaggtttggcataatacatactccatctgttccaaaataagtgcagttttgcattattcattttcaacgtttaaccgttcatctaatttaaatttttttatgattagtatttttattgttattatggatgataaaacatgaatagtactttgtgtgactaattttttttagttttctcataaaaatttttaaatatgacggaccgtccaacgttggacgcggatatctacggctgcacttattttgggacggaggtagtatattttaggcaaattttgctacaggacactccttatatgtggttttagccctaagacactgcccaaactcacttttggggggaaaacactccataaacgtggtaatttgccagtggacaccgcgccgattaaaataataatttccgattgaagaggagagagaaatcgtgtgaaatgtcaaaaatgcccttgggtccacatgtcagctctatctcccatctatcttctcctcttcctgcccacatgtcgctccccgccggtcgccgaccgtgcacgcgtagacagcgacagaggcaacagcgagcagcagaagcaccccggccctccggtggcccaccaaccgcagcgcgcggtggagcagctgcagccgctccttttccctgccgcctcgcaaccctcaccccctgcccccacccttcctcccgccgccggccgacgcgagcaagtcgtagctcccgcaccgcatccccagcgccgacgccgagccactcatcgccaccgccaccgcctttctctcatcccaatcgccgaatcacgacacc

SEQ ID NO: 62991 - DNA, 2302 bp, Oryza sativa
aggaagccgacgcgcgtagctcctcccccgcccgccaccacccgcgcccatcgcatccagctcatctccgtcggctgccgcccgtcttcgccggcggcgtggagcggggcgatggctggcgtagcacgcaggccgccgagtaggtgattcgcggatccggcgccgcggagcggggcagtggcggacgacgacgacgacgatggtgacgagtttgaggaggaggaggacgcgcgcagctcctcccctgcctctactataactcattgttctccgaactcgccaaaggccctaggttcgaatccattgccgcccgccgctcgtgcgcagctcctccccctgcgcgagcacggccggcggccagcggagagcgacatgtgggcccaatggcatttttgacatttcacgcgatttctctctcctcttcaaccggaaattattattttaatcggcgcggtgtccataggcaaattaccacgtttatggagtgtttttcccaaaagtgagtttgggtagtgtcctaaagctaaaaccacatataaggagtgtcctgtagcaaaatttccctatactttatcattttgaaaaacatgtactaatagaaaccgacatagaaactatggccaaaggcctgtttagttggtgaaataaaattttttgggtatcacatcggacgtttaactggatgccagaaggggttttcggacaggaatgaaaaaactaatttcataactcacttggaaactgcgagacgaatcttttgagcctaattaatctgtcgttagcacatgtaggttactgtagcacttatagctaatcatggactaattatgctcaaaagattcgtcttacgatttacatacaaactgtgcaattagtttttctttttatctatatttaatgctccatgcatatgtccaaagattcgatgtgatgtttttgggaaaagttttttgggtaactaaacttctcaacccaatgattaggatggtgtccatagcattaaataagctgccacctagaattaaaaataatgtggcaagtgaataaatgaggaaagagaaaaaaaccatgtcttgcatgagacatagtttctacacaacattcaagacatcatgtgagataagtagcattaaatttaattatagaatattggtatttgcattttagaagagtagtgtctagtactagtttcttgaggccatccccaacctagaaactatctagtagtttccatacttgacatgtcatatagacaccatgcgtagaaaatatgtttttaatggatggtgtcttcaaattaagttctcatccaatcccctctcttctctctccttttatccacctatccccttaattttattcttggttcttgtgtagaaatggtttcttgcatgagaaatggtttcttcatatttttacctctctcatcattaactcttttgccatatagaatttttgcttatgtgtcaatgtatttaatgctatggaaaatagatgacatggagggttgagaatggcctaataatgtggagtttatggaaactatgtttagtgtcttggtttgggaatggcctaaacagcccgtaaattagaaaccggtgcctatgaactgtgagatttcagtactgcatgatcccagtacattgaccagctgaatttgcgtactactactgtcaatctgccgtagcagtggtttttaactgcgacgaacttgccaaatcagccaatcagtatttgttgcgagtttgtgaattgttagtttgtgactcatgacggcggcagctgttgcacagctcagaaacgcgtccagtggcacgaacaatacataccgtcagatcggtagtactacgggttattaagctggctgacgccttggagcctggaacatcgaccagctgtgttgcatggaccagccgcgcagtcaaagcctcaaaggcttctgattgaaccaaatatgtaaaacgaggaggcgctcgtacgatggtggccaagtaatgcgtgcccacgaccacgctgccggccgcgaagaagacgagtcgacgacgtgacatcgcctcctctttcgtactctgaggttcagacatggaccggtacattctgtgtaggcaattgcctgaagtctgaacaattctgcttaagaaagaaaatgaattagtgcctaaagaccaaccaacggttgccacaaatttctttcacatcacaattcacaagcagaagtgcaggacaccctcaacttctgcttgataaaacaagtcttcgtttaatttcaacagcgagtaatgcagacaacaggcagaacgaa

SEQ ID NO: 62992 - DNA, 20151 bp, Oryza sativa
  unsure (1)..(20151): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccattgagacggtgaggcctttcttattaagatagttggactgactttttctgtgttatgtaggtcagtctgtatatcacctccatattcatcttctagggggacgtcagatgaactggcctcctggataagttgtatattcccaaagaggtgctctgttatgaaaatgtaaccggtaacattctctttatctccatctgatgtgatgagcagtttcctttatggtatgtgctctgtaactgctatatactggtcttaaggttttccgtttcctgtttgcgacaacatagccatgtcaacagattgatctctgaagcagtggctaatttctattgacagccgcaagagcatccttcttctccctgaatgaatgttatccctgaaagaatgcagaaatgttttcgcgtgtgttctgacaattcctgctagataactgactttcgcatgttatgccagagtgcttgacaactctacctaaacttgacaaaaaaaaaacgcgacagcctgaaacagtgaaactgtgaaacattctaattatgctgtgttcctttttgcaagttctcaacttcttttcgcacgcacggttcccaaattgctaaacagagtgtcttttttagaaattttctatatgaattttgctttaagaaaatcatactaatccatttttcatttttttagataatacataattaattatttgctaaactattacttcctccgtttcacaatgcaaatcattctagcatttactatattcatattgatgcaacagaggaattacgtcgttttcccaacccatacctccgaaacacagccataactagcaatctggctttgagccatagttggaatcagagacaatctcagaagaaatcaccgtacttcaattttgaaacggcaaaattccaattttgcattcaagcagttcgagaatcatatgcgtcgattttttccaatcagaaggagtaggtctcgtcgctctcgcgtcgcgtccaggtgcagccgtcgttctgttgcaagcgcatcgcatgttgtacagtacaaaatggccacccacccccaccaaacacctttcactaccactcctgcacagcacagcctgcactacaccaaccaaccaccaaaacccttcttcccccatcgaaagcccatctcactctcctccccgccgccgccgccaagcctgcgcggcgccctcccctcccgatcgccatggcctccatggcgttcaccgccgccaagttcctccctgccacggcgcccacgcacctcgactcctccccgcgcctctccccgccccgcgccggtagcctctccttctccccgctctcctcgtcgtcgtccgccctcctcctccgcctccgatccccgtccccgtctggtccgtctgggccaggtggcaggctgcccccgccgccgcgctcctacggcggcggcggcggatctggcgacgccgcggattccgggggcagcagcggcggcatcctcggcatcttcctcgccgggtgggcggcacgcgtcgccgcggatccgcagttcccgttcaaggtgctcatggaggagctcgtcggcgtcagcgcctgcgtgctcggcgacatggcgtcccgcccgaacttcgggctcaacgagctcgacttcgtcttctccaccctcgtcgtcggatccatcctcaacttcgtcctcatgtacctcctcgcgcccaccgccggcgcctcggccgccgcgtccgccgccgcgtcggggctccccagccacatgttcgaggccggcgcctactccttgggctcccgcgtcgcgacgctgctatccaagggcgccacgttcgccgccgtggggttcgccgcggggctcgccggcaccgcgatctccaacggcctcatctcgctgcggaaacgcatggacccggcgttcgagaccccgaacaaggcgccgcccacgctgctcaacgccgctacctgggcgatccacatgggggtcagcagcaacctgcggtaccagacgctgaacggcgtcgagtacctgctcgccaacgccgcgccgccgtcggtgttcaaggtgtccgtcgttgctctccggtgcataaacaacgtgctgggtggcatgtccttcgtgctactcgcgaggttaaccgggtcgcagaagtctgatgcgccggccgcctcggcgactgcggaggaggagaaggagaggttgatagccgtgggcaatgacattgccgcagacgccgtcggcgcgggaagggatggagagggtaagtgagtggatgcataatgcatatgcttgcttgcttgcatcgctcaagcttcgtttgcggcttcttggacatgggccaagaaagctctgtagatgataagccggttggcttggcaataaggagtgaggcttgaaacaatttgttcagtccatctttggtgttcttggtttaatctgtcgacatgcttagttgatcttagaataaagctttaccttttttctgttgctcgttttggtcactggcctaaccggggggattactttgcgcgcggtaacttcaattgctttgtttgcatgcaattctgtgatccgatcagaccaacattgtagatgtaaggactgaacaaatgaaaatctaagcgttggggggttagtgatgtacaactcagataaaattctctagtgtttgcataagtgaattgctgtttgtgtgtttaagtgcagataattatgtctgcacagccagaaccagacttacctcaggtcttccactgtggcaattcgagttttaccttttccttcataaaccatatctgaaattggctgtttgactgtgtatcctgttttgggcaaggtagcttgtgccgaaatgctttggttatatcgatattcttcaccgtaataagctgtgcaaatttgaggcataaagattgccagtatccctcttatttgcacaattgcgcctaagctagcctttggctgtcaacgtgaatagtggtactccacattaatatttgttaaatggatagaatcacaactttgaaattaaacaagtgcacgaatcgtatcaaatattgtaatgcacgcgatatgaatcgaatactaacatagttcttggtcctagcatagataagttacgaaggaaaattgttccagatcttaactgattatggtacctattgcttgcacaataactcagtgatgatcatcatctactgtctatcagtgtttggctcctgtcttctgaatacggagggcatcgatagatgaatagtatattgatgtgcttttctgattgaattgtttgcaattccatatcgagccgttcaagttgatattatcaaagtttggtgagaggttccaaatgcgttccacctttccccttgtttggtgaaggaaaagacgattcctcagtgtcctcccgaaacagcaagcgcaaacacttgtaatcgcgactggtagcatttgccatttttgtttgctctgtaatcctcctaacacaagcctgaaaagtacaaatatgaagcccaattttaacacgcgatgagttgccaggtggactccggcgtcgaccatcctgcacgtaccgtgcatcaacgtactacctaaaccaggacgtgcgtacatcgcacgaggcatgtagtagtaaactcgtcacttgtcaccaaccaaacaatcgccttcgtccccttcgagttttaccactgtctgtcttctactcttccagcctatcgttttgcctatgcttatgtttatcattgaaaatttaatttttcaaccttgattttaaagtttattttagggttttttcattgaagtttatttttagcatttacttttatatcgctaagaacacacatataaaaatcttattcacaaattactttttgtttgcaaatataccgtttagcttattccacgaataggtcaaacgatgagaccattcatctggcaggttgaaaaagcaatgtactccctctatttttttaaaaaaaaacttaacctgggaaggcggatgtgagctattagtataacgaatatgaacaactctttatctagatttgttgtactagcctactaggagaaatcacatattcgttgaatttttgttaggggatatttagatctaggagtgtaaaattttggcgtgacatatcgggtattatatcgggtattcgggcactaattaaaaaactaattacagaatacttcagtaaacatcgagatgaatttattaagcctaattgatccgtcattagcaaatgtttatcgtagcaccacattgtctaacaattcgtctcgcaaattagttgcaatatgtataattagttatttttagtatatatttaatattttatataaatgttcaaatgttcgatacgataaggtgtaaaatttttgcgtgggaactaaactgcgccttggacgaacggagtgtgttacacagtgacagtttcccggtttgctacggcgagcaggttccgtgcgtaagcaactaatggagagagagagtcagtcagaaaaccgcacggctcgccaaatccgcaggtgcgacactgcgaggtcgaccgcgcgatgtccggtccctgacgccggtttgggtcgctgcgccgtggcaagaccggagacccctccggctgcggctcgtttccaggtggagagagagagagagagcccagcccagcagcccgtgatcgatccgcacggcgattgaagcggctgcccttgcctgccaccttgatcgatcgagcatgtacatgcccactgtgtccgtgtcacggtcacgcccaaaattggccgtagcgcgatggcagcatctgaattttctgtgctcccagctgaaggcagtccacgttagagcaagtttaataggatagtccactactagctttaatttatttatagctaatttaatagccaattcatataatactaggtctcatctgtcatacacacactgtattttggagtccgtgctgcagctagttataaatctatagctcgctgctcttctctcttatcttttatttcattaaaatatgtttatagctggttaataatctgctattgtaattgctattacgtcgagctaccagccgtgccagatgcgcgcgccggtgtgacggtggtgtcgttggccggcggcgtggtttagtcaaaccaaccggtgaaggggagagaccaaaaaggctctggattttcagatcttgcaatgacacttttgccatgtgggtgtctatcctgcggacacggatcctctaactttacatggtaaagtcacggtgtgactttcagaccatctccaccgtccaactcatccaacggaggacgtccctgcggatgctgcttcctggccattaatgccatttgattcctgatggcctaattctacctaaagattaatctaaataatactacatgagattagttcagtaactaaaaattacctgccactttgtgtgctaagttattttgtattttggtgattaaaatttataaaggttgtaatttgttattatatgaaatactaagttggtattcacacaaagaaataggacattgaaattactatggaacaactgaaatttaagcaaataattgtgtgaaacaaaagaaatttaataattgtgtaccaatcagcttctttcattaaccgagtcaactaaaaaatcatatcaaattttggtgttaaaacaaactaatcacatgcactgattgtacaattgtttgttgataatgctaattacagtagttagtcttcacatggaatcggcaacttaattagcacataaagtgacaagtaattatttttttttcagttactagactaatctcatgtactagtattggagtattgtttagattcattaatcgttgagtagaatcagcaaacaaatactagcattaatggccaggaagcagcatccgcagggacgtcctccgttggatgagttgaacggtggagatggtctgaaagtcacaccgtgactttaccatgtaaagtcagaggatccgcatccctatcctgcggccctgtcgtttcaccagattttatgccagttcctttcttctacgaggaccatggtcatgtgcagtttcaccacacatgtttcgtattggcacatgcaccggttgcccccctggatcgccttgataatctgcacaagttccaactctaaataagaaaagaaaaaggtgtaacacaagtggctagatcattgcttgtgtacctagaaaaaaaagcaggaaggatcaaaatacatactacaaaaccaaaagggagagatttctgatcaaaatagagctcgactgtccaagcttctgcaacttgcctcaatcatacatcagtgctgatgtaacataccctgccaattggcacgaaacaaagggcaggaccacgttgtttaactgaaccaacaattttcagtttgctcgagttacctaatgtaattttttcttactttattcaatgaattgaatgctgtcaggtgctaatcgttaaaattggagtttaggatgtgttcacgtcaaaattaaaagtttggttgaaattgaaacgatatgacggaaaagttgaaagtttgtgtgtgtagaaaagtttttgatgtgatagaaaagtcgaaagtttaaagaaaaaaattgaactaaacttgcctaatctgaaggccgaaacggtgcgagcagcagcagcaggaggctgacaggtgacagccacagcgccggatacgtggctaggtgaggagagcgtgaggctggctagcgatcataacaatggaaatcttccactaaactatgactaaaatacatattctccaccaagaaggaatcgatgaaatggaagcaggccggccggtgcgatctttggctacatgtgctgcccacaaatacatcggcatggtcgcaacgacagatccaatttggtgcctcatagactaacatatctcgcaactcacatgctttcatacactactgtcttcaactctcgagtacagatctctttgtatcgattgcctatttgcctgattgtctcacatggacgctgtgtatatatataacaatggacttgatcgaataacatcctcactaatcacttctcagttctcatcattgttcagacagttcagtagcttctctcctcagctaaacacacagcaatgagatctgtcagcatttctgtctacttcctgatcatctctgccttgctacttctgcattgcttcctaagcctgcagacagcaagattgcctcgtgatgattgggcatcggaagagaggtttcagtcaaggaagctcctgcagaatgtgctgatcacaagttcagagaatccacaggtgttccttgaagcagcattactagtagataacaagagcaagaagcagcctgacgtcgaggcgaccgagagcctgaagaaggagacgccaagcaaggccaacccgattcagaattagtcaattagcaagtgcagattatgactccggttggagactgatgtgaagtctttgtagactgaaggctgtatagagggatttttgtatgccgttcttttaactgaaaccattcgattcatcattgttttatactagtatataaagctagacagaaaaagagattttgtttccctatttccatttgtttgcatctttttcagtcacactcaactttatcagcccgtcaggtccattgaaagaggttggtttggaaatgcatattgagccctgtactgtttcttttgttcagatacagatatgcaaacaaagtgaacatggaccatgaatcctacgggagaagatgcgccatccttatgcctgcaaacttggctgcaaatatcctgttccattatgctacagtgatctttattcccacacaaccataaaaagataaaaatgacctatttgatgagcctacttgccaattatcgtagcttttgtaaaaaggcaggcacttgtatgataaggcacatatgttaaggcgttaggaatcaatgaatcattgcactgaacttttttttgagaactattgcactgaccgaatatacatttgtccgtatccggtcctctccaacctaaagcatagtctgtagtactagttctctaccgtcacgatctactcctatttgttaatgaatttggggcatatgaattccacgtgtattccaaaatttctcctcaacaaaaaagaagcactccttgcgttcactgttcagtgatttttaaacagtccaaaaatccgggaagtttggactgcgggatttgcagaagaaattaccaactgggctggcttgatacgcaaagttggcccagtaagaatctgggcttgaggccgtcgatacgcaataatgtagcccaataacgcaaggcccatctctcacgttatatactcccccctctgttcgaacccttgttgacgctgtaggtttcccattcccgccgccgccgccaccgacgccgtcgccgacgatcccatggctcccgttaagaagacggtggaaaacctaagcttttatttggttttgaaagttcttgctgtgtggctttgtctcttggtgtgggcgtttgatcgatgggtggggtgttcgcggtgttttgcagaagaagaacgcggaggggatcaacaacaagctgcagctggtgatgaagagcggcaagtacaccctcggctacaagaccgtcctcaagaccctccgcaactccaaaggtagctctttgattcgtttcctagtcaccgctctagcttcattcgttcatcagtcaagcctggtacatatagtgtgataaatctaaatcatttggaattgggggtggggtggggggctgtaaattttcggggaacacatcttattatgttatattccagagtatagcatggatcttgggcagttttgccatgacagaaagttgccctctgtcgtttggatgttgtcatttttactcatgtggatgtcagaatgggactggagtttggctcttcggcttgccctttttgtgtcttagagatgaatgcagcgcccaacaacaattcatctttccttgctggtgttctccttgatcaagtctaggggactaagtgagattgaaacatttactgcgtcactgactcaccgttgcttgtatgcgcatcactagttgtttctactataacttacaataatgtaaatgtcctcagttgagagaacttttgtcagccgtatagtaatttttagcatggtaattcatgaaataaaactgcaggctttttcattttataacaagtttatccaatcagacatgttcaggtgattaggatgctattgccatgtttgtatgattgtccacggtgaagttgctagttggcacaagggactgaagtttggccctttggctttcctttctcagccttagggatgaatgcagtacccaacagcaatatagtttcttttccttacataaatttccagacactcccttgttatctgggaaagtaaggagctgaaacattttgtcttacctttttacatagatatttgatgtggtcagttcatgcgttttcttatgttatttctatgagttaaaatcgtcctatttccagtttatgattaccttgctgttttttttgtagtgggcagtaggtgtttaattttcacaactatatctttatctggggaattcatgcatcttgaaagactgttacttctgtgaatgatatacagtcttgcttctggtcaccatgattgtgttgcaaggaattaatcattaaagtgttcatcattatggtgctatacgaatctacctttttcaccatggaatttctcttccaatgcttagtagaaatttctatatcagcttattcatcaatgtgctaccttcttgataccctgtttatccattgggtcctgatactttcacgatctgttttgaatcttcagggaagctagttatcgttgcaaacaactgccctccacttaggaagtctgaaattgagtactatgctatgctgggaaaagttagtgtgtatcacttcaatggaagtaagattactcttcattcactgaaccacacatgatagctgcaaggctttcttttttgcattaatttatgcctgtgcatgcattagcctgtttataatttgattcgtcaatttcaacctctcaaataggctaaccgttatgtgttggttaattcagacaatgttgatcttggcactgcctgcggcaagtactaccgagtgtgctgtctcagtgtcgtcgatcctggttagtttcagtgacttcaatctttgaacctttccttccgcatccatatgaactctccatttccgttctttttttcatttgaaaacaccaataatgcttctcttgtaatccaggtgactcggatattaccaagcaattacctgagagtcattgatgtgcatgcattggccttgtgaccgatcttatcttcactttttgctcacatgaaaaagatatatatcttcatacggtgttcttgtgaagttgcgatacattgatgaaccaaacctggcacacttcaatagcatcgcctagttttgctctgctaagcatctgtcaacggtaaaggtaggagtgaaatgtatgtaggatttggaggtaatgggaaataaatggtgcaatctgttttactttccgagtattctcaggctgtcatgcatcaagtaaatttaattagatgacaagcagtttcaaaatccaacattgtcttgatgcgcggtgttggctgcagctatagatggccaaaaggcccgaggcccgacggcctggcccatggcacggtgtttaggtccggcccaagcacggcacggcccgtcaagggtcgggcccgtgccggcccggcccgaccaccgggccgtgcctgggcctctccgccggcacgttgggccggcacggcacggccgggccggcacggcacgatgggccgcatgccaggcccgacacataaacaatagggagtaaaaatagacattatatgccacggtcgaaagaatagggacgtaaagtagacttaatttacatatatatatatatgtcagcccaaagaggagggacaaaaaatagacttattttcactatatatatgtcaccagcccaaagtggagggacggaaaatagacttattttcgctagattatgtcacagcccaaagaggagggacagaaatagacttattttaaaaaaaggcacgatgggccacccgcgccttcgggccggcccggcacggcccgacagctggtgggccgtgcctaggccaggccgtgccgggcgggccttttggccatctatagctgcagcagatgatcaaagccatgaagaaatgaacttgtcccgcccgcgatcgaaaacgcccgtagttgcgcgcctgcaaatccaacttcgcgtgcggtgtgccgtgcgtgtatgtgaccaccgtctcggagactcggagtacgtaccctacgccactggtacggggtaaataatcgcaaaacccacgcgctcgcgggtgtcgccgaaccggaagcagcgcgcgcatcgtcgttgggtcgcggtcgtggctaagccgtttcctcagcttccacgcactctctcgatcgggtcgctgccgctgatttgcccaagtagatttggactctcgaatcctagtcggatccagccgcgcgcgcaacacggacgcccgggtgttatattttccggtcgacttacgccaatcaccaagtcgcgcgtacgcacggtcgcgggggcagcctgcatggggaccgtgtcatccagcagccgccgccgtgcggccgggagccaaccaagcagcagcagctgggtgaaggcgctcgacgtggagaacgatgaggaggcggcggcacgcgcggacgcggacgcggacgcgcacgcgctcgaggcgaagggcgacaagctgatgtcgcaggcgaggcgggagctgcacggcgtctggtcttacgtctcgcggcccttcattgtcgctgccagagcgcgcttctacttccacaaggccgccgaaaccttcgtgctcgccaacagctgtgagtctctctctctctctctctctctctctctctctctctctctctctctctctctccgtactcctctctacgtacgccaaccaatcgcgtcctccgtgttttgcacatttagatcaggttgttttacttatttcagccgtgttttagtaagatttcgttccaaaagaattaaattggtaatgtatacctcaagtttatttgctcaaattgaacgcattgcctcatttggaggacgtttttttttttctgttctctataagatggttgtagaattactgcactgtgaatgcgcttcaacgatgcgaatcaaattacttttccatagtaggttgctaaacattgtgtgactctttttcagggaggaaagcggcggctgcacaccacgaacatgccgtttgttgcatgaaggtcagtgtgtaatatggcttacgcgacttttaatttctttcattgctaaaaccgctctagacacatcttttgatgatacattcttaatttatgttcttccaatatttcagattgggcgatcaggtaggctcagagcggcatttgcgctcttcgaggctggaaaatgctacatgaaagttcttgaacctggtaaacacgacacgtgaaaccctcacgcacgctctctacttcttaacatctactgtactaactttcaccacgtagtaagtatatattcgctaaccatcgtcatatgaaaaatctcttgactttctatagatgatgaggagatgacgagcagaacggtgagcgacctggaaaaatcccttcgcatgtttgtcttggagaacgaattggtaatggccgcagaagtctgcgtggagctagccaacttgtatgccatgctgaaacagtgggaaaaggttagggagtacagacaaaaagcggcagaattccacgcaaagacgagtgatgcgttgttcgacacttccactgtttagtactacctcttttaatgtatgacaccgttaactttttattcaacgtttgaccatacatctcatttaaaaaattcatgcaattatcatttattttattatgatttaattcgtcattaaatgttctttaaacacgacataaatatttttatatttacacaaaatttttgaataaaacgaatggtcaaacgttggtcgaaaagtcaacggcgtcatacattaaaatacggagggagtatatctgtatatgtaggatgttgactgtcaaattgtgagatgccaagatgatcaatatatatatatttttgaaatctaagccagccgagctggtttatattcagaaggaaaacactgtacagaggtcacatatatcccatacatcggattccagagttgcactgttccagagatggcgttgttcgatcatatatcccatacatcgtaatcacacggggtttgctcgagctgctgcgccctcaagaagacggatgcggcagctgacaaggcttcctatggcacggcagtagcgaacaccttgctcgttggggttggggccactcccataataatccttggcttgtaagaagcaatgcactgcagcgtgcaactctctctgttcctcgtggaactcagctagctccttgcaacatgtggcagccgattgcatatcattgttcttggtgaacaacgagaccgccttctgcagagcaagcttgatggccgccacctccccctcgtctgcattaattaatcaccagatgagtaaatagtagattagctaacttgactattaacacatattaaagctaacctatataatatcactactaaaaaaatacatcgaagttgacgctatagataccggaacagttaaaaccgatacatatagtgtttttcctatttctgtgggtgcgaaaatacagaaccaaaacctttcaaaaactatatatgtcggttctaaataaaaaccaatacctataccataaatacatatatatatagtaaatttgtttggtgctccatggtgcccgagcaccattgttgaaatttactatatacccaattcaaatgagtatgaaactttttcaaatatttaggtattaacgttaactactttactaactagttcaaagcaagtttgaactgaattcaaacttgcttttgttagattttgattctagttatatagcatccaaacatataattagttaggtatgtaataatggattgtgaaataaagttaaatttgagttgttttgttgctaggtataggtatgaatcgaatacttataactaggtatatactcacaatttaaaaattttgaaaaatttgggcgaatttgtgtatttcataccatggtgcccgggcaccatggtgccccatatgagtgtcctgtatatatatatatattataggtggtagtttttatattataaatattggtttaaaaaaactgagcggagcctagcgactgatcaacatgcatatatccactattaaacttgttctaataacgaaactaatcagataattaacattgctaattctaagtggagactaattcacgacacgattcactgacctgcattgtcctggatcttcctgtagcatctcgctgaagcgaggagcgctacagctgcgaccaattctgcaggtggcgatcttctcttgagcctctggatggcttcgttgccgaatgctgccgctgcttttctccctgcatatataaatcaaatcagatcaacggaagatcggcaagtaatcatcgatgatgttacaaatcaattaatgttcgatccaatcgatcgacgttgaagcagtaacatacagttcttggcgaggacgtaggagagactggccatcctgaagtcctcggcgatggcgaaggccgtgtcgtgcttgaacgacgtgaaccaccagcttgaggctcgccggtggcccctcgccatgaggcggtcgccgcgcgcctcgagctcgtccggctctagcccctcctcctcgaacatcgccggctcgtacgccggcgccgcctcctcctcctcctcgccgccgcgccgcgtgatcggttcgtagccgcggcggcgaatgcggaactgcagcagggacgccatgttaattccggcaacgtcgacggcgaccacggtgtacgtacgtcggaggcgaggggttcgacggcccgctaatcagttgcacccggactcgtgtgctaacgttcgatcgatgatggtcgcgtacttgtataaaggcggttcataaacgaccaaacgacaatctgcttcggaatcggagtgcataaataaaatcgggggtttgccatcgccgcgcgtactcgcaaacaaaacatctgtggtctattgtatataaacttcggtcccatagtatataaactttaggtggtatttagatccagagatgttggagaatgaacttctccaccagagaaccgtgaggcccccctttgtgagttcggccgggggcagcgggtgagattcaagggcttggtgagtggagctgtgtgatcttgaggggttaggcccctccaagacgatgaaacaaaagaggtttatacaggttcgggccgctgagaagcgtaataccctactcctgtgcatgattgattgaatgtagaacgcaagtgcttggggttgtgagacccaagcaccagttcgctcggaagtccccccctccaccactaggactggacctccttttatacctcatggggttaccacattggcccaacaacctaacctaactccggtggagaagcattataatctttgcattaaatgcatgtcttgtctcttgacttgggaagccaagcacacgtcgtttgaatgatggggcctgtcaaatcttgccgcctgacacgggggtgcccctgttagtcaccatttaatgggtgaagacttctgggctcctattacaccgggaaacgggagtcttgctttgaccagagcgggaggaccgattccggttgggataagaggatgagaacctctcaccatcattatttgatgggatatgtcaggctgcacgtcgcctgatacacgtgatggtgcgcctgacatcttgggtcccatcagtcattcgaccggtcacagaccggttgagtgcattgcacaccgcattaaatgcggcgtggcgtgaccgctcgggtcgccataaatgcgggtaggtgggcacctggaggcggacacctaatccaccgtacgtggtgacctagagagggggtcggaggagcccaacccctagtcacgggagggggcggccgccgcccgacctcgggcccgatcccccctcgggggggagctcacgtggcgcctagggcggccttctccctctagtctcggccagggagtggccgccgccctacctcaggcccgacccccctcgggggagggccacgtggcattggagggcagcctcctccatccagtctctgggaagaagtggccgccgtcctacctcgggcctgactcccctcgggggagggccacgtggcatcgggggggcagcctcctccgactagtctttggggatggagtggccaccaccccacctcgggcctgactcccctcgggggagggccacgtggcatcggggggcagcctcctccctctaaacctgatacccccgggcccatatcaccgacaagagacttaactttagtctatgtatttagacactaatttagagtattaaatatagagcctgtttggggagctttagatactgagaagcagctgtttgatagccagtttctgagaatctggaaaagctctgaaacccagcttctctagcttctgccttcttagttcacttttcagaacagaagctgtggattatttggggcagcttctagcagaagccgcttttgggaaaagctgcagctgggacaagctccccaaactgggccatagactacttacaaaactaattacataaataaaagctaatttgcgtgacaaattttttaagcctaattaattcataattagagattgtttactgtagcatcacataggctaatcatagattaattaggctcaatagattcgtcttgcgaattagtccaagattatggatgtgttttattaatagtctacgtttaatatttataattagtgtccaaacatccgatgtgataggaatttaaaagttttagtcccatctaaacagggtctaagacttcacttgtaatacaatgatgcactggttgcgtattccaaaaaacatctatgatctatctgtttcagagcacgcagttgtgtaaacgagaaaggtccggaggtcttctggctagctccataaaatggtgtgctagataacctggtttggagcctcacccttctaattactcctttcgtttcacaatgtaagtcattctagtatttcccacgttcattttgatattaatgagtctagacatatatatctatctagatttattaacatcaatataaatgtgggaaatgctagaatgacttacattataaaacagaggaagtatttaatattaggtcattacctaacattcatgtcgtgtaaacgatcaccgcgtcgcagtgtcgcatcatttaggcgatccaaaagagaggccgaggggacgagccaagagcgactggttgctggcgcgcgcgggggcggtttagccgtttcattgggtgggctcgggcttggcaactgacaacgtcagggtcggcgctttaccgcaactcgcaaagtaatgtacataaatgtagcgtgtcaagcattgttacatgtactacaataatcttcaccatttaatttagctagatataagttataaaaaatctagatacactcatgatatgacatatcctagtaagaaagaatttagtaataaaaaatgagtacgtatagcttttttctagattgtccatctgcctacttgcctacatcgttttgatatcacatttaactccgtagtttcgtttatatttatgcttataaacgaaaattgtaaaaaaaaaattgtgtgcagctgtgtagattttcattaggattgatgtagcagagcattccctttttatggactggattcgaagtgtggtttgcatgttcaagtccagatatggaatgtgctgagactttgtatgcacggacttgaattttcgtactcgcacaattttgaacatctgcaattgacatctcgttatggtatactgtagcctaatagcagagtactgttgtttgaacgaacccttgctgccggagtgccggtcttaagatttttgctcttaggatttagtgaagaatcatgcagaattcagtattttattattatttttttcattttactgtgatgacatgctggtcacactcacacatggtttgcatgccaggactcgctgaaacacagtttaaccataaagtgggtattcactataggggtgggcgttaagtttactccgttaattcggctcggtttcaacggtttaatagaaattcggttttctagttatggcaactgaagaatctataaaaaaaaaaagaacaccgagccgattaaaccgagtaacttcggttcggttgttcagtgttaccgaacaaaccgttggaacacgttgccataagactgaacagaagcagaagggtgatgcccgaaaaaaccgacacttcggttttgttcggcttgcggtcttcggggatttttttgctcacccctattcattgagatcaacatgttgtactaattgttgtagcatggggaaaacaccatcccctgattcggtcgaagacgcataacaaggaaagtgagttcgagtttggcaggctgcttaagtgaattttccacataacaacctgcaactgggaattttcatttgcctaaaagggcccgttccaaggataatttattcgagcaaagatcacttgctcgaatcagcatcactaacaatatcaagtcatcaaacaaatataataaaacatccgacgcctcgagagaagaatattggagacattgttgggcctttagcttgccagtcaacttcagcctgagatgtgcccgtcaaaccactcgaaggcggcgaccagatgtgttacatattcatgagacttgacaaaaatggctaaagatctacaatatctaaaatattcttaactcatactcatgtgaatctagttcccagaatgtacactagattcacactttcatcttaagcatgaaaatacatagcaaaatacacattcaaatcagatttgctttcaaataaattcagcaagctagtacttagcatatggccatcaaagtaggcattaatcatgtgtaaatatgcacctcattgccattcatggcagcaaggagatcattctcaaatctcatcataatttgaaggtaaattttagcatttaggagaataaacacaagtctatactcaacacatatccacataccgctcataaccgcgagcacggctaatccattagtttttagactccgcaaagtttgtacagctttacccacatgatgtgaatcgctctagtttgtccggtacccgtcggtaccaccatactctacacattgagtgggtctagaggtcacaacgaggcttttacattaagtcttgtttaatccttgcatgagcacgatgagtgttgttccacactaagtctagaatcttaatgtcattatattggggggtctttaccaatataacgtcataggcaagccggtacagtcgcttcctgtgtggcactcaacgttgtaagtgaggcggaacattacagtcgtcccctcacgcggaacagtacagtcattccctaccaaaccataaataaaagtgaggcggaatgttacagccgtcccctcataaacatcatacacataaaaggcggattggtacagtcgtcccctttgcaatttacataaacacaaatagccctacagttcactcgtaggcactatcactactacaacggccttctaaatgtaaggttagacaaacacttaacataataggccaaggtcgccccataataacacatgtggatgtacggtaaacataatgaacagacattgagtgacgttcttagatcggtttgggcgcactctcccccatcggtac

SEQ ID NO: 62993 - DNA, 2108 bp, Oryza sativa
attcgcttagtaggtttctagctagttcaaatggataaaccgtgtgtatgattaattctgaatttcgttctctttacgtcgcatgatttattatcgagaagaatatttatcccaaagagtcaggattgctaaaattatgggggtcttagtttcagtcacgtcatgtatcctatatgatactctactaagtatgcttctctctatctctctcatttcctcttccaagtagataataattaaattaattttactcctaattcttataaactgtgtactaaaaaacaaaaggtaaatattgaaacttataatgtaattatagtttatgttttgaaatttagcgtgtaattaactacaatgcaagtgtatgcaatatattgtagttacctttcggttttcataaaagaaaatgtatctccaaattaggctgctaaattatacttgtaaatgaagctctatatattaactgaaatacttgttaggaaaaattgatataaggactaacccaaacgaatgaacatgaacactgaacagaaagctgcaaactacatgtacatatgcattgcatacgggatataccgggcatatggaaaattaaatatagttgattgcattcagagaattatagatcaatatatttttatctgcttctactgtcattaaacaacttgtcaaaatcagaattgacaacttagaacttgcaagtttaatggaataaaaaaacacattcaatatgtaaaagatgatcagcaaatagttgatcattccaatcaaaaccataaattgagtgcgtcctaattaaatagactgctaaatatgtattgcaaattgaacatgcaaaccatgcaaattcaaaggaatacatatatatgtatattgtagatgcagcaatagatctgtagcagatgcagtgacggatgtgcaagtaattttttattttgtagcaaacttttttcccccaaaattcatttggttaaatttcgtttcaggttaaaatttattcaatctttatggagtaaaaacagtacgtcaaaccagagacttaatagggatgaacgatacctctggagcgatcactgattcactggaaacttttaacttctcctcgtgattgaggcaaattgtcgctgatcgggaccacagtctgggatcaaggtcgactgcagcctatgcatatctcgtcgccctcgctcacgtccttctcgatcgcgttcgccgtttctttatcgcttcttaatttccaatctgatttctcacgatggaacttggagataaattagatgggttctgtccttccatcgataactggatagataggatttgcaaggagcccactgagtttaagattgattggcccacgatgttaaagtattgcaggatctacggtgtagattaaacgacttatctaattgacgcttagatctttctggttaacgtgagagctccaaaaaagtgcccgattagtataggtatagattgcccaatttgttctgtaaccgcaagatgccatgaactatatatttaagaacttgtttcacaaaactatatatttaagaacttgttttacaaaactataaatttagtgtactcgtttatcacagaactatacatttagtgtcttcatttatcacaaaagtacaaatttagtgtctccattatcataaaattacaaatttaatgtcttcattatcacaaaactactggttttaacaatgctaaaacctgtattttgtgataatgaagacaataaaccagttttgtgataaatgaatatattaaatctgtagttgtgtgatatatcgtgcaaagtatctatagttttatgataagcgaagacactgaatctatagttttgtggaacatgttattagatctgtagttttataatagattgtgtaaaatatctataattttatgaaatatactcaatatttttttctaacatgaaattttaagaattattaaagacaaatagaattataccgtggctccactactcaaccaatcacaatcctccaccatttacttctacgtactttcttaataaccgtgtccaactctaaaaatgcttataatgtgagacggagggagtaaaacagggctgcaggaat

SEQ ID NO: 62994 - DNA, 2507 bp, Oryza sativa
acatataaaacttcagtttccaatctgagcacgacaacatcacgcacccgctgcctgtggcctcaagcagtgacctatgcctcccctatcacaaaaacgagacccgtggcggtcagttgtcttttgagctgatagaatttttgctggtgggtctcacgaatctgtcttccatagttattaggatcaaaccggatcggcggtccgaccggggaaaaccaggtcagaccgggctggcttttggtgatgggctgaggcgaggcccgctgagcaaagtccaccaaaaatcgctggaaaaggatggggattcgaccttgggcagtgacctatgcctcccctatcacaaaaacgacacccgtggcggtcagttgtcttttgagctgatagattttttgctggtgggtctcacgaaatcgctggaaaaggatggggattcgaccttgggtcgcacggttgagagctgcacgcgctacccaccacaccatcgcttcgcttctgttggtctaagacattaatcctataatactttaaatcgcggttggaccggccgaaccaccaaaccagtgaaccgagacctcgaccggctcattctccggtccggtatagaaatcttcaagtaaactatgctgtcttcaagtgtatagaaatcttgtgaccgccacagttcatagaatatactttactcccttcgtttcatattatttttttcactcaaccagttttagctattaaatatttttgtttcactgattcaccagttgcacatataatagttcattttcttaaaaaatagctaccatatgtacccacgtgtgaaaaccctgttttcgtgtgcgatttgtgctgcccatatggaaagatactaaaaattattttttatagtgataagcgcccttatagcaaaaaaaatatttagacctagtagcctgcaagaacaggttttagccaaatgcgaaaatcattttttatagtgataagtgcccttgcaacaaaaaataaaatctttataccacaccaataagtaattatatcactacgtgaaacccacatctctatcatatgttccatccacaacgtgcatgagacccacccaggttcatgaaaaaaggcccccaaatatccatcatctaactctccgccaccgtacaccaaaaaaataacatatgtaatttggatttcctatcacaacgcacgagcatgtttgctattcttaaaagaaagaaatgagagagatgaaaggaaatggttcacttgaggtgccttatcttgaagtcgagtttcgaaattgaccctgaattgaaataccagatataacagatccctaatcttgcaaaaccgggtcacattaggtcccaaggcagtattgctccccggttttggtgacgtggtggctgagtcagcgtggggcccatgtgggtcccacatgtcagtccataatcttctcccacctatctcacctttcttcccttctcaacccaaacctccagggcagccgacaacaggtagggagaagagtggcgactgacggctgcgtcatggacctgcacggcgaagagcgcgaaaaagcgaagtaggaagggctcccgacacatcgtccccttgggttacaccacaacattgttgcgtggcagctcgccgcgcatctgcgccgtgtccgcattgtggtcgcatgtcagccacaccgtcgggattggtgagagaatctccaagagttgggagatggagtacgttgcgacgcctgagtatactcgcgagcaccactgactccatgagtgcccgtgcatgcacgcgaagaggacgctagacgctgaattgcgggagaggtgtgtggtggccggtgaccagtagggagaagggaggcggtcattgggcggcggcggtaggtagaagcccgacgacggcgcctggcgattggtgggaataaggttggcagccaacaagaagcttggcggtggcgagcgttggggagaagggcgcatgcatcgaggacgatgcgaccgcaatgtggagtagatggagttgacctcgaagacgatgcgggggagccgtgcgttcgcctctgcggaggagaagcgaagctcggggacacctgaacacatcggcttttgagcagctcgacaggggcgactatgagcttggggggtaggagcttggccagcgtgacgaggcggaagccccagccctcatgcgtgctggtgaaaacgacattgcagttgtagttgggacccgcgccacaccccgcacgcacgcaagtccatgacgtgagcgctcccggccgttgggagccacgtcagccggcagcctccgccgtcaagcttttccccgccaaccgacacccttctccctacctattggcgaatgccctagaggtttgggttgagatgggagtagaggggagtgaggtggaagaagattgctggttggcttgtggggtccacgtgggccctacactgactcagccgccacgtcaacaaaaccggaaagcaatactatcttgaattaaaagtgat

SEQ ID NO: 62995 - DNA, 2918 bp, Oryza sativa
cgcctgccgatctccatcctgctagcagaggtggcgccggcgtcctcctgctcccgccgcatttgcatcctaatccatcccatctggcctcggcctcgaatttcgtctcctcgcccaccgcttgcgccgatccccatcctgcgagcagaggtggagcccggcgtcctccttcttccaccgcatcgtcgttcgccggtgagcatccctctctacccatacctcatcaggtattctgcgttatccctcaaaaagtttgggggttagatctgcctctacccagctccacctactttcaagttgttaattttgatttccgtttttagctgatgtaatttggttactgaatctcatccaaacacccttagaacgaaaaatgtaagctcacatactttgtactcatccaaactcacataaatttcttaagaagaatctagaccacaaactactcatagtcacacaatatctttttatcaaggtatactcttataagaaattttcatttctcaaaattttctaaaggacatactgtgacacttggcattaatctaatttaacttttttttctttatcaggttataaattttctaaaagacatttgtgccacttggcatgaatctaatttaacattctttctttatcaggttataaattgacaccattgaacgtactttatctttctgtccacacatggctaccaccgccgcgacgaccatggtggcggcggtgcaccacccccgcccctgcttccgcgtgcgcgccgcctgggacatgaacccgagcgcctcccccaagcccaaggccaagcccccgcctcccccgccgccgccgttgccgaccgcccccgcccccacccacgccgacctcttcgcccgccacagcaacagcgagggccaaggtaatctccatccctcctctccgctttcccaaaccgctggaagcttatgagaatattgtgtgcttaggtggtagtggcgctgaaccactatatatgacatctactgaatgtgtcttaatacaatttctatgaaatgattatgtagagttattgtcttcgattgtcaagagcaatagaatggttgtgccatctgtgtctctgtaatcggtttgttctagtgtgtgtagttgaaatggttggtctgaaaatgtctgaatttgatcgatggtttgttgctttggtttgcagtgccaaagaagaccacaagtatgggatttgaaaggtggtggttaccacctccgccagaggtgaagaagccccgttcgctctacaacgctgcatcattggcgtacttgggggactgcatatatgaagtgagaaacagtttgactcaattgtggttatgcactgaaaattgttattatgtaattttattacatatagctcagcctatttgtcacttctatttgtattggattagtaagagataagatggtgcatataacgtgcacaaaactttcaacttcaggtctgtatactgtaggatgatctgataagaatggttctgctctttgattatgcagctttatgctcggagacatttcttctttccaccactgagcatcaatgactacaacaagcgtgtaatggatgtcgtgaaatgtgaatcacaggtttggatttggctcttcatctttctaatcaaatggatttgatagccagattcttcttattatctatctttttgggtctgtgctttgcataccttgatggacattgtctgctataagcaaaaatttactcaatgctttccatttttatggctgttgttttcaattctaaagggcagttctcttgtttgttatttttctgttctgtttgctacatgataatcacacaataagtatatcaaatattatttacattatttttggttattttcctttattcaggaccttctgctgaacaaacttcttggagaagattttctaactcaagaagaaaggtaaaccaataattctagccttctgccagatgtaaaatatatgctaatgataaaattcttatcaggaaattttatgctctagtgcccgtgtacatgactgaacttttatgggatgttagccctttagtgtccactgtccaggacttgtaaattcatctatctaggacttgtcttttgttgtaggccatctgttcttttatttttggatttttatagtgtttgatactatcttctgtgtccgatgctgatatcaatgtgcgcatgcttcagaagtactgaatttccttattctgcagggacatacttcgttggggaagaaatattgttagcagcaagacacgtaccagaaaacgtgctggaattgcagtttataatcgagcatcttcacttgagacactggtgtgttccactatagactaattaatgattgctatattggggaaaaatcaactctaagctgcaacttctgttgtactaccctcacactacttttgttgagaagactacatccttgcgttgttggttggtatttctattattagattggatatctttacctcacaaatttcaagcgcttggagcaattgatgttccagttaggatttacaagtggtgcttcctcacatcatattgcagatgagctagtctcaggctttaagtaatgcatcgttggtttcttgtcatgtaattaaggtatttcatcttgactttctgttactaacggataaccattggcaggaaaaagaactccacttctgtacaatctcagcaacaagcagcgcagtgaatagtttctgtattgcagcaaacatggtatgatctaaacaatagttatctggtgaccacaaccagcacaaaaattcatttagttttggtgtatgacatccaaaagtggttgctcaatgaatgaatagcaattaccgtttgtctgtcaaacaagtatcgagtgaattgagcaatgtacatgtatgcaaatat

SEQ ID NO: 62996 - DNA, 710 bp, Oryza sativa
atggctcgtttgggggtgcaaccaaaatacaaaatgaagatcatgttattgcgattccattcctctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatgctagacatggctggggtagctaggttgatgacggcggctcgtgtaacggctcggcggcggcaagaacctccgggtgaacggcgatggctcaatcagctccaagaactatcatgcatgtgtgtccatgaggttagagaggccccagggatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggtcgaggcgaagacgctggcgcgacagcttggcccggcttggtccagataagcgggaacggcgatgatgtcactgcggcggtgcacagagcgcgctccagagctccggtgtgcacggcagcgttcccgtcgattggctgcaccagagaggatgaaatcaaaaggagaaatattcgccatggtgggctgcaggaat

SEQ ID NO: 62997 - DNA, 9789 bp, Oryza sativa
  unsure (1)..(9789): unsure at all n locations
nnnnnnnnnnnnnnnnnnnnnnnnnnnnnnnnnnnnnnnnnnnnnnnnnnnnnnnnnnnnnnnnnnncgtgactgggcgctatcttgccagaagaaaggcatgcttggcaaaattattgatccacatctccatggagaaatcagtcctccctgccttaggatgtttgctgattgtgcaaaacaatgtgttgctgatcgcagcatcgacaggccgctgatgagtgatgttctttggagtctggaagctgcactgaagctgcaagagaatgcagagaataacaaaaaattcagtgaagcaacaacatcgtcaaagagaacaccagacttgataactatcatgggtactgacaaaccatcgacctactcaacaatgagcatcaccggacaaaagatcatcttctctgatatgatgcacccacagggccgatgaaggacaacagttgaggatttcaattaatttctgatccagagttcatgtattgatgatcttttgatcgcaattactagaatattgcattattgatcaattgtgtcagtttctgtctaactagaaccaaatgttagtgattctaaattccgaataaaaacccaatgctacaggtttgactagttttttcttgtttctgaatggtaatttaacttatctagctctatgcaaaggcactatatttccgttctgtggttcagctgtcaactgtactgattcctgatgtttccacatatccacattacattaggaacaaatatccagggtatctggagacggaacaaggctttgctgattctttaacattcatcacaatggttctttcatatcaatgtgaatttctgcaatgctatgaattggagcacactcgacacacacagtgttgcttgcactggctgagtgttgcatgggtcatgtgcatggtcaagaacaatgacctactacaggcgcaaatttctcatttagtctttctcgactattataaaaatagaagatctttttgccggtatattttggtacttcatccgtatttgagttggtttttaagttcgttcacttttggaaatacggattcatgtttgagttggatttttaagttcgtttgcttttggaaatacaaaagaagtcgtataagaaatttctttttaaaaaaacttgcatgctaacttgagattaaagtcagacttctaattgcagctcatgattttctaaaataaaatatccaagcaaattttcacagtgaatttcatcctagctaaaccgtataacaataataagattaaaatagcattcatccgttgcaatgcacgggcatattttctagttattaaaaaaaagaaaggtgaaggtatgagaaattgcctaaaattgattgatcgagcttgggagaacaaagctgtataagaatattaaaagccagaaacaataaagattagtttctcgacatcaaaggttctcatacttttgccaggtgcttgagcttcctccttaatcttctacatgaaagtgccatgaattgtgctgtgttgtaagcattcctctcgtgagcctcccaggcaaccaagaagcgcaatgctggtcacggattgtctcagaaaatgccgatcacggacataatgtgacaaaaggggtaaatttctaggtactgatcacatttctttcaggtgcgatgtctattgacaaacaaaaatcatatggtatgtgatgttcttcaccccctttgctaatcttccttacctcagaaaatacgaatctatgttcttaggtgttttgtttctgaggtgcaaggtgtaacctaataataacatatcgataagcttaaactgaatgataactattgaatgcttctttaaaaaaggaaaaaaaacaaggaccatggtgttaggaccacagagtcttgctcattggacaagaacactgcctcaaaggatgcctcttattgtcgcgcccgaaaatcaccctaaaattttatcgtctaaattatttctagaaattgtaaaagccaaaaatagccttcaacaattaaaattcaccaagtttcaactcaaattggcgtgtcggaatttttgtttgttcctcatgttttaaaacacttaaccaatttttactggaattttcagagcattctaaataattttaatgcaacactaacctttctcagttttatctaaaaacaaaaactaaaataaatctctctccctctccttgggccattttcggcccatctcttcccccccccccctctctctttctctacacatgttttctttagaaaaataaatcacaaattcacaaaatgacattcaaagaacacctaaaattcaaatagccatatcttgactatttgaactcggaattgacccgttcaaattgctaatttttccttaaacagtaaaagaaccccattntaatggctttgctccctgcacccttatatgggnttttaatttatgttttggcccttctttctttgcgtatgtcgtgtagacactgcatatccggaagagccgctctacctagaagttgatcaggagattttggtagcgagcaaggcaagtcatgtcattttgatcatattgctgtcctaatttataaaattatgtttatttaaattattgcatttcgttttattaaaaattcccgcgtttatcactgttttatttagccttaccgattctccttgttatagccttattatttgtattattatgatccttgataactctaggaaaaatgaaactagtgagaactttatatatgtggtgcttactagtaaaattaggaatatgcttagccctggttaaatagaaacaaatagatgttttccaataattagactttgggaataacttttaaataatggttaatatggtttagtggctgtttagccatgacatgatatttccccttcaaaattccccaaacatgttttcagctgggttcggagtgcttgcttttgctagtcgcacctcggccatcataaggaccggtcttcgggccgaccgggcctctgttgcaaagcgtactccatacaaccacctgtctattgggtaagtcttaacgcatcgtctagtacagtcataaacaaggaagacacgaatagggatggatgaagcccttgatggggtcgacgtctttggctgtatgcccgggtcataaactgtctgctcgacccagggcacctggcaggggaagtctatgtcggacctctttgtttagggcagtactaaacaataggttatgtcatggcttctgtccatatgccgtggtggcatgtggcacatggaaacatgtgaggaagacatgtctggtgggtaacgatgtacacctctgatcagagtataatctattcgaatagccgcgccctcgattatgggcaagccgagcaatatacccaagttagagtttaattctattaaaattttaataactagagttatcacctgttggcttgggttaaggtaagatagcgttggagcgcggcttggtaataattttactagagaaaggtttatgttttatttaaatgcctttaaatatttaaatgctttgaaatgctagttttctgcaaaatagccttataaattaattctttgtactcccttgcattatatttacattttcccggcatggcttgcttagtacggtggttgtactcagccttgctcctttttcccacttgcatggcttgcttagtacggtggttgtactcagccttgctcctttttcccacttccagcagaggagtatttcagagatgatggctttgatgtttagctcgtgcctgccgtcaagcgtatgtggtggcccaacgtagcttccggtttttatcgtttatctttcagtgttgggcatttggtcgcccatgtaataaagtactctatttacgcttccgcttatatactttgttatttatcaactttgtaatgtgtaccttgccttctgagataaggaattatgcactcacaaacggaatatagtgttctattttccgggcgtgacagtcatccacatcatgtttccttcactagtcatattcagaaggctgagaataaatgcccaagtgctgccactgttcagaaggcttacttgcttagtactccctccgtttcacaatgtaagtcattctatcatttcccacattcatattgatattaatgaatctagacatatatatctatctagattcattaactaatatatgaatgtgagaaatgctagaatgacttacattgtgaaacggaggaagtatgtttttttttctctttcaaaaaccatttagaccaaggtcacccaacgacagattcaagcagataaccttgtatgggctaaaaggctaactaaaactcacctgtgaacacacgatctcacagtgatctgttgcaacggccttgtactgcaacctccgtctctctcctagacattatatcgaacacctgtcgaacacactgttgcatgccatgtaaacaagcacacgatctcaccacaccattaagaagtgaaaagataaaggcaaaatacacatctgtttgactaatcccaccaaaggatgggggtagtaattttggtattactgcacaattaatctcaccttgttggacctcgccatatccgagccaccggtgtccaactcccagtgtctgcggtgcctttgcctgtcctcgcccggcgtccgctttgccgacgccgcttgccgactgttggccggagccgcggagcgtcgttgcggcgacgtcgtccagcaaccgctcgcaactgggcgtcgccacggttgatcgatccattcaaccttgtgatctttgttggtttggttaatagccaccgagttagaaatttcaggaaacgaattaaccatcactatgctggtcatatatgtctactgaaacccaacaattaatcaaaaacaaaaacccaacaattaagctctcggaattctctttccaacggatccagtttgatctccaaattccatctcagacaatcgtaataacagaaacaaggtgttgattatttaatatgagagagagtatatataccttgcacctatacctttgagatatacaacatagttgcaactcctgatcaaagtttttgtttccttttgtccttcactcgggacgagcaaaggtttaagtttggggggttttgttgacggtcgttatcgatcagcttcgaccgtcaatattaccaaaatagagaagaactagtaatgtttgcaatgcatatatatgttagaataataatattccattagtattaggtttactaaccttttgcagagaataaccatgaaacggaggagaatcgatatcaacacagacgataaatcaatcggacgatgtcgagaatcagacttatgcatgaatgggccaataactcagaattgacacgacaaattgggctaaaattcacaagtctgcggagaagaacaacggaggaggccacctgccgaattagggccaggttgggccggcccctggttcggccgaaccagggggttcgcccgaacccccctggcgccgttggatgcagggttgcggctggacggtgtggattagctcccaatgatggttggagggtatttccgaccattccaaccgtcacaaccgttattgggaggctatataaacccctcaccttctcacttcacttacacacctcaagcaaggctctctcatattaagtttagtagtatcaagctagtagaataggaatagagtagaaatcaggagtccggaagtcttcagaagagttcgggtatggctctagtagctttccttttctcttttgtaagctttgtacttttattagaatactcttctatatacatttatggtattgaaatactttccgagtatataaatgcctactttacattatgttcatgttatactgaatatgctgctagcttatctgggaaatgctttggtgcgggtataatgtttgcttatgcaattgctctatgtcatgacgatgatattagaatagtattgtagtttagacatggtatttagattacgggatatcattatttggggttatatgctgtggatgaaaggtgggccgcagatggtgacagctcagtacgggtattcctccgcgcgtgtatataatcctaagttaaatccttggggagggtactcctccgtatttagccccggttgtatggtcatacaggctgtcgtaaggaactcggcagtcaggggtggcttctcaaagtacgaggagggcatcggatagaggggattagctagtatattggataactataatgtatgtatactatgtatactagaagtataggagtagattatctttctcttttctttccacttagcttatataatatattatgagaatgagtagctactgcttgtgtgtcactcccttggattatcttaacccctgcttaggatttgattattacaagtaatatataaattattagttctctctacatgatcttcccacgggataaaataaatacgatacccttggaatactctcgggtgaaatgctacaatggtatatccgtgcgcttgcggatgaactctgtaaccataatatactagaagtatttctgcgtcattgatgggaattatatttctagtaatgtcgttaagaaataccaacaagcattttcggcgccgttgccggggaagattcataatagagattacctgaactaatactttatatttacctctgtataatcactgccctttgcaggctaaccttggttgttttcactttttactgtgaaaacagggtagtgcatgattggtttcaacttgccagaaaacttcaaagaaaatccagaagctttcttccaaagcgtcaggccgtgagtcgttgctccgcagaaaactctaccggcagagaaaccagccgtactagcgccaccgaccttcaagactatggctgacaagaccctccgcgagctcgctgctccctctgctgacaatgtggccattgggccgcagatcaacatgggagatgtggatttcaacttaaagtccagcctcatcactatggtgcaggctagcccgttctgcggcaagcctaacgaggatgccaacgctcatctgcagcagttcctggagatctatggcacgtacactataaagggtgtcagtccagacaccgtcaggctgaggttgtttccgttttccctcctcgggagagcgaaacactggttttacgccaacagtgctgctgtcaacacctgggacaaatgctctatggtattcctcttgaaattctttccgatgggcaaaaccaatgccctacgtggaaagggacgagtccattcctgaagcatgggaacgacttcaggagtatgtggccgcctgtcctcatcatgggatggacgactggttgatcctacataacttttataatggactcactccaatgtcccgtgactacctggacgcggcagctggaggaacattcttctctaagacggttcgaggagccgttgatctaatagagaagatggtctccaatatgggttgagcgaggtatgcacaccgtcaaggagacggaattacttactgccaagctggacctcctcatgaaacgattggacgaccacgacaaacggccacaaggcaccgtccaggccttggattcacacgttacgtgtgaggtctgcgaccacacgggtcattctgggaatgactgcccagaaacccgtgaggaggcgatgtacatgggcaacaacaacaacggatatcatcgacaaggaggtcaagggtggaaccaaccacgcccgtatcatcaaggaggtaacaacaacggtaacttctctaaccaaccctccttgaaggatctcgtctttgcgcaagctaaaaccactgatacgctaagcaaaaagctcactgccaatgacaagatccttgaaaatattaatgttaagctagatggcttcgcttccgcttttcaaaaccagctgagctttaataatgatagaaacccagctagctcaattggcttcattagtccctgcaaatgaaactgggaggattccagggcaacccgacacctccgttgaaaatgtcaaggcaatcacgacgagggaaggtaagtccactcgtgatcctccatatcctaaccctgcaggaactaacgggattgcaagagaagcatcatccagtgagtcggctgacaaagaggttcagccagaaaagactgtgccacaggagtactgcaacacacgattgctgccgtttcctcaacggagtaggaaaccgtcagtggacgagcagtttgctcgttttgttgaagtaatccagaagatccacatcaacgtgctattgttggatgctatgcaagtgccaacatatgcccgttatctcaaggatatcctcaacaacaagagaccactcccaacaacggaggtggttaagctgacagagcagtgcagcaacgtcatacttcacaggctcccggaaaagaagaagaatccggggtgtcctacgatcacctgctcgatcggtgtacatcagttcgaccaagccctatgtgatcttggagccagtgttagcgtcatgccaaaggacgtctttgacaagctcaacttcacggtgttggcaccaacaccgatgcgcctacaactggctgactcgtcagtctgttacccggcggggatagtggaggaaaatatatttttataataaatttatcttgggttgaaaatattattttttctataaacttggtcaaacttaaagcaatttgactttgaccaaagtcgaaaaatcttataacctaaacagagggagtacattccgatgacttctagaacacaagaatcaaaatcagtggattggtcaccgcgatcggcctgcagcaacctcatcgcgaggagcgaactgccagccatgacggacacccttgtcggtcatcttcgactgttcgtacggatcatcttcatgatggtcaggttcgaggcttagagctcctggccagcacgccaacgcagaagcaatgttttaggatcttttttagtgtacctttggttcgatgtggaccattgaacggatgagataactccttgctactacatctagtattagagtgtagtagtgtagtagaagggtaattgtgaaaaaattattatagcattattgtaaattcaccattaggattaggtgtaatatgtaattgctaatgggatcagatcgacgctaggtttaggggcatcagccaggaaaatgcttctcttcggatgtcctatcagatacaaaacatcggacgcctaggaccagctcactcctttacttactagtttctcctttctctatgttgacgtcaggaaaatgttgcaaatcggtagcatgtgaattggacgaacccctgtcagtgtaaacatacatgcctagccgtttcttttcattctttcctcatctctttaaatatttttctcctaaattacttatccgatctacgaaccgatcacactgttgtattcgttgcaattaaatatttacaacaagatatcacatgattatattatgtcaaaagaaaaacatgtgtttcaaaccgttaaaacaaaatgtttcatacgtgatagtgatatgtttcaatatgtgccttcggtgtgtttcacaaaattcctgaaactacctgctactactctctccccacctcatgcatgcatgcatgtattttagcaagcttcaaaataatttttctcttaagttacttattcaatctatgatccgatcataccgttgtattcgttgtaattaaatctttacatcaagatatcgcatgattatattttgataaaagaaaaa

SEQ ID NO: 62998 - DNA, 8939 bp, Oryza sativa
cctatagcatgctctaacattaattcacagctcatcggtgaaaaatgtccgagaaaaccatgcgcctgcaatggagaagtgaatacaaaatccaacatatttccttgtgatgcaacatgcaagcagcaacaacggacacctaaaaagaggcaattgaatttaggtattttatcaaataactttgcaaacaatacaaagtgcatataaaacggatgcagggcattttatcaaacacatagtgcacatatgattggttactatgcatacctgtgccaaaccggatgaggctcctgacagacttcctctggatccaaatgatttgggaataggagtctgtccaacaacgcgtacttgatctaacggggactggggaggcaactgatccagagcttttgaggtgactgatggttggtataggatgatttgaaagaggttatgaagaggattagttgggttaattacggcacctcatcttcgcgtaggtggttgcagtttcttgtcactgatttacttcaaagagaaaacagaacatggcgcagttaatagaaggcgatgagtcgtggctgtggcatcgttatgggctgggccaacggaaaaacgtttcacgtaacagaggctgagtaggatgggctggtctggcctggcccaatattgttgaatgtcgatctaacgtccatccggagacctgcaaataatccaatggctcaagagaaaaggatgacgtggcgcaatgtggtgcaagctttatagtctagtgggtaccaactatataggaagaaagaattagctctataggaagaggccttagtttgaagcagattgggcctgttcagtagccccttgactacagttgtacagctactacctccgtcccaaaataagtgcagccgtggatattcgttcccaacgtttgaccgtccgtcttatttgaaaaatttatgaaaaatttgaaaatatttagtcacacataaagtactattcatgttttatcatttaatagtaatgaaaatactaattataaaaaattttcaaataagacgaacggtcaaacgttgaacgtgaatagtgcaaaactgcacttattttgggacggagggagtatatctcttgtaatagactagttgccgtgtttcttatacaatagctgtactgtaggtgtaactgcaaccgctgcaccaataatctaagctgaacatgctcattattgtgtggattgtacacaacatttgcctgattatagcgataaattaaatattttgataataaacttaataaatactagaagaatgtattttaaggaaatatattctttagtcgtgaagcaaataatccggcaaataaactaacaagaattgagaaattttgatttattttttttcccgctgacttgactcatgtattggtatcactggaccagccgcttttcctgcaggagaatgggatccggatcaaacccgccacgcccgcatggacgcaatagtcaactagaagtcagaggatggccctgaccaagagtactacgactatgaataagagtatgatgcgcaaatacgcaatagctttgaccaactcatcttcctggccccttagcgcgtactcatattttagcagcaggttaatcgagtataccctatactactgattaatcagcccaagtgtttggatccaaactttgaatccaaacttctaatttttttcatcacatcaacctgtcgttttcagtcacattgtaacaatttcaacccaaacttccaactttagaagaaactaaacacaaccaaaatttcaacttataatctctccaaagcatcgagtactgacaatttctcatctcgagattcttgtactgacaagtttttattataaaaaaaggaaaaaaaaatcgtaaattagaaggcggcgcctacaaattaagcgagtcaaacattttggtagaatgcaagcaacggacggcagatgtcgcggaccaccttaaaaccatactcctcgatgacaagagcgaggattaccactagttagctttgtaactaggagcctaagccagggaggagcaatggcgagctcgagcttgtcgcgccgtgccctcctcctcttcttcttggaggtagccgtcgccatggcgctgcttcttccgggcggtcacgcgcgagtgtgcccgccgtgcggctcgacggaggtgccgtacccgctgagcacggcggacgggtgcggcgacccggagtacaaggtccggtgcgcggcggcggcggcggggggcacggcgcccacgctcctgttcgacgcgctcaacggcacgtcgtacccgatcacctccatctccccggcgtcgcagcgcctggtggtgtcgccggcgccgttcgtgtcgccgggcgcgtgcgtgtcggtgggcgcggcggcgtcccccggcgtgcagctggacccatcgcggccgttcaacgtcagctcgtccaacaccgtcatgctgctcaactgcacggagctgctgctgcggtcgccgctcaactgctcctccaactcgctctgccacgcctacgcgggcgccgcggggtcgacggcgtcggcgtgcgcgccgctgccgctgtgctgcacgttcgtggcggggggctcgtcgacgtcgtaccgcatccggctgggcccgcagtcgtgcagcgcgtaccggagcttcgtggggctcgacccgtcgcagccgccggcgacgtggggcagccgcctcgggctggagctgcagtgggcgacgccgagggagccgctgtgccgcacgcaggccgactgcgaggacggcgccgccgccacctgcgccgacgacccgtcggcaaccggaggcgcgggcacggtccggcgctgcctgtgcgtgtccgggctcgtctggaatcccatcgctggcgcgtgccagcagcagagtacgtttaatttttttgcttcgacggctgacagctcggctgtgaggcgcctctaatttttttttatggctgttaattttgatgcagatctcacggatagcggatccaaccatgcgcctctcattgctggtaattatattgcttccttccttcagcgctagctagcgtcttaatttcttattactgtcatcctgggaaattaattaggacctctgttctcgatcgggatgcatgcttgacgcctactatctagttacgacttcaatttgcaaggcgggcgactagccgcttgcttggttttaacggagagagatcgaattgtggagtcgttattcgttgctttggtgaaaactcagtgattaagtaggccgctattacccttttgttagttgttactgcgagtagttactcgctccgtgcacaaatatgaaaatttctcttagcatggagtaaaattaagaaggaaagaatgaggtatggataggggtagaagtgtggtcgttggggataagacgaaaataaatttaaacgagagataaatgattgatgggacacatattattttaaaatctttacatttgtgaataaattttaattgattggaatgtttataatactgaatttttaaaaaaatatttggaatgcttatatttgtagatagagggggtcgtagtattatagttatctgattatgaataagaaataatccaagcatcgaatacatatcaggagcatggtcaaggcacttagtcatttttattcggtatacaataagtaatccgggctgataaaataaaattgaggtcaatgatctggattgaatataaatgagagatcaactgaaagtaggtttacatcagtatcatgctgggtcccatactcccttgcgccaatggtcaacttgcggcggcttacatccggagaaaagcattgaccataccagagcaagtgtaaatctacttaactccatccagagagctagcattgtcagctttacaacacggacgaaccaaggaagttcaacggttggaaatttggaatgagttgctgcacgatttagctcgctttggagtttgtacgaattctccacgcgaaacaatttaactccttcgtggagcccaaccattaaatggatgtaccaagatttttctttgaaaacaatacttaataaataattcatggaggccacatcttggatagtttatatatgaaaattgtctatcctgtctcatggtgccacatcaacttaattaattttttctagatttgggataatcgattgatcaaagttccaaaacatataaaatatatcaaatcaaaccatgttcgctaatcgctacaatgaaaatcaacacaccacacaactcattttaaccattgtgaattcggtagatgtaaccttctatcccacggtaacagcagcaacacacatgtaattttcatctagctggttaaatatagggtgaatagctaatttagtccctcaagtttcaccgaaggtttaatttggtctttcacgttttattttgtccatatagctcctctaaatatttgttttggcttgaaatcatccttgggtccacttaatatgccatatggctatttccagtcaatattcctattagaaaatatcctttttgcccttaatttgtatacaactatacactagaaaagagaaagccaatataaataaacaacattacatatgtacttcccattatttcaatatgtgcacatgaaacttaagcaattgctatcgtatacacttgctagtacataatttatttttattttacataatatactatgtattatctataaaaaattcaagcatgcaatttttctcttttatatatatatatatatgtgtgtgtgtgttatttatgaagaaaattgttggttcaaggataaatttgaactaaaaggaaaacttgaagtacttatatatatatagatagattgaaatagaactaaactaagcctctgatgaaactgatgaaacttggaggactactttgactattcacccttaaatatagatatttgatgtttgttgttccttaaacataagctaaggaattgaagcataaggaattgattaaccagttagtactattggtcgaccgttaattaataagcacatcaaggcagcaagcgtggaatttactaactagtgaattaagaagataatggatggtttaatcttgctataaatacatgaatgcaatgcagggatcgtgtgcggcctaggcggcgcgctgctggtggcgactgcaggactgttcgcttatcggcggcagcagcgcatccggctggccaaggagaagctggccaaggagcgcgaggagatcctcaacgcgaacaactcgagcggccgcaccgccaagaacttctccgggcgagagctgaggcgcgccaccgccaacttctcccgcgacaacctgctcggcgccggcggctacggcgaggtgtacaggggcgtcctcgcggacggcaccgtggtggccgtcaagtgcgccaagctcggcaacaccaagtccacggagcaggtcctgaacgaggtgcgcgtgctgtcgcaggtgaaccaccgcagcctcgtccgcctgctcggctgctgcgtcgacctggagcagcctctgatggtgtacgagttcatccccaacggcacgctggccgaccacctgtacggccccctcagccaccccccgctcccgtggcggcggcggctggccatcgcgcaccacacggcgcagggcatcgcgtacctgcacttctccgctgttccgcccatctaccaccgggacatcaagtcgagcaacatactcctcgacgagcggatggatggcaaggtatccgactttgggctgtcccggctggcggagcaggggttgagccacgtctcgacgtgcgcgcaggggacgctgggttacctcgacccggagtactaccggaactaccagctcaccgacaagagtgacgtgtatagcttcggtgtcgtgctgttggagcttctgacgtgcaagcgcgccattgactttggccgtggcgccgacgatgtcaacttggccgtgcacgtgcaacgggcagcagaggaggagcgccttatggatgtcgtggacccggtgttgaaggataacgccacacagctgcaatgcgacaccatcaaggctctcgggtttcttgcgttaggatgcctcgaggaacgccgccaaaaccggccatccatgaaggaggttgcagaggagatcgaatacattatgaatatcgaggccggcaacgctcatctcaaggagctgcacagcttatgatcagtggtcaattatattagttagtcaaacaacccatataatgcacgggttattatagtttttctttccgagttttctgttttgctagtgtctcctcacgtttcaaaagtaacgaatttactctgtggagttttccatttactcttaggcagggttgaaaatttcggatcgaaatttccgaaattttagaaatttcggttctatcggaccccaccatatgatattatttcggccaaaatttttatttttttatgatttagtaatattttgtttaaattagatcaaaatttattaaaaaaattcatataatttcggaccaaaatttccaaaatttcggtatttcggccacccccaagtacaaatgaccaaaccgaaagattaaaccctgctcgcagctttctacatctgcttattcaacagtaacaaatttacttgcatgaatgcgccccacatcagggttggaaattttggtcatttcggacccctccgatatgatattatttcggccgaaatttttcaaattttttaatttttcgtgaattttggtaatatttgttcaaattcaactaaattttgttcaaaatttcggaaattttggaccgaaatttccaaaatttcggtatttcggtgaggtccgatcaaatcggctaaactgaaaagtttaaccctgccccacatcatacgacaccattcctagatggccataaaataattactatcagcttacaacgctagtaattcttttaccagtgttataaatattggttagacttcgtggtctgcgagtaaaataattaccaccttcctctcgatatagcccatgatctcgtagccaccgtatagtaatatgtttattgatgtgttcaatatacagtataagagtaaaagttgatactaagaggattgttaatctgtatcacaaaatggccatatgaatgaaaaaaaattataggctcaatcacacacgagggatacaattactcacaggtgaatcaaactagaaaagaaaaaaaaatgatacagccaaaaattcatcgtgaagctaggatcctggtggctttgttggatcttgctataaggatagagaggctggtctgtgtcttgtgatggtagtggatagtggagagggaaaccgggtggtgagcggtagtcgacgttggaatcatgaaaggacatagtggcgtggtataaagatgagctcgacgttgcgcagtagcatccatccatcatctagcaagcacggaaaaaatgcaaaaacattctcgttcatgtcatagagacgacgagggaaaaaaatagcaaacaacttccatcaccggcgaactccaccctatcctctacggccaaccacatggagcacgatgtgcaaatgtaagacctgtgcagccgatcagatcaattcagataaggtaatattggagattacacgttaatttgatttgcaaacaggggcttcatgcgtgaaagtgaaggagagtatgtagatgtaaattgaagtgtcatttccttacttgcttgttctgtcaatgtcaccgacgtggagcagccgccggttattgctctcggcctaggtgaacacctccttgctggttaaggtactacctagcgtccggctgcgaggctcgaagcagcaccttcgcctcaaccgccaccggccaccaccgtcaaccgccacggtgtcgtcgtcctcctcctcctccatggtgcatcaccgatctgtgggctaggatggtggatcaattcagataacccccccgccccccaagaaaggaaataatgaagtgagggcgagagtggttggttgggtatggggaaaatataatatatactggaagcgaggaaattgcttttatcgaaataaattatttcctccaataatggtgggagcgggatgatgggacgtggggtgggatcggatgcagggaagttgtttttatctaagtaaatcgtttgctccgataacgatgggagcgggatgatgggacgtgggtgaggtgggcctgcgctgatacatgtttgacacttgctatattaggagcgcactgcgctcctagtagtatctctatttgtttggattgtttttaacgttgattatgtttttcttttaattacctttgcagcatataaattctaactaaaaaagttgatgttaaattaaagatataatgttgttctatcataaatgaacgctaattgttctcatttctgttaacaactattaaaaagctttcatattggttcatactattatttcacacgcgttgtgcaaaatgtatatgacaataaaattgatcaaaattgcctcagcattcactaccaaattaaggatggattaaaacttagataccattgcttccgtataatatataggcaaataaatcatccacataatttgtggctagctagcatatatatcatgattggtacggtgagagttagaattcttctcttccatctgttcacttattttcttcgaaaatgaatttaatttgaaatatgactgcaactatatagatcgagcacgttgatgtgctatagactaaagcctaggtttattgtttgaattacttttcctaactaacattcacgtatttagtcattaaaatatttaaatcaaaactatattgtatatgacgaccgggtcctttatgctaaaaggcaaccttttatgcaaattaattcttcaaacatctaattgatatatgaaagaatttgtatcccttttactcat

SEQ ID NO: 62999 - DNA, 1829 bp, Oryza sativa
aggattacaagatagagactttatccttacggtataaagctctacatatactttacaattgtaaccgattgggactaggggatattaccttgatacacaagttaacataatacccgcgtccttttatatacatattctatccacatgaactatcccctatagcagttagatagcatagccatgtgggtatatggtacccataatctccacagtagcccctaagaccttcatagttgacaaaataatcttctaccgagtcatctgtactaatataaaaagcaccagttcatcaaatccagatgttttctaacctttagatctaatcatccgacagctcatatcaagagttggatcaaccactgcgattaacgatctcccacgtctaaacagtggttagggatcgatcaaagcgaaaaagaaaacgaaaaaagcttctttgctcgccgcctcctcgtgcagtcgcgcgccctacctcgcacgcaccgggcgccgctgccgactccgggcgcgcgcccgccagagccgctcgcgggttcaccggcagaaaatcacgcacgcaatttgtcaccccgccgccgtcgcatgccatccttcgcacgtcgttgcacccccgtccccctccaccgctgacttcaccccgcggcgcggccgctacaagtcgctgcagccctgtcactccctctccgttccctcgcccatcgtcgcgcccctgtcccctccgccaccaacttcgccccgcagcatggccgctccaatccgccgtacccgtcccgcacatcgaccatatcccgccccgcgtcatttgccgcccacgctgcctccggatcacccatatccgacctccagcctcgtcagattggcgccgccgccgaccctaagcttgtcgtcgagcattcaccgtcgccccatctgccccccatgccgatccatccctagcgccgtcgccgattcaccaccaccaggtcacgtccatcgtcttcttgatttgctccttccgcttcttatttatcctttcttttgttgatttgatcagaaactttatcctttcttttgttgatttgatcagaaacggcaatgaattttattttaacagagagagggggggggcaggggagggggaattgattgaaaaaatgaaaactggagtttgtttgagtcaatcaaattcaaatatgaataaacatgggaattttctgtttctttagctaggccatgtgcatttcacatttgtaatgttgatggaaaagctacagataggggcagagagtaactggagaaaatagaaatagaaatagaaatgagtagcgatgttagtagcgtacatactttacgcaagtcaatgaggatcaagaggaggaggaggcggtatcctagctaactggtcgtctcgtggaggtaaaaaaaatttctttgattccggcgaacctatggctatgtttcgttgataacttctaaagttcttcctgttgttcatcctgctatacatggtgttcttttaagtctttcctccaatcgcctccttatgttctattataccagtggtgccgtaccaatggctatgatgtgcagtccatatatagaatcaatcactgaaaaaaaatgagtttagataagtcacagccattaggactatattaaatgagtaatgaatcattgtatttgcactttttgcagaatcatggcagtaattacatggtcaggttgtgaccaaaaaaaaaatcagagatacatatgctcaggttttgatcaatgaaccacttgtagacattctcagattttggcaaaaatgcacagatacactacaaactcaagacacgttctttgaattt

SEQ ID NO: 63000 - DNA, 1113 bp, Oryza sativa
atgacgtattgtaaggacctagccgatgcaacctggatcgagtcggctgtaaagtataggataaacaaaggtacgtaatcctaaaacatgttgcatcggctgtagataaaaaagggaggggcggctagggcttcgccccgagctaccggcgcgtgggcgacgcgaagtgcttaagcagactatagcaccaagcaattaatcaagatctgtccggtaagtaacaaataattcctgtaccatactcggatactagggtacaagagttgtatccaaatacatacatacatacatacatacgtgtacaattatcgtatccgagtataaccagacgatacgtgctaggggatcagtatataccccaccgagcgcgagaaagctaatggacgatcgatcgcccagagcgatcacccctctactcctcacgtagttttctttttttggcaccgtattacttttctattttagtaaatttatgcacctaaagtttgtacacttcaagtttacacatctaaagtttatacacctaaagtttatagacccaaagtttataagtcaaaaatttatatacccctcaagtatttgaattcaaatttgaatttaaattcaaatattttttatatataatacccctcaagtttacacatgtaaagtttatacacctataatttatagacccaaagtatataaatcaaaagtttatatgccctattcaaatttgaatttgaattcaaatattttttatatatagtatttctatacataaatttttttctaactcgttttttttaaaaaatttatggtgtagtatgaagagaagaagggaggagaaagaggagaggagtgtgtaaggggagggatggggggtgatcgctcacccgcccattagcgccccccgaaggcggcgtgggtggtggggacgacgggcatcgtgctggcggtgccgctcatctggatcatggaccgggagcagatgcaggttgagtacgagtccgtcctcgaggccgagcagcggacgctcctcggcctctgatcctagctcggttcacgggtaacccctcctcgccatcagcgacagcggtagcatcgtggatctaggtttttaatcttgctttt

SEQ ID NO: 63001 - DNA, 1118 bp, Oryza sativa
tccatctcagcctcaccaaccttagtatgcaccttaccccattccaccattcgccttaattcagcagcagacggaaacatggtgcggaaagtatcatcaccattgtcatgaacaacccacctccatctaccaggaattaacctttccaactcaactataacatcatttacagaaagcttaccctttgataccttaatcaaagctgccctaggctcatgtttaattttgtgaccagctgagagaggaatatgaaaaaaaacccagaccatcagcagcataaccacataactgagcagtaggtttaactgtagatctaaaagttgggcaacggatagcaacatgatccacactttcacaaatttcacagtaaaacttagaagaacaatcctgcatcgtatgcccctttgtaagacatctaaagcaataaggtttacctgatcctttactttctacctttgacttgcctttgccaacatcaaccaaacaagctgccatctcatgttgaaccggctcaccatgaacctgagactccttgccacctccacataccgaagcggaaggagcaagagcaaaagcaccaaaagctcctccactaggtacagaacccccagcaggaccaccagcagtaggaccactagaaatattggagaccattgcccccgaacctctagtctgaatcccacctccatccacctttaacctatcctattgggtgtttcctttacttgaatcagcaattttcattaacgaaacagtctccgatgcaacagccgatgtagcagccaacacaccaccagttagcaaaagatcacctgccccaactgacccggcaccaggagtagcatcattcgtcgggaagccagcctgcaacccaccacctggcacaccaccggtcagcaaagcaccagactgcaaaccaccggcagccatctgcaatctaccacccggcgcaccactagtcggcacagcgccagccggcaaaaccccagtcagcacaccaccaccagccatctgcaatccaccacctggcgcaacaccagtcagcaaagcgccagccggcaacacacctccgccagcagccgggaaaacaggagcagacatccctggtaccgcaccaa

SEQ ID NO: 63002 - DNA, 6429 bp, Oryza sativa
ccattaaatccacctccgctcggaccagcattgagaccaaagccacccctccacccatgacctccagcagaattattccatctagtagtactttttgtaaaagacgtataatactccttcgtccttccctgtagaaatatgataatttttttggaagtaactttacaatttgcatatcattttgttatttacaaatatattacatcagtcctaaatatttactccctccgttttaggttataagacgttttgactttggtcaaagtcaaactgtttcaagtttgactaagtttataaacaaatatagtaatatttataatactaaattagtttcatcaaataaaaaattgaatatattttcataataaatttgtcttgggttgaaaatatttctacttttttctacaaacttagtcaagcttaaagcaatttgactttgaccaaaatcaaaacgtcttatgacctgaaacggagggagtacctgcttacctaaattgaggagttttattttccttcaatacgccttatgacacccaccaaagaaaatagcataaaaaatatatgcaaaatttaagacttaccatagataatactatatctaggggtggatagcgagccagctcggctcggtcaagctcgttaagataggagctggctcggctcggctcgttatcgtaacgagctagaaacccagcttggcttggctcatttgaaagctcgaggtagctcgttaggcttgcgaaccaaaccatccaggcggccaggcctctcctcttctcagcggggcgcggcgcaactaggggtaaggggtggatgcggcatgcgggcggcgcggcggcctccttcgtcagggactctagcacggtggcagcgagctcggcttcgacgtgccgccgcacgtcgccgacggggcacacgctccacccggccgccatctgtatgcgacgatgaggccgtgctggaggagctcgtcggcgggctggcgatcggcggcgaaggaggaggaggaggaggaggagctcgtccatgggctggcggctggcggctacagcacgcggcgctggcggcggcgcacgccggtgtgaaaggggattggcggcgcatgatgcgggcatgcggcgcaggaatggcaggatgcgggagacagggaaatcggggagagtgggagaccgagggtagtctctagggttttcctttcagttgggcttgggccgttgagtaacttgtgttgtctcattgtttgttgggcttgggccttagagtgctggctcgttaaggctcacgagctagctcgagctcattatctctaacgagctttaaagccagctcagctcgttacgaaatttaaacgagccaagacgagcgagctaacgagccacgagcttcctgcccacccctaactatatcatataaacataaaaatatgatgatacaagagagtgtaatttgtatatttattcatttctattcagtcttttgagtattgagcggataaatcataagcagtgataaaatcattcgagctaaaagtctacataaatagacaaataattagaaaaaaaaactaaatatagccaaaatgagcaacagattaaactgcaagtatcactaatattttagaaatttcaaatttaaattttagccacataatgatttgaacaatggacacgattattagaaaccttttcttctagataataagataatggatcattagatagcaagatattacactcctccatcccataatataaagtgcgcacatatttttagattcaacttttaaaacatttgtttagtaattagtataatatgaattgaattttatttgttgaaaataatatcattggatttgacatttgaatttactttcatataattataattttgtttctataaaattatatgagaaattataagtcaaatattatttttgaacatcatgccagtcttagccatctaatttatgtgtcttttatattgctacaatagcaagtcaaattggttaccaacatgtttattttatgaaaccaggttatgtctcatgtgtcaaaatggttatgttttttgcaagtcgaacaatattactatgttagtagatctgggttctatgaaatgtactcttttaattaagaagtatctaatataggttacatgcttaacccctcctttgcttataagggaatcctcaatgtagccaagattggtctaaatggtgagtcgaaagtttcaaaattgagttaaaagttctcatttgtttagaaattttactcaaaattttcagttttgaaatgacactttacgttaagaaattctctcacgaaattttactttttttttgcggggatacaaaagtttacttgaatttaagaattcaaaaaaaaactcggaattatctattgcgcgtcaggcgcagccgtgtcgcgtcggcggcgcacggcagacggccgggcagaagcggcgctaattagatctcgcgcttatagaaactacaagtctacaatcgaaccttggtatactctcctaccaatcaaaattaacctgatatcctgttttgccaaatctttactgctactcaagcttagattcactgcggttttgcttcaggcaagttgatgcacacagcattttctcagcctttcagatacgtacgcttcacccacaagctagcataccaaccgttcatgatttgacggcgccgccgtagcgacgcatgcatgcaggtccgttttgccctataaataggcagcctctgcactgatccagtgcactcaccaccactgcactgcaacacagcaagcaagctcacttcttgcattcttagctcatcgattcttagccccttttctactatggcttgcactagggaggttgctttcggcgtgaacctgatcggcaacaacggcgccgcaccggcggacgaggccagcagcctcgccggctgggcgccggtcggctcgcgcaccacgctgtccgctcacgtcgagaaggacgacccgccggcggccatgctcccggctgtggacgacggcgggcgcgagcaccggccgagcggctctcggtacgtcctcgcggcgcgccgtgacggcgaggaggacgggctgcggcacccggtcccggccggcgcgctcgtgccccgggtgacgtaccgtgtcgccgggtgggtcgccgtgcagagcggtggcggcgaacacgccggcggggagagccacgtggtgcgtgtcagcctccacgtggacgatggcggcgagtgccgcgttctcggctgcggcgcggtgtgcgccggagtggccggcggctgggtggagatcaacggcgcgttccgccttaaggcgaccccgcgcggcgcgacggcggtgcacgtccacggcgcgccagccggcgtcgacgtgaagctcatggacctccgtgtgttcgccgccgaccgcaaggcgcggttcaggcatctcaaggagaagaccgacaaggtaagacaacatctctcactctgaatgatcacattaactaacaatatagtaccatgcatgttgatcgggaccatgtcatattcacatcggatttggccatttcaggttcgcaagcgtgacgtcgtcctcaagttcagcggcggagccggagtggaggcgacggcgagcatccccggcgcggccgtccgcgtggtgcagatggacaacgtcttcccgctcggcacctgcatcaacggctcggtgatccaggaccccaacttcgtggacttcttcaccaacaacttcgactgggccgtcttcgagaacgagctcaagtggtactggacggaggcgcagcgcggcctgctcaactaccgcgacgccgacgcgctgctcgacttctgcgaccgccacggcaagccggcgcgcggccactgcatcttctgggcggtcgacggctccgtgcagcagtggatcaaggacctcggccgcgacgacctcgcgtcggcggtgcgcggccgcctcaccggcctcctgtcccgctacgccggccgcttcccgcactacgacgtcaacaacgagatgctgcacggccgcttctaccgcgaccgcctcggcgacgacgccgccgcgctcatgttccgcgaggccgcgcgcctggacccggccgcgcggctcttcgtcaacgactacaacgtcgagtgcgccaacgaccccaacgcgacgcccgagaagtacatcgagctgatcgacgcgctccgccgcggcggcgcggcggtgggcggcgtcggcatccagggccacgtctccaacccgtccggcgaggtcatctgcggcgcgctcgacaagctcgccgcgtcgacggggctccccatctggatcaccgagctggacgtgagcgagcccgacgtgtccctccgcgccgacgacctggaggtggtgctccgcgaggcgtacgcgcacccggccgtcgccggcgtcgtgctctggggtttcatgcagggccgcatgtggcgccaggacgcgtccctcgtcgacgccgacggcaccgtcaacgaggccggccagaggctggtcaatctccggcgggagtggacgtccgacgcgcgcgggaccatcgacggcgacggccatttcacgttcaggggctaccatggcacgtacgtcgtgcaggtgacgacggcgacggggaagatactcaagacgttcaccgtcgacaaaggggacacctcgctcgtgctggatatggaaatttaacgactacgccggtttatcttatatttgcattgattcatgcataatcatatatcgaatgagtggagggcacgtgggacaaaagaattctgctagagaacagagtatgttctgtccctaactccctatgttttacataatttggtaatgggtattgtatggttgtactattgtaagacaaatgtaaggtattgcatttgctaagatttaatgcatatgaataatgtaaacgagttatttccctaacaaaaaaaaaaggtaaacgagtaattcctcgttttatgcaacttatgtgccagccgtgcattgtaacggcttcttagtagggaggataattcatatcagcggtgatcccttataattgtagcacaacaatatctataactaagttattatataccgtgtattagaaaatttacaatataaatattggaacgtacaatgtagttaacatgtaagtgtaggtaatttacagtgttaaaatgatttgaagtgaatttcacaaaactatagatattttggccaaactattgtaaaactatatatttaaaacgttctatcacaaaactatagatttagggcctgttcggctgcatttctttttactatgctgtagcctacctaaacaataatatgtgtgtgtggctgcagtagaaagccagaaacaactgcattgtagtgcagccgaacaaagccttagtgggaaatttattataaaactatagatttaatattaagtatcacaaaattacagattttatattaaagttatcagaaaactacagattcaatatagattttatattaacattatgttggagctataaacgtcgtagttttgggataaatttactacttactcttcaattttataacattccatcctaaatatgtagttctgtgagaaattttgcgttaaatatatagttttacgatataagatcttaaatctatagctttatgatagtttgatcgaagtatttgtagctttgtgaaatttactataacatgataaataaatataactactcttttttcctgtgcattttgatggttattttgccaaaggcaagaaattgtagaatcttagattcgtattgaagttgcatgtgtgaagctgtgcaactcagaggccatgcacactgggaaacacagacagggatgacagttgacaccgctgttgtttctacagtactccggaaagaggagacgtgtgtttactatttatagtaaaaaaggaagggtcgctggttaagctcactgggtgactgtgcacggcatggaagagtgtagctgagccactgacatgtggggccatagcaaaagtgggacccacatgtcagtggctcaactgcatatgccgtaacggaatagcgctgatttgcttccgcgcggcttagtcgcctccacaaataatgaaataatactaatccgcatgcaaattcgtcagggaaattatatataggaccccctctcccgaaatgagtggaagtgttggaacgggttcagcgctgcagactgccactgtgctgcaacctccttatttcttgccgtctcctcgtcccacaaccactctttagctccactggatcgagaaaaccaagcacagatccaacaaacgcccaaagaaaaagtcttttgagatacacaccaatgagcctaactgactagctagcgatcgaaacaccctgctccagatcgatctggcctagctagggaccttgctgcg

SEQ ID NO: 63003 - DNA, 3118 bp, Oryza sativa
atccgtgtgtcattgtggcgttgttggttggttggttggttgcaggagagtataccgatccaggaggtgttcgccgtgctcaagagctcgccgcaggggctcacctccgccgatggcaacggccggctcgagatcttcggccgcaacaagctcgaggagaagaaggtcagaattcagaatcgtgtgttcgatcaagaacgagtttgtgtgttttgggtctcgcgtacgtataaaatatgtgaaattggcatgcaggagagtaagctgctcaagttcttggggttcatgtggaatccgctctcctgggtcatggaggccgccgcgatcatggccatcgccctcgccaacggaggggtacgcgtcgcccgtccccgtcgccgtcgcgtcagttgtgtgtgttttgaccgccgtcgatctgacgcgtgcatgcatgcgtgcgtgcaggggcggccgccggactggcaggacttcgtcgggatcgtgacgctgctcttcatcaactccaccatcagcttcatcgaggagaacaacgccgggaacgccgccgccgcactcatggccagcctcgcgccgcagaccaaggcacgtcgcgcgtgcgcagtgcgccacgccatggacgaacactgacctatctgtgctcgacggaatgactgactgactgactgactgatcgatggtcggtgcatgcagttgctgagggacgggaagtggtcggagcaggacgcggcgatcctggtgcccggggacatcatcagcatcaagctcggcgacatcatcccggcggacgcgcggctgatggagggcgacccgctcaagatcgaccagtcggcgctcaccggcgagtcgctccccgtcaacaagatgcccggcgacagcatctactcgggttccacctgcaagcagggcgagattgaggccgtcgtcatcgccaccggcgtccacaccttcttcggcaaggccgcccacctcgtcgacagcaccaacaacgtcggccatttccagaaggtatcatgcatgcatccatccgccacttctcgtcggagaggtgccaactgcttgcttgctctgctcaccatcaatggtggtcaggtgctgacggcgatcggcaacttctgcatctgctccatcgcggccgggatgctgatcgagatcatcgtgatgtacccgatccagcaccggcagtaccgcgacggcatcgacaacctcctcgtgctgctcatcggcgggatacccatcgccatgcccaccgtgctgtccgtgaccatggccatcggctcgcaccggctgtcgcagcagggcgccatcaccaagcggatgacggccatcgaggagatggccggcatggacgtgctctgcagcgacaagaccggcacgctcaccctcaacaagctcaccgtcgacaagaacatgatcgaggcacgcacagcacacaccattaatctttcagttttgccgttaatttttttccctatcgatcgagtagtagttgtcatcaaatcaaatcgcgcactttggatttggatttcagccgttcgtgaaggatctcgacaaggacgcgatcgtcctgtacgcggcgagggcgtcgcgaaccgagaaccaggacgccattgacgcctccatcgtcggcatgctcgccgacccaagcgaggtaagtgaagctcctcaagctcgcacggacacatcacacaagctcccaatttcctcttcttctacaaataaatctcacgacgtacgacgtgtctggaacgtggcaggcccgtgccggcatccaagaggtgcacttcatgccgttcaaccccgtcgacaagcgcacggccatcacctacatcgacaccaaagatggttcgtggcaccgcatcagcaaaggcgcgccggagcaggtcagccggccggccggccaccgtcagctcagccatgaattctgtaccatttgcattgcatcggtgaatttgatcttgttggtgtgcgtgtgtgtgtgtggcttagatcatcgagctgtgccgtctacgggacgacgtgagccggcgggtgcacgccatcatcgacaagttcgccgaccgcgggctgcggtcgctggcggtggcgaggcagaaggtgccggaggggagcaaggacgcgccgggcacgccgtggcagttcctcgccgtgctcccgctcttcgacccgccgcgccacgacagctccgagaccatccgtcgcgcgctcaacctcggcgtcaacgtcaagatgatcaccggcgaccagctcgccatcggcaaggagaccggccgccgcctcggcatgggcaccaacatgtacccctccagctctctgctcaaagacggcgacaccggcggcctccctgtcgacgagctcatcgagaaggccgacggcttcgccggcgtcttccccggtacgttcccagtgaccttcacaagtacaagatggaaaagcgaagccatggcgcagaactgatgatgaactgatgatgatgatgatgatgcagagcacaagtacgagatcgtgcggaggctgcaggagaggaagcacatctgcgggatgacgggggacggcgtgaacgacgcgccggcgctgaagaaggcggacatcgggatcgcggtggcggacgcgacggacgcggcgaggggggcgtcggacatcgtgctgacggagcccgggcttagcgtgatcatcagcgcggtgctgacgagccgcgccatcttccagcggatgaagaactacaccatctacgccgtgtcgatcaccatccgcgtcgtgctcggcttcctcctcctggcgctcatctggaggttcgacttcgcgcccttcatggtgctcatcatcgccatcctcaacgacggcaccatcatgaccatctccaaggaccgcgtcaagccgtccccgttgcccgacgcatggcgcctccaggagatcttcgccaccggcatcgtcctcggcacctacctcgccctcgccaccgtcctcttcttctgggccgtccgcgacaccgacttcttcacggtgaccactcatcacccaacctcgcacgcctcgccgccgcgcgctctgacgccgtgtgtttgtgggcagaggacgttcggggtgcacccgatcggaggcagcacggaggagctgatgg

SEQ ID NO: 63004 - DNA, 2434 bp, Oryza sativa
cgaacgcacgcagatggcaacgctgatcgcggtgtacgcgaactggccgttcgcgaagatgaagggcatcgggtggtcgtggggcatggtcatctggctcttcagcatcgtcaccttcttccccctcgacatcttcaagttcgccatccgctacttcctcagcggcaaagcctggaacaacgccttcgacaacaaggtaaacacggagacacggattctaatcacccgggtggacgtccacccatttatcgcatgttaattataggaatgagtttggtcgattgcgcgcgagcagacggcgttcgcgaacgagctggactacgggaagagcaagagggaggcgcagtgggcgatcgcgcagaggtcgctgcacgggctgcagcaggcggagacgtcgacggcgctgttcgacgacaacaaggactacctggagctgtcggagatcgcggagcaggcgaagcgccgcgccgagatcgccaggctacgggagctgcacacgctcaagggccacgtcgagtcggtggtcaagctcaagggcctcgacatcgacaccatccagaaccactacaccgtctagctagcaccatcgatctcacacgcatgaataccatacatgatcgatgatgctgctcgttagcttgataagtgagacaggatattctttttttttctttttttttggcagcttaatttaacggggtcaggagactgtcttaatttggtcagatgaataatgggggtacgtagcttttgttgttttaatggttttactttggagaggttgtaggtttgttggtacgtttgattggtcgaagaccagaataaaatgagggctaatttagtactttgtttgtgcatatgttgaagaatccatcagccttttcctaatgtttcaaactaagttttagcatgtactaattgttcttaggtaacactctttttaattccttgaggggatattccatcttttattgcattttatcagaaaaaatgaaaaatatatatatatatatatatatatatatatatatatatatatatatatgtcacatagcaatccataaatatgcaagtttcatttgaacttctacaattacaatagaaaaaaatatatgactataaacacatgtatacaagttagagttaattctgttaattttttataacttaggaagatcgaattttaattcgcatgtttgcaaagtggtatatagcatatcaatctatatttttttactatttttctaaaaaataagtatttaaatgacaagaaaaaggagggaatagccctcgatgggttcaaatacatttttatcattgtttatagagatcgcttggcacgattcgactcgggcacgaccaaggcacggcttgagatcagtcatgccgtacccgcccacgggttgcacatacggcctaagcacgacccaataaaaactcaggtcacttcgggcggtcgtgtcgcccgaagaaacgaccagcccatcgtgctcatccttcgaataagtctattttacctcccataagtctattttgtgtccttcatctccttggaccgtgccgataggctacagcgtgcaggagcggggcatgtcggaccgtggttgtgcttattattgggctatgtcgtgccaagccagcatgtcgtgtcgaggaagaggccaaggcacgacccaacggtcgggttgggtcgggttggcacgggcccgacaacaatcaagccttgttgtgcctaggccaagccaaatcttcatgtcgtgggccaggccgtcgagctacgggccttctggccaactatatcgtccttatacagtttctctaaatcccgtggaactatcatttactattcaaggttatacaaagattctagccttggagtatagaaataccgaacttttcattttatatattaaaatatttaaagaacaatttctattttcaaagtatcacactcctaacattctctggaatggtggttttaaagagcaccctttcgaagagtgttttttatgacgtcatacgcggttagcgcatgctaatgactgtgtgaatgagggctaactattctgccctcctagagggatgtaagagggccaacggccccctagtcgctttcctggaggtcctaagggatcgtctgcaacaaaatggccagccccatgtacaacagttagcatatattaaggttgtgccacattttgaaaaaaaaaaccactccagaagggtgttagagttataatactttaaaaataaaaattattttaaaatattttaatgaataaaataaaaataaaaaaaatctacaaatagcatatattaagaggactgcggtgtacagctcatatggagtaaactgtgggctggggaatcaaaattagtgatgaacaaaaaatggtaattgttcggcccataagaacattttggtggcccagta

SEQ ID NO: 63005 - DNA, 4937 bp, Oryza sativa
  unsure (1)..(4937): unsure at all n locations
attcctgcagccctccaattaaactcaatgtttttcttgtgataaattcaaagcatgctatgtgcattgaaagagaaaggaaaagttcaaaatcatgttaatggaccgacaaaatgatgcgatctgaatttaaatttttttcagacaggtgaatttaaacattgcactgtacccatgtcacaattgattggcactgagatggtgacatcttctcaacaggcttcctccccataaggagctctagaagcactactccgaacgcgtatacatcgctcttttcagtcaacttccctgaaatcgacatggccgctaaatgtcacataatgaaagtagcatttcagtgtcaataatatagttttgtcaacaaataggagtatgatttgggacgaggaagacatagtaccatccaacaagtactcaggagctacataacccaaggtcccggagagcttcacactccctttgttgacactcccactagacacagcaagaccaaaatctgcaatctgcaaatttcagcaaagtacaacaactgaagcttcaccaaattttaactttgatcccagcactaggacctgctgtcaatatgaacaagatagtttggcctttctgaaaattaaaggagtgtaccttagcattgaagtctgaatccaaaagtatgttagacgatttcagatccctatggatcactggtggactgcagtgctcatgaaggtactctaatcccctgacanaattttaannttttaccagtgcatanttanntaaccagctaatcattcaccaaatcatttttttnctcttaaaaaagagcatcattcagtgtgaaggaaagtggagggataagattataagaacctggccgtgtcaagggcgatcttcatccggatgtgccagctcagagttgatccatgtgaagaccctgaagacaaccactacacatatcaaaagctcccaatctggaaggaagatctcatctcatggaagagctaagctgcagctagctgtgactgtgagtgagtgacaactgacaaggcagagcccaatcatacaggacaataaatactataccatgaagctgtgtttccagtgatcccttctccatcagctcataaacaatgtagtgattcccctcatggatacagaagcccaagagggacacaatgttggggtgcctgatcctgccaagcaaatccagctcattctgccaacaaccacaaccccaaagcaattcagctcaacaacactgaacaccatacttccccttatcaatgggaactgaacttttacggtacaatttactgatagtatatactgtcagtatataggttgcaagtttactgatgggctaatggcattgcgttgtttatactgacagtatatactactactagtaaattgtaccgtaaaagttctcaccaacaattgaccatgaccagcaacagagtcacctcgaattccttctcgcagtcgggcccgccgccgtcgagccgcttcaccgccgcggtaactccggcgtcgaacgccgccttgtagacgcggccaaacccgccgacaccgagcatgttgctctcgctgaacttctctgtcgctgcctccagcgacgggtactcgaacatcccaaccagcctcttcctgctcatcttcaccgagttgaacctgctcaagatcggcaccagcttgatccccttcgctgcgtctgaaccatgtggattaagccagaattgtaattacagatagctcaagaacccaaaattgggtgagcgattgaatgagcggggttaagatcgacctgagctcctggtgaccttgccgccggtgctccggcgagatcgccgccatagtgtccaagcgtagagcgtggaaaggaagatcgtgacggtggcgatgcaggcgaggacggcggcgatgaccagctcgcggtggaaatggtggtgcactacgatcactgcaagccagcacaggtagcttgagacccactaagtaggagtaaattaattggacatgaacagatgcgccatctttttttttttttggtttaatctttgaaacggccttgaatcctggaaagatttgatgacagtaaactctaacgaaagaacaggtacgattgcattaaaacacgcagcgagatttccgcaataacgttgatgccacgtttttccccctcaaatttgaacaaaacgtaacatcccaaaatgcagattttgagaactcaaaacaaagaagattttctttttgttcagctagaaataaagcagagttgttggttcgaatgcaggcaacacaatgtcgatccccccaaaaaaatatatttctttttgccatcaagaagaacagtgcatgcttaaccaaatctgcagagaggacaaactctgtaaagagaaacagttccaaactcgaaaccgacaaaacagtaagaacacacacacacaccaaaattctgaatttcagctttcagcaccagcaacgtacgtaccaacaggcggaggcgccggaactgccgaagacaaggcggccgtcccattggcggcggcggcggcggcggcggaaatgccggtggccacagtagacgtcgccggagaagaagaagaagaagaagaagaagaagaagaagaagaagaagaagaagaagaagaagaagaagaaggcgtatccctcccattggccaacgagcacgaagatagcaccaagaacaagacggacgaacacaggagcggcaatggagttagcgccatctccatactctctccctttctgctgccctctccaggagaccaggaactcgaaatttcgtactgcctttgtggcgatggaagggagacggcatgaaagtgagaagaatctcaaggagggaaaaagaaaaggaaaggagtagtgccactactagctagtatcactgccctatgctgaacctgccgccactatttgtctatggcaatggggttctctcttgtgtgtgtataggttgctgccattttattcggtgtgctgtacgtgtgcacggacggcagagcaaactggtcgcgtggggccagtttgacagtgagaccagccatgtgcaattacgagaaggtggcggggtcagtcatcagtgtgtgtgagagagaggctgcaaattgtgaatattgcatctgtggagaggacaaaaagaagaaaagaatcgccttgttttgttgtgttcttgtgcttggtttgttcagatccattgcctggatgttttcataatttggtcattttcgaaaacttattttacaaatagatccctaaaaaacttatcccagaaataatcatttttgagcgtcagagtcgctggcactgctatccaacgggacggcgtcggcctctctggcaccaccccttgccaccgtggcggtccgcgctgacgtggcagtggagcgcgccatgttggtgtcggctcccctcccacccacggcgccacccactagtgtagaggaaagagaggtccaagttttttaaaattttttgatatttttttcacacttaggagcacataggaacaaaccatagaaaaaattagttcaaacagacgaaatatgttacttgtagaatttttcaaagttgtatcgaaaagcttcttacctcgaaaacaaaatcttccaagtggaattttgagattctgatttcgctgaacccgacgaagcagagagaataggatgaactttttatatagatgtccgtagatatataatttgcctgattccgagttaatatgaaaaagttatatatgttttaaggaaggacactcgaatataacaagtaaaaatgaactcaacaaaccctaactttttttataggatgtaaaaaaaaggctcaagagtttataggattacggaaatcgaatctactaattttttccgactatagaaaaaacaaaaacaacaaagaacagaaagtctctcaccgataaatcttagtgcatttaaggagaggggagagagagagagagcaagagcaacactccgactcgcgctgggagggtgctgggggagggagcatcatttggcgtgctccccctgctacgtcagtatctggccgccgtattgtgccacggtggcaaggggcggcgccagccactcttgcgttcaaaaggaaccatttctgggataatttttttaagggtttatttataaaatatgattttcacaagtttccaacgcttaactcattttcaccggatatgttatctttgggatataatgagaaatggatatttaaccatgaattatttctataaagctatgaaataccaagaaattaactttgtgtaaaaaaattgggggcttcaagcccagttgaaaataaaaatcgctatgtgtttaatgtatcatgtacacctaagcttttcgtatacacataggacacaccaactaataagtttcaccgaagaatctagaaaaaaaatatacatgtgttttttaatatcattacactcatgggtaaagtcttaacatcaaattcatcatattttagctataacaaaaaaaaattgacagttttaaggttataaatcgatcagaattttatcttttttgtgctccatatatatagaatggatttgaagataagattttacatataaatgtgatgctactaaaagtacatatatatttttttctaaaatttaatttggtaaagtttgttatttgttgtacatgatgtgtacatgagaaaacttgtgtgtatatgatatgttcctgtttaaaagggaatggagcgaaaaagatagaaaacacaaataaaactattcaaatctcttaattgattgtccagtggccaaactggtccgggaatgtgatttattgtaaaaagaaaaaaaaaacagtgaggaatgcacatgtttaggaattaggactggctagggcgagtttagaaggaggatttggaaacccatcctctccggcatgtaaaatgga

SEQ ID NO: 63006 - DNA, 2212 bp, Oryza sativa
catactaattcattatgtatgtcattattagtatttctttgtggtatcgtttacacaaacagaacgaaagcagaagaaagctgctgtgagggggtcctgttacaaagacaagtggtaaatgtcatcttttgctcgagatttggacggagggtcaacatgaagcggctggagtagcagaagaggaagatctgatgcaatcatggcttaagttgcctcctttcaggtcttgtgcttctatgaggtgaaaggtgcttttgcctgtatgtttctgcctgttttgctgagaaaggtgcttttgcctgagtatgaaacttgtaggtctgtggtgatataaggccatgtacaacgttccaccctatcatgtggtctaagcctccacgtcggagccgagcacccatggtagtgggaaccgtggttccatgaacccttgccgtgcatacctgcagaggtcacagttacctcagcgtgcttcagctcaagaggtgtgaaaccacttctcgggggtcacgtgttggggagaaccagagcctcgtgacgcgcttggggaaaaggagaggtcgagaaggacttcccgtggtcgtcgtcgccgctcaccgccaccgttgtggtcgtgtcactgctcgccaaatccgccgctgccagatccagcgagctcgtggccggattcggtgagctcatggccggatccatcgccgccggtggcccctcaccgtcacgagaagggggtgggaggggagaggccagccgatgtggccagatccggcgccgggatcctccgccgccaccgctcgcagagaagggagggggagaggccggaggtggaagaggagcactgcagcggtaaatggagaggagggggagaggcgccactggcagaagaggagtcgccggcgttcggatgcggagaagaggaggtgacgcgaaaaagggaaggggtgcctatgatacgaatagagtgcggtaatggagagaagaaggtgggtgtgagaggttaacagtgggtccatatgtagattagaggtatccatgttttttttatatggaataaaattgttaatcttataataataaatattgtaagggctgacatataaataaccagggtcgaaacacaaaatatactcaacagtagtctccattgtagattgtgtggcttttatgtgatcttatcctatttggtatgttgagacctctattgtacatgccctaagttaacaaggcttggtcctgctcctcgggtgatttttgtctgtaagtcatggggtgtctagctcttgtgaagggtgggatggcacctgacacaatctatctagctgcggaattttttttaaagaaacacaatacaagtgtaggcgttcaaacgcacacatgcgcactctaccatcattaacattttctaaaaactgagtcgatattaccttaagatagacgaagtctttatatatgtctcgcaattgacaggtacgccacttaccactgaaaaaaataattatctttaaatctagatgggtcaattccaccataagaaatcaaaccaattaacctatgttcacttaacagtcagtcgtcaagttaaaaaaagaggaaaacggtgtttttttttctccttttttatataaggtttacatttctattaatgaaaatggggggctatgtccttgataagaaaattaatttatgttttgcatatttgcctaaaaattccaaacactcaacagcatcagggagtactacagtagctgttgtacaagcaagtgccaggataagctaagcaccaaaagaagccgacctaataacttcgctacagtaaccatgagaggactcccccatcccccgagcattatctccacacccgtctcgtctccttgtacgttaatccagcatcagctctgtgtgggtcccacctgtctgtcactcactggccaccgacaaggcaacaaccagtgacgtcgtcctttggtaaattgttgcaagaagaagcaggggaccgacggcactatttgcctttcttctgttatgatcataacctattcctatcctatatcctatcacaacaacaaactacggtactttgctcatcaagaacgaaataatgggatcgttagtacttagcacgtattagagtgctactttcttccgttcatcgaccatcgtatctagaaaaatggtcggcagcgcataattgatcaccatctgtgtgggctgcaggaat

SEQ ID NO: 63007 - DNA, 5083 bp, Oryza sativa
ttgtttgcaaagtgacgtggttttatattagggtttgttcagttgatccttacatggaaggggttgaagggattaggagagattaattttgttcttaacaatgcattgtctggttaatcttcaggagggagggattgaaaggaattaattccacttctcaatatgtgtgaaattatctctccaaattcattcaggctgcgtttgggaggagagtttggtaacccctcctccccggcatgcaaaacgaagtatgtgttagtgcatattaattaagtattattttttttaaaaaaatggattaatatgatttttaaaacaactttcgtatataatttatttttgcaaaaaaatcacaccatttagcagtttgaaaaacgtgcgcgcgtaaaacgagagatatgggttgggaaaactggggaagaacacggcctcaacccactatggagaggattaaccaaacaagaccttaatgtgaaataaaatcctcttcaattgccctttaatcccttttaaagaggtattaaccgaacaggaccttagcgggaatgctagaaatggaatccatgcccatcaccttcccaatgtggtactcccattgggcgatgcacctcttcacctcgtcttacacctgcctccttcccttcctccaccaagcggctaacatgggccacttcgaagttggcgctacgctccacgcctcgctggcctccgtcagtcctccttggactcttgtcgctatggtagccgcatgctcaaggctgcagatctagtgcctactggctcattgtcgacgaatttgggtgatccaaaacagaaggaggagagttggtagcggctggcaaaaggaaggatgaggaatatgcatggtagcagcgatggtgatggtgccctttccacgcctagatccagtgtccttcctcaagctcattgttcctccagtgtgtgcatcgagctgtgctgcagttctttgccatggtggatggtgatagcggcatgtgcatcgatgtcatcgcaactacaacggttttctccgcatgtgcgcggattgaggacctcacactaggtagggagacacatcgacgcgtcgtggaaaggggtggaggggctcagccatagcgataacgggaggcaaggtggagcgaacggcgattgtgatgacagagatggggattcgtcggtatctacggggcaccagccctagtaccacctgtatcacttgatacctacctggtattacctgatagctagcaggtaatagatgtgatacttacctaatatcatcccgtccgaacaaaatgacgtaatataatcgccctcagtattaaaaccggcatatctctttgtaattgattatttctttcatttcaaaatttagcaatttctagtatttaaaatttagcctagaatatagcagtttatccacttacattcctttcttaacaaatcacactattttcctttaatatcttacctatctcatcttctcaacccatcacagctatcatttgtttaattttaccaattttcttaatacataaacatgttcaattctagaaaaaatcttttattttgaaccaaaaaacttattttttgtgcaaatgttctttaactagctactagctggaatctgctgcgtgtatacgtgccaatttggccgcggtttctggctcgaacgaacgttcagtacgggcatgtattgggctgagctactgcatgctggagcctggaaaagaataaaaaaataggataatgctgcgtaatttgacatgcttcccgttattcatggaaaataattaatgttacaaccaactggcaatatcagcctggaggtagcgcggcgcagtcgacgtgctcacgaagtcaacgggaaggaggcgccgctgtacgtggcagtatccgagagcacacgcgtgagtcgcatcgacgacgtacgtagcaacggactcggcgcggatcgagctcgtcgcatgggctgctgcttgcgactttgccgacctcattaccttgcgagccggccgggccccagtactgggcctgtggaccagcccaagctgggccggctctagcatctccatgattttaggagattattaggggcaaggaataagttcatccgaggtcccttaaattgtcaacgaatccgattttcgtccttcaaccagaaaaccagatacaatgtgtccctcaactatcaaaaccagtgcaggtgaggtccctcggcggttttgatggcggttttggctgacgtggtgcctacgtggctaatttgtctgggtctttatctgatgtggcaatgacgtggcattgacgtgacgcttacgtggcaattcgatacagaaaaataataaattttgtgggacccgcatgccagtttcacacatgaattaaatataaaatagtggggcccgcgtgggcccacatgtcagctaaaaaaataaagatggtggggcccacatgtccctctcggctctccctcgtccccgcggaggagcggcggcaggagcggaggggcggagcggcagcggcggcaagccacaggcggcggaggtggtcggaggaggaggtcgccgccacatgtgagcagacacagaacgaggagagaatgagagaacagtgggactgggggagtcgggtcgacgagaaatgccgatggagggcaccggtgctggcgcaacaagacggacggcgagaggcggcgtagggagctcgtccccttgcatcctggtgagggcgccgggccggcggaggtggagacgggttcagtacccatcggcggcatggtgtggggaggtcggcggcgtcgtggcgggcggcggagtcgaggaggtggtgggcggcgagcgcaggtcgacgggcggccggtggagggtgccgaggccagtgccccgttagccaggtggcagcgctgtggcggagaagtcgaggacaccgtggctggcggcagagccgcgaggcagtggcgtaggtgggccggcggcttgctccaggtgccgtcggaggcggcgcggcagtcggggctccgtgagcaggaccgtcggcgcaaagacgacgaacaggagctcgtcccccggccgccgcgcaccgccccttctcacccgacggagaggacagaggagaggggagagagatgaacacagggagctagcggatcatatctgtcacgccatgaagtttcccctttttcttgctttaaaaatttgttaaataaatcgtccaaagaaattatcttaattaacctagagctaattctctatttaataaatgaatttaataatcgaattcggcgtggtggaatttttcttgagttccccatgctccaatacattaacgagatttttagtggaattttcagagccttggaaataactttaaccaattaaaaatgagcaaatgcaatatttaatcccaggaaaaatcctatcccctttttccctttttcccatttcttttcctcattttcccacttcttgggccgtcggcccagtccactcccccttctcccgcctgcgctcggcctccctcttgctgggccggcccgcccctcccttctctctctggacgccgacaggtgggccccacctgtcggtcgtctcctacctccagccgttggagctggagctccaaccgccgccgccgaaaccgtcccgcgccgccgccttctccgttccacgtcgtgccccactccgcgtccacgtgcacccgcgcccacgtcgtcacccacgccccgctttcctgccccacgcgcgctcgcaaggggcggattcaattttgaatctcctctctctctctactctcccacgtctctggccaaataggggccatccccggccacgtccgtccctcccatgcctataaaatccttcccccgagccccctctctcgtttcccttgcttgccgccccctcccgtgcttcctaccgcgctcgcgccgctcgccgcacgcaccgccgcttgccgccgcctccggccgcacgccgccatcgctagatctgtcgcctcgccgcacaatcaccgccgctagcttcgccgccgcgagagctacctcgaccgccgctcgctttccgtgcgccgccgccgtaccgctctcctcacacgccgccgcctactaccgccgccataccgctctctccacgcgccgccgcctactggccgcgcgccaccgccgctaaagctgccgccgcgtcgtgaaaccgccgctgtcgcgctcgccagtgtcgcccgcacctcggccgccacttggttgccatccgccgccgccggaacccgattccctcgcatcgccggtgaggaccacctctctctcctccttcctttcctctctcccgtgcacaccgctgccctccgcacgtgcgtcgtcgccttcggccgacgccgccacctttcgcgccatccgccgccgccgcttgtcgtcgccggcagacgtgcgccgtcgccgcctcgccatggccggccgacttgagccgtgccgagccagcaaccaccccccctttagccactgccagtggggcccgcgtgccgtcaccccctccctctccccttgtgccgctgacatgcggggcccgcctgtcggcgctgcccccctcccttgatgacgtcggctcgggtgatattgcgcaataaataattaaggactttttctttattaataaaaacacatattatcttctaaaattcataactaattcatccgagctctgtttaagtccattcaagtctcagtaaattcataaaaatccctaaaatccattaaaatggtttgttttctgtttcagtagtcttatagcatgttttgcttgtgtgctttgtttgtcgcgtagatttcggtcgtttcgtcgatccgcggtttctcgaagacgttgctgtggtctcattagtgcgagagcaaggcaagtcatgcattacaattgatcatattgtacccaatttacaaatatcctgcatttctattaaatattgcattcttttacaatgtcatgtgggatgggtcctattactcagccatttattgtttaccttatgccattgataacttgggtatcaaaatgattagatgttggtttaggaaatgcttagccatgcctag

SEQ ID NO: 63008 - DNA, 2375 bp, Oryza sativa
actggcttttgaggggtgggggtgaaacattagcgtggtgtggatggttaggggagggttatgcggagggtcttgtcacgatttccccctttgcagtatcatggtgatacttcggggcatggcgacatgtgtggaatcgtgtcttgtgggtacagttgtacacctctggccatagtaaaactattcgaatagccgtgcccgcggttatgggcgatcaactagattcaccgtgattagtctcacccctagtttagcttaatgaactggtgtagttcaggtgttggttgggcctgttgcaacgtggtgtagcgttggacagtgattggttaatattgattaattactacaattgttttaatgttttcaactactatttttaaatggctgctttatgcaaatgaacccctagcctcctttggttatatcctgcatcatatctcctcttccggtatgacttgctgagtacagtgggtagtactcagtcttgctctcttttcccccacaccagagctgaagatcttcctagttggagctgtcttgttgaagttggtttcgtcgttgccgtcaagggttgcctgtggagtggagtcgccccgctgcagaattcaagcgtccaagtctagctcgttttaccttttccgctgcatttgtaatcttttatatttttggtaagacgtggatctgtatgtcaacaattatcgtttgtgtaccctggctggtcctggacagggatttaatgtacattcagcttagaaattctggttagtaaatttctgggcgtgacaagttggtatcagagccgaccttgaccgtaggacaagccaactggaaacctaagagccctctcaaccccttttcatctgcatatgccttttgcacctggatttgttttgggaaaatttggggttttgcctctttggtttgtgggaaaaatcttggtcgttcattcagatcggatctttaaaattagctcagtctagggttttagtaagattttatttggagtttattcgacagtcactcgggaatctattgggtggtatgcactaagtcgtgtctaggttcgatggggcaattttacgcgtatcattatgactatgcatctattttatgcattaatttagtgtttagttagttacattagtatcctctgtttgggttcatcaaaagtgttatatgcataaaaatcagccatgctcagttatttgtttgagtaatttgttgctttgtttatttggatttgagcatgcgttgattccttatctctagcccgctgctacagatctatagcccgctgctcttctctctctttatttatctctttaaaatatgtttatagctggtttatagcctgctattgtacctgctcttaagctttattgtaattctaagggggggtgtttagatataggggtgtaaagttctatcgtctcacatcgggtattatatagagtgtcatatggagtgttcgggcactaataaaaaaactaattatagaatctgtcagtaaacagcgagaggaatttattaagcctaattaattcattattagcaaatgtttactgtagcaccacattgttaaattatggagtaattagacttgaaaattgttttagcttgtatttaatattttatgtaggtattcaaacatttgatgtgacaaaggtataaattttttttgttaggaactaaaaagggccatagcatggagaccgctttgcttccattccaccaatttcacttatggcaagtggtaactactcccatgatggaacggcctgcatttaccgggaatagcgtgcaatagcctttctgggtccgtaggcctggcctggaaggggcaagggcatagggatcgaggcgtagcgtagagtccactagggatgaaaacggagcggatacggacgtttaatgctcatactatattcgttttcatattttttaccggatacgaaaacgaatacggatagcttgaatacggaaacaaatacggattatctcgaatacgaataagaatcgaatatgatcggacacgaatacggaaacaaatttttctcggaacacgaaaaccaactcaacttctaatagaaataaatatcaatatatataattagctcattttatataaaatgaggtataatttataaatattttttaaaatttaaataatattaatagtatggactagtgttaagagataaactattattaaaatctataaaggtatattgaaggttatagaattagaaagaaatagggtatgtctcatgggtcctgcggatatccgaatagcactgttcaccggatatctgaattattatccgtattcgacggaaaccctgatatcatattcgtattcatatccgggagaaaat

SEQ ID NO: 63009 - DNA, 11867 bp, Oryza sativa
  unsure (1)..(11867): unsure at all n locations
ctaatattttgagaggggctaattcactttagccccaaattagcccatctgtttggattcttaggggctaattcagggctaaaaggtgagggctaataattagcgtatagaaccaaacagggcccagctctttctccacaatacaagctatgggacccacagtaatattatattttctttctttttttgagaaagtaatattctattttcagtcctgcttatttgcgtttcagtcatccaattagtacaaacaccatcataaaaaagaagaatcatatcttactataaaataaagttacaacccactaaatcctaaaacttaatatgcaaaataccacatcatcattcactaataattattacatcttaaacatcatgtgagcatgctatattatctataattttatgatttattaaattttagagctttaaaatacaaacatgttaaattatcatcccatataattcacataatattttaatatatatctccatcattttttataatattctatatacctatatagtttatcctcatttgcttaatattatttctcttctcgcattaagtcatatcacattaattgtttttagccctcagatgattaatatatggtccaaattatctccatcattttcttgtcttattaaaccatatcacctcaattttattttatgccttagatgattaatttatggttcaaattattttcctccttttcttctcttataatgccacatcaccttacttttatatttaaatcatcattttatatactatttaaattaccgtaaaccatatcaacttatgtaagattatatcgtctagcaattttacacattatttctacttattgttatcattctaaactcccgcagcaatgcacggagttttaccttgttgtatagaaaccagaaacattttcctcaacctatttccccaccattgctcacctcaagcattcgagctccgattctcgcccgcctagcgcgtcaccataggtgccagctggtacctccaacctatccttccccaccactgagatgctgctttgccactgctgtggcctctctcctcttcccaccttggcaacgagcaccgccacctccacaggcctctcccctcccctttctccagtcatcacggtccccaacacaacttaaaaatgattttacggatgcatcccctattttatcgtaggcaagctaaaacaacatccgcatgtcaaaagatttgggtggtttttggttaagatgacccgcatacaaaaatatgctattttcgtaggcggtcctcttaagagtcccaactgcaaaaatatattttcagatgtggaggttcctctccgccctacctccccctcacctccactcttttatttcgttcgtcccactcccaattccctcacccactgctccgttccccctcacttaccctctctttcccaatcagccggccggcctcctcgcctctccgagcggcagtggcgggattcgagcttggagcagcaacggcctcggacagccacaggagcagtagtgttggcttcgtgcagcggtggtgaccacgtcaccatgagcggtaaccacgatcacagtggcagcgtgcggtggatccactgttggcaggctcaggaaggatggatatgctgccagcgggctcgggaaggacaaatctgctgctagcagactcgggaaggacgaatccgctgcctggctcgggagcggctgatccgtcctcgcatgtggcggaaaggaggccgaaggacagcatgtgaccacggcaccaggagcagcgaccatgatcacgatggctgcgcgtgtgggctcgggagtgacagatctgtcgccggcgggctcaaaaagggtggggccngggccccttggctcgaaaatggcggatccacgctcacgttccatataaacaacggtcgcgtggtgacatttgacgccgataaacctctgcaacatttgcctcattgccacctagctatggctttggttttttttttaataagaccttcaacttggccacttgcaaaaattcgatctttgcaagcgcgccttattaagatgtctatatgcaaattatggtatcgcatgcggttttggcagtgcacatgcccctgaaaataccgattttcgcagactccttgcgcccgacaagtggagcactcaattgtgaagatcctttatgtagtaatgcaacctcgtcgttggaggctgtaggtggagcatgagagcatgatatgttccttttgccttgattgataccaggcttgttccttaagtatcatgctgacatcaatatggtacataggtaatagaatatctggtatctacggtatcatatcttatacatgtatcatgctaacgtcaacacataaagtgttctattggctgaacggtataccgttctctactcacactcgaacaataaacccaattgtaagtacaaatccggcacctatggtaatctacgtgtttccatatatatatatatatatatgtgtgtgtgtgtgtgtgtgtgtgtgtgtgtgtgtgtgacatgataattcatgttttccattttcggaaataaattaatttagccatatataccgcggatgcaccaaccgagcacgcattcccgcacatttaattcccggtttaattcatacacatgtctactatgtactggcacctgcctatatatatactgggatggcagcaaagggcacacacgtacgcacacctgtcttgcgttgcattccgttgctttctcttacgagcactgcgcaagaagcgagagcccaagagcagctagctagcaatgggtgtcaagctgttggctgacggctgcgccggcgcctcgtcgtcgcctgcgctgtcgcgggtggcgacctccgcggcgcacggcgagggctccccctacttcgccgggtggaaggcctacgacgaagacccctacgacgccgccgcgaacccggacggcgtcatccagatgggcctcgccgagaaccaggtctccatcgacctcctcgagggctacctccgggagcacccggaggccgccgcctggggcgtcgccggcgacggcggcggcgacagcttcagggacaatgcgctgttccaggactaccatggcctcgccaacttcaggaaggtacgtgacaacctgacaattgacaaactgctctgttttctaagcagcttgcttgtccacaactagcttgcatgcatggctcccgagtttgacttttacatctggatgattgcatttgtttctcactcgtcaactatcaatctgatggtcgttgactcgttgtgaataatttttgaaatatttgaccaaattcttatttattgtgtacatcctgtaaaaatgctctgtatttggcatgccgagttggacttctacaatttgattgcattttgtttcagcctcctcaactataatcagccaaatagttataaatatttttttgaagaaaaaatgacaacatttatacaataagtcttctaccaccttgtaaaattgtaagtccaaattttatctacaaagagaaataaaataaaatagactaatttggttatgaatgatactaacattgcatttagtcattttttgatgcgtagtgcagataaaatttagtaatgcatatttgcgaaatgatacataatattgtactatatgttacagattttttttttctaaaacaatacaacatgcataagatgggtgaaaatacacaaaaaaaaaaaacaaatctccatgcatgcaggcgatggcaagattcatggagaagataatgggtggcaaggcgacgttcgaccccgaccgcatcgtcctcactgccggagcgacggcggccaacgagctcctcaccttcatcctcgccgaccccagagacgccctgctgatccctaccccttactatccagggtagtcgttcaacctattacttttcgttccataatataataaattatactactccatctaaaaaaacgaattcctacatgtatctaagttcgtaggtaggatttgtctttttttttggacggagagggtagctatgaatctgaataaggttatatctatgatcatagctagaaaattatatttggaacaaaggtagcagcaatgcatacgactagccagtttgtactccatctgtgccataatataaggaatttcgggtgaatgtgacacatcctaatacaataaatctaaacagatagtctgtccagattcattctatatttgtactagaatatatcatgggacgaagggagttatgttgtgccaataatcctgtgcaccagctcagtgctcagcttcagacccatcagagtggctgacatgacatccatggcggctgtgcgcgcgggtgcctgtgcatgcaggttcgacagggacctgaggtggaggacgggcgtcaacgtcgtgccggtgcactgcgacagcgcgaacgggttccaggtcacggccgccgcgctccaggcggcgcacgacgaggccgccgcggcgggcatgcgcgtccgcggcgtcctgatcacgaacccgtccaacccgctcggcaccacggcgaggcgcgaggcgctcgagggcatcctcggcttcgtggcgcgcaacgacatccacctcgtctccgacgagatctactccggctccgtcttcgccgcgccggacctcgtcagcgtggcggagctcgtcgagtcgtcgtcctcgcgcgcacggcaccgcggcgaggacgacgacggcgacgtcggcgtcgccgaccgcgtgcacgtcgtgtacagcctgtccaaggacctgggcctcccggggttccgcgtcggcgtggtgtactcgcgcaacgacgccgtggtcgccgcggcgcggcgcatgtcgagcttcaccctcgtgtcgtcgcagacgcagaggacgctggccgccgtgctgtccgacgaggcgttcgtcgacgcctacgtcgccgccaaccgggcgcgcctccgggagcggcacgaccacgtcgtggcggggctggcccgcgccggcgtgccgtgcctgcgcggcaacgccgggctgttcgtgtggatggacatgcggcggctcctgctcggcgacggcggcgacgccgcgaccttcgccggcgagctgaggctgtgggacaggctgctgcgcgaggtgaagctcaacgtctcgccgggctcgtcgtgccattgctcggagcccggctggttcagggtgtgcttcgcgaacatgagcctggccaccctggatgttgcgctggagaggataagccgcttcatggacgcgtggtgcaaagcaacaattgggaaatttaaccatttgcaacccaacagatgtgaggtgaattattttgcacttgagaggtaccaagggcatgtgcaacagtaatcgattgctgccttagcctgctaattaggtaacttaatttgttgatgtggagtgaagagtgaggagagaaacattaactcgatcttggcctaagatataaggattgatgggcattttgaggccagggaaattgtacgagattgggagaagagagggaggggaataaaaatttaatttagtggattaagtttttttttactgtgaactgtttgctgctaccttggaggctgtgtgtgtaggctcaactgttctttttttccagaatgcagatgttttttttttcgaaatgattgaatccactaaaatactagtttaactattttcttattattttacccctatttgtgaggaccggtttagttcaatcaattttgccactctgatgttaatatagttttcacaaaaggagatgaacatctccctcttccacgaactgagtctctagatactcgtatttacaattaattatttatatttatacaggtaacagcggctatgtatctgtaagcgactgagtgcaagtactctgttttaagaacatcttgatctcccacgcaagctaaagtagcacgcatatgcatgtggcatggtaatatagtttttggccatgccatgtgtgagctagtacgatcaaaaagttcagttttgaaaaaaagttttggggatttgtttttaaaattatttaacaaaatggtttatgtaacaaatataactagcatggtggcccgcgtagattgcgtggctagtatcattatattttctctcatataatagcatatatgttttctcattatattattaaaatatattacaatgacaacatgattttaaattttgcaataactttacgaaactattaatgtgtaatattcatattgtattttatatacgtgttagttattaattatttttaatataaaattttagttatttgtaaaatatatatatttctatatggactctagacttgtcttttaatatttcttttttttaattctgaatttttattatttctaattgtatttctatgtggactctaaactcatctttcaatattctttaatttttaatttcaaattttagttacttctaaattgtattcctatattggctttaaactcttcttaccatgtttttcttaattttgaattttagttatttgtaaattgtatttttatacgaactctaaacactacttttcattttattatgtttattctgaattttagttagttttaaattcctatatggactctttactctacttctaatattccttattttttaattccaaatttcttttttttcttaattgtatttctatatggactctatactctacttctaatattcattattttaattccgaatttatattatttcctaattgtatttttatatggactctatactctatttctactctacttctaatattccttatttttaattgcaaattacagttatttcctaattttatttctatatcctcttctaatattctttttttattccgaatttcaactatttataaattgtatttctatatgaactctagtctactcttctaatattccttattttttaattctgaatttcagctatttctaaattgtatttgtatataaactcatctttcaatattctttaatttttaatttcaaatttcaattacttctaaattttattcatatattgactttaaactcttcttcccatgtttttcttaatttcgaattttagttatttgaaaattgtatttttatacggactctaaactctacttttaattttattatgtttattccgaattttagttagttttaaattcctatatgaactttattctccacttctaacattccttatttttttaattccgaatttctattttttttttcttaattgtatttctgtatggactctatactctacttctaatattccttatttttaattccgaatttctattattttctaattgtattcctgtatggattctatactctacttctaatattccttatttttaattccgaatttctattatttcctaattgtatttctatatggactctatactctacttctaatattccttattttttaattccgaatttcagttatttataaattatatttctatatggactctagtttcctctcctaatattccttattttttaattccgaattttacctatttctaaattgtatttctatatggactctgtttttctttttctccgattaatatgagaatttctagaccgtgagagcgaacgtggaggcttatttttctattcctttaataagttaatacatagatagatagatagattaccttgcatgccatacggttggggattatatgtagattatcgattttgctatatctcactcgaaagattttttcttatctctcactcgattttctcactcaaatttacagtgcattttcttgtaagttacagtgtaatttatgaaacaaacactgtaacttttgtaagttacactgtaatttttgaatcttcacatgtaaattttaaattttgtattggatttggtctttttcttgaggatatggtaatttaatgttcattatggtgtttcttaattgctttttgctttttattatatctatcggattttaatataaagattaaaaatctgtgtgatacgattataaaaatttttcgaaagatgtataggtactcccgtagattatatatagaaattcagaatccgttctctgtcactccgtttgtgccttgtgcggttgtgccgctgaatctgcagctgtcctgacccctacccctagacagtagagtctccattttcctaagcactgcactgcacgtgttattttttatcaccatgcatgtttgtatttgttattttaatttaaattgaaaataattatggtacattcacaattatatttgttattatttttgttaaaatttatagaagttgaattttaacttacatatttatgaaatgatatattttatattaatttatcttattaactttttttttaaaaaaatataactacttagatgacatacacgaaacgagaagatatattctcagagagattaaacactttccgctttggatgcacgatacggcaaccgatttatagttttataccatgataatttccgtctatatacagtagtaataaataactagtctccctacgaatttcaacgtacatctcggcgtatcgttacagttcgtggtggaaggacacgtcgacgtcagcctccgccgtcgtcgtctcagccgtgtcgttgtccctcttgttgcagccccagcggcagctccacgcgcaccgggagttgaacgactgcagccgcctggagtgcgccgccacgatcccggcggtggccgccgcccggggcagcacgacggcgtagccgtcgtccatgtaatccgtgccctccgggaacacctgccacagcagcgcccccgcgccgccgccgccgcgccgcgtcgaccgcagcatcgcgccatacaccgcctcgatgaacgcgtccctcgacgtcgcgttgaacgccgcccgggcgcccctcgtggacaccccgaactccgcgaacagcaccggcatgccgccgagcgcgccctcggcgtccgcgatgtgcgcctccacccacgacgtcgcgaacctcagctgcgcctccttcgtcgcgcccgccggcagcctgtcaagaatgtcgttagagctgcgacatctctgcgtctccggccgccgcggcggctggctgttagcctgttgccgcttaccaagtgtccgggtagacgtggacggaggcgaagtcgacgccgaggacgcggtggttgcggacgaagtcggcgccggcgagggcgacgtcggcgttggggttcacccggaggcgcgccggcggcgaggacgggccgtagaacccctcggcgccgacgccgagcaggtgcgccgggtcgacggacttgacgtggaacgccatctccgcgatccacgcctggagcgtgtcgccggtggggtcggaggcgcagcgcggctcgttcatgagctcccacgccatgatggtcgggtcgtccctgtacgccacgcccgtgtacgcgttcaccctcgtcagcaccgccgtgacgtggctcttgaagtagcccctcacggtctcgtcggagaagaaggcgtcggcgccggcgccggcggcggcggcctgcgcccaccgcacgtactgcgccttgccgccgtagtcgtcccagttgttgatcagcggaagaatcagcctgatcttgtgcttccgcgcctcgctcaccacgaaatccagggcctgcatgcgcgtacgcaggtggggaattattattatttttgaacggaaatacctggagaattaattaatcaattgaatatgaaatgcaagcaatcgatcgatcacttcgatagatcctttcaaaacgaaaatgacacgtatgtattatgtatatgtttttacgcgatcgatgctaattattgggtgaattgcgtctcagtttagaggagagatgcctgtcgtccaacccaactatgatggaatcgaatggaaattgatgcttgtggagatgtttgaagccagcaggtgtcttatctgcaagcacaatgattgtttattctgcatggtaaaatagcacaatgcatgctacatggcattcttaacggtttctgaatttgtggacaccaaagagttgtcccaggatactcatagtgtggtcagttcaacgataggattgtaaagctcaatccagtgtggtcaggagtacttttgtattgatcaccattagttagtaaatgtacaaatcatgtaatctagctatctatcatgtgaatatatatctcaatcaaggatttaaataaacgcatcattaggtataggcacagctaattgatcaatcgacgttgacttccacgtgttaaataatatttggtttacggtaaatgaaatacaggtattcaaatgtgtgatctaaacaatatacagttcaatcaaaaagaaaacgaaatatttgcgagcttgggtggcagctggctagctacgtcatcgtcgagctcgctcaccttgaagacctcctcgtcgtagactccgggtgacttctggagcgcccgccacccgccgtcgttgaacgcccacgtccggcaaaccgtgagcccgaccgccgccgcctgccggaacacctcggtgaccttccccctcgtcgacgggtcgacggcgaggaccatcagccagtacgtgttgaacccgttcacgtagaacggccggccgccgccgacgacgaactgcgcgcccctcgtcctcaccatcccccactcgccgccgccgtcgaccacctcgctgctgctcggaccatcgccgtcgtcgccgtcaacgacgatgtcggtgaggcgattacagcgccactcccagtatgatgactcgtgtagaacggcgatcgctgcggccatggcgagagctccgaggaggaagaagaagatgcagtggagcagggatgccttcctcctcgcttcttcctccctgtacgacgtctccatggccgccgccgccgccggtggtgaagctccacatggctgcaatttataccggagggaggcatgggagctgagcttgatgagatccatgtacgtacagtcagtgagcaagacagggtcgtcttggcttggaagcaacagagagagagagagagagagagagatcatggatgcagatagatggtggtggctattactatcatggacattgctgagactgatacacttgttttaggttaaggttttaagcaaaaggaatcgttaagatgtcgatttgggagggaagagattgagatgatggatcatggattagatttggcggtgctggggaagcggcaacgcaaagcgtacgtggctgcacgggagaaaatcgacgcgttcttgttgggaatgtgggcctttgtgcttctgtcttttgtgcgttagttgggccacgcccttttcgtaaacaggccttgctgggctggattttgatgtgcagttcgggttttgcttgcacgtaaccccctcataatggctcactctcttcccctcaaaatgattcactgaactggtgtaaaaaaaatgatacactgaacttattctgaaaaaataaattattttagtcatctgaactatttcattaaaacacttaaccctgtaaactatttcttttacttattttgtacagggccagtcctaaggcagtgcggtcaggacaactgccatgagctcctaaggccctgcaggctggtagtagtagtataggtcagtgcagcttccattcagttttagatctcgatgttattgattccaacttatacagatactctctccatctatttttgatagacatatttctaaatctgaaaatttatttttgataggcatatttcaatctaaccacctatcatcttaatgactttctcggatttaatgcgtaactctcca

SEQ ID NO: 63010 - DNA, 715 bp, Oryza sativa
ttcataccctccccgcctcgatcgcagccctgcgatgacgggcctcgtagtacgcctccaaggctgggtaagtcggcggttgtccctcctcggccatcctacatgaaaaagtaataaattcaccgttagttaccaatgtgacatatattaaaagaaaatgaatgcgagaacatgagtaggaaaacaaaatatttacctccctaacacttaaattttttttggacttcttcttttttggacgcttaggacacttagttttcttgtgaccctcctggtgacacaacgagcatctattttgcaccggcgcagcatcaagttgaacgcatgaaggtggtttccttccagaaccacccagacccgagtccatttcgttcttgaatcgtttcgatctcctcttccctcttgttttaatcttcaaatttgggtcagcaacaaattcttcaccattgtacgatggccactgtgtggggtcgaggtatggctcaaagcgacttgcccatgtgttcacaacggctcttgaagagaactgatacggcattcggttgggagattccttatcaattgcatgaatcagataaacgtgtataagatgtgagcaaggcatatggtagagcaatggcctttggcaagaacatgagttcccctcaccttcaactttgaaggctcttgcgccgaatctaacaccaccacgtgttataccacgggctgcaggaat

SEQ ID NO: 63011 - DNA, 722 bp, Oryza sativa
attcctgcagccctattgaacaaagaatagagagaaaacttagtagttggaaaggaaaacatatgtctgttggagatagattggttttgattaattccgtcctttctagtttagctatgttcatgatatctttctttgagattccgaaaggggttcttcaaaagattgattattatagatctcgtttcttctggcaaggggatgatcataaaaagaaatacagattaactagatgagatataatttgtcaacccaaagatcagggtggtttgggtgttcataatttagagattcaaaatatatgcctgttaagtaagtggttatataagttaattaatgagaatggtgtgtggcaagatttattgaagagaaagtatcttcataataagtctataacccaagtggataggaaacaaggtgattctcatttttggtcagggctcatgaaaataaaaaacacatttttaagtatgggctcttggattgtgaatgatggtcaacatataagattttgggaggataaatgggtagaaaacatggccttcagagataagtatccttatttatatgctattgtcagaaggaagagtgctactattgccagtgttatggcctcggttccgctaaatgtttcttttaagagagctttagttggacagaacctaactctttggtatgatttatgtgcttctattgctcacatccagttggatgattcttct

SEQ ID NO: 63012 - DNA, 3842 bp, Oryza sativa
acatacaaaacaaaactagtccacatcgaacatcacataatccacataatgcataagtccatcacatagtccaattcataggaaacatacaaaacaaaactaatccacatcaaacatcacatagtccataagtccatcacataatccacaactccatcacataatccataagttcacaagtccatcacataatccacaagtccatcgcatagtccataagttcacaagtccacatgtgcattaaacaagttaacacatatcagaaaaagttaaacttcctagaaatcacttcttgcgttgacgccaaagagcttgcgagcctggagtgtacctatatttgaaaaaccaatgttcacaacatttacaaatcgaagcgagggaaatcaaataacatatgagaatggtaagcccagtgtaactctttttccttgaccgagtggatcgtaagttgtaggtggtgggctgcgacgcctgagacacatcgggcagctgcaacatgcctatctcgtctgcgtctggtgtgatgtagtcgtcgtacaaaaataaaccaaacaacttttaaaattgttacggtataccccattcaccattcaccatacaggactgactttaccgggggcatcgtcaaaatatgtctacgtacagaccattcggggtcgctttgacttttctttttattagaaacgtttgaccatttgtattatttcaaaaattagtgcaaatataaaaaagattcatacttaaattgataataaagcaactcaaaaaagagtaaataataattccataattttttgaataagacgaatgataaaaccttacaaacaaaaactcaaagcgacaagtattttaggatggaggtagtactctcttcatccagaatataaatatctagataacttgccatgccgcatcctccttaaactcgatctcttctggataaatttccttaaatagattaatttctttaaccgaatcctccatgaatccgactgctggcgacttgataactcccatcggttgattccagaactctaaagctgatattgattttaggctgatgacatctttggggcttaccaaatttcactatcaacattggtggacagcatggtggcgacggcgaagcgggacggtgcggctgctgggtgacgacgattgagtgggggctcctcactctcacctccctcccgttgcccctgcctccattcatgacgagatgcggcgtcggaagcaggcagcgtgggtgatcctagctagctggggcggcacgatggagagggcggtgggtagcagcgaggtgtcgacagcggagtcctttcggacggcggcggcctgagtgtcgatgtcctgtccgtggcaggatgaagatggttcgggcggtggtcccgtaggcagtggcggcggcccgggacagtggtggtctgagcaccggcgcaaggatcttgtcgaggagcaggtggaggtcgaccttggcgacagcggcggcccaggacagcagcgaccttagctctggcgcaaggctcttagcgaggaacaggcggaggtcaacccaggcggcagcggcggtgggcctaggggcagcgggacaccgggacccgggacggcaatggcttgagcaccggcacgacgctcccagcgaggagcaaggctgaggttgactctagcggcggcaatggccctatgggcaacggtggcgccctgagaacgggcacaggactctcaatgaggagcaggtggaggtcggccccagcggcggcgggctgggagtacaaaaggcggacaaacatcctctgacgacaacgatggccctatgggcggcagaggccaaggaattttggcgaagtggaagtcgatcccgtcggctcgcggctagttctgactaaacaccgaacgatgatggatgaaagtcagatgaagatggcaccaacgaaggttgacaacgacggcacactaggggccgcggcgactagacgacttccactcgctagtatgtcgggaagaagagaaggaggggtgtgccgaggtcatttgtttttcttttcttttttgattgagtgttctcctccttgttgaggtgtgagtctaagtgttcttatatccttttggctctgtatatcctatccttcatgtatatagaggccggactaatgaaaatctattatctaaaaaaaatcttccactcacaccaaagccaaatataatccacacaaacaaaacgagctcctgccaaacttggtaaaggtgataggcaccgaaagccacctcacttccaatggacggcagaatcccagctatagctagctagcttaggttcttcgttccgggatcagttgacagtgtcccccatcacatctgcttcccctctgcatcgtctgtcaatacgatccgcggttcggctggtttccactttctccaggcagactggcgtttttccaagctgtcatttgctagtggttgctattagtgatttgattggaacctgtagtaccggctagtggatgtcgttcacatctgatgttccaagaagcaagagcagcgaattaaccaggtttgttcatacagcaacgagcagcaggaagcaattgcacattgtttgaacattcactgaaccgggaggtgagatagccgttccttgactcatgtcatcactcatcacatctgatcagggtcaatgaggaggaatatccaatattacctttgtttattaccaacctcttgaaattaagatacttgaacaatgctgaaaaattctggaaatacttcaagagtagggcactggtattatatacataccaataccatcctgaaaatgttagaggacggtcagggcaccaaggttcagtgttgtgcaatatgatctatgatgctgatctacttgtagtttaatacaggatgggatcaaacagctgaaagtacagaacttctcgtagttgtaaaagggagtatgtagtcaaaactcagaaagggataagtgggtgatatcttccatgctcttttattacaagattacaactgcattaggaggtaagaatctcaacccccttcaatttagaggtacctatacaattactgcgattttgaaagaaacatagatctgctaaagaactaaaacatacatatatttagcccaaaatgatgcatagcaaggctagtagagcaagtaagataactatacaattagctattcctgacaagaattctgttgaggcacaccacaaatctagggagcaatattagagcttgcaatttgattttcatcttccatctggtgtcatgagctgggagaagatgttgcttggggtcagcccatcagactccacgctcgcaatgctacggtcagtgatgctcaaagaagttgtcgttgtagtggtagtagtcacgtcggtcgacggctcatctgaatgcagcctggccacaaccagcggcgacgtgctcgctgacgtcccctcggtcaggctgctactgtcctccgtgctctcctgcagctggagcgcaaactcgaggttccagagcacatcacccatggacggcctgtcgacgctgcgatcggccacacatttctccgcggtctcggcgaacttcaagaagcactggggagcgatcttccctttgaggagtgggtcaatgatctcgccaagaacacctttcttctggcaacgcagagcccagtctgcaaggctcacttgctccttcggaagtgatgggctcagggcgttgcgggcgcacaggacctcgaacagcacaactccgaaggagtagacatcagatttctcggtaagctgctgccgtcggaagtactcaggatcaaggtatccgaagctgcccttcaccactgtgct

SEQ ID NO: 63013 - DNA, 2202 bp, Oryza sativa
tgcacccgtgtgcaggtaatacagcccacgggcggcgccgatgcagatctccagcctctgcttccacgacaatggtgggttcttggtgttgtacaagtgttctcgaagtgtcccatgagccatgtagtcatataccaaaatcatctcattcctatcctcgcagtacccgattagagacacaaggtgacggtgtcggagcttggacagcatctcaatctcattctggaactcatggacaccctgctcagacagcgggttcccacgcttgattgcaactctagtgccactgtctatctctccaaggtaaacgttgccaaatccacctttgccgaggaggaaggatttgtcgaaattgttggtggcagcctggatttctgcaaacgaaaagtgccggcaaagattggctggcagcatcgagtggctccctgtgttggttgtctttcctgaggtggctgactgtgacttggtgaaatcagtgagaggagtccagcgtccttcatcagatttgccagtatcctttgctaccttcttctttcgtctacagatgatgcacaatccaacacaagcaatcaacaacacggcaaggccacccactgctccacctatggctgctggggcaacactctttgatttacctctactagatcccccattgggattcacaccaggctttggtggaagtggagggttgagcccagcaaggttatttcttccaaggtcctgtagcttgaagacctcaaggccatttagtattgcatcaaaatactctggtttgcttgaaagatcagggtgaagcgcgacccacaggtccgtctggccagaaccaaccgttgtgacaacatagttggtatatgttgttctgccaattcctccactccaaacaatgacgtccatttgattctgcgccgtctggttgttgatgtaaatgaaaaatgatctctgattcaccttggttattggatactggatctcacagaaatggaacctcaagaggtaggtgaaccccgcatcaaccggtaagatccatgtaagattgtagttcaggttgatctgtgcagttggccccattgaccttgctgttgcgtagactgcaactggtgcagtgtaatttggctcagtatttggatatttgatggtgacattaccatctttggagaaggtcaccccataggcagcaccatatatgtaaggagaatcattatcccaagaacgatagaatccagaatcaccttgcggagagatgggctgtcccccaacattgagccggtacatcgtttggagacccatcacaggatctatgccatattgcacattgtccccgccattggcagatgtaggtgtcggtgttgtgaagatgtcaggcgtgggcacaatctcaatcccattcacaaatgcataagacccgtttcgtgtggacggggcaaaggtgagttttaggctgcttgaagtgacattaaccgagaattctcgaaagaagtaggcagagcttgttgccagagcagtttgtgatgcgttgaagttgtctaaaaggatcagattgttggttgtgacaccaaagtaggcatttgcagaatcaaggttcccattataattagttggatagaagtgtaggcgcacgaacatgcggcctgggctgacagggaaggaataggtgtaatttgaagtgaagaatcgagcagtcatgtaaggcacgggtgatgggagcgaagggtcttggtatgaagccctggctacattgcctttcaccgatggcgcaaacttggagctagcatccccatcccagctccgattgtagctatcaggttgcacaccagaggctccacaattcagaaagattggagcagaggccgtggaattgttatcagccgccatggcaatcgataggagggctgacagtgtgagccattggatggtagctagtaggcttgggtgcatcattgaagtggtggttggtgtatcaggatcaaaagtttgaggattcgttcacatcaatttgctataagagttgggaacacttgcataatgccttttctctgggtgggatttgaggcaaggaaaatgtagagtttggaggattgtactcttgtttactgaagaaagcacatccagatagctgtaatcctgtagattcacctgcaatcagagcaaacgaagggttcggaaattctgcaaattgtagattggaaagatgaataacaagaa

SEQ ID NO: 63014 - DNA, 17196 bp, Oryza sativa
tgcacttgttggagtattctacccgtacaatcgtggtgctctttttactgcattggttgtcatctatgctctcacttcaggaattgctgggtatattgcaacctctttctactgtcagctagagggaacaaactgggtatgtgttacatgtatacataatacatccctagacacttctacaatgctaagactgcaaatttaaaagcatcgattataattcttttattactaatgctatcgttttatacttctcaggtgaggaacttgctgttgacaggatgcctgttctgtggacccctattcctgactttctgcttcctaaacactgttgctattgcttatagtgcaacagcagctttgcccttcggcactatctgtgtcattgtgctcatctggaccttagttacatttccccttctagttttgggaggcattgctggtaaaaacagcaagactgaattccaagctccctgccgtaccaccaaatatcctagggagattcctccacttccgtggtaccggcaaacaatcccgcagatggctatggctgggtttttacctttcagtgccatctatattgagctctactacatctttgctagtgtttggggccacaggatttacacaatttacagcattctcttcatagtcttcatcatcctccttattgttactgccttcattactgttgcactgacgtactttcagcttgctgctgaagaccatgaatggtggtggaggtacattcatttccctttatgttttttaaacaagtactggcatgggaatgcatcatatatttcattttatacactgaaactgatattttgggtatttgcttttatttattgagctctgagatcaatcaggtggctgtcaattttctgcagttattttttcgtttgtttgacatcttattcatatgtatttcctgggcacccttctgttgttttcccatagttacaattggagttgctgattagcaaagtattatcgtagtgaaattttgagtacaatgcaataaccaattatgtatcatctcaatggattctagagggactagttcttgaaatctgttgcaactctacatttttttgtcatgagcaaggtatacaatgctgagcagtgagcaccacccatttatggatattctaccaatccttatgttctctcatccatctatttattatctaggaactccagtttaatgctgttcttttgtactaaatgctgaacaacaatatgattttttttctgccctttctcttatacaggtcattcctatgtggaggatcaactggattttttgtctatgggtattgtctgtactactattatgcacgatcagatatgtctggatttatgcagacatcattcttcttcggctacatggcttgcatctgctatgctttcttcctgatgctgggcatgatcggtttccgtgccgcattgttctttgtccgtcacatatacaaatccatcaagtgtgagtaatactgttgtcaaaggctggagagcagcggagttgtactcctttttggtgccactaagaagtcccagtatagaaaaggttagctctcgcacaacaggagcagctagagattgccatgtttcaggttaggccattattcataggaacaggtaatgaacctataaatttgttctccttttgtgcgactgctgtgataaatcgtcttttctttggtcatgtaattctccctgtgatgtctagacattttcacgttgttgatgcatgacctacctgagcatctctggaagatcatgtcatgtcttatttcctatagcagaataactgaagtgtagagatgatgcctctagagcggcttgtctatttatacgtgtacccaccgctggttatgtattgtcaaatattgaaatactgaaccattctttttttttcacttttgagaatcatgatcattttgattgatagtgcgaagcagcttccaatgtgcaactaggcttgacacgttatatttgttgatgtgattcgttcttcataatccagcgaagcttgttctgcttttggactgcattttctgaaaagttacatcttttctattgctaatgagacagaaaaacctattccatctgtactaagataactttattttaacatctaacatttgtcccaaaacaaattctatgctcttacctatcattcagtctaaaattaaagtttttatcatttcagtatcttttatctacccatccattaatataacatttctattaattagggccacttttttctgtgctaatttgaacccttatgtctgaagttattttgagcccttatgcctgaagttattttgggacagatgtaagtacataaaataattcttaaaattgtactataattaagcttcggggtataatttagatagtacgaagaagtttcaaccctctcttaattgtagaaaatgactagcatgatagccatcgatatggatgtattagaacgccacttggattatcacttgctctgatccacatcgcatcgacactccgagaagtcactactagcggtgaccgttaagattaatctgtgatgtaacgcaaagaaccaagcctatgactgcatgagcttggccggtctcgctatgctacaaaaccaggatggcgtgatatgggccgcctccccttctccttagatcagcataggcttgagtaacggctctccttttcccgtcaaatcgcaaatgaacttccgttacgatccaaaaacaaatccgagaggaaaacgagaacgatcaggcgcgatgcgcgcctcaaaatatccaccttttcctcctcttttttgagaaaattctgcgaaagcatcgaatagttttgtactggtcaccgacgacaaccaaataaccaaccggtgtcacggcgaattccgtcaacaccgcacccaagtcgtcgtgtttatatatgctttgccaatttgccataaaaacccccacgaaatcctccaatccattgccgcagtccgtccaagagagggggacactctgcctccagccatgagcgacggcggcgcaggcgccaagggcgcgggcttcggcatgccgcgcgtcggcatgggcacggcggtgcaggggccgaggccggagcccatccggcgcgccgtgctcaaggccatcgaggccgggtaccgccactttgacaccgcggcgcactacgagaccgaggcgcccatcggcgaggccgccgccgaggccgtgcggtccggcgccattgcctcccgcgctgaccttttcatcacgtcccagctttggtgcaacgacgcgccccccgacagggtgctccccgcgctcaggcagacgctatggtatgtatgccccccccccccccccccccttctctttgcccccgtataagattccggcggaatcaagtgaagaattgtgattttagtagtggattattacgagttgtttggagtaatcggttgggccaggcctataagaaaaacaaaggcattatcttaaataaaggaaaatttattgtggaattaggatatgtgatagggaccacctatacatttgtcgacaaattttctcctaaaaatttgatagatgtaattataatacaattgtagtgtaattacactgtaacttgcatataactatataactatagtgtaacttgtacgtaagtttcacgtaattttgaattgttagatctattataagatttgttttgatgaggaagaaaaaaaatcacagcacacacacatgtgaaatagtttgttcccacaacctctattttaccaaaataacatgttacggagagatttttaaaagttacatagaagttacattatagttacagtgtaattacatgcatgttacagtgtaattacactatgattgtactgtaattacatctgtcaaatttttgggggaaaatttatcgacaaatatatagcaaaattgtatgtgatattattctttaatcttaacaagacaaattataaaaagtcttactctttggttgtcgtgctgatgctcatctttgagtataggaatgccttgagtatatcacgtgccgaccactcctatgccttgagtatagggatgccttgagtatctagttggtaactagtttctaataatttaaaaaagctagaaaacctaatttctaatttctagtttattttttgaattttgaatgtagttgaaaaaccaaactgtttgagtgcttttaattttggaagatactgcattagccacgagacaaattctttcattaccatcttggctgccacctccaaacagatattagtccctcattaactgcagtgcatttaatttctatctgaggcaccatgcgactaatcaactgattatgaaaggttaagactcaccttaattaacagaaagcacatgctcatcccacacgtatatatgcaggaaccttcagatggagtacgtggacttgtacctggtgcactggcctgtgtccatgaagccgggccggtacaaggcccccttcaccgccgacgacttcgtgccgttcgacatgcgggccgtctgggaggccatggaggagtgccaccgcctgggcctcgccaaggccatcggcgtctgcaacttctcctgcaaaaagctcgacaccctgctctccttcgccaccatccctcccgccgtcaaccaggttggtttgcacaattcacaatgctgcaacaaccaaaaatgttataacctttttttaatggttgatttgcttattgtgttgggtttgcgttgcgtttggtttgtcacggtacgtacgtacgtgcaggtggaggtgaacccggtgtggcagcagaggaagctgagggagctgtgcagggagaagggcgtccagatctgcgcctactcgccgctgggcgccagcggcacgcactggggcagcgactccgtcatggcctccgccgtgctccgcgacatcgcccaatccaagggcaagaccgtagcccaggcacgtcacgtctacatttgcacgcgtgtgttcgtgtcgcgccgtcgtctcagcagcaactgacgtgtgtgtgttgatttggcaggtgtgcctgaggtgggtgtacgagcaaggggactgcctgatcgtgaagagcttcgacgaggcgcggatgcgggagaacctggacatcgtcggatgggagctgacggaggaggagaggcagaggatcgccggcatcccgcagcggaagatcaaccgtgccctccgcttcgtctccgaccacgggccctacaagtcgctcgacgacctctgggacggcgagatatgagcactcgccggcgaccgcttcgtgtttccaggcgccggccgacgtgcgtgctgctctgaggaacgtaacaacaaaaactgcggctcttgacgatcgtgttgaataaagcaaagtgtgacgatttcatcggctctgattgcataattccggagtgcacacgctagcacgtgcgagagagagagatataggtacatcgagcgtgtcaaatcgatcaaaattgttatagacgaggccgagccgagccaaggaaaagcttccattagagcatttacagtgcttcttactcgcatgccaagtctcacatgtcagttggctcaagaccagtattagacactcgtgtcacaatactgtagccttaagtggggtctacaaaaatacagaagtcccttctctcctcttttttcccctctatcatgccttccactctctctctctctctctttctctctctctttccctctcacgctcgagcggcgacttgcacgctctcctcttctccttccactgtggcggggcggccgggcggagcagcagcctaagcggcaatagcgtcaggagaagcggtggtccgagcagtgatggcgctaggcggggcggccatatccgatctgggctcgctagatctggccttgggcgatggcagcggctcgtcggatctcccctctcccctcagcttgctagtgccaaatctcatctcccctcctcgtcggcgcccgttgtccaaggcgacgacgacgagcggcggcgtggcctataccctctcctcggtggcgccttccgtcctcttctccgtccggcagccctcctcccttggccgtcgtgggctatccagacgaatccctgacaaatctgacgagaaacatgcgactcatttaggctccattttcttcacttggtaacggaaacatccgacgtggcgtggaatcttggctggggctgcctaaggttgaatgccagttatacgcattgtgaacgccggccgtgccatctgccaccggcacgtacgaaccgaacgtcgctagcttttgcgtcgtcgcgtcgtcctcgtcgatctcggcggaatcaaccgcccaaccaaccgaaccgcgcctcgtctcgtcacgagccgccgtgacagcgtcgtgccggtgcaggggcccctggcagagcgtgcttacgccgatacgtgcgaccaaaaagcggctcgcatcgatcacgtcttgagaaaagagaagaatcaaacaaaaaggaagaagaaagaaagcgtactaggggcaaagctttgcaagagtgtattacatatatcgatcatctcatggcatctcacctcacctcacagcttttatggaatcacatgttggtcgccaatgcaagcttgtcaagttgccaccatagctaagctaggagtactaggtagggcggtgtctagctaaggaaccagtagtagtcatcggaggagcatttgctttgcaaatgctttgcaagcggctagagtaggtcaaactacattgtcacaatctattcgaccgggagctccaacgttggagcactctgtagtctgtagtactccatcgatgattatttacccaagagcgtgctctgacacattggcattgcccccttgcaaaacaattctgaacatttcgaccgtacaaacaaaatccttgcaaaacttgtatactgtactagcactgtacctcgccggatggtcgtacgatgtggccaagtcacaggcacacagtggcacgacacatttgactgacaacgccatcgaagagatcgaatgcaactggcaaaacgactcgagtacccttctggtaaaagtcaccgcgacgtcgccaggtttgtttcagatgaggcaaagtttttactaccgaacaggccatgtggtgaagcccaagaacacacgtccccacagaccggcccagccatgtataaaatcagggcatattccctcatctcgctgtgcaggaggactgggcgaaaaaaaagaaaggaaaaaagcgaaggtaatcgagcgtttttactgcggcagagttcacggggaattcagagcgcactgggtgacgaaatggattgcgcgctgcagttgctcgcagctgcgccgaccgggaagggggggctctgcgcctggatcgtgcggttaaaagcaggatgagtaaaggcgttttttggttccttttgcgaaaggaacggcatcctctgaatcctcctcctgacgccgctgcagcctcttttcagtgacgcactgatgctgtaaactactggctcagattgattattactccaggctgagtccagctcgatgtaaacgagtcgaatactcgaacgatgtgcatcatgcaatggcatccctgttgccacaactactgtatttgtttgctcactaataagagtctaagatgagtactgtatatgcattgaggtatggttaaagagatcgtttcatctacgtacctagaatattgtactactacgtctttgatagcggctttgtccaaacgctgtaatttgatattttgtgtgtgtgtgtgtgtgtgtgtgtgttagagctctaatacaatcgcaacacaaatatggctatatatttcttaagtaaatccaagagacattactccctcatcccatgatataaatattttttattcgtgtttatccagatatatatgtagccagaaatccttttattttgagatacaatgctacttcgtccgtcaataaatatgttcacttctagcaattgggatttctcaattcatgaagcaaaggtacgtaggtagggaaatagaaattaatatattttagtatagagaaaatacaacgaaattaaatcaatccgcatgtgactattagaaatatcctactatttttttatccacggtaatactataatatattttgttttcagcaatgagtaacggatcccatatatacatatttgagtgtgctcacactatcttaaaataattgttggctatgttcccgaatagtaaaaaattggtacattttgggatggagatataaaaaaaatgcataatcattttaagaaaagaaaatgtttgacttgcccccctaaacgtttggtgtagcatgcttcccctaatcccccctgactctcgtggcaacgttgtatcaggtggcactcaatcatccaggtgggataatcaacttatatatatataaagaaagaaatatctatacctatatgtcgtttgcttcatattcttttctacttgcgctcctctctagggtcaacctatatatctacgccacccgtgccaaggagggaagagaggagtatgcacaggtgccggaggaaggaggggagcagagaggatgaaagccggtgacggagaagctaaaggtggagcccgcaattcagcctgcaaatggggcggggcaggtaggcccgttccctataccctctgacccatttgcttttgggcaccagttgaaaccagagacaaacattggcccgcccctctctggtggcactggtcgccccgttaggttcctactccagacaacataacagtgcacttgtccaagcagcgacatgcaaagatagcagagttcagtagttgataagcatcaaataaaatgcagccggacaagatgataatataaattgacaaatcatggttaaacaattcagaatagaagcaaaagaaaaacaaattgaattggattcagaaaattcaatctagaaattttaaagaaacagatataactccattaactttcctagatgttccattcagaatttgtgattcctttgcacaaatcttcgcattctaaaacacaaacatcactactagcaaccagtagtacttcatcaagcaaatgacacccaatctaacaacatgctcttctgcccaagacgcaataacaaagaacactcacactccatgctcataatcctgatgatcgccggcgtcgtcgctgctgaagctgcagcctgaagcaaggttgggctaaatcaataatggacagcgggagcgcatcgccgcctagcttgtaagcttggagccgctgctaccgtctcgatccagccgggccggagcccgggactgcgtcgccccgaacccgaagccgccgccgccgccgctccagccgggacgcgtcgccccaacctgaagtcgtcgtcgccgttgccgccgccgccgctgccgcctcgagccctcgatccagcctggggcgcgtcgccccaacctgaagccgccgccgccgcctcgatctagctgaggagtgcgtcgcccctacgcagtgctgtgataagccgattacgggtcgacccagggtgcactggttcctggactcgtttgaccctaaaattatatgggtcgacccataaaccttctggagccgaattttgagggtcgggccagcggtccaacgggccgacccgccccatttgcaggctgacccgcaatggtgatgggggtgatgtacacaactgaaccaacataggcaaggtctgacgctaccaaattaacaaaaggggcaaccaggtagacgtggcaacaggtaggaacttgtcaacgccaccaccttgtggccgcttaaatccccttccacaattacttcttcccggtgatgagggggcatattccttctcgccccaagatggcaaactacgcctcttcttcccttcctgagatttgcccctatcgccccctccattctctgtggcactgtgaatttggggtgcaatccacgtgcctttagctgccagtcgccatgggagaggatggaagaaaggggaaggaaagggaagccaaggcatcatggcatcctacagctctatgagagagagagagagagagagtacggagggaggaggaatgggaggacatcttcaggctaacccaaccatagagatgcttcaggatggagagatcaagaagagaggatgctagagaggtaaacaagcagcaacagcaacactaataggtcggcctcaccaattttttttattttattttgttaattggattatcacatcagttaaattattgcctacacatgttacgtgaaaccaaaaccgcattggattgagtgagagagtacttcattcggattgaaaagtttagagttaaaaatgtctaattttgcggtttatggggtaaaccggactaggccaaaagttcagtgtaagtcagacatttccgtttcaaaacagcggtttattgatgccgcgatacaccattaatttattttatagtgattgaagtatcatttacagattgatgccgcgatacaccattaatttattttatagtgattgaagtatcatttacagattgatgccgcgatacaccattaatttattttatagtgattgaagtatcatttacagattgatgcagcgatacaccattaagtagtaacctagaaccattaccagtccagattaaaggagcaacttttccagtaaaaaaaaaagagcaactttttagcaccctaaaaactactccctttgtttcgaaatgtttgacgccgttgactttttagcacatgtttgaccattcgtcttattcaaaaaatttaaataattattaattcttttcctatcatttgattcattgttaaatatatttttatgtaggcatataattttacatatttcacaaaaggtttttgaataaggcgaacggtcaaacatatgctaaaaagtcaacggtgttaaatatttcgatacggagggagtataatggtgccagggtgcattcatgcaaaagttgcaaataccacctttgataattttccaacaatgacatcgatcgaccgaagctcgaaacaacctacgaaactacgtacacttcatcaatttgcggctaaaaaaaaagatgaattacaccgtcgtcacccaaccccccttgctttacatacatacgcgtgcacgtacacacgtgaacgtacaagttgtacatgtgcatgcatgtacatatcagctagatgccgggcgccgacgccgccgcccctcaggtgctcgcgcgccaccgccgacgcgccgtggccgtcgatggcggccatggacatcacggcgagcgagcgctgccggcacgcgtggcaggtcacctgcgcgatcaggcgcgccgcgtggtcccgcagcgcgagcgccttctcgagctccccgcgcgcccggtggcgcgcgcggcgggcgtctccagcgcgcgctccgccgccgcggcctcctcgcgcgcccgctcccgcgccgcgtccgccgcggtcttctcctccagcgcgcgcctcacctcttcccgctgctgctcctcctcccctcctgccgccgcggcgcaggcgccgccgccgccggacgccgcggcgacgacggcggcggggccgattgagagctgcagcttcgtcgttgtcatcgtcgtcgcgtgttgctcgtgggaggaggagccggtggtcgtggagttggacgagaacgcggcggccaacggcgccgtggtggacgccgggaggagctgcagctcaggcggcggcggcggcggatgatggtgatgatgccgcagcgccgcgggacggatgaccggcagcgtcgtggccacgggcacgacctcaccgcgcacacgtccagagttacacgcatcctggtgctctatgaagctctccactctgcaaccaacacacacaaccaccgccattagcacacactaatcataccacttaaccaccatcttatcaccaaacacaacaaaaacacggcgatcgatctgatcgactgattgatcatctgtacatgtagatcgatcgaaagcaacgcatcgatctcgaacaagacacacactgacagatcgatgagagcatgagacaaccagatgaaacccatgggatggaccaccatatgccatcgttaaacccatcaaggaagctagctacgttccattgctgactaaatggccacgcgcgaccagtccgtccaagggaccaaccaacagcagcactgtacacatatactacacacacagctagctagtgatggcgcctgcacttacgccattattgatcgagctagaaaaccagtcgtcgacgacgacgacgacatatggaagaagcaacgatcatatcggtatctgcaggggaaaacatgctgcatatgctgctgatgctgctgctcgtccggtatatttatgggctggtcagtgacaagagagtgtggcttagctactgccaattattaaagcgatcgcctagtgggaagctcttgtcctggagagaaaaaaacagaggaggagatgatgctgttgtgtgtgcatggatgatggatgggtgcacatggtggcctgtgtatagcttagctccgggcgatctggtgatgtgccccgtccgcgcgtggttgtactttggtggtggatccaggggtccgaggaatggagcagcttgtctttacctacctagcgacctctgcttcgtcaccttgcaccttgcctcgtccacatcatctcactccctaggacatctacatgtagtactagtgtccgttctattacgggatcaaacacacattctaattctattactgtaaatctaggcaggtcaggattatcctatcacgtacttgattgctatatttgatagagatattatatacttcattcttaaataattggctatgtcactatacaggtttaaacttctggtaatttttctggaaaaaaataaatactacttaaaaatatgttatattaccgaagtgtacatcatcattaatataaccacacaagttttcttaattataatgttctccctccgtttcaggttataaatcgttttgactttgatcaaaatcaaactgctttaaatttgactaagtttatagataaatatagtaatatttacaacaccaaattagtttcatcaaatcaataattgaatatattttcgtaacaaatttgttttgggttgaaaatgttactactttttcctataaacttggttagatttgaagaagtttgactttgacaaaacaactgataatatggattggaggaagtaattatttaaaagtaatttgtggttaaagttacgtgacgatagcagttactacagccacctgataagttttcacagaattaagatccataaatagctgctagtaactcgcatgctaaaatgctactcctacaagctattaatggctgattagctctggcaggcattatgtttgcacatgaacaaacagtggcgctcatgttttacttactttgagttaggactacaacaaccagccatcttatcagcgtaactggccggaagctggagctatcgctgctactactacacttagcttagctgttgggtgaaatgcgcagagacagtttttggtcgatatgcggtcgctttcctgtaggaattttcggtcctaccgcaacccgccaccgaaacgatcatatgccaggcgtctgccctgctttttcatctcttccatgatctcatcgatctcctctgatttaattttttctctccctttttcagtctagctagaaaatagttttcgattaatctcgatggatatatgcgtactactggaccctagctacctagcaggatgtatgtatgtaagtgatcagcatgcatcaacagcaagaacctgaagtagtagtaatagtcccgatccaattagtccgtacataaatatgctctttctttggtcagctagctagccagttaaacaacggatcgatcagatcaaactatagctagtcaattggtgtcggctacaaaaacacacatccttttaattttctttttttcttttttctctctccgagtggcgatatcatatctacagcccagtggcaggttttaaaccctgaaacgtaccatagcttttgtcttatctccatgcaaccctgtctcccaccaaaaacaattcgaaattcatctctttaaatctaaatactccaagatctaattacgtatgcacataatcatgatatatatccaaccacccaaacgtcatcgtatcaatcgctaatcatggatggttagcgttcgtacgtagtagtagtagtgcatgcgtcgccggccgccatgaacgctacgtaggtttgaggaggaggagagggggtggtgtacgtaccgggagaagacgcggccgcagtcgcaggagtggccgcgggtgccgcaggtcttgaggtgggccttgtagtcggactggacggcgtagcccttggcgcagcgggcacacacccactgccgccggccgccgtgcttgcgccggaagtgcttcttgatgccgacgaggtcgcccagcgcgtgtgccgggtcgtggtggaggcagctcggctccgggcacacgaacacgcgcttccgcgcccctccgccgcccgcgccgccgccggcgccgccgccgccaccgcggcgccgccgtcctccgccgccgtcgccgccgcggggcgcttgaccagccgccacggcaccttgtgccggcgccggtgcatctgcaggttctgctcccgctggaacccctgcccgcagatctcgcacacgtacctgtccgactccagcagcgtcctcggcgacagcgccaccacctccgcatctgggtctacgtacacacgggctccatgatcgaacaccatccttcctgatggtattaatggcttccacccattccttttttccttccttgccttcccggagggccccttttgcccctggccggggaaggcttgtccgccgccggcgccgccaagcttgaagaattccacgcccgccggtgaagctgcttctgcttggaagaaggtgaagaagaccaagtggaaaaaaaggccaacatttggtggtggctcttgaccagtgccataactgcaaggagcttttcttctttttaaaggagaggatcactaataagcttaagcttaagcttatcaccacaataccacttctagagctagagctaccaccacaagagggttagatcacagcagctacttctactactactactactgcctctgcagcagctgccttggtttggttctctttttgctccttagtgggataggggtgccaagggaggctttatggggtggaaaggtgaaggtgcattgtgtgtgtatgtgtttgtgttgtagaaagggctggggcatgaggggatcatatatagcttaagccagggagagagaggggttgtgtgtgtgtgtgtgtgtgtgtgtgtgcaaggtgagatgaaaaaaagggctttgtcaatatctctttgcttttgtgcctgcatcggtgtgtgggtgttggccccctttttttgaagggggaatgtgtctcatatactcattggatgggcagcttttatcaaggctttgtttgtttgttttgggggtttattaagatgggatcatgagggggctagtctctgccaaatcgatctcgccaacgcaattaatggagcactgtccattaccttcatcataacttgattagcaagctgatgaccctctttgattagtctctgcgtacgttttaatttcctctcgacccccctctttgccttcttttctgttgtcctgacaggagtttggcagctagatggaaattcagttcacgcattcttctttatttatctagaaatacatatatatacacactaaaaaaaatctactccaaaacgccacgtatatacgaatgcaaatatatatatatatatatatatatatatatatatatatatatatatatatatatagttgttgatgccgtggtagatagctgaccggagatgaaattaaagctagtgtttttgccaatgataaactatgcagacgaacagctcatccttgtcaccgaagtgattgctttgctgaaaaaacgccccaactgttagtgatcagcaatgggggtggtgatgggggagaagattcttcacacatgcaggcgatcatttttctcccacaagtgcccccggcccttgccttgatcctatctaggatctcccttttctctctctcgctaaataaactagcctcgcaatgagatggcattgacatctttctctcctcaaacaactaaagtttatttgtctcttggcttttcctccctttcgactttctgctaagatggccgcatgtgtagctcattaacaaaattttagaagtaagttgcacacacatgtcttttttaatactaccatgcatcatccggctactgctactcgatctttacaatattcagaagttgtccttttggcgaagctgcatgcagtagtacgcatagattcgatgaggaggaggagaaaaagatggcatctttttttggaggaaactaaacgatgggccggcgaacaatccatcttcttttgaacagaattttggcaattacttttggactttgattgaaactaacaaatactagtactgtactttgcacaatagctgctagtatagtagactagtagcagctgattttcatgacgaacagaggactggccctactgaattcttctatctttgttattgatctcaatgctagaaaacgtcatataaaattaatagaacgcatggccagattgtttggtagtatttgttttgatctcctgtatgaaaatagtgtattcattgcatatataaatttaaggggaaaatgacaaaatgtcataaactataggtgtctggcattcctttcctcatacatacgcatgcatgcaaacaggactgaagaaactgtactatattctgaagtgttaattcgatgatgagtgccatcttgttctctctctctggctggttagcactaagcatcatcatcaacaagtagactaccgtatattaacatgcgactttgtgtcgtcgtacgtttattgattttatatagcaaaaagaaggtgttattaataagaggttatcaagaacatatcgtttcgagcagtacctttctccctcctcgttcgcctgtttcatcatttaggtctccatgctatgcaacatgct

SEQ ID NO: 63015 - DNA, 13526 bp, Oryza sativa
ctgttactactaccctcctgttggctgttaggctgtgtttagtttcaccggcaaaaaatttgccgggtcgcatcagatatacggacacacatttgaagtattaaacgtagactaataacaaaacaaattacataatatgtatgtaagttgcgagacaaatttattaaacgtaattaatccgtcattaacaaatgtttactgtagtcccacattgtccgatcatagcataattagacttaaaagattcgtctcgtaatttacacgtaaattatgtaattagttttttttaatatttaatactccgtaaatgtgttcaaacgttcgatgtgatggggaaataaaatttgctgatggccccccttgtaaaatcaaaggtgtttttgattattattctgtgatgaacaattgggcatcgtagattattggttttgttatttggaatctattcacgaagtggttttggagatgattggatttcacatgtgatcgcaggattcgtcattttatgtgaccggtcagaccgggctgtgtatgccggtcagaccggcggtgatcgagcggtcgaaccggccagcccgcggtttgaccggccgacactgtgtcggtttcggtttcgggttgtttgtttggatatccgtgattatttcatgattatgacttctagatggatactatacgtatgtaatactgttgtttgctactaatgagttaagttggagatagcttggtatcggaatatggtttctttgtttatttcatgtgtatgtgactcgatgcctcgggacagtatttgcggtgatggaccgggagtcggcttgggaataagacgacgtccgtggtggtcagagatcatgcgggatacttaggctagagttgatgcacgttgttgatggagatttcatatggcatacgatggaggtattgtgtgcgtatgggatgcggagtcaaatttggaaggagtccaaatttggtacgattggttatgtaaagtttctttcttgtactagagggtttcctaaagtgtttaggacttctagtatgagtttggttcgtggctttaggctgcctacctcgggtataaatagagggggagcgtgaggcttcccggtatcgctttagagagcaattgagttgagttttgagttaggatttcgagtttagtcgaaattttcgtaaggagtgctgttggtgcactttgtaaacacagagagaatcaataaagtcgtcatccactttaagagttcttcgatttgtgtttaccgggtttcggcggtctaaccggcgatctaccggcggtcagaccggcggcatacgggcggtcagaccggcggcggcgacaggcgcggcaggcaacttcggcggttagaccggagattcaacaccggttagaccggcggcatccactcggtcagaccggtagattaatctcggttagaccgacttgcgtcgatttcgagggtaacttttatttccgctaaaagttttcggtttttggatataccaaccattcacccccctctggttggcttaattcttgtgattcgatcctataccccatagtaatatttttctctaaggtgtgaagtcatggtcaaagggccctttttttcagctatactgtgtcactgttcttaggtaatttgtctctgcagaagaggactgtagcatgatgtgtttgggcacatgcctgcatggtgcacttgtgtggatttggcaagttccaagaatacccttttgtccttttcagtattttgcatatccatgggcaattgggcactctgaggtgggggtaatgcccattagtgcagtagttaattaattagtatgtatgcatatattcagggagaagcaatatatgttggccggttattcataaaaatagaaagattatcactgtatatgactgttgaacgaggtttttatatagaatatgtatgtcggtctatctgtgtatcagtatgctaatttgtcattacaaatgagctgcaacgttaataaaatttaagaatcaatcatcgtattatcattgtcgtggaacatattaaaatatgtgttaaataaaatatgtcattgaaaataccattgactcgtttgttttagtaaaataaatatttcttaaattcacaattaataattatgaaattgtagcgatcttgcaacttaatttattattataattattattaatttaattctaaaatataaattattaattacattttctagaaaaaaatagcaatttctaacaagttgtaatcggcataacttttctgttaatctaagggtacaattgaaaactatgccaatatattattacatgattgcaaagtaagcgtaactcaacttgttaagttttttgtggtggaaccagttcacctgggttcaagtcctatgattgacaggagtgctcgtatttacggctaaatattctttcagcggtaaacggcatatttgtcaacagcgagacatatgtaataacttcgtcaatctcaagacatgtcgatccagtccttgagggtgctcatattggtagggtgtgtgtgcgtgttcatagggatgagtatgtgccgttgtggacgcctgacgtttgtactgctgtttctaaaagagtaaatttcataaaactacatactactttgcacattctatcacaacaactacatatttaagaatttattttacaaaactacagatttagtgtctatgtttatcacaaaactacaggtactttgcacaatacatcacacaactacagatttagaaacttgtttcacaaaattacagatttaatatcttcatttatcataaaactacaagtttagtgtcttcattatcacaaaactacatgttttagcattgttaaaacttgtagttttgtaataatggagacactaaacctgtagttttgtgataaaagaagacactaaatgtgtagttctgggataaacgaatacactaaatctatagttttgtgaaacaagttcttaaatatgtagttttgtgataaattatacaaagtacctgtagttttgtgataaaagtagacactaaatctgtagttttgtaaaacaagctcttaaatatgtagttttgtgatagattgtgcaaaataactgtagttttgtgaaatttactctttctaaaaaaagtatagtagcatatatgattaatttttaatatatataataaatagagtctatgcaatggcgtggtaactaattggtttaatttctacaggaattaggaaaccttacattttactttttttaaaaaagggctgagcatatcaatcgatgaaacctttcaagtggaatatcaacagaaaataaaataaaaaacactggagagctgaagaagatgaagggggagctttgccaagagaagggggtgtcactattgggcctggtccccaagtctgtcctctcggcccgtttgaacttagcaaggtggcccacgaatccgatggttgagatctgagacggcaaggcgggcccaccctgtgcttccttgcacacgtagactggcctcccccctggacccacccattcttgcttaaccatcaatgatgactacgaggcaagcaggatacttggcccagctaaagagctaaccatcattgtgtctctctctaattgtacttgcacatttcgtaatctcaactacatatatgtgttcaaatgtagtagacgagcttagcttaattttaggatgacagtgagatagggataaaatgtgttaaatcttctgtagaataaaagggagagaagactgcagcgtatactgtaactgatgaatagccgggtgataaattgacaaaaggcagcatgttaggcacagggaagaagcacccaagtggctctgtgttgataggcatcaagaacagctattcccattaattagctggccttggtgtaaactcatgttaacccaacagtcacaactcatcataacttacatgcaacacagggcatgacaagcacttgagcttagtttttcagcgcgcccatgtctccatctgtcgggggtggctttcagacctcttattgctgcttaataattaataacttcaacttaatctgatcagtatgaaattatgaatgattgggctagcagcttctaactaactaagctagatctagtgtaccggccgggttggttctaattaagggggaaaactctgatgttgtagtttaatcattatgcttagctagcaggaatcgatatatgcctaactgaaagagttcagagaattaacaatacattagtgcaacgaaatatatatcaattgtggtaattaaggttaaattgtgcaggctaatctctgaagaactgatataccaacctaatgatttccggcttggtaacgaggtttagggtactcctacgattttgctagttagctagttgcacttgaaaaaggtaggcatgcaacagaactagttttggtatccttcgattgaactaatctgccgacgacgtacgcagatatatacggatggagtacggtggccaatgcaacgacaaggacatgctgtacagtagtgttcaagttgttatgatcctgatcgatccaagttataatatggtacggttttggagagcttataatctggtacggttttggagagcttaaaaaatttgagaagtagctggctatggttggtaagggcaagttttatagtagaggtggatgtcacatctaatttgaaccatgtcatcttctcattaattaagaggtaacacatacaaaatatcacatctaatacacaaaccccaatattagtctactctcacatcatctttcacttttcttggagattgtgtagatgttgccccttgcatgagggatggctcattctctctctcctaacttctctcttccacctcattatctaatcttatgtggtaaatttaggggcgcaatatgtagaggcttatagtacttgccctaaccactttctaagaatctagagaagttaagaagaattctagtttattttttagattctgtaaccatatgttcataaaatctgaataaaaactgaatttaataaagcctttaattataggagaagttaccgttgtcaaaagtttttctaaataggcccttgacaatgtttgcaatgtcccctccccccctccctctaccacatagtatgaaattatggcgattttttattttttgtgaatttggttaaaatctatttaaatttagccataaccgggcagaatttaaaaacaaaaatcgctaaacgaactccaaaacatctgaaatctcggaagttctgttgcccagcataaatgttcaaaacacctagtcatagtaatatcttacgagttacgataccatggtcctatcaaacggcacgatgatcttgatcctaccataaatatgttatagtatcatgttcccacataagagtattaattgattccataagatcggtggacgatcttacctgggatcccgataatatgattaattatgctattgttcaaaactaaggtggattttttttaaaaaaaatgaataactctactcaagtttacacaatttaacaaaactgatattattgtattaatttttttacaatgtattataacatttatataaaactatgcactttatgaaaatatgacaggatcatgatcctacgtccgattctacgattcaatattgttagaagaaaacgatcttacctaatattatattatcgatcctgcagatagctttgatgtgttcattgtcacttgtcactgctgcctgaaagtttcgagagatcgccaagtcagttaaagccaaacgcttggtgttgaaatgccggccggtgcgtgtgcctacgcacgtggacgagccaaaaaccacgtagtacacacacccactagctagctcttgttctgatatatatattctccttgcctgagctctagtcgtcctcagccaggtcggctcatcgtcccgtcgaccgacgatccatcgatccatccatcgacagatcgagggtcccttcaagctcttaattaatccatacatgtaaatatgtaattcgaacaataattaatcttgactcggcgctcttctcggtctctatggttttggagtctattctctcggagagtcatgtgtgatctttcgctggcgtagttgtttttggggttttttttagtgtagtgtggctccatcttcaccatctcgttgattgaagtagcttttatccgtaatagtttctctttcttttacctagttgtagcttttgttttttcttttcttcccacccctgatataggtttatccgattgcgttgtgtaatagaaactatcagtctgtctatctgcagctagttgcatacacaattacatgtaggctacagccacttcgatctcgatatctccaaagaacctgatcactaataaacgatgctaatatatattcccctcgatcaccatccgatcgatgcccgaaacgtacaactagtcaactaggtagctagcgcatgcctagttgcatagttgcgttgcatcacatgcatatatacaatgcatgcatccatgcacccgattaatcacagatagctagctgcgtccgtcaccgatcggcagctagcaagtagcacggggtacagtcgcaatgctcatgctgtgccactgtcgggcgtacgtacacacaaaaacacgaacacgcaccagtcacttcttggacgatgcaattaatcacagtccatgcaaattaaagcacggcatgtgattgatcatcaagaggccgatcgatcgagatcgatcaccactgtgtacgccgtgcatgcacgcaccgatctcatctcatcgatctcatctgatcgatcgatctagcagctaagctatcagcaggtggaattggaggaggagcggagggaataaaacggtggcaggtcgggtacaaacgcaaggcaccgcgagatcgccgtggcaaaggaccctccgggtgcgcggcgacaaggggatgcgaccagccgcgcgcggcggctgctctctcgatcgatcgatcgatcgaccgagagccctgtggcgaaagcaaagggttgtagctagccagtacacatgtagctatggctagcttcaattagcttaattagccgtgcatggtcgattggccggccacccagcgagtcgccactgtgctgcagccggccgtgcatgcatggctagctagagctggcccaatgcagagcacgatcgctcgcgggcgagaggaatgaacagtgcagctgcctgttcatgtcctactgattaaagccgttgattcccagcactttggtcactgttcgacgctagctcgacatgtgtacaatgggattgaaaggggacagagaacgatcgcgacagtacgtacttgccgtcgtcgccgtcgtcgtcgtcctgtgccttttttgtggacagggaatggccttgcttggcctcgatcgatgatgcatagcatagatagcatcctctagagccaagccagcgaaattatatatgtctatatatgcacatgtacgctttatataatctgcatatatgcaagtatgattatatagtgcatttagttatcaacacattagctaccactggtacaataacaatttttccgtgcagtcagaatcggttttcgcgtgcggatcttccacccgtctggaacgagatgtctgcgaaaatctgattttttttcgtacgggtgcaggcacttaagccgcccgcatggaaaaataaaaaaaattaaaaaaacaaatcaaaagcggaaccctaatccagcggctgccgccgccgccgtcaccactgtcatcgtcgctgccaccaccgttgttgtcaccgccttgcccgaggcccgatgctgtcatccccgcggttgctggcgatgaatccagcctccccgcgatggccggcgacgaatcaggcctccccatggtggttggcgacgggtccggcctcctcgcgatcgccggcgacgaatccggcctccctgcggtggccagcgatggatccgctccaccgccgccaacctagccgttgccgtcgcctccattgtcgtctccgggatcaggagatgggaggagggtgaggaggagagggagatgggaggagtgggaggagttgagagtgatatgggagtgagtgggatgggcggcaactgcgggattaaaaatgtaggtgggctatttccgtgtgcgggttatttaacaggtccgcacgcgaaaataagcttattttcacgtgcggacatgttaagtggtccgtctgcaaaaattaattttaccgtacagtcattttaaagagctgcacgtaaaaatagagcacgattttttacagacgcgaccggttacggtcccgtctgcaatctaaaattagtcccgtccagaaaaattattccggtactagtgtacaatctgcatgcagattgcagagtactgtgccatagtgcgtgtcgtcagttttggaagaagaaattaacaggataagctagtgggttcattaatattttggtaggagcatatactctctccgtaaaaaaaaactcaacctaagactgaaatatgagataatctagtacaacaaatatggacataagttatactagattatgtgcttgtttagttcccaactttttttttcaaactttcaacttttccatcacatccaaactttcctacacacataaacttccaacgtttttctttaaacttttaattttagtcaaacttttaattttggtgtgaaactaaacacaacctatgtcacatcccaattctcggttgagttttttttggacggagggattacatttcttttgcttcgttacacacgttcgagtccatgcacatatgaccaagcaaggcagggcacagcctatagctaggtacgtgtacgtctcccctggataattaagctctcagtagtgtggtactacactactacacttatgaacactgctagggatagcagaattcagtggtcgctgtcgtggcacagcgttgcgcatcattgcacacgagagaccaaaggtgtacaaacaaaaagcgtcaagggggggagaacagcacaagtcacacccaattggagaaggatttggatcaaggggcttgtcacgtagcagcaaagagccatgagacaagggtgaaagggacaaactagagtttgtaccgccaactctttcccgggagcccccagatgccatcgccttatctttgccctccaatctttggacatggctaatccaaatcattgaggtagccctgctgctcaacagagccatcgagcgaattaacttaacaaacccccccccccaccccccctcgatcgatcttgcaaaagctaggcaacagtcggagaacacgccatgtggaactaaattaactttgtgtaaatgcataatggaatcttaggtttgcctacatgcctcctagttgtagatagagtcatagagagggatatttatgacctcgttggtaaaaaaaaattgctaacatattgttggaaaagaaatgacggatgttaagcaagtgtttctgtgaattcttctgttcctctccccttctgagggttacatttatatatttatacttagtggctccccttctcagcatgctccgtattcggctctgactccagattatcggagccacgagctcctcctcacgctaagggggaaaccgctctattcctcctgagccatcgcctccttagggtcgacgtgcttgttgcctgaaggacaactcaacctccgacggatgaccttcccaacggaggccctccctctgattacctagaaaggggcgcgagggtcggagcccttccccaacacatataatatattttaattttttaacttagcaagatttgaaggtgatgatcactttattaacctaccaggttttagctttatcaaaatttggcaagctaccaaagtttgataattctaggatcgtcttctcacaaaatcttgacaaatgtggcaaaccaaatacaacttacacatctcaaccttaattaattactaaatattggtaatgctaaaatttgccaatatcaatatttgatcaagttgatttaggaatcaaagtgaactcccctataaatagagttatattgttaataattcatacttttgttttctataaacaaatagcgctagtagatttagtaatgtgttagaaaaaaatggtaaaaaacccgtagatgcacttcttacaattgtatttacatgcagttattagcctacatcacgatcgagaacgattaacgtgctcccatcgagtggtcttctgacaaaaatcaaggacgaggccaagatatgggccttagcagacgcgcatcatctgagaaattggcttgttccttagttgactagggccaaaggtcctgattttttttctttccctttacactgtacagttttctccttctatatttaatgaaattggcggttcgccgattcaataaaaaaataaataaagaacgattaacgtggaagtttctaaaccctaagtacacgtgcgcagagcacacggaacgtggctctttttcctccaaatataggcgttgtaatgttccaaggttattttccgttacgaatgtgtcgatgacaaatttatcaacgtactacgcctttaattatatgacctcacacctaacaatacactgacaatagcagaaaggaatttgacaaacaccaagcattatatattctcttgagcgtacaaaatgccagccttcaaccgcaacttgcaagtgatcgatcactgcatattttgcaatcctaattaattgtggaaaagggaacattctcattgttgtctccctgtcgtgggttgtcgctttcaaggggtgatcaaacatcagtgtctcttatcagaaccagatcagctagctagctggcctggagatcaagcctgacaattaagagagggcgaaaagaaaaaaggaaaaatcattattgtactttgggtcagaatttgttacctaagtctgcacattatattgtactttgggtcagaatttgttacctaagtttgcacattaatataattgcattatatcttagttccttctttaaatatatatcagcgtatatcttatctctttccatcatttagtttaattggacgagttttatttcattttattgcactttcaaccaggtagatctatccttaccacacttgcggaccagccacctcctcctttattcatcgctgctataccatttcctcattaacacttcctcatcatctctactatatatgtaggattgaaacataagaactaagccaaccagaggagagagggtaaatggttggtataccaaaaaaccgaaaacttttagcggaaataaaagttaccctcgaaatcgatggaagtcagtctgaccgagattgatcttccggtctgaccgaagcgtagccgccggtctgaccggtgttgatcttccggttggaccgccctggaatccctgccgcgcctgttgtcgccgctggtctgaccgcaggttacccgccggtttgaccgccgtgatgccgccggtctgaccgtcggtgtgtcgccagttagaccgccgaaacccggtgaaacacaaatcaaaaaactctaaaagtggatgacgactttattgattctctctgtgtttacaaagtgcaccaacagcactccttacaaaaatttcgactaaactcgaaaccctaactcaaaactcaactcaattgctctcaaaagcgataccgggaagcctcatgctccccctctatttatacatgaggtaggcagcctaaagccacgaaccaaactcatactaagagtcctaaacaccttaggaaaccatctagtacaagaaacaaactttacataaccaatcataccaaatttggactccttccaaattcgactctgcatcccatacgcacacaataccttcatcgtatgccatatgaaatctccatcaaccacgtgcatcaactctagcctaaatatcccgcatgatctctgaccaccacggacgttgtcttatccccaagccgactcccggtccatcaccgcaaatactctcccgaggcatcgagtcacctacatatgaaataaacaaataaaccatattccgagaccaagctatctccaacttgactcattagtagcaaacaacagtattatatacgtatagtatccatctagaagtcataatcatgaaataatcacggatatccaaacaaacaacccgaaaccgacacagcgtcggccggtcagaccgcgggctggccggtctgaccacgcgcataccgccggtctgaccggtcacataaaatgatagaatcctgcgatcacctgtgaatccaatcatctccaaaaccacttcgtgaataaattccaaataacaaaaccaataatctccaatgtccaattgttcatcacagaataataatcaaaaacacctttgattttacaatctcccccttgatgaacacattggcaaactcatcaaaaatgttttggtgtttggaaaaataaaaacaaaagtggtaaaaagcacacttcgtacaaatgtacacatcgtgctcaaaaatcaaaaagaaaacttatcccccttattaaaagaaagaaattccctcatgaaccaaaaacatgctcttctcaacaactccgaaaatacaccttgcttctccaaaattccaaaaataaatttcacattacttctcccccttttgacaatgatttcatcaagcataggaattatgttcattaatgttcaagagcttagcatacatatagcatatcaagtcatgtgttgcaataaaaagaagataaacccatctataacagaacaagcatgcattaaagtataaccatgaaccaaagattttacaattaagcttgaatcaacaatcaaaattcatgatttcatacgatttgtaatgcaacatcttaacaagcacataggttgaataataaacactaaagacatatacctattgcatttatcactctttctcaaataacctttagcacaaaataaccaagagaactttttataacttttctttttcttgagcctttttgctcatatttttctcttttattccgggtacgtccctgtcgtcaagattgtttccagggattcggcacccattattttgctcacatcgaatacgtccttgtcgtcaagactatttccaaggattcggtattcatttttttcatattttttattctccttttcacaatgagcaattaaagctatttgaggaataacaattcaacaaagcatatatatagagcatttatagatcaaaccatatgctagcatcaacgttgcatattttcttaattcaattatagaatttaagtgtcatgcatcatctcccttaaaagcaaaatctaaatctcatgaaaagactagaatgcatacaagctatgttagagacaaataaaccttcaaagtattgctagcatgcacaagaaaataccatatgcataaacaaagctctcttttctcaattttctcattgtcatattattgcttgata

SEQ ID NO: 63016 - DNA, 1924 bp, Oryza sativa
ttgcaacttggtgtccaaaaactacaattcaacatctcccttttcaacatgatccctcaaaaagtgaaaacaaatatcaatgtgctttgtgtgtgagtgttgaacaggattcttagcaatgttaatagcactagtattatcataaaagagaggtaagtaagaccataatctttcaaagtagataaaagtcaaagaatctgtgaacaacaactagcagcagcaacatattcagattcagcagttgattgagcaacactagattgtttcctagaagaccatgcaatcaatgacgtaccaagaaaatgacatgttccactagtactttttctatcaattctacaaccaccgaaatcagcatcggaatatccacttaagcatatagaagatgaagtagaataccaaattccaaactcaagtgtatgattcaaatacctcattatttgcttgaccgcttgacgacgtgaagcacgaggagaagcttgaaaacgtgcacacaaacacagagcaaactgtatgtctggcctagaagcagttagatacaataacgatccaatcatacttctatattccttttgatcaacagcttcaccatcttcatcaggatccaacacagctgtagaaccaattggtgttgaaattggcttgcaattctctaccttgaaccgtctcaaaagatccttcgtatacttcgtttgatgcacaaaagcaccttgaggtgtttgcttaatttgcaatcccaaaaagtacgataactcacccatcatgctcatctcaaattccctgcgcatagtctcagcaaaatctacaaccaaggcgtgagtcgaacaaacaaaaatgatatcatccacataaatctgaacgaaaagttgattataaccatgcttaagaacaaaaagagttttgtcaacctttcgcattgtaaaacctttcgcaagcaaaaagttcttaagcctatcataccatgccctaggagcttatttcaaaccatacaaagctttagacaatttaaaaacatggttgggaaaaatcaggattttcaaaacctgatggttatttgacataaacttcctcttgtataaaaccatttagaaaagcacttttcacatccatttgatacaatttaaaaccttttgaagcagcaaaagctaacaaaagtctaattgcttcaattctagcaacaggagcaaaagtttcatcaaaatccaaaccctcaatttgagtaaaaccttgagcaacaagtctagctttatttctcacaatcaaaccatcctcattttgtttatttttgaaaacccacttggttccaataatattatgtccagaaggtggttcaactaaagtccaaactttgtttctctcaaaattttcaagttcttcatgcatggcgttaatccatgattcatcagttaatgcacgtgacacatctttggtttcaaaagaagcaacaaatgcagaatttgcacaaacatcatgaatcgttaccttagaccttgtagtccgctcacctatattaccaataatttgttctggcggatgtcatcgttgaatgtgcaaaggagccacgacttctgaagttgatccacgttatgtatcagtactggtcgaagttgtagtttccggaggaccatctcgaatagcatcaacagaaccttcagccgacgatcctggccagtctgaccgcacctcctatgccagtctgaccggaggtgtgctggcggtctgaccggcttggcgcccggtctaaccggccgagccgacctcgtcgtcgtcgttttcgtcgctctcgtcttcaaaaatacgaccatcctccccctgaaataataggagcatgtgaagaagcaaccatcttagcatgacgacacggtgtacaaaccaaatcaagatctttcttaagtttagacgaaccatgaacaagatccaaacc

SEQ ID NO: 63017 - DNA, 2078 bp, Oryza sativa
gtggatccccgttttttgacacatgaccagaagatccaataggcatatatccacgtgcaaaatcaatttttgaattttcagaaaaattcctccgaggccggtctgaccgaggtacagtggccggtctgaccgggggccggtctgaccgcctctgtaccgccgtctgaccggtgcccggtctgaccgacgctcagtagccggtttgaccggtcgccggtctgaccgcgggacccactgcggtctgaccggtttcttcgagggaaaaccatatttttgccattttgattttgcaaaagcaatctctctctcctttttctgtttatgagctaatctgaaacaaaaaccaacaatatgtccatctttgccacaaaaagaaaagtatatttctcacgatgattagacacattggtagaattagaagatttagcaacacaaataacaacatgagatttagcatgcacaacattggattttgaagaagatgcactcataatagacatgataccagtagatttaaacacagttttattagtatcaggtttaaccaaaatctcaccacttctagcaccaacacctaacacaataggaggatgtctagaattatgagcataaggattaaaacctaaaccacggttatgtgtgctaacctttgattgatccaaaatcatattgaggttctttttaccatcagaaaatcttagcaaagaatttttcaaataagaaaccactttttccaaattagcacaattttcacaatctaccatgacacctttgcttttacgacacttggagcaagaaagcacttcattgtttttcacaacatcttccatgtactcaacacgacctaaagcatatttcaatttcaacttattcaaattacatgttgagcaatccagaacatcatgaggttgttttaactttttagcagaaatcatgttaaacatcaaactagcatgaaaagcaatttgatatttttgcaacaactttttagttaaaaacaactcatccaaagtgcgtgtgtgcaaagcaaaactacaagcaagagaagatttatttttcaaatcatgtgcatcattaacatctctaatttttgaaatctcattcattaaaacctcacaattttcgcaatcatcatcattaggaataagagattttaatctagcaatttcagatttaagagattcaatgataaattcctattttctatacatcttctcacacttcttattcttttcactcaaaatattaatagcttcctcaaaatcacttacctcattttcttcatactctgtgtcagattcaccacgcgccatgaagcaaacattggagatgttctttcccttatcatcatctccacttagtggctcgaaggcggtgcaaacttgttgaaaagccttcctgagattctccagcttcctcctttgggatgaaccctttggcttgttgttgttggtcttctcaccatctttgtcttctcttttgcctgtcccattcttaggacaatgcgaacaaagatgatcaattgaaccacattcaaagcaacgatttggaccacctctttttgtcagggttatagataccacatacctaatagtagttggctaaatctcggcaggatccatcacataccatgtcttatacggaaactgacctcgagggagttccggataaggaaagacaaccagagttctacatggaaacgacaatgactactcggattgtatccatattggtttccctagttctacttggacaaggggacacctatgggtataaatacaagcccccctaggaggagaggggacacgagagaatcaacacccaccatggaggatcaacacccaacacaatcgacatagaagccacaacatagaagactacatacgccaagacacgccgccggatatcgacttcagggataagcacggctagtaccctacggtgtctccggatactgtcaggagagacgaaagcgccatctctgatctcgccgggcacggattcgaggaggaaggctaccctgttgtcgactacgagtcagatcgtcagaccgtcatgtcgacaacagttagataggc

SEQ ID NO: 63018 - DNA, 1867 bp, Oryza sativa
cacataccatgtataccagaattgcgacatcaaacgccgacagtggcgcgccaggtagggggattttggtgcttcaggatttcgacaagatgggttcaaaagatggattctccgacaacgagctactcgacgacttcagctgagggggagatccaacctaaccagatcggagccatcatcgtcatcgacaacttggtctatcgagatcatccaagcctcaagctccgcggcgtaccaaaagatgtcagatcgcatgatatcgaacgagtacgcaacaaggtaattggtagattggttttttaaattgatctactaatttcgtaaatacatccggcatgtatctacaaaggtacgcaatattttatctgcaatttatcgtacctattcagatcatacagtattgtcagatctataatttattatgtttacccagagcatgttctttatacaataatatttgttgcgcgggtatccccgatgttaaatcgactacgatctaacgctgggggctcgctctgtctttttctgtataaatcatgcttgtttacggtttacataatgccctgacatttacatctgctcgttatatcctgataatactagaagatccatgcagtttttgagtacatactcgatattatctgctatatgtcttgtcttctagaaaatatttttcaggaacaattgagcactcgagtaggttgtggtcaagtacaccgcattatcgagaacgatctcaacaaatgcagagttgtcgcgcccaacctaccaacgaagaccgacgacctatctcatagcaccggccatggctggactactcgagaaaaggttgttaacggataattcctcgcgaacaccgtcggcttggtcacccgacatgattgcgaacggacatccagatatgctacaagttgggtgtgtgagtcatgctggccacatgagatgcacataacccaactctagcgcctccattggtgttcgagagataattctacatgttcgctggttctccaaccagcacgtagcaatctctcgcaccgcaacctccattgatgttcgagaaataactctactcgctcgctgcttctccaaccagcacagagcaatctctcgcaccgcaacctccattggtgctcgagagataactctacacgttcgctggttctcgaaccagtacgtagcaatctcttgcaccgccaacctctattggtgtccgagagataactctactcgctcgctggttctccaaccagtacgttcccatccctcgcaccgcaacctccattggtgctcgagagataactctacatgttcgctggtcctcgaaccagtacgtagatttctctcgcaccgcaacctccattggtgtccgagagataactctactcgctcgctggttctccaaccagcacgtagcaatctctcgcaccgcaacctccattggtgtccgagagataactctactcgctcgctggttctccaaccagcacgtagcaatctctcgcaccgcaacctccattggtgtccgagagataactctacacgttcgctggttctcgaaccagtacgtagcaatctctcgcaccgccaacctccattggtgttcgagagataattctactcgctcgctggtcctcgaaccagtacgtagcaatctctcacgccgcaacctccattggtgctcgagagataactctacacgttcgctggttctcgaactaatacgtagcattctctcgcaccgccaacctccattggtgtccgagagataactctactcgctcgctggttctccaaccagtacgtcgcaatctctcacaccgccaacctccattggtgttcgagagataattctactcgctcgctg

SEQ ID NO: 63019 - DNA, 8039 bp, Oryza sativa
gtagcgattctcccactatttctacttctagtggtagagttgcgactaccacctggtcctcgaccagaggtgtggcgattcttccattacctctactccaacaaagttgacatcagatacacaatatcgccaagtgttttacccagagatcccttaccacaaaagacacatagcgttgaaacctatcctactgttcctttacgccgtcttgacaaggcctccgaggaacctaagggaactttggctggggacgcccagagccgataaggccttgtcggattcttcagagacgaaagaccatgtaagatctggtcgtgtaagagttctcgccgtgcgtattaaccaagccgtgtaatcggaaatggattttccaacttcatggctgggggctaggatcagtgcttgttcaaccgaggcaggtcaaaggtccaagagccttgtcatccgagaacgattctccgacgacaatgctgggggctagggagagtgtatgactctacaaactgactgatcggagtcggtaagagataagacactcatatacaaaacactggtctgtacattcaattcactagtctgtcatattataacatgttaccctttgagcgttcgctcgggggctatttctatctaatattcttttcttagtattgattttaggaaaattctattcgacattatcgaagatcgcatgtctctatggttctacaccaagatcaactaaggcgaatacgacaaatgttgacaaggctctgtcgcagactctacgcctactcgattactcgagaacggttcgtggatctcgacgaggaatacggaatgaagagatggtgtacccgccgagataaaatttcttgacttcaatccaaattctcgattgcagcaagacgggagacttagtcatacgctctgtactttctcggtcgacatcagagattgacttagacaaaccctttcggtgcccgcacgaggctgataaaggaagtctaacattatctctaaactcaccgagaacggtcacgtgagctcgataatagttcctccaaagtctgcggttgagaatatgaactcgttcatttgcatcgaagtcggaggctactgtcaaggttatggataccacatacctaatagtagttgactaaatctcggcaggatccaccacataccatgttttatacggaaactgacctcgagggagttccggataaggaaagacaaccagagttctacatggaaacgacaatgactactcatattgtatccatattggttttcctagttctacttggacaaggggacacctatgggtataaatacaagccgccctaggaggagaggggacatgagagaatcaacacccaccatggaggatcaacacccaacacaatcgacatagaagccacaacatagaagcctacatacgccaagacacgccgccggatattgacttcagggataagcacggctagtaccctacggtgtctccggatactgtcaggagagacgaaagcgccatctctgatctcgccgggcacgaattcgaggaggaaggctaccctgttgtcgactacgagttagatcgtcagaccgccatgtcgacaacagttagataggctaccccaaatattgtactagtgtgattatcatgaataagagcaataccggcttcggccaacaggatgtagggttattacctgacaattcaaggcccgaacctgtataaaaattctcgtctccatctattttacctcagtctcgcatatatcctagcaccgatgatccccataccatgtaaatactagaattgcaacatcaaacgtcgacacttttcctgttcttggaattattcatagctcgagcaattctgttagcaaccaaagccaaatcctcctcctcgatttgttcgagttgatcatcggatgtggcattaaaaacagcaagaaaagaaggcttagatgaagaagcatcaacatccgaagaggaagacgaagaaaccaaagcactcgacttagaatcaacttttcgagaaagaacattcatctcatgtgttttcaattttgtgtaaagtgaatccaaagtcaaagtagacatgttaacagactcctgaatagatgtaactttcatcttccaaatagacatgtcaagatcattcaaaaagtgacgagaaatctcagattatggataattagcatcataagaagaatcaacagatctaagatcactcaaaattttattaaacctagaaagatagtcatctaaagcttctccaggtttcatctcaaatttaatgtactcctttttgaaaagatctcgacgaagttctttaatgttattagttccttgatgaaattactcaaccattccaaatctcatgagcagtttgaagatgagcaacacgatcataatctgaacgagaaatcccactcaaaagaatattgcgagctttgcatttttgttcaaacttagtttttaaagcagcagtattaatctcttcaggaatcacataaggacgagaaacttttctccaaatatcataaccttcagccataatataagattgcatcctactacaccaatgagaaaaatccgttccatcgaaaacatgaggcttagttgaaaacctagcgggagtagccatgacaaaaactctagatcgataaaaatccaaagaagaaaacaaggctctaataccacttgtaggatcgaaacacaagaactaagccaaccagagggggggtgaatggttggtatacccaaaaaccgaaaacttttagcggaaataaaagttaccctcgaaattgacggaagtcagtctgaccgagattgatcttccggtctgaccgaagcgtagccgccggtctgaccggtgttgatcttctggttggaccgccctggaatccctgtcgcgcctgttgtcgccgccggtctgaccgcaggtcacccgccggtctgaccgccgtaatgccgccggtctgaccaccggtgtgtcgccgattagaccgcaaaaacccagtgaaacacaaatcgaagaactctaaaagtggatgacgactttattgattctctctgtgtttacaaagtgcaccaacagcactccttatgaaaattttgactaaactcgaaatcctaactcaaaactcaactcaattgctctcaaaagcgataccgggaagcctcacgctccccctctatttatacatgaggtaggcagcctaaagccatgaaccaaactcatactaagagtcctaaacaccttaggaaaccctctagtacaagaaacaaactttacataaccaatcgtaccaaatttggactccttccaaattcgtctccgcatcccatacgcacacaatacctccatcgtatgtcatatggaatctccatcaaccacgtgcatcaactctagcctaagtatcccgcatgatctctaaccaccacggacgtcgtcttatccccaagccgactcccgatccatcaccgcaaatactctcccgaggcatcaagtcacctacacatgaaataaacaatgaaaccatattccgagaccaagctatctccaacttgactcattagtagcaaacaacagtattacatacgtatagtatccatctagaagtcataattatgaaataatcacggatatccaaacaaacaacccgaaactgaaaccgacacagcgtcggccggtcagaccgcgggctggcaggtctaaccgcgcgcataccgccggtctgaccggctatcagagcccgatctaaccaatcacataaaataatataatcctgcgatcacctgtgaatccaatcgtctccaaaaccacttcgtgaataaattccaaataacaaaaccaataatctccaatgtccaattgttcatcacagaataataatcaaaaacacctttgattttacaatatatcgtgttcttttctcctgaaaatgaagatgaagattaagattaagttttttacgcaaaatgatgtgatattaacatatcattgattgtgttttagttattacaaacttgataaatagattaatataatattttagagtaactttcatatagaaaatttttgcacgaaacacaccgtttagtagtttaaaaaagcgtgccacaagaatcttaatcttcatctaacttttgttggagaaaagaataggactactgcatgagctcgggctacttttaactattgctataagttccaaccatgatcaagaattcaagatatgtgcctatgagcatggaagaaatacgctagagaggataaggttacaatcaaagtaggagagaagctctcaggcgtggaagaaaatatctcattaatgtggggaggagaagtgcttgctgatgggaggtaacatggctctaagagcaagttgctgagatggaggagataagagaggagagagagaagaaacggactgtaaacttagaggcggtttagacacaagaaccaagaaactctgtaagagagacaagtgggtctatattaattgtaaataaccttatagccaacaaatcggctgtattactagccttgctttaatagttcagcgattctagaacgacttacgagaaataaggctacctagtctaataattacccccctccattttaaaatataaacataatattaaggttagaggaaagaattcagtggatgtgcacactccttaagaaataatttggctaaagaacaaaagcaagaaacttagctacaaaactaaaatcatctataccgaaaccttgcttttgatgtccctattggaaccttgatgctttgttatgctaaacttatatttaatactaattacataattacttactcttcgttccctaattgttttgggtaccgatgaccactctgaacaccctagctaggtccgccccaaaagaaaaaaaagatctcactttactcacctcaatggttaaaatttaaattttgaattacttgtactttcgtcctaagcacttgattgactaaatatttacggattttatgccctagaatcaacgcctcaaaaatatttatgttgtattatttattttcaaattaaaaaaataccatatcacgcgacttaaagtaataaaacctaccctaaaatgccattagaagaacaaagggccatcgacccatcgtagggagagaaaaaaaacagtttgctactcataatttgatactaacaaggatactttggccgagattagtttcaaaatttttcttcaaacttctaatttttttatcacatcaaaactttcttacacatataaacttttaaatttttcatcgcatcgtttcaatttcaaccgaactttcagttttagttttagtgtaaattaaacacaccctttttacttacgtgcggcctctattccctcccgctttatcgcacgtcctgtttcccggctgcttcctcgcgcgcgcgcggtcggtgagcgaccagaagaggttttgatgccatggctgaaactgaaagcgtgacctgacctcccaccaactccccccaaggcggggctagtcgatcgagccatccgattcattcccatgacccacgcgcggcgacaagtcggccggtgatttcaccgtaccagctgcccccccttgtagtatcacgttcgaacggtgcgcccgccgatcgagcttgcgctcggtgcgccagcgcgcaagaaaatcgccgcgcgacgaggcggcacgcacgggatactgcgccgcgcgcggcttccgctcttccgcggtgggatccccaggcgtccgccgcccacaacgacaagttggcacggctgcgcgaaggaacgaccagcccagccggcaggcagcatagcagcagacacgggcggatttcgtctcggcccgcgtcagggcccggctgttcggcggatgtcgctggctggctcggtccatgcaaacaagtggaaagtggcctatatctggattgagcctggccttgtcaacaagataggccttgtcgctggctcggtccatattgggctttcgggtgtgacatggaagttcgattcttttcttcaagtagaactggtggcactgttaaaaagacaacatgtttttttattgatcatttgcttctacccctggggacagtgtatagcataggttgttcataccatacggttatatgggaaaatatataagtgtaaaccatatatataatgtaaacccgaaaactatcgtacaataaaaaaaatggacgtctgaaattgtccacgttaccctgagtgaaaaaattattttcagatttaaccatagtaaaagttttaccatgacatggataagcattagatgcccatatttttatcctactatagtttttttttgtaacatatatgtgatttacaatacatattttccctcaattatataatgctatgaagaaatggtcatatgtctaaggatagcatcttcacggtggaaactgaactagagaaaatgaccgtttacgttctttatgaagaatataacatggcatgttcaagacaatatgtacattgtgtgaaccagcagtttactgtttatttttttagtgcaacgaaaaagggctataatcttttcagggtagggcaaatagagaataaataacatttttttccttgtgaattactcctatcaattactttacttcgttaaattcagaggaaacataaagttgataacattgagtatttaatacaaacacttcataaaccagagaaaagatcaaaattatggcatgaaggaatgaactttcagaagtcagaaactgtgagctatagatagactgatagagacattaaacaacaattaatttcatgccatctaaatttgagagactgttgccattacattacaactaagtgatagatatactcaagacaggacttggcatttgaaagtcaagagactggcatgcaaattagcaatgctcaagacagcatgtacatttgaaagtccaagaaactgaacatcactacatgctacttctagagacttttgcagattagcaatgagtaaatggagacaataactcagaccaaactgcaatattgagacctacaatgaaacaaacataacatgtattttacacgattgttacaaattcgttcgccccatgcttggcccagaaagtcttcaagtcaattggaatagcaaggttatacccctcaccacttcaccagtcaccggctagcttcctccttccagcaatacatgcaccccatgtttagttccaaagtttttttttccaaacttttaactttccatcacatcaaacttttcatacacacacaacttttctatcatcgtaccgattttaaccagacttccaaacttcagtgtgaactaaacacacttcagtgtgagtcattggtagtggatatgtcgaaatagaagttgtgcaacatgcaaactgccagccacctgcaccccaacgataccattgctggggggatcagtgcaagagctgctagcacacaggtgttgctatccttgaaagatccaaatcaataaccattaattaccatccccacagtcttctcgtggatgcatgcatgttatgtttgaagctttaccaaattttggtgtggtttttaaagagtgaaagtttctacaagattccaaaatttaggatgtattgatggttgaaatattttttgttcgctgataacgttgatttgggcaacaaattaaataggcacagtaaatactggagtatttgaacaactttgtggtaatccttgcacacaagtcataattcgtaatactccccttttctcaaaaaatagcaacttagaccgaagaagacatcacttagtagtataaatctgaacaaactatcagttatctactcacgtaaaggtgattatccagatttatagtattagataatgaaattgctatatatttatcgacaaattttctcttataaatttattaaatgtaaatacaatataattgtaattatattgtaacttttatgcaactatattctatcttttatgtaactgcaatgtaaattgaatgtaacttttatataatttt

SEQ ID NO: 63020 - DNA, 2949 bp, Oryza sativa
atgatagggaaaataagaacccgggaatcaatccactagtcaagaggtgtggaactaatccggatgttttgttgtgcctaatatgagtaaattggttcccgacccggaataaatcccggtctcttgttgtacctattataaatttcttgttatacctatcattcccggcccagaacgaatccttgtgtaaccgaacaaggccttagggggtgtttatacaaatgaagctgcattgaaccttatcttgttggtttttgaattgcctgtacatcttacatttctttactcatcatcgtgtgctatctgaattttaatcctgaaaatagcgacatcgctgttttgagaatggccaggacacgttagaattgcagttgttaatataggacttcagctgtaatgctttatatgatgggagaatccattcagtccataattgaacatgaatgtttttttgggttaagttctagatactctgtgtttatcatattatactgtttgtttatgtgctggtgattctgatttaatgtttacatatcagtttggcaatatcattttcacctttgaaactaccagcttctgctcgtattttgattcatctgttcatgatcttttcctacgtttttggatacagatatcagatgcaaactaagttcttaggtgtgatttttgtttcagttcttgtttgtgtcagaccaaagaatcaatgagtcaaaactaaattttgttttaactgtctttttttttttttggtggagccaatagatcagtagacattgaaaggtttagccttcgctggtgtgctgttgctccccttttcttgggtatgttttgcctgcctttagtttttgtaatagcttattatgggtttatgtagtcttttttgttgcaagaaatttgtcttctttgttgcccaaaacatacccaagcatgaagtactgtcaaggaaacaattttatgcggcgtttcgatttttacgttgtgatcaccgatcaagcattctcttattagttattacatcttcctgcgttgataagaggcaagccagtaattgagtactaaaaaaatcagtagcatggctgaaattcccagctggagttctagtttataaactgtttgttattgttgtctgaaagtagatggctttgaaagaactgtgtttgtgtttcggacagccatttcctagtataaatatgaagatgtgcaccactaaacacaaattacgaaccttaacagagatcgaaatattagtaccactgttctgcagaactattgcgacgagcaactagcctatgtcttctattttcttttgttaatggtctacttttgtgcataatgcacacgctaattaatttcgcatgggcatatctttttcaggttattttgcagttcattgcaaactgcatgtcggcagaaagggttggttagtagagttttgtatttgtagaccatctatcagttctgtatttctagacagaaattaacttgtcattcagggactggattcaatcatggttgccagttttttttttctttttttttctgtacttctagtactcctagagaagtggtaccaaaagccagaaccacaagaaggtacttgcgtcaaaagatgaaatcgtgttgccaaactgtacagtaatacaattgaactttgctactgcgtgtcaactttatcttggagttgccgtttcatgctaagaaaggggtaattctcaagttgtttactgttctgctgttcactggcgttttagctactacacaggcttgttctttacacatgtcaggcctccctatatctttggaagaccaaaatgcagcaagggtgttgtaaaatgtactccctccgtcagcaaaaggtaatttgcttctttctggtccaaaataggggtgctggccaaatatttcctcagttgaagactatcagagcttctatcgcaatgaaagattatcagagcttctatctcctctgctttttggaggatttggaatcacaaaaacaacgttatcttcaataatcaaccaccatcaggtgcgtgaattttacatcaaagaagcagatggaccggccctagatgggtggaaggctgtcttctcaattgctatttcttcgggctcctcccatgtttaattctgtttctttctctttattatgtactagtatgctccctccttgttttcttctttcctgtattttaattacccgttgtaagcgacttggttactccattaggaggagcttatatcaatataattcaatattcgcccaaatcttcagtccttgaccaacagttttgatcccacaattgcagcagcaattggtaacaagtccacttgcttctactgcattgcttagcccacttgttaggtttgtaacatatagttttatttcttaccgataatcaagtactccatccgtttcacaatgtaagactttctaacattatccacatacatatagataataaatctaaacacacatatgtctagattcattaacatctaaatgtatgtgggcaatattagaaagtcttacattgtgaaacgaagggagtagataagtatgaagtatgaactaaatggtagtaaaacatatgcgacctttgagttaccttcctgaatgaagtatgaactacgatttccatagcagtacagcacacaaatcaaaggcctcaggttgagtctgcaggatgaaattacacagcacctttggattgcaaatcaacaccaactccttttcacatgcaaaacaatgactaaatacaaaactcaaagaataccaagaaaacgaatataatgcacaacttaggcatgcttcctaaccaacccactgatcaatcgacgtaatttaggtacaacagcaccgcagatgttaggtcatatatctacaggcaaatcttatctaaatcctgtcacaacctgtcgtcactcattagcaatgtcaaccagtta

SEQ ID NO: 63021 - DNA, 4062 bp, Oryza sativa
tctgaaggcgatcagactgaacaaggagggaatgaaaaagattattgctttcactaatacaacaatatggcatggcaaagttaggattttagataacaaaaatgaaataacctatcctttgaaatatataactaatcttgttctcagcatgttgaaagtgacagtttatggttgaaacaataggtaaacaaaaaaatggttgtagcacgtaaatgcttaaggcatacacatattttgatatccaccattcactttatcatcaatatctagtcatatgcgactttgtgtgaaaatatgtacattttgacaagatacatttgatttattttttattattattattttggtgcaactcatatccacatgatggctgaatgggttgaagcaagttgagcaaagaaccattttaagtcaagatcatagttaccttctctttctgtaaattgcgaagctccgcttgaagatcagaaagccttctggttgacaaatcatgattgtccttggaatgattgaccggaccattgtcatgctgattattgtgatccgaaatttgtgcttttatcttctcgatttgagattggacaagtgagaattgttttattctttcttctttctttgacctgagatcttccagtagaggcgtcactttggcaagttgctctttcaatgattgcttttcatccacctgtagacgaatatctcaaattactcagaaatggaatatacttatacagtgatgtcaaatatgtgacagagaacctttacgatataacaaagcataataattcacctttttttacttaactaatgtgaccctaaacatgccaaaagcaattaactgtggccaatgcatgtagaagttgggagtcaaaagaccaacacctttgctttttttttctttctaaatgccattaccaaatggaatttcaaacaaagttcaccgtacagcaaaccatgttgcatagtcaacctcatgtgtaaaagaaaagctaggcatcatccaggtatgcttaacttacaggaatcatatccagcgattcttcaaccaagtagatggtccacaattataattctggccaggaaagaaaatggtcctttgaaccaagttctacactaaactagtttctcaaatgtgcccatcagacatgactatgtaccaaccgagtgacccagctgtgcatgttgcagtgatatgatccccatcattatttgaacaaagatggccaacctgctgaatatggtatattctacgaggtgtagcatgacactaacaattatttcatacttgttgtacaagctacaagataacctaccaatatctgtagctacagacaaatcaaaccttatacgcataagacacacgataacataatcaaggtccctaggcacaaggcttggaacaagaggcaaaaatagaagtatgggctgagtataccttaaattttggggtaatttcacctattgaagccactaaaactttaagctctgcttctttggccatcaatgactgacggagctgggatctctcagcattggcactatcaacctttcgacggtacacacgcatgcactctgtttcaagttctaagaacatgcgatctttatcttcttcgcgctccccaatctcagtccatatttgctaaaatagaagttatgttagaatggaaacaattgcaagaattacatataagttcgtaatattcagagaaaataaaaatgtgcagccacctgagcagcattaatggtagctacatgtgacatttttatttatttatttatttatttttgcatatttgatgtttttattcatctaattgacacattggcaaaccggcaaatgataaattgttatagaccatgtaatttcatgccacaaggaacaaaaatctaatacgcaggcttttgatgaagcaagctgactgctcaaccacagacaacagagagagtaaatgaaactcaaaataggggtatagagcatacaaaatgtaatgttcataagagagctactaacttcccaaaatgtatataaatgtgtctttgcataccctaaccaggccccacttctctggacagcattagttagtggaaatttaatttgtttttattttctttctgcagagtttttttttggtaaaaataaggggcatagcatttcttttgaaacagcagaggattgcactctcacttacaattcccaatttcgagtacgcctgatgctattaaacttatatcattatgctcactgacacattagctgagataaatactactcctaccaaacgtaatatttctgacccgtggtacatcaacagtggtataataagagcgctcctaactgaatttacacaagcagtactactccaagttcttcagctccaaattcagactttagtaaaaagaaaaagtaaagtaaatcgtcgcatctgctttgcttcccgagaaacatagtagagacccggaatttccataaaagaaaaacatagaaaccaagaagaagctcgtagtaaatcaaaagtgaaacctttaagaatgaaatctgcaaagctgtaggcagaagcaacaaactcctgctgttatctaaatcctagcatctgttcaaaagagcgaacttttttggtagagaaaacagtatgcttgcaattcaagaaaaccaaaggagttggaacttttgagcataatttggacatataatgtgtgctcatctcgaaaacaatacacagaatttacaaaaacaccagtccagcttggctcaaactgtgcaatttcatccaaaacaagcaacgaaatcctagtatttctacgatttaaacgagcaaacgaatcaagcaagaagtatcctctcctattccttccaaagaacaccttccatttctccttaaatccgtcgtattcttgcagagaaccaaatcaaatcaaatcaaggacgccatgaacaaagaaccgaattacgcacctcgagctcgcgcagcagcctgccgcacggcgtctcgaagctgacgctgctcctcaccgccttgtccatgccatacccggccaagaccatctcgcccatctactctcctttcctctcccactcctctctctctctcccccctccaggaaggagaaagagaaagcggctagaggcaaaggatgcacctatccagtgcctcttcctctctctcttccgtcttcttcccccctcctcctcctcttgtcttcttggtttcttggttcttggcccaacgacgacaacaatggcgcttctcgccggggctgcagccagcaaccctctctcctacgctttcctcgcagcaaccctcggctctagaggactagagagagaaagggagggtggagaccagagagatgggcagcggtagttgctggaccatatatggatctcactgagcacagttggtagcacaatggaaagaaaacgaggtgataagggtgaagaaaccgagaggtaggagacgaccagagggatctgtttgtaaaattcaagaaacttttggggtgatttggatgaaaaaggtagtaacaaacaaatctcccatttttgcggtttggggacaaatctgaagatcttggactcacacaagcttagtagaattttacagcatttgtttaccttttttatttcctgttttattacatagtagatcacaattatatactacataagaaaagtgtccccatcaacttgtttcttttacaatgtttcggtattctaagcgaagatttggcaaataaatactaaacacattatacaggaatttgagaattttttatgttccaaattagtcctttaggtcatttagaattaaaaatggctgggcttcataaatgaattgcccccaaagaaggacattccctgaagaaaactgataaatgacaggtacataattaaatgacagcattgttgcctgttctgaagcgcgccagattgtgtgaagcaagaaccacccggatttttgtgtgattaatgtacacataagtaggaaaggtaggtacagttaaccacaaggtttttcatgccatttactgcacaagtaaaaaattatagaagagatgaggcaa

SEQ ID NO: 63022 - DNA, 1377 bp, Oryza sativa
gtctctttttcgtccacttagctatgatgggtctatgagaagcatttgacagttgcatcttctctcagaatcaaaagttctctaacggcctaacttttaattaagattataagagttggaatctagatgatgaattagaagccataaattgattttttttcagcttcttcagattctcatcagttagattctcatcagctgcttcttataatctaaaactccctaaacaaatcctttattttcttcttaagaaaggattgccaatttggcatgtgttgtctacggcagagaggtgagcagtctctctgccaagaaggaattcagacatttcttctcatggtccattgcttcgacattaatctctgcaatggtacaccatcgctgtctcctctagtttggtcaaacaaacctacttcctctattctaaaatataacaatctaaaataagataagacacatcataaactataaatctggacataatagtggatctcatcccatactagattactatattttggaacggatgtagtaatgcagaactgatataggagtatccaagtgccactagtagtactatcctgtcacaactcacaattcacacatgcttatttcatgcagtttcccccttttttttaactttgctgtttctctggagctagtgttcgtctgtatcgcagactcccagtttgtgtttgactgcaaaaatccatgaacccccccaacttctcaacctctaggaaagagagagcagaatataaggtgtgttatgattgtttatgttgtgatcttgtgatctttcagttgtacagatggacaaggagcgaaaggacaaatgtatcatctgccgtgcttgatgctcccttgcgtcttcggttgagggagcaattagcaaataatacaataccttcagatagtgattaacacgcgtaggacaaaactgtactcctctgagcctgaagagttattccatggcaaacatgaacggtcattttgtacctttgagttaatctgtgtgtgtgtgtttgacgtcttcctgtccacctgtacattggtcggcacggcctgcaggaaaggttacgctgcactttcttgtgcacatacaattatacaaacttcataaatttcttttctttcagaaggaatttttcatgtctgaacatgaatgtgattttgtgtacatctaatcagggttctatatttcggaataaaatatatttcgggggttaacgatagaagaaaaatttcagaaatcatggaaatttcagacaaaaaaaattaaaatttgaataattttgtcttatttttgaaaatttcaaccaaaataatttcctatctggaacctaaattcctgaaaaatttccggaaattttggaa

SEQ ID NO: 63023 - DNA, 1669 bp, Oryza sativa
tcatatttttgacaagatattgcacatttcaaggctgaaaaccaaactcaagttttcgttgttaccacaaacaacaagtgaaaggaaattgatggtctcacatagacatgaggtgacgtccattcgtaatctcgaggtaccatcggcacagctgcatcattcacataagctgaaacatcagaagacaatacttctgtacatgtttacagaattatcagtgagcattattcatcaacatatggcattaaacgtatttacagaatcgattggtaaaataaggcactcataaatattagttacttcttaatatccaatcatgaatttcagttgaatcatcattacttcaattcccttgcatttctttaatctttgaaaagcaattcccttgcattttcaacattttagtctcaacaatgtgtcaatgtcggtcgtcgggcatagacgggctgcacaaccttgtacaaacatgtgtagcagtacttacagttacatgagaatagtgcttacaacggcaaaactgggactcatgctctacgcataaagaattcacaataaacctcagatattgaaatctctctcgcccttccctttcatttcatctggtttaagcacgtgcattagaatagtcagaacaaccttcatgatttcttcttcatcatatgatgtcgtaaacgtaactgccaagtgcagatattgaacaagttagaaacaaataacgctctttgctcaactagagaaggaaataacctaactaagcaacgtgcatcttctggaccatacaggcatacatacatagatagagtaaaatatgcggccaaagcttaccccaaggaaggattgggaactcccatctctgcttaggaactgatatggcatatgcagtaacctgaaaagaaatgagacatcatataaatcataattcagcagtctatacaaaatctcagtaacaaaatgctgcattaaataacatacaagagctgaagcagcaagttgacagggagagttaaaaagccatgaactatcttcagtctcataaagaatatccaaaatttccatgcaaacatccatatttaaaagatcacctattttggatatttccctggcaatagacaagaaattaagtgatatatcagtagaaactatatggttaagcttctcatagatcaggaagtcaagaaaaaaaagcaaaaactggtagtttaataatgctgtccggcgatggtaatactaatacaggtaaacaggattgctaaaacaaatgataccctggcaggacagtctttcaagggaaaggaagaccaatgggaagagtggatgaagaagcaaaagattctttttcttttgttttattattcgcttcctcagaacacaagtgaatcacaaaactagttttaaatatgatctgagatcatctatactaacatgacacatttaaacatttctagtgcaaaattttggcactaaaaagtaagaactgctataaggaactaggcatacactgattgtgcttggtgagtaaaataaatgcaacagattatagtgaccaatcagtacagctgtctgttgtgatatacatataatataattcacaaatacatagatgtggacagtggaagccataaatgtagacttagaagagaagatatgttcgtcaagtatttattagttc

SEQ ID NO: 63024 - DNA, 2487 bp, Oryza sativa
acaccagttcctgtggcattacagcaaacaccttttagccactacaagaaaactttcaaacaaggaacaacaatgcgtcgataactcacagcattggcgaaatcgcggcaagtgaaatgctggtcggcgatgatgcgatcaccaagcgccttgaggctcttcaccgacagcggcttcagctcgtgaatctaaacaggtaaccaaatgaaaaataaaaaggaatgtaattccacctctcatggcaataaatccacacgacgtttgctcaacaaatgctcacagaatcaccttgctggcgatccacacggcaacgagggcgaagagctccaggttgctgtccctcagaggctcgagcagccaggaggtcacagctcggccaccccgtgcgccacagaaccccatcttcctgcagcgacagcgagcaagttagtaaaacaataagaaaccaatttaacccccacaaaaaccaaggtctcaacttcgcggggtcacctccggagggagggcagtaggcggtcggcgaagaaggagagcgcggtgtacttgacgacgggacggaggtcgagccgctagaaaggaatcgcagcagaaggcggcatgcgaggtgaggtagctgtcgaggggaccatgccggaagctgagggggtggaggggagcccgtaccgtggaggcgtggaggaggaactcgatgaggcggcggcggcgggaggggccaggccacgcgcttgccgccgcctccaccgcgcggtcctcgtccatggtggtgcgcgccgcggtgcggcagcgaggagttgggacgccggctagattgccgaagaggtggggagaatggaggagcggctgctcaaccaggcctccagaattcttcaacggcccactaacctcatgctttcggcctgttcggctcttggtgttggaccctgtgaatagtgtgctgttctatatgaggaaaacggaaggggatcctctcacgtgaagtcagatgcctacatgtcagtgacatatcacgaagaagttcaagtcatgtatccctttccaaggaaaacgggtttggctatatgtttctttcgaagttgcattttcccgattttgcatttcaattagaaacatatgacctatttgagaattttttggtgactgcagttttttccaaaatctcagctcccaaaacaattcatattaccactcggattctgaattgaaaaacaaattagaagccggaaattaagaaatcagtttatttcatattttcaccggctggctattaataatctctctaaacagaattacctacattcaagcacaagaattatgcgttgtaaatttatatactttttaaaaagaaaaaacaatgtacatttaattgttacacaaaaaccaacatgacaactctagggatgataggatttgcttagttgatcaattgtcaaattctgaagagaaagaccgctcaaactctgcatccatgaggacgccggccatgacatggacaatgatatcccgctccttgacgatatccacgcactctgacggcacgccgttgacgaccagtgcaccgtccacgtccctcctccaggcggagatcctcagcccagacacggactccaggacaggcgccaccgccaccatctgctgccggtggcgcggcggtgccacgtccgcggcgcgcaggcggcgagggacggcggagaagccgagcacacgggagacgacggcgtaggtggcgtcatcatcggcgccattcccgttggtagcgctgtcgttggggcgttgcagcttgaggacgcggcgaaacgactccggcgagggcacgaagacggtgaaggcgaggttcttggggagcatggacaccatcatgtcgccgaactcccccaggctcgccgtcatgtcgtcgcagttgacagatggtggtggcgaggaagacgaggatcttcgtcctgatgacacgacgctgctgtcccgcaacgacggtggcgacgaggagggagctgaggtggagaggagaacgaggacgaggaagaggagcgtcgctgcgaaggcgccaccggcgacgccggcatggaggtgtcgttgccatagcagccgtggcctgaccaagaaaagtctcttccttctcttcggcagcatattcatcagtgtgtgtcctcgctacctgttgatttgctggtcaggttattggcacgaggagatcacgggaggggtcgaggcagccgcccggcgatgtgggcgcaggagcacagccgcacatgacggatccggctaccttgcctccaggggcggcccaggtttttcaacttggctattcgaaattgtaaaagatagaaaaatttttccaacccaagatctaatagttgtataatatgtaacggtataaacatgatttcataaagtcataaatggatagaattgaccataaattgaatgcgttaagcatattagagtacagtactaaactattaattgacaaaacatatcaaatttatagag

SEQ ID NO: 63025 - DNA, 5495 bp, Oryza sativa
tggatccccccgttcttggacggaggcgagcccctcctccctctgccgcgacgcccccgctcccctcctccttttcccaaagaagcaaggggcgagccccctttctctccctccttttccccttttcctcccgccggcgtcatcctccctccgccctgtcgccgatttggccgcaagcgccgagcgccagctcgcgccttgaccgcccaaagtaggtttccaaaccgacattgccgccctttaaacccaggcgccctcccttcctctttcccccccaatcctccccgtttctcgtccgcgccattgccgccgccttccgagctctgtctcgcctccgccgttcatcgccaagcgccgggagagccggtgcgttcgtggacgcggaaggggactctgggcgctcgtcttcctcctcttccccggcccgaggccggagagattactcccgcgccgtcggcctctcgtcactgcgccccacctcgtctcggtaatgcctccctctgttcttcctcctcgctccatctccccccttagttttcggtagtagcacgagtagcctccccgtagctagccggcgccgccccgaccgttgccgccgctcgcagtgtgctcgccgccgtcgccgcccgtgctccgtagtacccgctcgtcgccgacctcgctcggcgtagctccgcccaatccgacgctagcaacggattcccgtagctgcgtagatgctctcaccgccgggaattggcccctcgtgacctcgtcgccgtttccccctttcctctccgccgggcgccgccgccgcaatccgccgccgacggactccctccggcgaatctaagccgttggctcgctccctctctttctccctcgtcatcccggtgtacgccccgtcgccccccatcgtcgcaaggcgtcccggagaaaccgccgccgcccgccgtccattcgcggccggcgccttcgtcttcctcccgccagcccgtgtggcagccacgtaggcgacacgtcggcgccagctcggccgagatcggatcgggccgaccccggtcagcccctctcgtgcgcgcgttccaccgtgagccgtgaggctgcgcgagggcccgccgcatccgttccaccgcgaaccacgcgcgtgcaccgcatcccttccccgcccgcgcgcgtgcgccgcgtgctcgctccgcacggtgaaccgtgtcatcgacaagcgggtcccacccgggaccacgtgtggtgagcccggtccaccggccctctgtctcctcccctcccgcgcgcgcgctttagtctattttccctccctcttttcttttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttatttttgatgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagattggcggacctacctaatttgttgcatttgatccttcctttgttaattgatatatcatgtccccttgtaaccatctagttgcgtctcgatattcgtgcaccctgtgcgagtatcgacggacgccttcaaacttaaaatctgagtaacaacttgggtaaaactagggttttacaaaagacttggaaaacccgacacctgggtcggtgcttgcgaactaaatgaatttccaaaaccgcggaccggggaacgtaccgggtgtacggtttcccgctcttgcacttaaggaccgtttccttggaatttcatccaaacataagacaagtacgaccacatgggtgaaatgggacacccctggctgagtaactagcttatcaggggagccttgatgccgagagacatgtggattcgctggggtggtgtcggggaggaccactgggcttcctggcacagtagggtctgggacctaacctgttgttggtctgggacccctctcgtcggcatatggtaaacctgtgtcggctttggaaatgccttgtcatgaaagcttggaggtctcccgacgtggctgattcccacgggctgggtgatccgggttagtaatgtcgtgtgggtaaagtgtaccccccctctgcagaggttaacaaactgttcgaacagccgtgcccacggtcatgggcggatgtgaggtgattcctagcgtagttttgtttgactactgcttgtgaaattgctgttgtgaaaaggggttcgatgtttgaaaaatctgcagctgacgggatcagctaggcccgggtggccgtttgaaagttgttggcccgggtggccgtttgaaagttgttggccgggtgccaatcttgatcaattctaaagactgatacattgtacaaactccgaccggacgagacgcactgtctcatccgtgtcgtttgagaagcactcacttagttgttttcagaaaggagttcaaataaaatcaattgtaaaaacaacagcctttccttgaagcctgcattaaacacttatttcccatggcttgctgagtactcccgtactcacccttgctctatataaataatcccccccagttgctgaagaagatgaagtggatcctgctgatgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtccgcagcccaacatgactgtacctctactctataataaagagacatctgttgctgtgataatctgtcttcttgtgataccagcactgtgtcctgggactggtatcgattaacaggttaatttggagcgtcacgggctagttccggtcggtactagttcggggcgtgacaaagggctgcgccgcagtacgccgactcctgctccggtgccacgggggagctcgccctcatggaggacgcaatccaggagatggagtcggggggcttgacgccgaaggaggggacgacgtggacgcctgctccgcgcaacaaggcggcctccacttcttcgctcaccagcgaaagctttgctgcctctatctgagcacagggaggcgcctcgcgctccccgccgtggagctggggcgcatcctccagcgcggggccggggttgagtggcgagtggtggccggcgcaggtgaggggccccgtgtgcgggggaggcaagtcgccccgggcctggcgcttgggcaacggggatggcgagggaggcttggtcgccttgcgcatgggattgggcttgctgcgacggcggtaggtggtggtggtggcggctggtggcaagggattaggctccattttggtgtcatcggccggcaaaattatttatgtcagtccgccggcttctggccagccctcaccaccttcaaggtccgcaccgtggccttctccatcaagtatcagtcatcaaccctcgggggtatctcggggaatcacgactgatactcacaagtatcaggcctggtacccaggtatcaaggtctaatacctaggtaccagccggtacccaaggttttagaggagcgcacgtggaagctcacctatacagaggaaaggaaggggaggagtcacttaatatttagatcccacccgaaaattttataccttgtcacatcgtacgtttgaacacctgcataaagtaattgcacatattgtgactactttgtaagacgaatctttaagcctaattgctccatgatttgacaatgtggtgctatagtaaacatgtgctaatggtggattaattaggcttaataaatccgtctcgcggtttactaacggatactgtaattagtttttttattagtgtccgaacaccccatgcgataccctatataatacccgatatgacacgctaaaactttacaccactgaatctaaacaccccatattcattttttgcaatggcccaatggactgcatgtcagcacggttgaacccctggcgcccttgtcttatccttctactctactctccaccagaacacgcacttcccctgacaggaaagcatcccgaagctttgcaaggattttcaaggcgatgtaacacttacacagtggcattggttggggccccccccccccccccccccgcttttttttttttttgacaactctacggtttccacttgtatttgtatatgacattaccttgtacttcaaagttcatatctttcaatcatgcaagttcataaggtttgctccttgcacggttaaactgccatattttttgtagaccaatgttgtcattgctctgaactcaagctcaataagttgcatactcagcttcgagtgcttttgtagcgtctggttggcacattgcgagacatcatgcgacattggactacctgtatggctgtagcaggatattttctagggaaggcaaagaagaattcagacttctctagaccgcttctttcctctgccaagttgcagtctcgcagaactgtcttccttgtttgctcagcatggttgtgacttgtgagaggcagagagggagttgacctaagagccagcctgaagattaggcagggcctaccaacttgccattcttcagacaaatccacttgcacaatctgataggagtcttgtctcctgtaaaaatatgctcgtaatctcgcctgatgtcaccgatgaaagatggtatttgtcatgtacatgctatgccattcaatatggctgaaacatgtatagtaaaatgaagctctcgttgggaacacataaaaaagaatgcaacttgttcgtgagcttcatctcacggctgatttgctgatgtgattgttgagggattaggactgcaatattcactaacaagaaagttcttttgtactgaatggactttttaagcttgatgattaacacaatatagaaacattatctagttacttattcatatgtccatcaacggcgctctgttctcatcgatctaatgatttcgccatttcccttgaataaaattggacccatatggtttagcaggtgttaggtgatgatgtaagatgattgctaatttcttttatcagaaacgataagagcttaatgtggttatcaagtggaagcatggccagtggtccagtgctactgtaatttagttatttcttttttgaaaaaacttgatttaattactttctgtgctgagaagaatcttctgggataccccctggttaggaccaaatatccattattcatcaatcaaactgcagagtgaaaggtgaaacta

SEQ ID NO: 63026 - DNA, 16572 bp, Oryza sativa
  unsure (1)..(16572): unsure at all n locations
catcacatgttaatatattttcataatttttttataactatttgagtgacatgcaaataatgaggggcccctcgagggattaaaatccactcccgataaacaactgtacacacattgtagttctcccaaaaaaaaaaagaaaaactgtacacacattgtctaccttcgaatgtggatgtacatcagatactcctatagtcctatatgaccttatttctgaagaaaacttcaggtgttttcatatttggaggtacagtcttgatgaagtaacctaatcattcatgttctaatacagctacaaatatgtttatcacaagatgcaggtgaaaaatggatttttcttaaaaaataaatgggataataaaatagatttacaagatcaatggatgtctctcactctgcaagaatcaagatagcaacctatagtcagcagccttgtcttggatcacttcatttgttctgcagaatactgacaaatagaaggaacaagcagcagaaaacaagaagaggggacagtcttagcagaacccttgaatttagggtggtggattgagactgaccaccactagtaagtgtgtgtagtgagcaatttgggatggtccatgaggccatgacaatgccacaatagctcttttggaaggtattactgtgtacacatgtacagctaaatccaatgccggatatatagaataagaagattattagaggttcagaatacccaaggtctgacggaattatggcgctgaatttgtctcacctcataaattgtatcccacttgttttgcgatttgaagcacacttgctttagctgttcttcattccattaagatactcgccacttgcattgttcttccattcatttgttaagcttacaagccctgaagcagccaaaaacaacgcccaatgaaacgtaacgttgacgccagcctctatttacacttgcttcatggccacgtatgcacaaatctaatcctccctaaggtggtttcacagtgaatttgtgtttagctgttcatccaagcaaattctagacaaattgatctggtattgtgaatttctgatcatgaagagtacatatgtatagttacaggaagtcaggaacagtctgtatcctagctatactgcagattatatacgaacatttactcaggacagaataatcaatttacattacaccctctctgtctctctgattctctttctctagatctctcatcctcttcttccactgatcctctctctgtttatctgcaagaaagcatcaaatggtgtcgccgaatctcgcgctgctggcggtgccatcctcccggagcaggtcggcggcggcgctcctcccgccgtcgaacctctccgacaggaagaagctccgcagcgagttgaggttcctcctcggcgcccccacctccacctcgaacagcgccctcaccggccggtggtccgacagccgcgactcgcaccggtcgtaccgcttctgcttcagcccggcgccgcgccatagtatccggtcacacctgaaaagaaaaaaaaaaagaacggcggcggccgccggttagccgcggatctcgccggaatctcacgctatttcagccgtttttctttttctttctttctctggcttaccacgccggcgcgcgccgcttctcgcctttcctgccatgggaggcgcagccgtagtaggggtcggagttggggtagtacttgtacgtcggcgagaaggcgatggcaccctcgttccagccatggaatgcgcctccttccgattccacctcgcttcgcagctgcaaattattcagaatcaacaacacgttcagtatgattggtactaatttaatttggagattgattgattgattgatttggattcatgcgtgttgcatgcctggtcattttcgagcagcgtcttccagtcctgcctctccaccagcaacctcgtcttcgcctccggcagggagatcctgtagttgaggtccccaagcaggatcactcggctgcatccacaggagtaaacgaagaatcaatcattaatcatccgtcagatattcagattagtcaaagcccgcctgaatgcctgatgattgctttgatttgaaatgtcgtcgtcatgaaggccggtgaaagaaactaaacgaacgatcaaaagcatgttaattgccactagttaattaccgtctaaaatcgatgcgattttatactacgttgttgactaccggtgtcggtatataaaacagtcgacgatacggcagatatttgtagtgcttggaagaagttaattaatttactgtgcctaattgtctactgtatgctacgtatgcaactattaccgctaatgactagtatcttatgctacgcaaatcctagatacagcaatacctaatcctcgatttttaccggtaccgtggacggttcaaccaccggattaaattagtacggttgccgtcgtgtgcacaggccgtaacaacggtcgctgtatggtaatttagctgacggatatacatgcatgcttgggtgtctgtcagtcagctcaatgcttcttatttccagctctttaattagtcagcgacagcgatgtgtttcttccctgcaattctagtatgcttcgattttcagcgtgcacaaaaaaatgtgttttaatttgggtcaaaaatgaaaggaaaaataggattttgaagaggtcgatgaatgatcaagtgggaggggtgtgtgcgtttgcttactcgtggtctagaatcttctgggggaggttgagcgagtgcccccgggggaaggtcgtccgggagaggatctccgtggcgtcggcgttgcggtgcgcctcgtcgccgtcgcggccgccggacgcgaggtggcagcacgccacgcagaagctcgtgtcgtggagccagaacctgacggacacggcgccctgcacgtccaggcacagccatgcacccgtggcgatccatcgatgccgtgcgtgttaggtacaattcattcccctcgcggcgcggctcgccgcgcgcgcgcgcgcgcgtggcgtgtggtgagcaatggcggaatgataggtcaggggtagggtaccttgttgccgaggcagcccatgacgccgcagccgacgcaggagacgctggcgcggcggacgaagcgggcgaggtcggcgcggacccagacggtgaggaggatgccgaccatctgcttgctcaccacgcaccggtagtccctgcaggcgagctcgccgccaccgccgccgatgccgccccgcaccgggtgaaccttctgctgcgccgcctgctgctttatctcccctcctccggctgcggctgcggctgcgccgccgccggtgcccttggcctctctctggtcacgggaggagttcggcgccgacggcgacgaccggttcagcgccgcgcgcacgagctcgttccagcgcatcccgacgcgcttcttgtccgcgcccagcacgttccgcgcgctcaacggcaccacctcctggaatctgcatgcgccatttgcgaccatgaatccatgatcagctattgatggccgccaccggcatgatcgagctccactactgcacttatggttgcttacccgaggacgtagatgtcgtaggcggcgttcctcgtgtcgagccagtccgacaggtcgaggtcgtccggtggcgcgacgccgccgacgttccacgtgctcgcgaacagcctgcagacgagacgacgacgtcgcgagtgagatcgactaattaatcaagacgccatgagtagtccaagccaactaatggctggcgcggcgcgctgctacatcgtaatgaaagcttgaccgatcgagcgccatatgtacctgtacttgagcgtcttgttgctcgctcgctgctgcggccgcggccgcggccgcttcacgctgcggcaggcgtcggcgtcggggctgcaaccatcgtcgtcgaacgactccaccgccgccggcaccgcctcgccatcgaagtcgtcatcaacggccatcgggaagtcggcgacgaaggcatggctgccggatggcttcctgaagagcttgttcgccaccagcctcggccaaagaacctagccacacacaaacacacgaatcagctatcaaacgtgagctaccaaatctcacaccgacctcgtcaagctagctaagctagctaggtacatacctccgcttgcctctggttctctagcatggcgaccaatccgtagggaggtaggtagggatggacgggtggtgaggtcgaggagacgaggacgaagggaagaaacttcaggcggggaagagggagacggcttaaataggcgaggagggcggaaagtgacaaacaaaaggagtctcccgtcccgcgcatgttcatgcgcactgttaaccagcggtggatggattgacggatcgacgctgatcgatgcatgcattcgcatggcgcgtgcggtgagcggaaaaagggggagagggtggtcgactctcgactggcggactggcggtgacacggtgacagcggaggataaaagcacttttgactgtagagggattcttatggtggggtacgatctgtttggtaattagttaaggtcgaacttctaaatttaggtttagtagttggatctgtagtgaagttttcacaacctaaacccagttacacatttctagtttattttatgatagtgctttaggtgagtggactaaaaattatttggctggacttcagctccagaagagatagagttagagctagagctatgcaaaatagaactacatgctttcacttctcaaattattactccctccgttcatagaaataagcatttttaggttgtttaagtaaaaaataaatctcgagtacaaagagagtaaaaggcattttttttcagttatcttattggtcaaatttgaaaatttggcttgcttagattcatgtacattgaagtgtcctataaatgcttatattgtctacaaaatttaaatcttagaaatactacctccatcccccaaaaaaagttactctctctggtttcatttcataatttttgacgttctggataagtttgaggtcaatttttttgtaactttgaatatcaatatctttaaaattatttaaatgtctaaagaactagaatgacatatatagatttatcttttaaaatactatagtaaaagtaaacatgtatttattgattgtatatattataatagaaaaacaggatcaaagatatattttggagattgagtcattatctaaaatatcaagaattatggaaccggggggagtaatatattttggtacatacgtagtacttatattcggaaatagagggattagaagtaaatatatgtataagattttcaatatatctactagcatatttcttctgtttttagtagatgatgttgttgactttttttttacataatgtttgatctttcaaacattcagtgtaaaatatacaaagatataagtaatgtttaaagtataataataaaataagtcataacaaaataaacgaaactagtatgatgaatagtcaaatattatgtatcaaaatcatcagcattatctatttattatttgtagtcagattttattctgtacgtatatatcaaatctaatatagacccattttcgctgaatggtgtattacccttcttttagagaatggtctttgcatattctattaatgatgttaaaaggtttcacaatttttatagctttttgcatgatatttgtgagaaatgggtgggcatcgctataagagagtagagctnttgttttgaatgttgtctagcggtcaaaaagcggaatcacataagagataagcacgattatttggatagggagggatatgttgggaatctttgtatctgccaagtctgttcaactacagttacaatgagatagatgtactggctcatgctattgtgcagggttaccaaatccttttcaagttttctaaataataataatcagaacatccgatttctttagcagcgataaggacataagattaactttttgagatattttagtccggagtaccataatttattactatctacgtcattgactttttaaatacatatttaatcattcgtcgtatttaaaaagttacagaattattatttattttcccatgacttgatttcttggtaaagatattctaagtatgacttacattttcgcataattgcgtaaaatttctaaataaaatgatcaataaacgcatgttaaaaagtcaacgatgttatctattcaaaactggaggggatttatcattaaaaaaatatgatgcacgcctctcaatttctacttaaggatctctatcttattttgttgttaaattatattcatcgtgatggatgaaaagacttattatatatccaatagaagtatttctcagttagggcatttaaagatttacacctgaaaattattgcgccttttagcaaaaaaaaaaaagccttcgaccttcataaagcatagtttatagaatcgttgcaccacccattggaaaaatctaatcttatacatttggccaatgattaatcaaattactaatttaatgtaaaaatatatcaacagatttatatttctattaattaagtgttttccatatattagttttgtaggtaatggagaaccaacaattaaagtttagtcttaaagactttttataatgaaaagatgtcctatagaaacaaactgagaatggagcgtggagaccaatttaattagctgtacatgtttatccatctggccatctcgtattctcgtatctacaactaactattatttttctactaagcacatacatataactatttttctaacacgtgttttaagtattgtgcctagtatatagactcaggatagggaggttgagacctatagagtttttggtctcaacttgagcaacttgtgttcggtatcacacctcttataactggttaaaaaatcacaacatatgttgtctgtttatctcacatacgtttgtcaatattcagtttgaccttttaaatatctaatgctttatcttgcttgtgttattaattccatatcacatttgattatacatatagatcacagtgttctttatgattttacgcgaacatgtaacactaaatcccattcatttttcatagggtatgattgccttccctctcagacttgaagctgcaacacatctaaaacactatactctatactctgttttaatttactcgttgttttttaacattattttttattaaaataattatcgttctcatattccaaaacatttttagagatgcttttctttcttaccttaatttcatcaatgtagcatgctagtactagcactcttccaataaaatttagtgtttgctgcgaaaaagatgattgtgtagagtattaatgtaatttgccatacttcctaatttaatgtaatatttgttagaacgataagtaaatttttttaaaaaggggtacatatggttgatattcttccatgaatttgttttagtagcaccttaattttacaacatcatagctagggttggttaagctcgcacctcacgcggcttaaaatgatattcatcccacaacttattcatgactttgcttcattttttttgtttgcttcagaaaataacttattcatgactaatacctcagtagtctaatctgaactggaatatgctttcttcccttccttatcttttcagagctttcaaaatacatacttgcttggcttatgttgtacacgttacgttctgaattttaaatttgacattagtactatattgtatatacattgcatgcatatacaagagcaagtgacctatcgatcatgggcatcatgcaaaaacaaaactaggagagagtaaaaaaaagttcagacaatgatgatctgatacacatcgcccacgcatagaaatcgaatgatatatggtggtggatgagtttctgtcacacaatgttacaaatttaagagactactcacccatatgatctcgcatttagctcttctttttcatcacattttgttgtccttgttctttgtcgatcagccggccaatcattgtttggaacaggaaaatggcaaaacgcaggtggggaaagggagctgctcttgacgtttagcctgaggctatacaataatcatgcagaattatctaacgaaccatgttgattaatccacaacaagctgagtcattagtgactataatgatccccatgggtacggcgattcctcgttaattccattttttatatatttcggcgaaagctctatcattttttttaaagcaaagcgactccctactcattccttcctgctactcttttgtgtttgtatcagtttctgaattatcattgcgctgcaacctgcaagatacttcctcatgtctttttttttttgaacgactcgcacgagacggtgcgaagttctattgatagagcaggaaaaaattacaagattacaaccctggagggtcgtaacgaggaaaaaggaaaaaatataccaccacccacacatcgacagcgccaacacacaagcccaggagaaggcaagcaccggaccggccgccgctaagcgtgaccgaccgccgctagaccaacaaaagaacccagacgagatcgccccctaggggatgctaaaacgacgtcttcaagaagagaagcgacggaaagaccgccgccgccgtccgtcggggctcaaaggagccaagactggactttcgcccggtaaccaccctcttgcgaatccacggctggtgcctcgatgctccaccaccattcaagctctgccgacatgtgggaccccagcaccggtgccccccgccggccagccttcgtgcgccaaagaccgcgccacacccaccggcagctctccctcacaccgaggtcgcctccttcaccgccggccgcacctctcgcgccaagccggcctcctccaccggacgcgcctctcgcaccagtccgacctccctccatcggccgcgcctcttgcgccacgccggcctccctctccgctgcccgcgcctctcgtgccaagccggcctccgctgccatcggccgcgcctctctgcgccaagccggtctttgacccctcctccaaacaatgccgcgccagccagaagtagccgtctgccacgccctcggctagccaaccgaagccgtcatgcctccggtgaccacagacacggtcaccaccaccgcagccgctgctgccgaacgcccgtcaccatccacacctcgcacccgactccttccccgcctccactagctatcgccggcgatcgtctgcatgacgtcgccagccgctgccgcatccggcgaccagcgggggagcacatcggcgacggcagcggggagggcgtcggcgtccggtgagaggcggtctcctcatgtcttttgtgatagccttctgcaaccttcggcttataattcagaaagaagtttctgccaagtattagatagcatacataataaagttcacacaaacacccaaattctgtatacaaaaaggagaatatattttgcatgtatgtgaaaaagtcttgttggactatgatatcttattaggttgtacgtaaacaaacctgcaaggctgcaacccaatataccaacccagtgttgaaatctatgtcaaaggtaaggtcttgaagtgttagtcatatagtactacttcccacgtcaagtagctttgatttgcattatccttaggacacccttatatgtatcaaaatcaccatgcgtgaaaatcaaaacatgtactgtactatctaatttatcaatttaatataatttttcaaagatagaatgatgaggatgtccaatccacatagtacttatctttatctagaaagatacgtacttatagaagaatatttaatctaagcaaagagattccatagtggcatagccgaaggaagggtgaaatatatttcaaagtcgataatatattagtggtgtttttttaaaaaaaaaactttcatatttgcataagtgaactttccacatttatctaaaagcttagcattttaggaacaagttgctaatacatgcaactcaatacgatcaggctcaagagtcttgagttctagttatggatatatagcatgattaaaaattgcactccacctctaacgtttgagaattgaggagcacatacatgacatgaggctgggcgtgtttaattataagtgaattgccacatatataagataaaacctcacagggaaagactacccgcatagcttctcaaactaagaagaaaccttagccaaagacgtccgagaaaaaccacgaaccctaacccctttgacacgcatatttgcttcccatgttttaaacaagggggaaatgagtggtcttttctaaaccaactctaaaaattcgctttcgagagaagtcgaactaagaaactggtatgtgctactaaagtattgtaaccactaggctacaaatcccttcaccggtaaactggattctagattacgcattaataacctaccatttacttaaattgtcataaatttgatcaacaaaggtgttcatgctggcgaaatgccatctgtagtttccttcaacaacaacccaaaaaaaaaaaagaccctatcatttactttatttctatcgcttcatgaagaaatctctttattaaaaatatttgaaaaaccttactttatactctttcagattcatattataacttgttttgacatttttttagttaatttttttaagtttgaccaaaattatagaaaaaaattaacatttacaacacgaaattagtttcattacaactaacatttaatatattttaataatatgttcattttgtgtcgaaaatactgctaaattgttttataaacttggtcaaacttaaaaagtctgactatgaaaagaatcaatatgtaatatgaaacggacagagtatacgattagtgtgtaagatatcaactaggctcttgatattgttctaggcgccacatcatcagaagttatagaaacattacaagagacggtcatctgagacttcaatcaagatgccctgccttgtcttccttaaactttctgtagattattcagaaaatggattcacctgcattcaatgaacagagcataaaggtcaagccagggagcgatggtgtttgtataaaagattggtcatagaaaacctaacaacaaaagattctgcaaacaaattgcttccgtcacaaatagcaatttaactcatagaccaaggtccaaggaacactctgtgtctgttcagattgatgccaaaataaaccttaccaaaatttggtaataacaaaactttggcgaattggtaacattgccaatttttagtaggatgtactcaatataatgttgtcaaaattctatagacattaccaaaatttggtaacaaactaaatatagccgcataattatcaatttaatcaaataataacatggtttgaaatgacatcaatctgaacaaaccctctttttaaatgtggcctgaaatgctgtgaaaattttatcctaaagtactgctgctacatctatttctttctgtataaggattaactcataaaaaaattactccatccacaaagttttaatattcctcaaccaatcaaatcaaataaaaatgacctaaaaaatttctctcgttttttctcatccatttcaattggatcagagattggctagtatccagatgcccttgccttgtatttccttaaacttcctgtaaattattcagaaaatggatacacctgcatccaatgaacagagcatacaggtcaagccaaggatcaatggcgtttgcataaaagattgagcagataaaacctaacgacaaaagattcttgaaacaaattgcttccatcagacgtagcaactgaactcatggaccaaggaattaattgtggcctgaaatgctgtaacatttctcttaaagtactgctgctatatctgtttgtttggaaaacaactagctcagaataaaaattaccccgtcttcaatgtattattttttagataataatgtattaatattcttgatccaatcaaatcaataaaaatgatctcagaaactgctctctcttttttttttttttttttttgctcatccatttcgattggatcagagattggccagtatccacgtaagaatagttttgaggagatatttacgaaagggactactggagctatgcaagccagacatctacttgattaacaaatgttctccctgcaagttgcaaataaagttgtcgtgtgtgatatcaagagacaactaaaactatggcactgcgtgcttcagcagtcaataaacccagcccactgcttgttattctaaccaaactgattggattatgtatttagtcagaagagagagtaagccacagaaatttttagtaacccagcaagttgccggtgatgatgcctgcccatatctgtttggatcttcgtcgacagcaaatcatcacaggttaagtaacaacaacttctacttgtaacatatatatactaatgaccaagaaataccagggattattaactagtaaaaatgcctcctaattatcctacttatgggtttagctggcatggcatctcttctctcaattcatatgaaagttgctattgtgttaggtttcacattgacctggaaaatcgtttttcttggcgcatcaacttgccaccaggtcaaactatacttccaatcatgctacaacaaaacggccgtcggctagtacaagaaaacgcattcgatcgccatcactgggagcaacttgttttgctgctactaccacaacagaatttaggcacaggtcggcattgtaatctgtgaaaattggtcacagtctagcatgcagggagtatgacataattgttcaggcatgttgcctgatcagccgattttcttggctgggtcgcaatatatctctgaacttggacgacttaaagatatataactatttctagttcttgagaccgtatttgcttgattgcaacacaagcataaactgcacttgtcatgggcgccacacgaagtaagttctagaggtaatactgttatcatggccattgccttttttcctgaaccttcgagtcttcaacttgctaacctccccactgcatgattctgtcacaaatccatctcaatcttttacaacagtattgctgttcggacaatctgaattctgaagtttcttatgctcactgtgatatacggagtagctagcaaatgtcaattgtcaagtagcataacaagcttaaatcttcttttttttttcagcaacagttttggcaggagctagatagttgctctgtgtttgtcaggtgtgtctgtcggatacaatcacagcagtgacagcacgaacactaagcttatttactcctgttaattatccctcctcatgatgtaacactgcacaggtgatcacacccagctggccccatttcgtcagtggacgccgccggtgatcgctcgtaggtcggagcaaaggtaaagacaagcagaattagttagttgataaccgaaattattgccgactaaggaagcatcaaactgcaattttgtgggtgtcttgttgcgccaaggcttgctaattacggacttgggccatgtgattttgtgctgcgcctcgtgattgagacagcaatgtcgtggtgcagttaagaggattatatcatcataaagtaggcgtgttaagctaactaaaatgtgagcctagcagctacttagctagctaggtttgctatacttttacaaaggatcattagctggtggtgacaggaaggaggaacagagctaatcatgcaagtaaactaaagcatacgccttgtcgtttttatggacatgctaagggccatatctttaaaaatttatcggtgtgttttgtccggttgatgctagtttcaaatttgttattgttgattgtgatgcacacgaagcaccaaaattgtcgctggaataacccgcgggtgcagccgcgctcgaccgccgcctcgccggtgagctgtgcgcctccgtcgccggccgccggcgcgccacctgacggcattctctgtccggcacaatgaaaccttattagttactccctccatccctatgatataagagatttttgagtttttgcttgcactgtttaaccactcgttttattaaaaaaaattagaattattttttttttacttactttattatccaaagtactttaaacacaaattttcgtttttttatatttgcataaattttttgaataagacgagtggtcaaacaatgcaaacaaaaacttaaaatcccttctattatgggacggagggagtagtaatgtaagctgcagttgataataagtagtgaagggtgtggatgcaaaaagcgtgttccctcctcgtaatgatattcgatctgtgccgtacaaactgatgggccgatcagattaacgcccgggattggatcgcaagcacatgttgtactaattaagccatagtacacgggcttatccgtaaatctgccgctccttcctgtttctatactacagccgggccgcacaagctagtgggtcggtgggaggaggccccatggcaacgtggcagcgatcaaatttgcggcccaccttcattgacaggccgactccgccgtgaaaaaatggcccaaataatcttcggggcctagtacgttggcccaacaggatttcagttggctttcgtgggctcgcgttgaaactatggcccaaataatcttccgggatctcgaaagcctcgcgcctctacattatgggcttaattgccgggtgataaacgggccacgtaaacttccatttgttttcgtgggcccagcttgcggtagcaggccaatcggcgcttctgcgatctcacaagtgacaagtctcacttcttcagtctccacagcattcaagggaagagtccatttcttcaactgcaaaccaattcatgaaactccttaaactatgtgatggactcaggccccaggtaaactggatcatgaccaagcatcaccaagagattatgtactccgttctcatttatgaatttttgggatttttaatcaaaggcaaattttgctacaggacatcgtactttgcgattttaactataggacaccgcacgaagtgacttttgagagaaaacactcccaaaagttggatagaaagaagagagataggagagctgacatgtgggtccaagggcatttctgacatttcgcgtgatttttctctcttctttaaccgaaaattattacttcaatgcgtgtggtgtccatcagcaaatatccaacttttgggagtgttttctcccaaaagtcaactcgtacagtgtcctacacctaaacccgcgaagtcacggtgtcctgtagtaaaatttgccttaatcaaaaggtagctccaaccgtttccctattctattgccaaaaacttggagttgccatccccgtatttcgcactctcgacttgtaaggaacgaacgaggttcccaatcacaccgtcctgcctcgttcaaatcataatcgtctaggagaagagtagtttcactttcgcatggggctcacttttttgtttcaaggagtcaatgttatccaatcttttggagggatgtttagagttctcataaaggaaaattttgtaatggaatttaattagtcaatatcttggtgatgctctaaggcttgggtggcaaagcttatgtaaacgtatgtattttcaccatatgattttcttcttggtccaataagcaaaggcatggagcaatcttgtgtccgcctatgccctcgactattaaaactagtacaaattccctcgacaattttgcgaagtgttttttttccaaagaatttgcaaagtggttttgtccaaactagctccaattgttgggtcgtcaccaccgtctcggccacttctctaagttggggctcaccggagctcgacgaagacgaagcacggattttagagcagatctgaaggttttaaatttggttccatggactatgaggcccaactgttaactgcagctactacacaaacagtaatggtagaccattcccgtttctgagacaaatgcgcagggtggtagtatactactcgacgattgatagagtctggtatagtcttaatatctcctttgcagaagggtcgtattttcccgactagttttgttgttttttttataaacttcacaaaatcttaataaactggccgtagatctatatcgacggctcagcaaaaaataaattactggagctgttccgacaaggtcacacatcgcatgtgcacgacaaaactctcgcggtgaatggacggatgcagaggcggattcaggaagaaatagcagacgtctgaacaaattagaacaaagctacatccctcttttccgtctgtgtatggcaaaaaaaaaagagtaaatttcacaaaactatatgttttatggtttaagttggagaaaaccacacacattttgacacttgacacttaagtacatatattttggtagtttagtttcacaaaaacacactatcgatgaatggattcacccgtgagatgacgtggttgctccatttaggatgatgacgtattatatcctattaatttcgtgagatggct

SEQ ID NO: 63027 - DNA, 7556 bp, Oryza sativa
tatgagtacttcaatagtactaatattagtagtggaggctcgaaccccacctcccggttggatccgcccctggacggatggatggttaggatggatcatgacgactcgactagtgctggagcacacagagagatacggcaccaacgaatatcccaaggatcatgccaagtgaactatggtgaaagtgatcgaccaaaaatcaagtaatcaacccctcggaacatgcacctcgaatattcgcaccgggacagcaacttcaccgcttgattacaaacttatatacggacacgacgattgcttcggcaaaatgctaccaaaaggtccaaagtaccaccggttcaggcactcgtatactcgtattctacaagcaacgaaaaagttgtaatagcacagaaaaagatggtgataccggctgtatccagaaacggcgatcagatgcaacgcgcacggtatttctacaacccgtataaggagaaaaacactagtatgcgttaacgttatggcagcaacaacttgccaaacctaacatgatccaccggagctccaacttgcgtgcacatctcgcctcggtttcgttcgtaaaatatataaaaagcgccgtctccaacgtgcaggatggcgagccaattggctcctcggctagttcttacctgtccgagctgtgttctccttctaccgttctctcctctccctgaccggcccaagtaaaggccgcgataccatgcgatgcagtaggactcaactgagaccgggtaaaaaatacttttctctacaaaaaaataaaaggactcaactgagcaagtaaaaccacaggcagcgtcgtttgtccccgacagcgatgctaacatggctcgagccgcacatggtggtggtcacccaagacccattttttttaggagtactattattgcgaaactacaaaaagacagccgctacgcacacacacgttttgtttattgcagggaatgtccaaaacgtgactggcttcgctggaagataacccaatttttcccatcggcgcaacgcaagttgaggagcccggcggcccatacatacgctgataataattagtagcctccaataatgcgcgcttatgcgcgcgcgcgcgcgccacacgcgtgttgggaaagggaaagcaaaaccataattaccgtggcaatagacagcgatcgtggctgttcgtgacacgaaagtgaaaacgacgttgacgtcgccggccggccggccagacaaacggcatgagaatactctgtgagcctgtgttgtgagttgtgacgaggcaagcaagcagggaaaggcccaaacacaaacacaaacagaaaggggagggagaggccacgtcgtcagccagccagccatttcaatcaccagttgctttaatttcttttcctcctaacaactacgcttgcaaaggcacctaacctaaccaggtgataacttgtccttgcaaatcactatcatctacatactccagtacaaatagcctcctaacccggagcctctcgttaccgagagagagagagagagagagagagagggcagtgcaggtgtcgctggccatggcgaggaggagcagcagcagagcgtgcgcggccatggcgacggccgccgtctttgcgctgctggccgcgacggcgacggcgtcggggctcgtacgggtggagcacccggccaagagcgacgggtcgctgagcctgctcgtcgtcggcgactggggccggaagggcacgtacaaccaatccagggtcgccgagcaggtaaaaccaaacgccccctcctcctccgtcggccgcgatccgtttcctcgcttcccgggatttaactctagttgttaaattttgctctaattgctgcggtaaatccatggtttgagctggccgttttaaggtcctaaccgcgcattacgggctcggataattggattggatggaaaagagagagagagagtgaggagacggcgagatgggggggagggagtccagatgggattcggtttggcagttgatggcgtgtgcgtacagtgctgggttggttggttggttgcttgcttgcttcgccagttggcatttcgtcgcgtatggtttaaactgacgaagtcgccggtgacgacgccgcgatggcgtgggcttcttttggtcttctgcccgccggtatgggcgcgcggccgaatgaaggaatgggaggggagaatatcagagtagaactgccaatacgcagatgcccatattaccgaactggccgatgtgatcagaaactattctcttgttgtgtgctcgagcaattaacagtttacctccagtgaaatggctaccttcatttctgggattagcagcggacagttttcagaagacatctcttgaccattattttctatttgtattattaaagtgaatactttttttaaaactgaaggtattattttttaaatagcaaagacaaacaatattaagtatggacaatttatcatgcagatggggaaggttggggagaagctaaatatagacttcgtcatatccaccggtgacaatttctacgaggatggactcactggcgtcgatgaccaggcgtttgaggaatcgtttaccgatatctacacggcaaagagcttgcagaagccatggtacctgggtaagctttctgcttcttgtcacttatgtcaccaataacatttaccaagtacccctgttacgaaatatgctaatatgttatttgaacgtgtactaaaacatgaacatttcttcagtgctgggaaatcatgactacaggggtgatgtgctagcacagcttagcccagtcttgcgaaagatcgaccagcgattcatttgcatgaggtcgttcattgttaatgcaggtaggaaaaaaaatgcagtatttggttactacttggatatgatgatagagttctgaactgtaacgtgcaaaacaacgctaactttgtatgatctgtcatcaacctttttttttcagagattgtggatttcttctttatcgacacaactccatttcagctgaaatattggactcgccctaaagaccatcattatgactggagaggagtggcacctcgacaaaaatacataactaatctacttaaggtgcgcatttggaatggaacagtcatcaatgcttaagaacaaaaaaaagctattcctaggttgctgagcaaaattgttttaatattttattttatggggtctactatctaggatatggatgaggcaatgaagaaatcaacagcgaagtggaagattgctgttgggcatcataccattaggagcgtcagtgaccatggtgacaccaaggagcttctgcaacttctacttccagttctgaaggttatacagaagttgcctcgatattaagttctgaaggatccacaaaaagagtacttccttatcactgtttcatggaatttcaggtcaatggcatcgacttctacatcaatgggcacgaccactgcctggaacacattagcagcagagacaggttaacatcatttgacacaaagtttccgcttttatgtcacagtaatatagaacaaaacatgtttgcataatcgatgaaacttgtctaacctgaatgcatgcactcctattgttacagtcctatccaatacttcacaagtggaggtggttcaaaagcatggagaggagtcttgcagccaaattctgataagctccagttcttttacgatggacaagggttcatgtccctccagataaaccaggaccaagctgacttcatattttatgatgtttctgggaacatcttgtacaagtggagcaagagcaaagcaaactacctccagccctccacctatatcactgaagcatgaggcagatgcaaaaccacaaaacggagaattagcttggctaagatatttgtatcaaatttgaatgcattattgtggcacgcaagggaagaggaccggaaaggaaataggaaagtatttaagcatggcatgtgattgatctactaaagaaatttgagacaaggccgagaccatcctactagactaggaaaagagatgttcagtatggtatccattagatctgattcatacaacttcttgccagaggaccatcgattatgccatgtataatttacaaagaaggcttaaaactctaaaagctagtagtgacctttgcatatcggcatcagggttcttcagtattgccaagcattcacatataacctttggagagagagagagagagagagagactttgggggtttctaagctggtattttcatttaaaagagacaatgaaaagaaaatttgatctatgataatcaagcatgtgtcggtgaagacggctattagttactgcttctggaaaaaggttgtaattcagtacagagttgtgtacgtgtccatttgaataaaaattgcatataacagaataaaattataatgaaaattctggcaagcaagttatgaaaggtaaaatgaggctttaacatgccatataaaagctctccaaaatgcaaagctagataaatccaacattcttgacacatcgttcttttcaaagaaaaaaaacactataatttgaaactaattctaggtaacatcatcgcgacgttattactattaatgtattgaaattatcaggtcaacatttagttcccttcagtgcatacctggggagaacaggaactgacaataaaaatggcctcactggacagccaatatggcaaaaatgtcaacagctttctctgcaattcttctgaataattctcccacatagatacggctaattcaaaatcactccattcaaaatcaatctctacattcttatgtgatccaaatatggtttgttcaaggccatggttgcatggcaatggtagttttgttcctctggattgactaacaggacagcagactgttcctgaaccaccagaagtttgtttcctctttgctgacagctcaggtgctttccagtagtaaaactgcaccacctgtttcagagatttgcaaatcatagaacactgacacgcttaacagaacaggatataacacatttgaatgccatgtttggaaagcaggaatatcataggaaacagttccttttgtaaaggaattagaaaaaaaaagcatattctaatggggcataaataattttttatttgtattttctaaaagatgtcaacttatttgaggaatgtcattctctaatacaaccacagaattttctgttgttatagcattctcatgaagatttagactataacattgaaataaaggcatcttacacgtgcagtaaaggataataaagtttgactattgtaatctaatggacatgatctgcagactaaaactacttaaaaagtgaaagtatgtagatacctgaagagcatgcaagccattggcaaaaactttgtcaaagacatcatctcccctaccaagtcgtactggcttcccaagcaactctatagggtcatcttcagcaggtgcaacagatttattgtcttcatcaatgcttgagtggaaagagaacccaagaatgtgcactctagcacatcgtacgtcaaaaccagaatggtcataggcaaaccaatacattatatcagaggctggcaaaggaatataagaactctgatgaactggttcatagttcagtgatgtctgagaaagaaaggaaaggagctttgggtcctcgtcataagcactgtctctggtgaaccaaagagttagggtgagtctttcaccttcagtcacctgcaaaaatagctgcactttattaataaacaagaaagggcacgcatcaacctcagaagaaaaataaaatcccttgacaagataatactttggccacatatgaattgattgtttacaaaaaacaaggtgcaagggaaaaggatagacataaattaggactaaatcattgataacaaaatgtagcctcaattacctgttgcaacttagagcacactcaaacaaataattttatttgattcatcaaaacaacaataatagtaacagatatactaacatcttgctgattatccaagtgaaaacagaaaatgtgacaaacaatgccaatgaaaagaataggcatgaacccagtacagaaacaatcaactggcccatgcaggaaacagaaatgtacctcatctacacaatgggtattactattatctgcagtgtagatgacaacatcctgaaaacaacagtacttctcagaaattccaagaatatatattcatttaattattaaaaaaaatgcatgcatgcaaactgtaaatcaaaatgcattagcttacaccagcaactggagtaataaaggaaggttcaccatcctgaaactgcaaaattccacctttatagtccttcccatgatcgtttaagtagcacactgccttttgattgaaagatggaaatggtgcattccatgccatattttaattcagaaggaaaaagggtcagaacaagaactgagaagagtgttagtcaaaaaaaagaactgagaacagtacatttgagtaaaaagggccgcattgaaatataaacaactacaacaactgagaaaatggaagagtatattttggacaggacctagatagtcccacaaacagagataaattactcatacaaaataagattaactagataatcatacaaaaaaaatgcaattcacaatatcagaagcaccgaaatgaatgcttgcatgaaatacagtttgttggaacagacaaaacaatatgtagacatgaaaacaactataaaagttgactaaatacccaaagatagattgaccctcaccgtgaaggctctttgcctaagataaggtttgttgtcatcactgtgccacccaatagaagctcccttgcaccaactgcagacccaacagacaggattccaatacgaatagcattttagtgtcaactgtcgagtattttcagagaagaactcttgaactagctttcgggaagcaagtgagtaaggtgatgacgtttttatatggtaaaacatactgttcattcttatgcagttgctagaacaataagaggggctgtttttagatctcaatgttttcccatgtactaatagttaggaaaagctgtcataacaatggttaggaaaagttttcccatgaaaattaccacgattccacaatagaactcaaatgtgtctcgctggatacttaacaggacaggaaatcccacaaacccagtgatatttccacttgacctacggtgcttcagcaacctggaaactcactctaccacccattcactgaatatgcatggcatcgtaacggcaagcaattccgaacttacactgcacactaaattcctcaactacgaacagcaaccatttcgatgtggacgtcaagctgcgaacgtactagaatcgagtcggcaatgaatgcacatgcacatcacgtgattgctcagcacctgatgagcccggtgaactcgatgaagaggtcgaagtggcaggagaaggccgactcgacggcgtcgcggagccgctcgcggacggggacgaacgggaggaggaggtggccgcagccggtggcagccaggtgcggaagcgacgtcgacaccac

SEQ ID NO: 63028 - DNA, 1867 bp, Oryza sativa
gatcagtgccatatgtccccatatttacatgtcttgctggtcaatgtatgtatcgtaccaaaaatttgattctggcgtattggaaataaacgtttcagaaacacggtaaacttggttcaggtcagtatagcctcgagtatcggagaaaatgattcagtagtaagatccttcaggtaaattgcatactacaattaacttaactactcgtcacgaaaagattgtcaagcggctctacatgccagaacattgtcagtaaagaacgacgcatccataggcatcagcacgcacatttgctacacaaattctcattccccagatgctaggagcatagaatgataagagattagcaaagaacaaatgccgcagaaatggtcatagcacatagccccatatctccataagataattgccaaggataacttagagcagagtgatcatccagttgtgctacagagcagctacaaaatttaatatagcattcagtcctaagaactcgacagcgaggtctcaggccatgggcgacagccgcgacagcaacactgctgtcgatgaagctctcacttgagcgcagcatactcctgggatttctttctgtgcttgcaaccacacgatccaaaaaattgaagtttcctcatctcttcatgtctttttgttgttgtctatgtactacaaccctgcctctattttgcggcattcggctggaccttgttgctcccaaccttcttcatcccaccattctgctgctccttacttacagcagacttcttatccaccaagctactgccaccattcgagctcccattgcactctggtttctgctcaaccgcgtcggattgttttgctggtgagctctttggagaaacgtcaccgttggccatctcccccatggtgctggtgctcttgttatgcacgtaagcagatgaatctgttgaagagattggctcggcaggagactgagaagctgtcatcatctgatgaggcagtgcgtgacccgatccaggaggaaggaagacccccgtgccaggaactgggagtcgttgtggagcagaccttggagcagcttctgccatccaagctgttgttgagtttggcaaaggaacaggtgatgggaaaggcatggctgcagcagcaactggagcaggtgctacaaagagtggctgcattccatctgatggaggaatgtgatgcgctccaatggccggcgctggaagtacgccactgtttggggcatatccaaagtgtttagggcttgaagaatgacgcgccatgttagccggccttggaggaccccagggcataggaggtggtgtcaacggggtagtaaaccgtgaaacactttcagatggtacttgttttctcgataaagacttcccgaagcttagtaggatccgctgcttacatgcagcaggaatagctcgcttagcaacatcagcactcttcccatgcaacaccagaagagacctgtagtcgagaggaaaagaaaagagcatgaaaattatacggtgcttttagtgaaaaatgatactccatattgtaatgcatcttaaatacagtattgaattacagtgcttttagtgaaaaatgaaagcatcttacacatttaaatactaacggggtgtaaaattttgagtaatacaaaggggaaccaccatgcttatatccttattatatgggcatattgctacataagaggggtaaacatggtcattatgatattcttataggggactaatccacacgattatgtagtaagtaaataaaaatgaaagtgttgacatctaaaatattcatcacacatacatacgtgtgtgtgtgtgtataccaaaccacaagtattaaagatttttcaagaaaacatcaataatca

SEQ ID NO: 63029 - DNA, 1484 bp, Oryza sativa
tgaagactagatctacctcttggatagtcatcttcaggagggccttcaacgataggaatgcccagctgaataatttccctcccatgacccttcattggtctttttccaattattacagtctgcccagctgttttaccaaaaaaaatcatagtgaagtgacaagatcccaaaatgttacatggttaatatgaccctttttctctagtttgtgctcagcatctgtgtcagtttgtgttcagcgtcatagttgacatagatgctgaacacaaactagagaaaaagggtcaaattaaccatgtactaacataagtgtcagacacatatccaaaaggagccgcaaaagtaactgtcaatgattttctagttgatcaactaagcataagaaaaggctgtttctcagacaaataatctttgatggactcatggtacacttttttatatacagatatggaaacagattttgcaaaactggaatcttagtgcacaaccacgtggtgcacagtgaacacattagcacacaaatgaatagctgttcatggttatttcacccaaaaaaaagaaggtaagtctaccttcaagccctcctcgacgaaaagaagcttttgtttcattaagtaaagagagaatcttgtttttctcattctcatttaccaacccttcataaaccttaagcccttcaacagcattaacctaaagaagcataaagcatatttcatcaaatcttcgagattcaagagaagctagttgaaaaggagatgcgaatacagcactagaatttctgatctaggtaaaacagaccgtcttgccatcaataatgtcattgaccgtatactccacaggagttggaaccactttactgcttccttcagcaacagcttgcggcctaggagttttttcaccttctacatgatgcaaggacaataagatgttaagaaatgataaaaaattattgcatcactatatggaaactatcagaagcaagaacaaaaagtatagcagccagcaataaatgtactattctgcctgtataaatattcgacaatgtatcaacaagctggaaagtggaaacagtttcctagcttttgtcagtctagaaaaaaagaaaagggccaaaattcctgatcctattttaccagtattgcatcctcacgctataaaattaaggttgtaagtaatgtggtctaacaattttatgaacaatttcaaaatattccaaatgtgaccaagtcattgacatagttggactaaatttgaggtggagatagccacttaagaaaactaatgaaagtcatcttcagattgagattgcttcaccatcatttttcaaaaaaaataacacacaatagtaaaataaattcgaatttttgctgacagggtagaaatccaagcattgtgggttgcaatttattgctgtcttttttagacaattcttttcccaactaaaggtctgccctatgttctacaagattctagagaactattga

SEQ ID NO: 63030 - DNA, 9365 bp, Oryza sativa
  unsure (1)..(9365): unsure at all n locations
atggaaatcctacgggcaaacgtaaagggtcaggtgggtccacacctaaaagtatgcaaggccgattagacagtgattgtatcttccaccctttgggtttctcctagatggtgtgttccaaactacgatgaagacaacaaagcttccctaggaacaaaaatggaacaacaacctctgccatcactgattgttcttgctacctaagctgattgctctcaaaccaaccacaggtgttcaacaaacccagtggtttatgaaccaaagcacctcagaagtacaagaagttggcagtaaaaactttcgtagtcgtacatgggtgagcacgatcatgctgtacgccatctctgggttttccgtatttggcctggcagagttcgaggatgacaacttcacagggcacatgaagagcagagcacatggaacatgtaccttctttgagagatttacagggtaaatttgaaactaagagaatggccccctttacctgagccagttccaactcaaataaattacaggtaaaaaaacatttttataagcagaaagaaaagggtatctcttaatgcactgagcaaaaccgtttccacatgaagcaactcaaaacaatctttgcatgtgcctataatactacatgggaaagctattttcgggtagcattgctggtatctttagaacctccatggtttagcaatatatatagaattacacgacaaaaagataaaagcttgtcattttagagctcaatatactaattacaaacacgaatgccagaaaacagcgacaagacttagcactttttaagcatagcaaaattagcacttttcgacagcagatattatctgatgaaaaaaagctcctgtggctagtcaattgggagtagtagtaaacaagcaactcaacaccacaaatgcattccatggatcggaccattttggggcccaagtgatcagaaagaagtaaaaaagcatccgcctttcccacaacaaaatacactagtaccaaacaaacaattgaaagaagatcaatgctatcacaccaagagatctcgactcaccatctttatcggatccagccgtcgcaccagtgccgccgccgcgcaccgaatcggagcgatgatggtgaccaccgtggcgatggtgcgagtgggacgccgagaacgaggggcggccgcgcgggggagggggcggcggggacggcgaggcgccggggccctgctgctggtggtgcggcggcgcgcggcggcgccacccggcctgctggagcgcgtacgcgacgtcgccgacggggaagaactgctgcatgtggatcacgggcgcccagtggtggcgccgctgctgcaccgcggcggcgacgtgctcgaactccccgggctcgccgacggagcggaggtggagcagcagcaggtcgatgatggcgttggccgccgcgaactctccgcgcagccatgaaatgaagccgtcccgctcgtccaccacccacccagcgctctcaaccgcggccgcacctgcggcggcggcgccgggcgcggacgacgggatgacggcggcggaggccatcgcctttcctcactgagagtctccggtcatagaaaggcgaaccccaaccagcaatgcgagcgaaggagaacgaaactagcgagagatctagggttttgccgtgttttttcttcttcttcttcttctttttcttctttttcctttttcaaaaggcaagctgttttgtctctggtggtggggcgttggaacggaagaggagagcagcagcgcgagatgtgaagaggaggagggaagaggcggatctgggaacggaagattcccgaaactggaggcgaggaggaggaggagcgggaccggcttgtcagtggctcacgtagccaccgggttgtgagaaacctaacgatctcgcgaggtggaggcttttgcttcgagattcggaaaccggggagatggccgttgaggcgattagtgagtggttggtggccaggccccactgtcagcgccctgtccccgcgtggttaactcgttaccgcgcgtgcgtgtacgtaggagagaaaaacggggttagcagtaagactctggtgagagtcacggtgccgttagatcgctccgcgcgcatcggaacggacggccgagggatgcggggggttgcgcggaggaggcggcgggctgggtgggtgtcggttggcgagtctccacgccataatgcgggtttggtggttgcgggatcggattcatggatggatcaccacattcacacacggtcacggggcggtggcgtcgcgccgctttacgccaccacacccacgcgcgcggcgtcagcgacgacgaaccgcaccgcctgctccccacccaacccatacatgccggctcgcgtgcggcgtcgcggcggggccttcgtgtcagcctccgttggtgaaaattaatttcgtgctggcttgggtagctcgcgcacagtacgtaccaggccgtgtcgtttcctcctcggcgcgggctcggtttggaatgggcgcctgctttggtgcaccaggacggcacggacaccagcccgaaaccttagccaaccatccgatctacttcgagcctacgagtgtcactgtgtcagtgtgattagtttggtttaattttagttttgacggcaacggtggcgcgtggacgcacgagccgtctggtcttgacgagcgagtgatcactgatcaaggtggtggcaagtctggcagataggttggacgactgtcactggctcgagcacgttggtttgcagtggaaaccgcgaaggtttcttgcgaagcaatcttgctttgttgacgatgcaaggaacggtttcgggtttcgactttcgagtccccgggttcccttttatttaaaagtccaagtcaatcgagcgatcgtgagtcctaccgtgtaagagaatggcaatcggaccgtgagcgtgctgtgaacgtctcaagttgaacgagcaagtactcgttcagaaaatgtgatcgttttcagaacgattcagtaacacgtgcttgcgctggcccggtaataggaacgtttccgaaaaagacttgcaacagcgactagtctggcagcgggacgtgtcatgcacgaacagaacgaaacactgctgtcgtgatccaagtataaattcagtacacatgcctatccatcgcttgagaattccgatcggtgttcctcttttggcaggtcatttgctgcggcggtacgacaacagggtcagggaagagcacaggtccaagtccaaccgctaccacagtggagtaccactgtaggcttaacttccaagggcgatggatgacaatggttgccacacttgcgtgcaatctgctgcactgctgatgcacggcggaatgggcaaaagtcacgcgcctaactgacggagcgccaaattgctagcatatgttctgttctgtgttaaggaggtatcactaatcagttcccctttatttccattggccgaattatggaagttttgctacacaaatgtaaaaccacgtggattatcttgatatcgcggtcacaagcaattacaaggaaggtgggatttggaggctttttggttggcaccatgagacaaatatacctagccagggacaagtatgagaaaatttaatcttgtttggtttgtgtctgagccattgtaattagttttgttattagtgtccgaatattttagtgacaccccatataatatccgatgtgacacactaaaattttacacccttaaatctaaacacctcataaggtggtgttcttttttcctgaagatgaagatgaagattaagtttttttacacaaaacgatgtggtattaacgtatgattgattgagttttaattactacaaacttgaaaatatattaatatgacattttagagtaacttttattttttattacacgaaatgcatcgtttagcagtttgaaaagcatgccacgaaaatcttaatattcatccaactctttttttttaataatggaatagagcattccagtctttactcaaagagctatagccaaatcttgtttgagaaaagaacggaccgatgatcaaatttggtgggctgagttgcatgcactgccaggcctcttgataaaagtaattctctcacgctgcagctggttgcttcttttgcatgctgaactgctctccacttgattagctaaagatatgttatgagactaaaaaaattacttgttaaatctttcaagtatctatattggatttgtgattaaactccaagcttaaaagagaaagatataaaataatattagttttaagtgttctccggcataggtcaccaaccaaacaggtttgtctcaggcaggcacgaaccactcctacctcatgcaacactcaagcaaaggtcaccaatcaaataggctctcaagccagtttggttcgaggggatatcccttgtctttaaataccatctaaaaagtcatagtttcttgttaacgttttgaaacaatattgagatagatcaatattagataatgtcgttccacgatatgcttatcttgtgttcggcagcagagttttccaacccatctttctcgtttttcacgcgcacactttttaaattgttaaacgatacgtcttttataaaaaaagttcttaaaaaaccatattaatccatatttcaaaaaatagctaattatgtgctaatgagtcgcttggcgcgcgggagattagttcccaactgcaaggaaagaacgcagccttacttagtaaatactccatagaaaataaatgtacaaaatatgaatatagatattgtccgtttttttaatatatgacaacattgactttgaacacacgtttgactatttgttttatttaatttttttttgcaaatgcataaaatataaagcatgcttaaaccttaaagtacttttaaggataaaacaactcacaacaaaataaaagataatttcataatgtttttaataagataaatggttgtcatacttgtgttgaataattaacgattatctatttaaaaacgaatgtactagtatttgttatttttaggctgctaggggagggacgcgtagtacgcgtcgccggcgcgcactcttccgacaagcccacatgactacgtaaggcccatgcaactagcgggacgtgttttgattttttccgtggatttctcaatcatacgcgcataattttttttcacaaattttttctcagcgtgaatttttttaatcacgtgcacacgaacgtacagtaactaatccgtccagataatgatgataattaagataagatttttttttaatatttttttaagtaatagattgaaaagaaatttatacgtgaagtcaaattctgaaaaaattcaacctagatttgaaaattttcaactcgaaatttgaatttttgaagtcaaaatttgaaaattttcaacttattatctcggttttgaaaactctcaactcgagatttgaaaactttcaactcgattttaaaaactttcaactcgattttgaaaactttctactcaaatttgaaaaattttcaactcaaaattgaaaaatttcatctcaaattggaaattttcatttcaaaattcaaaaaattcaacttgaattttgaattggaaactttttactcaaatttcaaaatccttccactacaaatttagaactttcaactattttaaaagttgtaactaaattatgtatacatggtttttctttaaaatagtgctaatgatgacaattgacactaattacttaattagtgggtgggcctgagcgctagggagtcgacacggcaaaagtgcgcgctgcttctcctcctcgcgcatctgcgcgaagtagggtgtagtaggtacacccgggagggatcccgtctaaggatgaggaacacataatacttttagtgaaaccttgtacaaatcacaagtgcggaattgagcggcttaaaacaataaacaataagtcacgtacgaagtgagcgtaacttaattggttaggtttcttgtggtgaaactaacccaataaggttaagttataaacttgacataggtgttcataattataattaattattcttttagtgcaaggtaatataggtgtgcatgtgcgtgtgtttataaggatgagtcatgtcgagtttcgtgtctgttacgatccattttacaccgggccgggctgccaaagtgccaattgatcgagggccggatcagcttttgccgtggcccgtgaggcggaggtcgacgtacgtgacgtgttttttcaccgcctccgagcgcgcgtcgctggacagaggtggatatggtgccgtctacgaactgaccaaagaatggcacgcagaagtaggaagttgtgagaacactatgaccaatggcgagctctgcaccggtggcacacgtcagagaccaggaaactataatcacgtacgacatcacacacggcacgatagtacagtcgagcacgcgcgccaccatcgcgagcggcgctgtgcggatcacagaatcggtcagagcgcggaatccacgccgccgccggcgcgccggtggcgcttgccgtgcctgccgccgcggcggtccgtcgacctcgcctcgccggacgggaggaacgcctcggcctccgcgccgacgctgcactccggcagcggcgcgtggtaccggacgcggtcgtagcagtacccgtacgtcatgtgcctcgcccggaacctctccatcgccgaccgctgcccgggcggcatcgtcgcggaggcggcggcgccctcgcacggcggcggggagccggcggggcagccgtggagcaggaggtcggtgaactcggcgacgtagggcgcgtacttgtagttcaccttgtaccggccgcccgaggtggcccagctcgagccgtcccagatggtggcgtacagcgacatgggcttggacgggaactgcgcgcccatggacgccgtcctcaccacctccctgatcggcgtctcgtcaacgtagaatctgcataatggacaggacagtcagtacaaccgtgcaacgaacaaggaagtgaaggttactgatcctgctctacattattgcagtgtcacacatgacacagttttactccgtagttctgtaggagtagttcagtaaattttgattttatgattgacagttggttctgtaggagtagaagggtaaactagattactagaggcagatgaaccctgtatctctgaactcttgaactctgaaaccaataggttggcagtgaaaactttgagaagttcagactttggccacgtgtagtggctagtaatgaatttcggttttggcaaaataaagacgtcattgtcacccacgaatctaacagatttcatggagaaaaacacggaggaaagtgggtggcagtttttgaaacaatggatagaaagtagctcccggtgctgacatttccctcctccatcatgcgacacagatacaaagaattcagaagttcgcctatgaccgatcgcacaactacagaagttatgcaggttagcggagaaagtaggttatcaaatgcaattatatgcgagaaaaggttggcacggggatctcggtggaaggatatcagatatattgatagagagttatcatgcacatggtatgatcaatgctcaggttcagtggaaactgtaaaagcaaacgcaccacatgtgatgtcaacttttttcacacgatctcgcgtgtagcagtataggatgcatcaatgttttttagagcagttgcatcagtaatttgcagtgatttggttacagaatttcagagtccagtgattgctgtggttaactaaatcagaaaaatattgtgataatgcccatctcagttttggggcctctacttattactcctatcaaagtgtaaacagcacaaggaatctataagctgtaaaggaagagcaaactgatatctcccaatcatggcccatgataaccagaaaataaagaaaaggaaggaatgcaagcatacaaaaagtaatagtgatagtgaatatcaatttgttgaggtacacaacacaccataatagaaagaacacaatcactatgcagaattgcactattactagtttagcacaatgaagaactgcaagtatgacaatatgacatcagagggtagttaactgacattgtactcttctaatcttttatgggaaaaggctatacatactaactttttcttactaaattcttactaaaacaatgtgtcatgctaggaatgcatctagatttttcataacttccatctacctaaattaaaccgttaagatgattgttagtaaaaatttagtatggaaaaaatagtacgtataggagtgttctgcttaatataacactagcagacgctggcttcgttttcagaagaagaaaactgtcatttcaccattctgctatcagcgtatcacagaataatgttatcatatattctgatatactgatgacagatacataactctagtgagtctgcagaatatatactgagtatctctgaagttcgtgaagcgtttgtgaatctcaacgcttgtgaagcgtgatatactgatgtaggcaagctcttatggcgagccagagactgcacagtgacatctgacacgctgcattatcgaagagtaaaaccgagctaaaatggcggatcggttatcttacatgatcgtgtcatggctccagcggatggcgtagcggtggaagtcctgggtggggtcgaaccagaggccgtacctctcctcccggccggccgccgtgctgccgttgccgtacacgttggtctgcaccctccactccctccccctcacgttccccaggaactcgaagtccagctcgtcgtgcgtcctctcgtacacgtccccgttcgacatctgcggccaaaacgacaatgccgtcacaaccatgcatcgcgataaacccaagctatcgagtgctaacttcagtattaagatttcttgccgcattgcacatttgcacctattggttcgcaaggagttggtgatacttacgtagaaagcgacgacgacgccggcagtgtggtcggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaat

SEQ ID NO: 63031 - DNA, 877 bp, Oryza sativa
aatttcttactatacttgtcattcccggccgaattgaatccttgtataaccgacaaggcctacacaaggattcaatttgggcctctaggatacaccggtacatgcatacccaaagtataccatgttcaccactagtccactacattgtcttataaaatctccaacattgtccccgtctgtgagaatgtgagatcatgatctaaaactaattttagtcctactgcactaagactagcattagttacaagcattgtactgtagcatcgtaacactaactactaattacattagcaattgacgattggtaccaaaggggaacaaaaagagaaaaaaaaaacaggattacaggaagaatcgatgcaaaccgggaaggctgttctgtaccttcgctctcaaaagtcgaatgtcttgagatacgagggatccttcttggcccgctcctggaacttgcggaaccaccggtcgaggatgtccgtgggcaccaccagcttgccgccgtcggcgccgcagaacgactgcatgaagttgaacaggttctcgccgacgcggagcgcgacacgctcggcgcgctgcccgtcggggggcggagggagcgccgccgcgtcctccacggcgacgccgagcttggcggggccgagggggggctccggttcgtcgccggcctccgggagcgggaggctcgcggaggggcggcccgggccgagcgcgccgaggaacgcgaaggggcggttggcggcgggctggaagtagacggcgacggccttccccggcgggagcgcggcggcggcggccgggagcaggaagacgacggcggagcgcggggcggcggcgagggagagcgtggagaggtcgagcgcccaggagttgggcgccacct

SEQ ID NO: 63032 - DNA, 2393 bp, Oryza sativa
  unsure (1)..(2393): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcagagctaaaaacccatgagatggatgttttccatcggaaaggcctcaaacactcgatggctttggtagctgatccctctggtagtacttcttctaatgactcagcctttgtgtatggtggcttctctcttgccgctttacactcggtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgatcaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcacaagcaaaaccagagacaaaccaagcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtgtcattgtcgttcaagtggtgtatctcgctttcctcgccgagatgtgcaccctcgacgtgacctagcagggttggggcaaaacagacatggtcatcttgcatataattctgctcataacactaaagatgcttgtacttctcgcatgattcagtactggattcctaagtcatttttcactaaccccagtactgaatcatcgagatctgctgtgtctttcttgtaggattttggagtagggagaagtaattcttggcttgtggactccggttgctcacgccacatgaccggtgaagccaagtggtttacttctctcactcgtgcatccagtgatgagaccatcacttttggggatgcgagcagtggacgcgtgatggctaaaggaacaatcaaggtcaatgacaaattcatgctgaaagatgtggcactagtaagtaagcttaagtacaatttgctctctgtttcacaactctgtgatgaaaatctggaagttcgtttcaaaaaggacaggtctcgagttcttgatgcttctgaatct

SEQ ID NO: 63033 - DNA, 2697 bp, Oryza sativa
ggatgaggattcagatgatgatgacgatgattctattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgaacttgtcaattcagcttttgttgcctcttttgagcccaaaaatgtttgtcatgctttatctgatgagaattgggttaatgccatgcatgaagagttagaaaattttgaaagaaacaaagtttggtctttggtagaacctcccttgggttttaatgtgattggaacaaaatgggttttcaaaaacaaactaggtgaagatggttcaattgttcgaaacaaagccagactggttgcacagggtttcacccaagttgagggcttggactttgaagaaacttttgcaccagttgctagattagaagctattcgaattcttttggcttttgctgcttcaaaaggtttcaagctttttcaaatggatgtgaaaagtgcttttctgaatggagttattgaggaagaggtctatgtcaaacaacctcctggttttgaaaatccaaaatttccaaatcatgtgttcaaacttgaaaaagctctttatggtttaaaacaagctcccagagcctggtatgaaagattgaaaacctttttgcttcaaaatggttttgaaatgggggctgttgataaaactctttttactcttcatagtggtattgattttcttcttgtccagatatatgttgatgacatcatatttggtggctcctctcatgcacttgttgcccagttttctgatgtgatgagcagggaatttgaaatgagcatgatgggagagctgactttcttccttggacttcaaatcaagcaaaccaaggaaggaatctttgtacatcagaccaagtactccaaagagctcctgaagaagttcgacatggccgactgcaagccaatcgccactcccatggcaactacttcatcgcttggtcctgatgaggacggtgaagaagttgaccagcgcgagtacagaagcatgatcggctccctcctctacctgactgcgtcaaggccggacatccacttctccgtgtgcctgtgcgcgaggtttcaggcttctccaagaacatcacatcgccaagcagtcaagcgcatgttccgctacatcaagtctacacttgagtacggtatttggtactcctgctcttctgccctttcagttcgagctttttcagatgctgattttgctgggtgtaagattgatcgcaaaagtacttctggcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgtattatacactcttcaattgagctttgcttgttatctcttggtcatcactatgctatggatgtatcactcttatgctagtttgatctcttgtctagctttcatttgcttaagtagcttgtgtgatcatgttatgctgttcaagcgtgttgaaacctgcttaaattaactattcatttgaactcaatcaatgtgcaatgcttgctctagaagtttgtttaaattgaagtatccttctcatactcatgccatgtttacattcttttcgcaataactgtcagtacatgcttatgaatgctcatgcttatgcgtccatactttgtatcaatcatgctttacaagttttatctctgtttttgtccgggctactgagtgcgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaaattaaaaaaaaatcataaaaataaaagtcatgagaaaagattaaaagctcatgttctatgctttgttatcatgttgatactctttatgaactgggcattagcacattagcatgggttcattgctttgtttatgtaaatcttgcatgattatgagctggtttgcttccttttaagcttcttctagaaatagctttgcacactaaatcactaattcacttgaaagctttttgcttgctggcgatactaacttgatattcatgacttggttcatact

SEQ ID NO: 63034 - DNA, 4468 bp, Oryza sativa
attcctgcagcccgagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagacaatgtcttaggggtcttaggctataaatagagagatggatgcaagggtggaggtcgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccccccccctctatagctgttcttggtctttcactcttaaaaaaaaacaaaaaaaaattatctcatctttattggctatattaattcatacccttgtaagattatgtgagtataaaagtatccatgcgatggccaaaggtggagaagaagagggaaggggctgacgggtggggttcatgttgctttccacgtgggcatgccacgtatgtataaatagttaagaaatcacttctctccagtgacaaattattaaacgcgagcataagagagacgacaggcaaagccaaaccacaacatcaatgtggcggggatttgacgcgtttgtcatcctagttgccttgacaatttgaaaagagcgaaacaaatgattgggtcttgaatgaccaatgcaaaacattgcgggaagttgcagaggtggcagtactctggcgtgatatgggagtacctgtctggatggtgtgctcagtcattcaaaaatgtgttgcgagagatcgtcatgtcgaaagggctttcatatcgatatgtattaaggctgcgttcgttttgggtgatagggagtgagaatgcacatcgtttttcgcgcgcacgcttcccaaactactaaacggtgtgttttttgcaaaaattttctatatgaaaattgctttaaaaaattatattaatccattttttaaatttaaaatagttaatacttaattaatcatgagctaatgtttcacctcgttttgcgtattttctcaatctcctcaatcccctcctcctcaaacacaccctaagagaggagtgagtgtgttcgcggggaatcgagcgtaggccatagggcgcaccacctcagaccctgtccactgcgctaggcgcagttctcgtacctccttttcttatcttttgtacatagtttgtatctgagcgaaaccaatttcctaatttcaatacaatgatatgcgctttgtgtataaaaaaaaaaggagttaatgatctcaaatgatagaggagatgataatgaatcatacaccaaatacacccaactgttcaaatacaaatttcaggtattttgctgagagtgaattaaacagcacattcaaatctacttcctccatttcatactccatttcatattataagtcgtcggacttttttcttaattaaaatattttaagtttaaccaaatttatagaaaaatatagtaatattttcaatacaaaacaaacatattattaaaatatatttaatgttaaatttaattaaactaatttagtaggtgttgctatttttttttataaacttggtcaaacaaaaaactttgattaagaaaaaagctagacgactatgagtagacaacagttcatattctgccagctactcatagccagatcaagcaaaagttcaccatgaaaatcggggcatgctttgcagcaagattttcttacttttatatatgaaaacgggtgcatgcttttgcaacacaattgtccttttccaccaccattatattgctaatgttaacaaggttcaggaagccttcttacatttgtacctcatggcacagaacacaaaggccagcatattcaagaaacacaagccagccatcatccagaagaaccgatccaaatgcccttcgttcaagttatcaggtatccatccaggactgccttctctggctgtgaacactggcacaagagaaacgataaacgagctgaggtaacttcctgccgaaacgttagcaagtgagaatgcgagacataagcttctcatggcgtccggtgattcctggtagaaaaattcagttaacccaatgtttgagaacacctctcccacgcctatcaggaagtactggggtccctggcacaggatgctcattggaacagccaccttcctgtgcaccaaaccttcatcttgcgcaatccgcaaccgattactctccaccaatgctgctgataccatggagagcatggaaaagaacaggccgatccccattcgctgcagtggagtaatgccatttgctctgccagtgaattttctgaacactggaacaaggactctttcatagactggaactagtataaggacagcaatgacatcaatggattggaaggacgccgcaggtatttcgaaagagccgatgtgtttctccatcaccatcccctgttctatgaatgtcgaaaacatgttgtccagaactgcagcaaataatatcatcgttgcccaaacggggaacatcctgatcaaaatcttcagttcctccacttgagtgactgtgcaaatcttccatgtgtttagtaggccatcagattcaaaatcagatggtgtcaccattgcagctctatcaaagaacctgagagaaataaaataaatagatggctaacttgatagagctgagatggaatggacagctccttgccgactttgcattgacaaacaaaggttcatgaacaatgaaggtttgcttctagtatgtataaatgaacagcagaaataagtgtattacgggagactttgtttcaaaagcgatatcacaagagacatttctttagagaatattataaacaatgtgctgaaactcttgtaatgttaactggttttccatatttgtattgtgtgatgtgtcccacagaagaattttcaaagagtgaaagaatgaaatgctttactggaattaagtatctctactccctaaaaagaggagtttcccaaa

SEQ ID NO: 63035 - DNA, 1184 bp, Oryza sativa
gctatatgatattcatgtactaccagtgttttgtaatatacgacgctgttaatttttggatctaatgtttgaccattcatcttatttgaaaaaactatgtgagtaccatttttttttgttgtgagttgttttatcattgaagatagtttaagcatgacctatatttttgaatgtttgcactaaattttctaataagacgaatggtcagacatcatgtccaaaagtcaatagcatcatatacttaaaatagaggtagtatataaaaaccagtgcatcgcatgggcactacactagaatgagttaaagacaagcttacaaaatcatattactagaaatgaaataaattatagttcaacagaaatgcaagcataaataaaagcatagaatataggcatcaaagttgtaatgtcaacatagtgtattacttaagtccagttgtatgctccaattttcggctgccttcgattgctgaactctgccccagaaactcataaagaactgaggaatcacatggcaaatctttatcgcgtttgtgaatagcagcaacaacaacctggcatattctcgcaagagggcttcctccaggtttctgaaatctatacatagaggagccaaagataaaagtaccaaaacctaaatacacaaatagtgcagaaatggtaaaaccccagatccaacctttgtgatcttgcacccacacaataacagtccccgagatcaatgagcccgcattggctacgaaataggtccaattgaaaaaagaactcttttttgttctctcattttcatcagtgtcatcaaattgatcagcaccaaatgatgatatgcaggggcactgtgcaccataccctaaagcaaccatgtacaaaccgacaaagaatatgatgttctgagaagagactggatctgtccatatgatccatgagtgaggaccagtagagattaatggaactgctgctgacagaagcaacatcatcaatccctaaataaaaggataaaggaaaaaaatgtgaacgaccatttctagaaaaatggtataaaggaaaatgtaaacggtcatgtctagaaaaatgatataaaggaaaatgtaaacaatcatgtctataaaagtttgtcaagtgttgaatgcatcactcctcttacatctgaagattaactgtataaactagagttttatactgcca

SEQ ID NO: 63036 - DNA, 6700 bp, Oryza sativa
  unsure (1)..(6700): unsure at all n locations
gatatgaatcagctaagaaggctccaaccagaggtgcaagataacttgttcctgaccaagttgcaacatctcttgcagcggccacgtttgtttcatgtagaacttttgtgagataactgactaggttttttacaattgaagtaaaggccagataagagcagaatgaaaaaactgcaataaaaaatgaaccataaaaggtccagtataaaattaaacagaacccaaacacaggaggaaagaatattcataaatcataataatactgtaatatatataaatgctgggaaatgaaatcagtttcagatgttcgagtatttagcatcaaatatcctactatatcttcaagcagaagcttgacaatgcaacatcatttttcagcactaaccgatggctaatgaggaacccttccagttccctgtatgtttccttaaagcaggatgcccacggatgcaaacagatccatcacctgtatattcaagggtctgcatttccaagtaaaaaacacaaatagcctttaatgccagtgtcatccatcactggtatagatgtttcaatagagaattgtgcattttcctaatgtagatggaattattctatatatttccaggaaaatttatcctaagaacaaaattatattatatacattggaagcaaattaactgatcatccaaaaaaactgcaaagtatcactaactaaaaacattattagtatgcaagggcctagccattcttatggtcacattagtaatatattgctaccactttatgtccttattgtaaggatgatatatttagacagaacatttgaaagtttatcttggattgcatgccccagtcggccatgccccatactagtgcaaccatataaaataattttaagtaagagaaaattttccgactgaacttcactctatatttcttttttactttcgcaacactctagaactagagcattaaacagaaacaaaacatcagctgaaagcagtattttcacaccatttgatgaaagcagaaaaggcacctcaaatttggccaaatatttttttctctttaagagaaaaaaatcagacaaatctcgctatgagagtgagagagagagagaacaaaccacttgcgaggagttctcttcatccagcagaggcttgtcatgctggtatgaggagtccatggctttactttcttacaagtaaaccaggttaatgtcctgaggaagaggaaagaaagtagcctgagattttgagcagatagtggaagtgcagattagaggttttaatggaaaataatggaaaacatattgccctacaataaaaaaatgccagagttataatttataaataataatagaccacccaacaactgggcatactgtgagtgatgtcaggtttcagtttagacaagcagcacgttgggcatatggctatcatttaatcagaaaaatctgtcgtacagagttttaatgtgataatcaatagtagcctgtagcccttttttgtccattatcttagactgacgcatcagtactagctctcacctaaaattactagtagttctagaaagcaagcggcgtcatggcatcaatcatctatttcagaaatgatgggccaactacttcgaataaaaaaacagtatttatatatttcttccatcctaaaatatatcaatattgtactaaacgagtcacatcatattactattaatttagacatgctgcctatctagattagtagtaacatgctacatccgatcctaggttactatattttaggacggaggtagcaaaactaaagccgtactcggtagtaagtgaagtatactactatctccgtctcaaaatgtatctatttttagtacagtaacttgtcccaaaatgaagctatttattcacctactctctcctcttaaccaatcacaaccatttttttcacctactttctcttccccatcaatcacaactctcctccaatcatctctacctacttttttaatatctgtgtctaactcaaaaatacttacattctgagacgaaggaagtactcatcagttgcaacggattgagatctcaccctactctcttgataaacgaagagtgatcatcttggtagccaatatgatgaaacactcacacggactgagaagacagaacctgctacgaacaataaatgggcagcgcatcaaccatcaagtaatccatctaacgctacgacctatccatcttctaattggcgagacggattagccatcctgacgaacgccgtaacagctagagctcagccgagaggcaagcacgcgaacctaacatggatattcttctgctccccccattttccccttcgctagctcgcttgttgggggaaaagagagaagatgagaccgtagcatccaccctcccaagaacttctctctacaactaactttgcaaaattcaacgaaggaacatgcatgcgactaatctgacgagatagtttgcaccgaaaagggggcaattaaatttgcctcgcttcaggtactagatggagacgaaaatcggagaaatcacgcaccgagagaatgaagcatgaaccggccggattggccggactccggcgagcccgacactgagcccgccactctctgctgctccgcgtgggccgtcctcactctcctccacgccgaggcgaaggcccttgatgattttgcgctttgtagagtggggatgacacgcgggtccacctgcttggaataatgctaccggtgctctctccgactccccttttcttttcttttttacttcttttcccgattacacggaagtggagagtcacaactcacacgcaccactgcacccgcatgtaactctcactaaaatagaaaatgagcaacggcaaattataatgtctctcttttttccagcttcagtttccttttatttttcctgcacgtaagcgcctcatgcaccaggcgatttgtcttttccatgtatgttgttcctaaatttggatggtactgcaaatcctttatatttttgagctgtcaagcaaatatactgctagacattcctcgagagggaaaaaaataagtagtattgtaagtttaaatctgattaatgcactagcagtcaaactgccattcaacctttttaagtcttcagttcagtttgacacactcgattcattttttcctggaaaaagtatactttaactccctcaactatggccagagtacgattcatgacctccaaccacaaaaccggatatatcgactcctctaactaccaaaaccggtgcaaactatatcctaggtggttttggttgacgtggcacctacgtggcggtgttgacccggtcttcgtcccacgtgtcgtcgacgtgtcgcttaggtggcattagagtaaaatcaaaaatttgtaggaccaacgtgtcattaacaaaaaaaaaatagtgggacccaccgacatatggccccacgtgtcattctcacccctctcccctctctctcatcttttcctctcctctcaccttcaatcactagagcgcggggcggcggcgacaacgcacagggaaggaggtcgctggccgtccacgcgcgggggaggagctcgtcggccgttcacccgcagagaggagctcgccagcgccccatcccttcttcttcctcatcctcctctctctctctctctcccttctctctctttctctcccctttctcttcgtctgcaggcggcggtgggtgtttgagggccgtagcggcgacagccagcgggagggcgggcgctgcctcgagacggagcggcgacgaggcgccctcgaggcggagctacggctcgtcgtcctcaaggcgtcgcgacggctcccgccgcgcccacgcacgtcgcgatgcctttgccgccgccgccgcctacctcgactacatcgtcgacaacgcggacgagtttggcggcacctgctgggccatcaccaagttcagctgggacgtcaagtatgccggcgtccagatccttgccgccaggatacgtcgtgatagcaacaaacaccttgcattgacgtgatatgatgtcagtgagagtgagctatgtaggcgatgagtgtgaatgtattttgcgtgtgcagctagccaactactgatgagaggggagcacgaggagaggcacagggagacactggagaggtacatgagagaaggcagagcaccatgtgtgcgcgtgcatgggccggcggcgccgacgccaacgtggagcagagccccggcgccggaggcggcgacggcggcacaggcgtcacgacatgcatgggcggcgggagccatcggaacgccttgaggacgacgagccatagctccgcctcgagggcgcctcgtcgccgctccgtctctaggcagcgcccgccctcccgctggctgccgccgctacggccctcgaacacccgccgccgcctgcagacgaagagaaaggggagagaaagagagagaaaggagagagagaggggaggaagaagggatggggcgtcggtgagaatgacatgtgggcccacatgtcggtgggtcccactattttttctcgtgtgaatgacatgttggtcctacaaatttttgtttttactctaatgcccgacacgtctacgacacgtggaacgaagaccgagtcaacaccaccatgtaggcgtcacgtcagccaaaaccatttctaaaaccacccagggatatagtttgcaccggttttggtagttggaggagtcgatatacccggttttgtagttggagccttggaggtcatgaatcatactcgggccggagttgagggagtaaaagtatactttttcctttttttccttgagttgggcccaaccgcataacgagcagagcacgcaccgtgggacgggccctgcaaaaatccgtcgagagaggcccgtgttatcgacgcgatgtgggcatacggcatgacggcccatgtccaaccgcgccagtccctagttccctacgccgcccttcgacgctttgccgaacgaagcccaattcggtggcctagtttcatcccttcgcgctatccagcaccgcggctcgcgctcaagtcggcctgtgtggtgtgctcggctgctcgcgtcgcggtgtgtcgtgtgcgtgacgggggtgggggtgggtcgcgcccccgcatcacagcgtccgttcaaggcttcacgcacatgccgcgccccgtgattggttggtactcctatctctagtagctggtgtactccgcgttgccgggtcgtcataggattttttttttcctttggctccctgcttggctgcttgtttttctttctagcagttaagtaaagggtatgtttattcctgcaccagaagtagttcaagagtatatatgctcgttacagatattcttccttgcattgcatgttacgctcgttacagatagcttacctgcgaattaaaaacaagggagaatatagacgggtgtgctgagtaaagtagcaagataactcccaactactaagagcatatatacccaataccaataaagatagtataatctaaacaagctagtaaaacgccatggtcggctcgcgatagcagtgcatgcataagagcaagtttaatagtatagccaactactagcttcaattcatctatagctaatataatagcttattcatgcaatagttatatactacactattaatacatggtcccacaagtcatacacactgtgtctagaggcggatccaacgtgggtgcaggggggactnnagtccnccntncaccnacaagacccatggatacccccggagcacccccttcgattttttcaccataaatgctaaattaaatgtttctaaatggctagaggttgaagaaaccatgtaattgaggccctcctcccctaattttctgtttctggatccgcccctaattgtgtcttagagtccgtgctataattggctacaaatctgtagcccgctactcttctctctctccttatttatcttcttaaaatatatttacagctagcttatagtctactattgtacctgctctaaagaagtcctcgatccttgctccttggcacgaagcaagcaccagcgcagaaattcaacacgatacatatccgatctcacctggggaaggctaaaaatgggcgtacacacgcacgccgtcacgtggatgtttcttcccggcgaccgactgaccaaaacatgcacaagccggggcagcggagacaagtacacgtggtcgactggtggtagctcgcacctcccccggttttggccttctggttctactagccttctaggcgtccagtagccgcgtcccttcctttttcctttgcctttgcggctttgcctctgatcccaagtcccgacgacagtgtagcgtacgtagacgcagcgcgatttctcagcgcggacggccggacgggtggtgtggtgtttggggggattttcacaaagaacggctgaaattttctgcatgccatgtacgatcgatgcctgcttttgctacccgctgcacaggctgcctgccctaccaacctaccagcgctttgacagtttgtaatgggaaagtacagttaattagtaacgtgcatggactgcttgaatctttctgctacgtctttgccccggtccgagcggaggtcaccaggtacgtatcgatgttagctttttatacgtctttgctccgtattgtgtggagtcatgaccgtagaaatgtcaagttttgatctcatgca

SEQ ID NO: 63037 - DNA, 6338 bp, Oryza sativa
gccttcttggcttatccctgttgatggattgattagattttgttcagtacctgattgtaagggactataaaatccagcatatatggttaagaagaaagagatcacaatagaaaagcatgctcagccccatattcaatggcggagcaattatcaggttatatggtcaggcaaccgcttgatcttcgccacaataataaacattattaaaaaaacaatcggccaccaaaaacgttattcgtgaagtgagcttgacggcattgttggctccaacattgcctatagagcaccgatatggataacggttcgaacttatcaaacaccaaaacacagtcacatacacgagtacactacactgatcgtataagaatgtgagtggacatcgatatcaatcaaatttactgacttaaaagcctttctagagggcatacaagttgaaacctaatgtgctaacacccacgccaggcacaaagccagcttccactaccaccgaacgtggcgtgaaacaaaacctgcattaagtttttgcggctattctacgggctagcactctgtttcgcgtcataaagatcgataaactataaataaaaccaaggagcaaggcaagagcttttctgcacgaaatggccatccccgcgaattctccgaaacaaaaagaattggcaaccccccccccccccccctcttcaccacacgcttcttccgatgaaatggaatgacgaacggcgcctttcgcagagacatcagtgctcgcatgtgcggtacagcgtcacgtccccgctctctagaaataaatcgtctgccgagaaacgcaaagggcgggcagggcagggcagggcagggcagccgcgagtcggtgggcagccggggtgtgggtggggtggtgtggccgtgtggggagccacgcgcggaagaaaacaaaagcaattaagcgacgctggtttttcgatcttggacggcaggtaagcccgtgggccggctgcgcacgcgggattcccccgcggcccgcagggaggcgcgaccaggggacggcggtttcgacttcgcgccggcagagggggcgctgggtgttgggagtggacgacgcggtctctctctctcgctcgcgcgtcggcgtcggtctttcccagcgcgcgcggaaccgcccgcgcgccgcgtgcggcctgactcggacgccacgaggcccgcgccgcggtggtggtgggttcggcgcagcagccggttcggcgccttggcggtaacaggccggtggtggtttggggctttgggcatctcgcctagcgatgcacatattccttggcttaaaccccacgatttgggctactgactaatcgcgtgctgtatttccttgccttttgcactttgttttttgcaattcgtttgcttccgtgggagaagactttgccccttcgtcctgcgtgtacagtctatatattaatacagagggtgtttgtagtcagacacccggactatgtcaattcccacggcgtgcgagctcgcgtcatttgataactgagttcgtgtaattaacccggaaagctatcgaattctacggctctcctctaacatgcatgaacttcaaagtttagtttatttctacggttattaatgacttaaaaagctttgtccactacttaaagaaaacaacataaatcattttcttacgtgccaaattaaacggcacctccaccctaaggtgagtcctccttaccgtattctttgggtcttcctcccttgtactagttcactagttatagtgaggtgccttcagctcacttgtatcggtttgctctttcccaacaagtgcactttcacctcccgcaacctatagctattaaattattgagcaatgctacacgtactaaatttttcttactaaacttttactaacaatcatctcaaccgtttgatttaagtagatggaagtttataaaaaaaaatctagatgcacgcgtagcatgacacatcagtgttagtaagaatctagtaagaaaaagttagtatgtatagccttttcctaaattattttacccttgtttttctcttttccttttactaaaataatgtatatttttaaagtctctaataaaagttagtcctattgtttaatatatcataaaacgatgaaaaatttcataatagagtatccgattaacttttttttaggtactacttatgtgaaaatgaaaatgtgaagtcttctcttacttttgacgagtaacacatgatagtttggggtgggggtgatagcattgatatatactatcccctagcctagaacaggggcggatctacagaattaaggtcgacaccgacgactttcggtaaaatctataataaaactgcttatctatatgttataacaatatgacctaaggataattagcatgctatgacaccgatagtcacgttatgacaccaacgaatctattttctagatctgccactgcctagaacccttcccttctcttttcctacttttttttttctgtccaaactccaaaccctcaaatgaattataattttgatgtcagggcgaatatggcatatgtcttgacgaaggttgaatggtaagtggtcaaaattttcgtccttttcaaccccgtttcaagaatttacagctaagattctcttacgttcaagacatgtaacaatgttaggttattatctgaaaaacgtaacaatgttaggtctccctgtatcaacaaattaacaaaaattagcgttagtggacgaaagtatacaggtcttatttctttgtaagaaaaatatgcaagaacgctactgggtttcatcaagagtaggagtactttttgtgcagcttgctgacgtcatgagtttctcagctgccgttctctgtcacgagtcacgaccacctcagatcaaatgtcaaaaggggcgagtgacgtatttgatacaagatgaacgaatggaacctgaaaaaagcagttaaatataagtacaatatatgtcgaacgtgtgtcgatcttacataagactaaccattttgcttttcgttgggaaaatgatttaaaactctcgagggaatgctttcttttcatgtcatttatgtagttgtattttttttaaaaaaatagattaatatgtggtatatcactacataaatatataagatcaaatatgatatctacaagttaaaaaaaactctagttagtttacatatattgacagttaaatttgtttgctttgtaaacttgtagaaatcatagacatatcatacatcaatctaccttttttttaacttttgagtaaagtgaattgttggtctctaaacttgttcacctgtgtaatttaggttctctaactctcgaaaatttatttttcaaattcctggacaagtgtttcattctgattccaaattgcctagacccctctataaaatgagggcctgtttagttggtgaaatgagaattttttgtgtcacatcggacgtttgaccggatatcggaaggggttttcgggcacgaatgaaaaaactaatttcataactcacctggaaaccgcgagacggatcttttgagcctaattaatccgtcattagtacatgtgggttactgtagcacttatggctaatcatagactaattagactcaaaagattcatctcgcgatttacatgtaaactgtgcagttagtttttctttttatctatatttaatgctccatatatatgtttaaagattcgatgtgatgtttttgggaaaagtttcgtgggaactaaacagcccctgagtcaatgcctcatgtggcatgtcaggtgaacaacacataggatcccggatgggtcatgaccgaaataacatactttaacaagtttaggatctaaaaatgtattttgagagttagaatacttatatgacacaggagaccggcagtgtactttactcttaattttgtataagtatttaaataagagtataagaggacaaaaatcatttttatttctggtgtatataatatttcgtcttatctcttactagctggtacaagtaaccagtactccctctggtaaaacaaaaatacatcatttgattttctttcaatcatactagaattttgatcatcaataaatttcaaaatacttaagtctaaatcataaaaaatgatatatgtagctttgtcttgataaaaatactacctccatcttaaaagaagtacacttttatccatgaatttaaactttattttggcaccaaagtagtacgctaataatccataaactaattaaactttttgtaactaatatgggtagaccagtacttagccacttctttatattttgtccgaaaattgctagattgacaagtaatacgaaacggatggaggggttgtgattaaagtatcatcattgtgacctaaaaatgtatgcgtatattttggttacagatcaacgatgcttttatttatttgaccatttatggtcagaatagactttcataaatttatcttaataaataatcacgggccaattcacaccaaaacgacctaaaaatatcttcatattatttgatcagaggagcatgtgttttacagatcaacagttcctttgtttatttgactattcatggtcagatttttctttttggttttaagaagactgtgcaccgtctctctctctctctctctctctctctctctctctcacgagtactgagtactgacaggttagtttgtttccctattcattggacaattacgcagttacacaccagtgcccattttttgaccaactagtgaaaacggaaccaaatcaaaagtgtccatttaccgaatcaagtaacgacagcacacggcgatttgtctgcgcgacgaaggctcgcggcctcgcgcctggcagctcgctcgctcgctcgctcagtcgaccgtcgctgcttgacttttcccccttttcaaagtcgcttcctctagacccagcgagagcgggcaatgacggagcggccactgcttccgtccgtccctctctccttccgtccctttcggcgtttgttgtgctccgtctccgccgcgtcactattttttgcggtataaaacccggcgctgccccctgcctccaaccacaccaaaacaactcgcatccgtttcgttcaagtccccccccgaaaagagcttagtagaagcgcgccacagagccttctcgacctggctctcctctagccacctctgcttcttcttcttcttcttcttcttcttcgtctgatcgccaccgaggctaaagccaccaggaggagcaggttgatagctcggcaggcaagatggtgctctccaaggccgtctccgagagtgacatgtccgtgcactccaccttcgcctcccgctacgtccgcgcctccctcccaaggtacgtgctctcgatctgctctctctctgttcttgctgttcttggcccaatgcagagcttcttccaatatttcatggctgactcgatgggattgatcgattggtgttattaggtaccggatgccggagaactcgatcccgaaggaggcggcgtaccagatcatcaacgacgagctgatgctggacggcaacccgcggctgaacctggcgtcgttcgtcaccacgtggatggagcccgagtgcgacaagctcatcatggccgccatcaacaagaactacgtcgacatggacgagtaccccgtcaccaccgagctccaggtacagcaccctgcaggcatctctgcttcgttgaattttctcctatcacctcgcgttttctcgccgccgcgcgcggctcgaatgcacactggaaatccccggatttttggtcgataaaaccggcttggccagttggcctggcctggcagattggtgataagaatctcaggctagaaactttatttccgagtttatcatttgcgtcattcacgggaggcagaatgggggaagaacatggcacagtttccgagatgatcaccaattcgcattagaaaaaatatataggaagtccaataaataaagtaaggggatgggaagaatgatcaccatatctcttcatttttcgcattaaaatatggaaggtgcatgaatgaagggaaatgggaaagaataatgcttggtttggtcaaaacagggcaagagaccaaagttccatctactgaaacggcgtggacaacagtcaaaacctggaacacagaaaacaccactgcaactttcccctttttgtgaatgagacacattattagtccttttttcagccagacatgctttgggccagatgatgtcctagcatgaaatgtacaacattttttttgggccgggccgttctacagctaattaacgaacgctttggatgtgtgacgctgtgcagaaggctgcaggaat

SEQ ID NO: 63038 - DNA, 4587 bp, Oryza sativa
aaattactatttctactacactaaattatctatctatgaaagtgagattaatcgatgtcattgcggccgtggtgtgcaggtgggagacgccgatccacgtggacgcggcgagcggcgggttcatcgcgccgttcctgtacccggagctggagtgggacttccggctgccgtgggtgaagagcatcaacgtgagcggtcacaagtacgggctcgtctacgccggcatcggctggtgcatctggcgcaacaaggaggacctgcccgaggagctcatcttccacatcaactacctcggcaccgaccagccaaccttcaccctcaacttctccaagggctccagccaggtcatcgcccagtactaccagctcatccgccacggcttcgaggtataatcaatggaacacaattaactctcttgatcagatgaattttttttagctgatctgacacacccatcgatccgatgttatttgcaggggtacaggaacatcatggagaactgccacgagaacgcgatggtgctgaaggaagggctggtgaagacggggaggttcgacatcgtgtccaaggacgaaggggtgccgctggtggcgttctcgctcaaggaccggagccggcacgacgagttcgagatctccgacatgctgcgccgcttcggctggatcgtgccggcgtacaccatgccgcccgacgcccagcacgtcacggtgctccgcgtggtcatccgggaggagttcagccgcaccctcgccgagcgcctcgtcctcgacatcgagaaggtgatgtaccagctcgacgcgctcccctccaggctcatgccccccgtgccgccggcgccgctgctggtggtcgccaagaagtcggagctcgagacgcagcggtcggtgacggaggcgtggaagaagttcgtgctcgccaagaggaccaacggcgtctgctagtctcaattagcgacagcgccacggcctacaaatccacaaatcaagacgctgctgattgatatgattaattacattcatggtgtgagctaccattactgtattttttttttaccgtgctaatttgagtggagccttcgattctaggtccaaggtactagtagagttcataaccaaaagccatgctcttgcttttgtttctccttctgataatctgtgcagctgcgctgcagcctgcactcatctcccgagagttgtaagttgaaactgtacgattttgatgttccctgttctagtgtaagtgccaattattgagtggtatggaaaatatttcttcaagaaaccaatcagagcgtaatttccgtgcttgatgttgtgcttgcttcttgccgttatatgttccccgtagtaccctctctacctgcacttgccttaaacttttttctcaaccttatcagtagtactagtaattttcccctgatttgccttaacagtaggagtagtactaatagtatcaagtagtttgttctaaagaggacttctaaaaatgtaaattgggcccaattgagcccgactcggactcgacgcaacggcgatagccctataaaagcaacggttagccgcaacgctcagccatcgaacgactcattgatcaaagaggagagaaaaggaaacgactcgttgatcaagaaactgactcgatggcgttggagggagccgcgggcggcggcggcgtcggcggcggtggcggaccaccggggcaggaggcggggaagaaggtggggtggagcaaggaggaggacaagctgctgcgggagctggtgcggaagcaaggcgggaaggactggggcgtcatcgccaccgcgttccccggccgcaccgacaagtcgtgccgcctccggtggaggcagcacctggaccccagcgtcgacgtcgcgctgcccttctccgccggcgaggacaggaagatcgtggagctgcaccgcgtccacggcaaccgctgggccaccatcgcggccttcctccccggccgcagcgacaacgccatcaagaaccgctggaacacccacctccgcaagcgccacgcccaggacgtgcagcagcgcccgtcaggtggcctcgccctcggcctcggcggcggtggcggcgctgggcaggctgcgggcgggaaactgacgccggtgtgcctccaattgttccctccgacgcaggcaccgccgatcggggagaacttaccggggccggcaagaagcgctgtgccggagctcctcaagctcttccccctggctcccggtgatctcaaggacaatgcgagcgcggcggcggcgatggatgtgggtaacgaggccgtccgcgcgctccccgagttgaggctttccccggcggcggtggtgttcgacgcaatgccgctgcaggctatccggatgtagattcttgcctcgtcttcaattttttcttgtttcttctattttgttgtttctgagatgaacagctcttcaatcaacgcagggtatttcctagaggaacttagttttgatcgaagagctgtagattttgatctcttggtttcttgcaacaatcttgctagttagtggtgatcaagaagccgtcttgtgattctagttcttgttagtagtagtcaaaaaattgaggtatcaccttcctgtaattacttgattgcaatagtaatcaaggtctgaccatcctgtaattacgtgatgtcgatgaatcttttgttgtggtattcagttcgaaacttgcaattggtttcatcaatgtctggtctagattacgctgacagaatgacagtatcaatcttcagccgtgcttgtgtgggactttaaaacatcctggtatgggtctgggccagttcttcagaatttgtttgatggatcaatctgcatccctccagtccacttgttgtttcttcctgtcctgtgttggtaatgtgatctggaacgactgcccgccgtggcagttaactgtaaagatgttatctcgttgatgttgtttgtctttcgttacagacggactctgcttctcctgaacagtcagactctgttttctcttgcctgtacatattcagttacatttacattttggagatggtttgagttcagccaacaacggccaaggagttcgacctgaaggcaaacaatcttaaagtgatttttgagtaaaaaagttcgattttttaaaagaatgattctttttttttgaatgcctaaaagaatgattctaagtagtttttatatatataaaaaaaattcttcctagcaattatgggatagagttgtaaacgaaaatgacaaagaaaaccctacaatcaaattctaaagcactgataaatcgaaactcctagtgggcgggcgatcgttcccctctcctccaccacttagttttcttttttggcaccgtattacttttctgttttagtaaatttatgcacctatagtttacacatctaaagtttagagatccaaagtttataaatcaaaggtttatatatccaattcaaatttgaatttgaattcaaatattttttatatatagtatttctatacatctaaagtttatacacctaaaatttatagacccaaagtttataagtcaaaagtttatatacccgattcaaatttgaatttgacttatatctaattcaaatttaaatttgaattcaaatattttttaatatattatttctatacatttaaagtttatacacctaaagtttatagacctaaagtttataggtcaaaagtttacataccaatttaaatttgaatttgaatttgaattcaaatattttttttatttatagtatttctatatataaatttttctaactcttgttttttcttattttttaaaaaatttatggtatagtaggaaggtaagaaggggaggaggaagggggagaggagtgtgtctaaggggaggatggggatcgatcacttcgcggcttcgcccgttagcatgccccctgataaattgtgtttaagaataactgaagtcccgcatatagcgtctccgtgaacgaagcagttgtcccatacactgggactccgattaaagcggagccaaaacaagtgtctgaagacaatatttccatattggttagctctatgatcagatattccgatcaccacaacgacggaaaaaaaaggcaattatagttgtctatttggtaatttgtatattcttgtagataaaagaattttcctatgaggtactagatgcatagtattactagatgataccccgcgcgttgcgacgggatatttgtaatgcatgtttgtttattattgtaaataactttaagtgattagtatatttgcaaggaagttgtaagttatatatagtctttcagaaacactacatactaaaaagagaacgcaagtaatgattatttaagaactgatttagctaaggaacactcttgttaccgctcatggtaaggaatgcgattgtgaaatactatgatagaagtatttgatcacacatgggtataacatgcaaagagccatagcatatacatttcgttacttatattgggatagtagcttcagttgtgctatgtaaaagtgccaatggactgagggttccgtagctggtaccggctgacgtaagcagggcgatccgacaaagc

SEQ ID NO: 63039 - DNA, 4202 bp, Oryza sativa
gtggtctcgctagaagccgaggtcagagcggcgcaaatcccggccgtggtgtctgtggtcagcgcgcggctgtgggtggcgtttcagaggagagcggtgaagcgctgtgtgagcaaagggcacggcgtcaattgtccaaggaggtggcgtgggcagcggccatgaccggccgccccaagccggtgcatgctgtgaccccttcgccagcatcgccgatccgctcaaagttttgggcaacgccggacgacgatgactcggaggatgatgatgaggcaccgacaccgcccccgttcacaggctcatcggcgacatcttctccgtcgacggaggaattcgtcaacgaggcaagcgcagcgggattctcacgtgcacagctcgtcatggcggagcagcaactccaagcaggtaagaacagcgaccaacggttgccggaggtaatcttgtccacgctgctacggcggaagctggtgggtccgccatggcgtggccctttaccagcggaacgcgtttctccgccgagaacgctgggcgactgcctggcgtcggcatctcggtgtccgcggcgtaggcggcgcgatggtcgacggtgcggcgttcctcgttcatcgtcatcgccggaggccgggacggttggttcaaaattcgtaattccgaaatcgttgggcgtttcaaacgactccgatcaattactacggcagggttcacggcctgatttccctcctctctgcggtgcgcactcgtcggtctctaccgcgattgccagcgcaggaggggaggtacgaaggccggcgccatctgcatctcagtcggatcggattcgtttggggcccgggaagtggtttcggcccaccaaaggattgatctccctctttgctcgctctggactcaaacctagatcgcgaaaactgcagccgccatcacgccccactgccacgatctcgtacgctgcggtcgtccggaaaagaaaaacctagggggccaccgaagccaaagggttggccgttcaaggggaaggaaaaggttgggccttcgcccaaggtttcccccctggtttcgacggcggccgcggccgtggccgtgatcagcccgttcgcccacatggccacaacggtggcggattcggaggagggtacggaggcggatatggcggcggaggctatggtggtaacagtcacggtggatacggaggcaaccggaaccgccgcggttggcagggtgggcgccgcttcgcgccggctgctggccacgcggccggtcagttccacgccggaggtggcgttcctggacaccaggccggtggccaggcggtggtcggccaactgcagcagcaggccgctgctggtcagttccagccggctggcttccagacagcggggctggctgaccaacagcccgcccaggcgcccttccaggcacctctggctggccagcagcctacccagccggctgcggctggcaaccagaccagggaggctggggctgtgctcttccagcaggtcagccaaagccagaaggcccaggtggctgcaccggccaacggtggcggcctcggtacgtctcaggtcgggacgtcggcgctgctggcctccagccaagcagcaccggcggctgctccagctggctccacaagaggggccatcattggaggatcggcacaggatcccgcggcgacacatctggaaggcttcatggcaaccaagcccgaacctgcacaagccggaaagcagaagagcaagggtaaaccctactgtttccgctgctatacaaaggggcacactttagatgattgcactgtcttgctttgctgtgatttgtgctttgaaaatcatgttctaaagaattgcccaaatgtgaagaaaacaaatgcgattgcggctccatgtggttatgcagtagagggcatgggcttttactatatccctatgaatgacaacccaaagagtaatgtggaggagcacacggtcttggtacgtgtcttagacggttcctttactgttgatcaactgacagtggaacttgatagactactgccagctaaaatcacttgggagattggtttgaaggggtctgatgccttcatcattactaattttccatccgagctccgagaatatgcggtgaattggggtccaatggacaccaagacaattaagggaaagatccgcttcgagaaaggtgtcgagaatgatgtgaacagatatgagattgacaaagtttgggttcagtttcggggtctacctagcgagctcagagaatttcctattatatgggctatagggtccatattaggggtctctaaagcggtggatatgcgctttaccaagacgtttggcaggtccagactgaaggtggctgttctagacccgaacaggatcccagattacgttgatgtggtcattggtgacttcgtttatgagctgcagttccgcatggagatagatatgcctgttggagagccttcagtcattgacatggactctaccacagacaatgatggtgacaatgatgggaaaggcgaggacccaatggaggaggatgccaacaaaaataatggcacccctgatgacttaccaaaggatgctgcccctgaaaatgcccctgcagaccagctacccaagcatggcgcgggtgctgagacaggcaagctgaaggagaaaacagtggctaagtctgatccgggaaaaaataaaaggcccgtggctgtactatctcaggggatctctctggagggttccattcagtggcaggcaaacatgttgggtaaccatggctcttctagcaaaccggtggtgcacaagggagagactgtatctcctctgaggtccagcaagcgcaatgtgtcctccctggagcaggactccatggaaaaggccaccaaactgaaagctcgcaaaaacttggattccactgctgcaaaaggtaacaaacccctcccctcctcttttcataatttagatgattctgttatactggctacaactgactctttaggaattaatttgggggacgatgttagttcggttctagattctgtacattctttaaaacaaattgagttacaaagatttaacgacttttgctcatctagtaaagaggagaaacgtagctgcgaggaaaactcatcagtttgttcggaggataatgttgatattgatgctttaaatactatctgttcggaaattgcggaaagccttggtgatgggggctatgacccgctgtgtctacatacccccttatcacaaataaagaggaggcagcctaagggtaagcagaataaaaataaaagcgaacgtagtaaaacatgaagggtattttttggaattgtaatgggtttgcagacccgaaaaaatataaatttttgtctgatctaactaaggagcaaaatctagactttattgctttatcagagacgggcagagcctcttttcctcagtcaacattaaataatatttgtgctggcagagatttcatctggcactgcatggcccctagggggcgctctggtggtatgattctaggtgttaatttgctgtttcttgacattggagaaattgaggaaggagattttttcattcgctttaaattaagacagagagcagatgattttaaatttaatttgatttctgtatatggtccagcacagtctgatttaaaaggtcattttctctctgaattagtacgagtttgctctaaagaaaccatacctacagttgtaggtggtgactttaatatacttcgtaacccacaggagaaaaataatgatacctttaacgatagatggccatttctgttcaatgcagtaattgacactttgaatcttagagaattggagtcatcagggagatcttttacttgggcaaatcacttacaaaatcaaacttttgagaagcttgacagaattctagtttctacggagtttgagacaaaattcccactctctactgttagcatcctcactagggaaatttcagatcatacacctttgctatacaattcaggcggtgcgtccgcagcttaccaacctcaatttaaatttgaattgggctggttgcggagggacggtttcagtgatattgtaaaggaggtgtggcaaggggtgtccattgagggtacacctttagagagatggcagaggaaaattagacgattacgccaatttcttcgaggttgggcgaaaaatattactggtgcttacaaaaaag

SEQ ID NO: 63040 - DNA, 1154 bp, Oryza sativa
cccatcgttgccggtccggccaaggccgggctaggttttcacccgctgctcaccacatgcaaatctacagctggtgtcccgatgctccaccactgctcaagctctgccgacatgtggcacacctgcaccgccgccccccgccgaccagccttcgtgcgcggaagaccgcgccacacccaccggcagctcctcctcataccgaggtcgcctcctccaccgccggccacgcctctcgcgccaagccggcctccatctccgccgctcgcgccgagccggcctccactgccatcggctacgcctctctgcgccaagccggtctccgacccctcctccaaacgatgtcgcgccggctagaagtagccgtctgccacgccctcggctagccgaccgaagccgtcatgcctccggtgaccgcagacacgatcaccaccaccgctgctgccaaacacccgttgccatccacacctcgcacccgactccttccccgcctcaacctgctgtcgccggcgatcgtctgcacgacgtcgccagccgctgccgcatccagcgacatcagcaccgcctcacagacccgaccgccgcaaaccagccgccgttgccgctgtcgctgtcaccagccaccgacgacagccgccgtctccgcaaaccgccgccaccgccaaagaagccactgcaccgtcgccctccaccaccaaagcagccagcaaccggcccgatgccgccgccatgtcctcagctgccgcagcaaccaccaccggccaccctccagatccggccgagcggcacggatctgaggtacaccgccgacgtcgtcaccgagcaccatgccaccgtcccctccttcgctcccgccaccagcgccaccatgccggcctccgcctgccgtgcaccaccgccaccacgcacgcaccgctgccaccatgccatgccgggttttgccgtcgctggccgagccgccccgccagtgctgcgtcagtcgaagctgccgccgtcgcacgggctccgcgcgcctccgtcggccgcggacttagcctcgcccgccgccgcaccaccgggcgccgcccacgcccttgccaccgaagccggccgctcctccttccccgtcgtcggacgcctccgccgcgcggggagcgcaggggaggggctgcaggaat

SEQ ID NO: 63041 - DNA, 1915 bp, Oryza sativa
ctgtttggagtgagtttcgacagtcatgtcaattgtcaaaatgcatctccataggaaataaaaataatttatatgctgcaattttccatgttctatgggctggcatctgtctttactgtcactgctcattacatttcttttcttttagtgcttaactagcacatgtgcatagtgggctcaggcaaatatcgtgacatgcatggagtatcttccaaaatatctttaatacttaatgtaaatacgtaatgtatagatccttacttgacaaaatcgttcttcagtactcgcatgaggatggtcgccaagaatccagtcaaaaggaggactgtaacacaagagtttatgatagagaaccaatggacctccaaatggtgtgggaggttggaggaactggaatacttctccatcctcttctcaaatggtgtgggtgtctccttccacttgactgagtaaaggaattgaacatcagcttccttgtcctcagtcaggtcaactagtgcactctggtcagtgtgcacattgatctcaataacccggtcattgttgtagaggatgtcaaagatgatgtgcctgtacaggtaatacttccactctttcggatctgtcttgcctcccttctccaccttaccaatgaatccccacagtgggaggtcatcgtagtacatctggaagtagtagtcctttgctaccgcattccgaaacttggccacctcctccttggtgagcttcttcgagcaaaccggcttggagtcataatccacacggaaatcaagcttgtaaggtgcatcaaccaaccggtccccattgaggacctcaccgagtgcctcgctcttctccttcactttctctgtaattaacaccatttattagcaaacaactaactgggattcttcagcaatgaagaggaagcatgaatctgtgactaactaacctggagagcagaaaggcaggtcaaagtaccgatacgtctcactgcaaggaaaaaggaaaatatcatgacaacggcattcgcgtgacattatcgcctttaagaataaaaaatctactttacaaatagatccgattcccagcaagtctagaatccgctctccgaacacctatacttgctaaaactgaaacgaaaacagagcccgacgcgaagatctgggcagtcaacagtgcagtgatcgatcgttatcccgtccaaatcactacgaacgtcatctctcggatctccgaaactagcctctctgcgtttgaccagacaaacctaaacccacgacgactcagcccacacacacctcgaggcgagatcggggggcgggaacaactaacccaacccacacccacgaatctaacggatccgacgatgggatctgagcgggggaggagagagagagagcctcacctggggttgtggaaggggccgaccttgttggcgtagagcgggacgagctcgttggccttgtagcggtggtcggagccgtcggcgacgacgccggtcgccgcgagggccgcggcgagaaggacgagcagcgccgcgggggccgccgctgccggcgaggccatcgctctcgtcggggcgggggcgggggcgcgcgcgttgacgaggagagagagcgcgcgcgcgagggtttgggggtggtgggatgcacgcgcggagatctgagccggagtggccgctttgcttgctccttaatagagagagagaccgagacgagacgagacgaggcggaggggagatctggagagggtggcgttttcagggttgggtgggggggaggaaggtggaggcgtactgtggccctaatattgtagtactagtataatggggtcagctaagctaaaggctagtagtagcccacattttggtgcgtcggtcggtttgacacgatccaaatcagagcgctctctcgctccccgggggtcggggttg

SEQ ID NO: 63042 - DNA, 4831 bp, Oryza sativa
atgaagattaagtaatggtacggaaaacgggaaagtcattagcgtatgattgattaggttttaacttattataaagttgaaaatggatttatttgatagtttatagtaacttttatgtataaatttttcacatgaaacatattgtttaacggtttaaaaagcgtgataatgaaaactgaagtagactacatacattttaatccaaaaagaacgggcagtagggcttccctgctctcaagaaaatcaaagtttagtgtatagcatatgtccatgtaacaatgttgtagaaacttgaacaagggaggaatgagggcaggaatttggtacaacattgctggatggacatatgcttcagccaaactttgttcaagtttggtacaacattgctggatggacatatgcttcagccaaacttgaactcagaaacgaatcgggctggatggagtacattgctggaagagaagcattactgcataagctcactggccatccctggaaggatggaagcgaagcacatgcttgattttttttaaggtagaaaaaattgctaggtcattcaaagaatctacaatagtgactactgcaggagtgtaatattcagttttatgctgctaagaaggtcactgcctatagagatgaaaatcacaaacatcatgagagttgacagtaccgcaagaatggcaacgggccatgtactaccaaagtgagcttatgcagtaataccatctgcagcagttaccaacttagcagggctatgcaaatgctgaaagaaaagaataccacaacgcaacctttgcttttcacctgccctcactagcgccatgcaaatgccaccaattcagtgagcttcacttcccctagtttcataatcctttcctgcagttacgctgtcatcaggtttcctctacatacgcatgctgacttcaagtgctggtaggaactaactctgtcggtcgacaatgacacctcttagctctctgcatgtgatgtatggagtatgcagctcatttccctgacaatttctcatgaataaatgggaaccgttgagagaactgataagtttcagtcaaaaaagaaccatccgcaggcggcagccacagcgaggtggttctcatttctactccctccatcaaaagaaaaaaaaaacaaacctaatattagatataatatttcctaatacaataaaattggacaggagtatgttcggatttgttgtataaaaatatatcatttaataatagatttttttcgattttgctatatctcactcgaaagatttttttcttatctctcactcgattttctcactcaaatttacagtgcattttcttgtaagttacagtgtaatttatgaaacttacacggtaacttttgtaagttacactgtaatttttgaatcttcgcatgtaaattttaaattttgtattggatttggtctttttcttgaggatatggtaatttagtgtccattatggtgtttcttaattactttttgctttttattatatctatcggattttaatccaaagattaaaaatctgtgcgataccatcataaaaatctttcgaaagatgtataggtacttccgatttttttttgaacagacggagcaacacactagttatcgggaaaaaaaaaaacccttccaagacactgcaataagctaattgctagcgttattttcttccctaaaaatcttaccttttccgaaggcatcggcttaatgctttacttatttggaggggccatgcctctttccagatgattgctgaagaattcttaatgtttactccatgaatgattgtatccccggcgtgattttctgcgtgatggaaattttgcacaaactttggaatcactacggttttgtactcatgtatctaagtaaaataatctctcattcaacaaacttaaattagcttaaaacacaagttagcattaaattcaactgaggcaacctttgcttcctccatacagtcaagtcaattcggcagttgaatttggtgaggccacgagaaatggatatgctccatcgatttgggggataaccgcgagaaatcgtgtggaaccaacagacgacagataacgagttctgggcaactaattgctcagataagaaagagagcgtacaacattgcacatattactttcatctatttaatagtatttaagaataataatcgaatgaaaccgctagaaaaaaaaaaagaaatccacaaatcttaggagtcaggcatagacacttcgtaagaaaaggatcaagattccattcaaatttacagcaaatacctcagttatcataagaatgtaataaaactacctcacaattgcggctgaccttaacctttctaaacatgcagaataatcttgggcatcattagtcgtgatgacaaggaatggacggtatttacatcagtacgaaggtaacaaaatcttgatgatacggcgaatgagcttgagcaattatatattaaacactaactttacaagactggctacagatgatccgaattgatacaacactcctaagatacaacatcacctgttgcagtttgcgaacagcgattgcacctatgctatcttgtccgagcagtgatttgacagctggactcgagggctaacgttagcatgtctgtggagaattgatcgtctggtttcaaccataaagcctgaccaaaatagcgagaaaatattagtaactaaccctgcgctacatgaaaacaacgaacaaactgaatagaaaggcattggtctccactgttatatctcttcagttttaaacttcaaaaacttaattgcatatatacacggtgaagatacattacgcacaagaaagtccctatgctgaactattggcagctccaagcggcttgtttggtaactggagggaagaggattgggagtttacacgagggaattgatgatgagattaagatggaaatttgatttttaatcccaatatcttgtttggtagaggtgatggaaattgatagggagtttagttggagattaggtcattaataaaaacggatggctgagatttgcttagacaaagtaaaggaggaattccctcccaattacctgcccctacccaggtattgaaaaggagggagttccttcctcaattccccatccccatcccaccaaaattcccatatctcccaaccaaacaaaacacttaatagcctcatccctctaaactcccaatcccttctaaaaactccctccaaccaaacaggccgaaggtgtttgattagaaagatgtattctaaacatgacagctaagtacaaatgatcatagagcgtcaccttgtggtagtaagttatcgcagcctcgaatttatcctgtgttatgaaaagatgatattagtaaaattcagatatactcagaaagtaactgtggaagtgtcaaactgaaacaatgaatcaagcatatcaggtctcattcttaaaactaaaaaatattgcttctacaaatgcaacttaagcttaaaggtcaattgtccttcgtgattttcatgtaaattagcaaggaatctctggctcaaattttttttcctgaaaacactattactagaacttaaatcaccctctcattactctgttctcgattcttccaatggcatctctatgccttgtgtagttgtttcttacttatgcgtaggtgatctagcaaataccaagtatccggatgttttaacggtaaacgctcagcacacatatatgaattgatgttgtaattgaagtagcaggttacataaaacttagttttgaacttctgatcatatagatatccaatagataattaaatataagtctatgtggaaagaccatgatctaacacgtatcatcttccaggttcttttgtcagaatttgcagaacttctgccctatgcacatgatacatcgcctttacagcatgccagtgcagcataacagagatagtaccattcaaagcagtggataagaaaggaacagaagagtaccataaggtggtaagtataagcaagaccagcaaacgcgctcaaacttttggtttgaaaggtgagtgccttttcataatatgatattgccttttgatatttcctgttgcaacaaaaaaaaaaggttagctcaagaatgatattttaacaactgatgacaacaaccaaaaagaaagagaaccagtataattcggttaattattattccatcagtcaaaactaacagcaaagctgctgttcatcgcaaagaaatgctattcaggtcaggatatgctaggcacaaaatctaaggcatattttcttattaaagtttcatgcaatttaggcttgactggctctggatacaaagaaatccacaagttcgaacttaccctcacacacactggcccaaataataacactggcatattgctgatttattttgttctagtctgtaataaaaggtcttcaaacaaagcaaccacagctgcacaactgagatgactgaactaaatcaacacttcctttcccattctctcatgtataacaaaaatcataaattgagcatataaatgggattggaacttgacaaatctattgctaaactaacataaaaaagtcatatgccaacagacttatgaaattaaatgtaacaatgtgatgcgatggttcccttacttgagtttccgcaatgcatgcccaagattcaccaatgttggttcccacatttcattcaaggaagatgaaatatgctcaattgttagctaaaccactgaactggtttttgatacctaaacattttttttaaaaaaaacagaatatcaaattctcaactactttaatagcagcacaaacagtcctttttactg

SEQ ID NO: 63043 - DNA, 2024 bp, Oryza sativa
caccaaatcaaccttgtatatcatggacatctttcaaaacatccatgttagcataacatttttcctataggaatatcagatatagaacttataggaatgctttccctttcatgagagcaaagcatcttacaagggaaagtggagcatcactggttccaataataataggataagcagacaaaagaaacctttagaacagagaaactcttactctttcatattataagctacaacccccatctcgttatatataagcggatcagatgggcagatagattttgcttgcgtgaagaactgcatcacagcagaaagaaaagggggtttaaaaaaatgatgacaaaactattatgccttgccaaataaaactttgcaaataacatactctccatgataggctctcattgtgagctacaacaaacagtattcactaagtaaaaggaagttgtgcatgataatatctcattttctataacccatccaatattacaaatacaggatgtattttcagcatctgaccaactactattaccacattaaacctccttttttgccaaaaacaaaatatggaatgagaaaatatagggaaaaaagtcagctctaagtatagtttctttatcagagtggaagcctcataagaaaattagtttcggtaggatttttcaaggtattacctggtttggaaggtttgaaattgtgcattcgcaaatattgcatgcccatgtataaagttggcagatgacatctgaaatagaaaacaatttcaacaaatagtgagccgaaggacagacaacaacagaggtgaagtaattgaagtgcaacaagaatctacactccaaaacaaagagaggaactcaatccacaatgctcataatcagtaatgtgtagtagatacaaaagcttgccagtgtcccaaaaaacacgaatagcagtttccagaacagaaggccaaaaaatgaaagaaagtagaaaggatccacaatgctcataatcggtaatgcatagcagatacaaaagcttgtcacacccaaaaaaaatacgaatatcaatttccagaataaaaggccaaaacaattgaaagatagtacaaaggaaaattaatgcaactaattgtgttaagataattgctccttagacaaacaagtacaagtatgctctggtgttaatattgagttgacttaagtgtaaaaagaatcaaattaatttaattaatattttgctaaactgtacacagcataataacataacaaataaagaagtttttttacacaaacaattacttcgaaaggaattactgacccaggaaatagccgagctgctgtccgaaatgcagccattgcttgatcaccctcctcctgtgcagcataagcaataccagtaccaatccaagcaggaggaaatgtcccatctaaccctgtagctttgctgataggaaatatattagtgcaaaacatattacagctacttaaaattgaacaagaatacaaggtataagaagttgtaagagggttaaacccatccatgattaaattcaatgaacaatgagcattgaacaaataagaaacaaaataacctgcaacctttggactggtataactgagacacatgtcttaagaaaatatatattgtttatttgaacttggactctggagaattattggacagatatgtttcaccttacaaaccatctgacagactgatactacatgagtagaacctactcatttctgtctttttatcacattgttctatcattccagacaactaaaaatatttaacaaagaaatatattgtttgttataagaaatcaatcagtcagttggatatgcgtagatttcaggaggcaatggcacctatggacactgttctctccatcagatggtaacactattgtagcacacatgttataccatgtctgccatgttttcatgacaaaagtgttgccttacgcaggaacatggttgtgatttgcagtgcagaggatattcactaatcacaccctattttattttacatcccaacatcga

SEQ ID NO: 63044 - DNA, 8887 bp, Oryza sativa
gctcagattctgatatcattgcataacaataagtaccaagaacaaagagaggattgaaggtccaacattaagcatatcttcttaaaactagtccagtaataacaataaacattgtattatttaaaagaaatatcctaagaggatggacatgacagatgggaagattgattttgtaaaacttaccttcctcgcatgtcaacatgtagttatcaacaaggcattcaagggcctgccatgtacagacataagaagttaggaatgaactaactggggttaccacagaggcccaattccatgttagcatctggatgccaaattccatatttagtagaaccaaaaatacaaaataatggtggttcatgtaattgaaaaggtattgtactaaagagtcacatgattcttctcacctcatagcacaaaggatcagccttcactgcagctttgtacctgagataacagcagaacaaagccataaaaccatcttaaccaagctatttggccagatatgcccaaaaaaaaacactgattagacaatcctgcttaaatcttaatttcaaacaaagaaaattagcagtacttccaggtagcaacagttatttcaactattagcagtgtgtcctcgttttacaagaaaaactcattttctttatatcttctaaagagtatcgaataacccaacattctcagtgaagatattgagtaaaaggtgtaagagaagaaagacttcaaaataactgcatcgtcattcacagaaccactgaatacactcaattagacaaaaaatgaaatgatgctttaccattgtcgagcaaggtcacagttgtccagtgcttcgtatgccttgccacgtaaaaaacatattgccgctttgatctggcaagcaaatattactatcaatcaccatactaagagagagagagagaggcatggggaagagaaagaagagtcaacacacattgatctcatggtcttcagcatccttatcaaagtaaatgtcactgccatcatcctgatcaacaacgtttccatgctcatctatttttgcatctccaagtatgatcaaacactgatgccattctttcaactcctcctaacaaaccaaaacaaaacgatgaaacagtagctaagataaaaggaaagacggtagataaaataaaggactacacaggactgtacaccagagcacaaatcagaaaaatctatactgaatcataatattttctggtatggttcaattttctaaagtaaaatcttagaagtacattaaaaaaatcactaatcctatacagttcttttgatctttcctataagaaaccagatttttgtttcgagtgtcatggatattgattgaataagcagtcaaaatcatatgtgcagtttatatatctgacatatatagaacttaaacaaaattctcatttatctaaaagtccgaagcaggaagcacatattataatcaaccaaactcccagatcagaccagctattaagaaccaagctaagcacccgttcattgatggaatgcccaagtaaaaatattctggtcgagaaaatgcaggtgtatcatgttaattattttgaagcatcagcagagcattggacttgaagccaaaaaaatgaaatcccccagtgcaagccattgggcgcaccttgtgtgaagtaaacgaccctatctcaactcatacagctaaagctaaaagctgatcaagcaaaattttatcgagtgcttgcaaacacacagaatcaaatcgtcaaaaaaactgccaaacaatgcccagagtgaaagaacattgaggccaccatacaaccacaagctgttcataaggaagctcaagcgcagccacgcactggaacattaacaggggcagtgaaactaaaccttctatctacacacagcatgcacccaacatgttcgacaaaatggcagactaaacaagggcgtgggtggggaagctcacgaggcacttggctgcgaggaagcggaagcggaggtcgcggaggagcttggaggagttgaggatgtggagcgcgcggcggaagtggcggcccaggaagagcgcctgcgcgagcatgtagacgtcggcggggtcccccgtggccgcggccaccttgtcggcgaggaagatggcggacgcgtacaggtgcttcccgacgctgtcccgcaccaccccgcgcagccgctccaccgcctcctccctcatctccgccgccacctccccctccgcctccgcctctctcctccgcttgggatttttctgcgctgcggcggcggtggtgggcggcgctgctggagggaaaccgaattttgtatcccacattcgccactagggttcgcggcggagagtggtggtttttggaaatttctcacggggaaaaaaaaatggagtcccgacgcgccgcggatcgcagcaagtgatcgatggatggaacgtgcaagcagtatggcttatgggccacgggcccacggcccacaacatatgcaaacgaaccagaaagcctgtataggagaggacacacgggccaggcccatcatctggccggattcggaatctacctctgtgaaattgcgatcaaaacctacggaaatgtatagatttcgtggtatacaaatgttgattttgccagcttacattgacgttcttcaccttagtcgtccctgtttgaatttacttttctattattattaacacgggagaaacgataatttgaaatgattcctttggaattcctgcaaattcttatgtctatcttacaattgctgcactgttctttttttttttatcatgtgaagacgaattaatgtgcacgaacgtcgtccatcggagccgaaagcggtcgctacacgccgccggtgatggccctcgttgccggagtagcggtcatcgcctgtgagccgcaccgctggaaatcggcgacgcggggcggcggcatgccgcggggagccgtcgctctcaccggcggcgagacgccgacggcgccggccgggtgcgccgccgccagggcttcttcgccgtcggctgcgaggtcgccgccgccgcaggagaggaggcacgaggcggtctgggagcagcccagcgtggtcacgatgacgtagctgccgttctcgtacagcttcatgacgtagcactcctcgtcctcgagggtctcgcgcgggacgccgcccacccgtcgcgcaggcgccgccggcgaggccacgggaacggcggcgacgtcgtcggcggcggcggcggtggagggcgcgtcgtcaaagcagttgaggtggcagtagtcccagtagatggggcacctcctgatcaggatcgggttgcgcccggtgcagaggtagcagatgtacatctccgtgtcgtcgccgccagtcgtcgccgtggcggtggcattgccgggcgccgtgttgccgtcgccgcccgtggtggacacggcggcggcggcgaggaggaggagaacttggtaggatgcacggttgatggaagctgctgagagaggcatatcacaaattgatgagagatgatgcgtgcagcctgtctcatttataagggttttttttatggcggggatatttataggtcattttggctgcagctgcattttgacgtcaggagcgtagtagtatgaaattatgattatgttgggagaccaacaaaatctcagtcaatgaatggatactacaatttgactatacgagaataagtgcttacctgtttctgcgtaagagtgctatctgaattctgaagggtggtatcaaatttcaatcgagcaatctgctaattatctcttcccatgtagaggttacatgtttttcttcatcaagataaaccagaaaaatcggttgcatacatatgttattttgtaattaagattcggattgtatctctgtttcgttagcacgcttttaaactattaaacggtatatttcatgcaaaaactttctatatataggttgctttaaaatattaaagatacccatttataaaggctgtaataattatattttaattaatcatgcactaatagttttctcgtttcacgcgcatcaacttaatatttcatcctcatctgaaaaatagctttctagctgtactcattttccagatcaaacgtctagggtatacatttcctattttcctctgtacaaattttctaacaaggttcatactcatgaatacccggtacatatccctttcaaaaaaaaaacatagtacatgcacgtagactacgcatatcgctatgaacagcaaacaaatgtagtgcaaatcagtagtggaatagtgatttactaattcagctgttcagcaactacgcgctccggcggtggatggtactatttgtcagcggtggacacggttaattagcaagcccaggaagcaatggattctgtttgaaagtggtgagcaacaagcaaagtgtgttgtgctgccgcagccatttaccaaaaaacaaaccaccgaaacggcaggttgggacgtttttagccatagaacgaggagacttctcgtgttgctgccgcaagccgcaagatcgatccgatcagtaagaaattaaacggctgtgaatttatcccaagaacacacactcgtaatttggttaacagagacagatcgtagtttgcaaatatgagctggttgattcttccacattaactactacttcctgaaaaaaaattgtgaaacctaaagtgttactcgtattattatttttatttgttttgcttgcttgaatttcttttggttttctctctaccatactgcctatatatttatgcacagattgacacgaggtttagtgctatgtccaacgttacattcgtcggatcggatcatcaaacggcacgtacgcgttgtcgacatgggctcgcggacggcggcacccgggcacggctagcgctggtcgccgcaccgctcgaactcggtcaggccgcgcggcagcgggctaccgatggcggccggggtgatctcgccggaagcggcgcccgacgacgacgacgacggcagcgcgtcgccgtagctgcacacgaggtagcatcccgcggacgcctggcagctgaccacgtcgacgacgacccagctgccgtcagggtacaccttcatgacgtagcagtcgtcgtggcccccgccccggccgttgtcgccgccatcgtcgtcggcggcggaaaaaggcagcgcgcgcggcggagacgaggaggaggagcgcgacgccgacgacggcgacgagaggcaggcgatgtggcactcgtccttgtcgagggggcaccagctgatcatcagcgtgttgcgcccgcggcagaggtagcagatgtactgctgctcctcctccgtcgtcgccgtcgatagcggcgaggagcggccgcggcgcgccatcacggttgcgttggcggcggccgccgtggcattggtgccacgagccacgacggcggacgtggctggcctggcggccgccgtgcctaccaagaggacggcggcgacggcgaaggagtaaaaggagaagatggaagccgagaaagccattggcaaataataattgaaggcgtgtgcgcggtgacactgacacacgcagcgcgtggcttatataggatggtatttaggtggagagattagtactatggtcatgtttggaaaataggtttgggatatgatttcccacacctcaaaggataagtcttaatcttagctatccatcattctcaccatatttcatcctatcgcttcattcatttccgtttcctaattccacctctcctaacctattttccaaacaccctatagtactaaattagcgagaagattggatgtccttgagctttactgcagaggagtatatgcaaagaagttatcatgggttttaaaatttaatcatttcctcccaataaaactttgtcagtgatatgggcccggggttatcatgtttagagggaggaggctgccccccccccaaaatgccacatggccctcccccaaggggagtcaggcccgaggtggggtggcggccactccttcccaaatactagtcggaggaggccgccccccaatgccacgtggccctcccccaaggagagtcaggcccgaggtgggatggcggccactccctggccgagactagagggaaaaggctgccccaggcgccacgtggccctcccccgaggggggatcgagcccgaggtcgggcggcggcggccacctcccgtgactaggggtcgggctcccccgaccacctctctaggtcaccacgtacaggtgcccacctacccgcatttatggcgacccgagcggtcgcgccacgccggcgtgcagtgtactcaaccggtctgtgaccggtcgaataaccgatggaactggctagtgcacctgtgcgctgctcgtgtgttaggcggcgtgcagcctgacatgtcccatcaaataatgatggtgagaggttctcatcctcttatcccagccggagtcggtcctcccgctctggtcaaagctaggctcccgttccccgatgtaataggagcccagaagtcttcacccattaaatggtgaatgacatgggcgtccctcgtgtcaggcggcatggtgtggtaggccccacgaccgaggcgacgtggatgcggcttccaagttaaggaacaagacatgcatttaatgcaaagatggtaatacttctcgaggaagttagttgttgggcctatgtggtatccccttgaactataaaaggaggaccttgcccactgagaaaagggacgatgacgacgacgacgacactcagtaggcctgaactctaggagaagaagagcgagaatgctctccggagtttaggaacccttgtaacactcaaccataattccaaacacaggagtagggtattacgcttcttagcggagcgaacctgtataaatctcttttgtctcatcgtctttggggattgaacgccctcaagatcacacagcttcgctcaccaagccctcgaatctcacccgctgcccccggccgaactcacaaaggggggcctcacggttccctgatggaggagttcattctccgacatctggcgcgccaggtagggggcgcgttcgtgatttttgaggttctttcgagcgccggcgcgataagtgttgcgccgccaatgcgggggaaggcgcagcttcctcaggagtgccgcaccaccccaggcagggggccaggcccccctcatcttcaccggataaggctggcggccaggtctttatggcgagtcttcggaatgaccgatgacccccaaagtttcggcccagcctcaccgaaaggtaccacggtagcatcaacccctccgagtccctccagatccacacgacgatcatagaggcggcgtggggtgacgaccgggtcaaggcgagtttcttccccatggcccttcatggccaagcgcggggatcgctcatgaacctgccacctgcctcggtctactcctgagaggactcttgcagttgagctccgggtgtcgtcgaagcccgggaccccctgtgctggctcttccatagcggctagttttggtcccgccggctggctacggtgctcggcccggctcaactaatcgtcctttcaagcttcaagtattttcattttttcaattcatcagcttaatacagcttgaagtcttatatttattttcccccgttcttttctcatggccatatgacgctcgcgtgttgcgcatttgtttgctccctcggtggtaaaagcccaacctctctcccatctacatgaatgtttcctcgctaggtgtgggggctaagttttctagccctattctagccttaagttgagtgtcgggtgccgtcgaagcccgggaccccctgtgctggctcttccgtagcggctagctttggtcccaccggttggctacggtgcccggcctggctcaactgtggacggggatcgctggctctagagtttttcggctctcacacacgggcgaaagtagtcgtccgtgtagaaggaagagatattgaaaggaggccaccgaaaggaaagatcaaacagaatgtgtagcgtggggacacaggcttgtgggaacctaacctcgtttgctaagtggtcgcaggcttcccaaagtggttagggacccatggagggaggccctcttcaagctaaaggtttgaaaggtcgcgacatgcaagcaaggtttgtgtttgcttcattcatacaaacgattctttgctaaaagtatgggggctacgattcctagctctatcctagccctgcgtcgagctttgggcgccgtcgacgtctgggtccccctgtgctggctcttccgtagcggctggttttggccccgtcggctggctacagcgcccagcttggcttgatcgtgggtgaagattgttggctatggaaaatttagtcctcgcactcgcgcaaagatgatcatttgcatagaattattattgcttatgtttatctctcgcccatctcttcctcgcggtcccgcggtacccacgtgtcgcgcgctggcttgcctcccttggtaacaaaaagtttgtattcacctcatccattcaaacgattctttgctagaagtgtgggagctatgattcctagctctatcctagccctgcgtcgagctctggtcgccgtcgacgcctggggtcccctgtgctggctcttccatagcagctagttttggccccaccagctggctacggcgcccagcctggcttgatcgcgggtaaagattgttgactatggaaagttcagtccccacgctcacgcaaaaataatcgttttgaatagatgaagtataacacgaacagaggttaacaagaggcaggggcaagcaaggtacgcggcgtaaggtcacgggcccgagagagtctaacaacatttgctgagtatatacaggaaataagttcacgacctaaggtatgggctaaactc

SEQ ID NO: 63045 - DNA, 3102 bp, Oryza sativa
ccgaggtggggtggcggccactccttcccaaagactagtcggaggaggccgccccccaatgccacatggccctcccccaaggggagtcaggcctgaggtggggtggcggccactccctggccaagactagagggagaaggctgccccaggcgccatgtggccctcccccgaggggggatcgagcccgaggtcgggcggcggcggccccttcccgtgactagggatcgggctcccccgaccccctctctaggtcaccacgtacaggtgcccacctactcgcatttatggtgacccgagcggtcgtgcggcgtgcagtgtactcaaccggtctgtgaccggtcgaataaccgatgggactggctagtgcgcctgtgcgctgcttttgtgtcaggcggcgtgcagcctgacatgtcccatcaaataatgatggtgagaagttctcaccctcttatcccagtgtcatgaccggcaatggtgacactgaaaaagttgtaatcaataaagctgtgagagctgccagaatccaccaaaagtaacaagactttactgtgaaccaatgctctcaaacgaatagcagtaggaaggtgagctcctgtcaactgcagaccttatcgctattctccgttacaaaaagacgagattgagaaacaggtgaaagaaatgattgatgctggtttaattacacctagtatgagtccctatgcatcacctgttttacttgtcaagaaaaaggatggtagttggcgtttttgtgtggattacagaagattaaatgctctcaccattaaaagtaagtttcctatgccggttgttgatgaattattggatgagctctcaggcactaaattcttctctaaactggacttgaaagctgggtatcatcaaattcgaatggtggaaactgatgaagccaagacagcctttaagacacatcatgggcaatttcagtttagggttatgccatttggtctcacgaatgcaccctccacctttcagtgccttatgaactcagtccttgcaccatttatcaggaagtttgtgttggtgtttatggatgatatcttagtttatagccctgaccttgatagtcatttgcatcatcttcagcaagtttttgttattttgaggcagcaccagttgtttgctaggaggtctaaatgctcttttgcttgcactcaactggaatacttaggacatatcatttctgacaaaggagttagtactgatcctgagaagacagcagcaatgctggcttggcctgtgcctacttctgttactgaattgaggggatttttgggactgacaggctattacagaaaatttgttcagggttatagtatcatagcacgaccattgacactcttgttgaagaagaaggcctttctttggactgatgctgctcagcttgcttttgatcagttgaagacagctatgagtaacactccaatgttagctttgcccaattttcagcttccttttactttggagactgatgcatgtgcttatggtcttggtgctgttttaagtcagcagggtcaccctattgcttattatagcaaaactttgggccctgttaatcagaaattgtccatttacgaaaaagagtttctagctattatgatggctgtggataagtggagatgttatctgcagagaggtccatttatcattaaaacatatcacaaaatcttgtgtcatttggatgatcaaatattggggactgaattacagcaaaaggcaatgactaaattgatgggtttgcaatattcttttcaatacaagagaggggttaataatattgttgctgatgctttatctagaatgccttcctcctctcaattttgtgctttttctgtggtccaaccgatctggattcaggagatgatcaattcttatacagtggatcctcaagctcagcagctactagctgagttggctgtgcattctcctaattctcaagggtattcattgacacaagggattattagattccagaataagatttggattggatccaatgcaggactgcatactaagttgattcaagcttttcatgcttctgcacttggtggccattctgggattgctgctacttatcatcggattaagaaattatttgcttggcctggtctcaagttggatgttgaaaattttgtgaagcaatgtcaggtttgccaacaggccaaacatgaacactgtcggcttcctggactgttagctcctctcccaattccaaaagaggcctggcaggacatctccatggattttattgaaggtttaccgcgctctgatggctataatgcaattttggtggtggtggatcgttttactaagtatgcgaatttcattcctttgcgtcatccattcactgcatcacaagtggctcatctggtggacaaaactgtatttaaaactcatggcatccctcgttctattgtgtctgatcgtgatcgtctctttactagcaagttctggacaactctttttgctacttgggacactcaattacagatgagcacagcatatcacccgcaaacagatggccaaatagagcgtgtcaatcagtgtttggaaatgtatttacgatgcatgactcaggctaaccctaagaagtggagccattggattcatttggcagaattttggtacaatacaaattatcatacatatcttggctgttctcctcataaggctctttttggggtggatcctcattattctcaagttcctgatctgacattggctactctgcctgatgtggtggatgttcagactgaaaggcagcacttgtctgaatttttacagcagcagttaactcgagcccagctgcgcatgaagaacaaggttgataaaggtcgttctgaccgtgtttttgctgtgggtgatgctgttttcttgaagttacagccttatgctcagtcctcagtagttaatagaccatatcctaagttggcttataagttctttggcccttttactgttttggagcgcattggagtggcggcttatcgtttggatctacctgccagcagcactgtgcatccggtgtttcatgtttctcaactcaaagctcaggtgccagatcatactccgtttatactt

SEQ ID NO: 63046 - DNA, 3794 bp, Oryza sativa
atatgaccttttttttttcaattatacggtagagtacgtgcacacaacactatacacatatttttatgggagtatccacaggtttgtccatgatgcacactaaaaagagcgagaccagcgacacatctttggtgtcactaaatttttgttgaaattatacttgtattattgagcacatcaaattttaatcctagtgggtgaaatcatacatttacaactacaccaccatactgttagtgcttacttacatgcatatgaaattcccaaatggatttatcaggtaatttgggaaatatccgtatagttaaaatatcttatattataggacggggtagtacctaaccttcaaatgtacacaagttaccgatccaatttctaatatatttttattgttgtatcccttattaaataaaaatatgtgtattgcattttcttaaatctgttaaagttccccgcaaaaaaaaatctgttaaagttaattaaaaaggaatctccatgaatttctaagagaaaaataaaaaaaatacaatccttgcatagttggctcatactacgtattaattattaaccctcgcagggttttatcgaagggagaaattttctttcaggtattatcaccttacgtgcagctattatagcgtgttaaagttcatggtgtcatcattgttggaaaagacatcaaaactagttacagaagtactcagagttatgagaaaaatcgtatggttttagtgcaaaattgtttcattttgtgtcaagtttagacttgcagtagatggttcattcgaagagtcgtatgagccttactgaagtggaagccgagctttcccccaacggcaagagtccaactgtccaagagcaatcaggaaactgcaccggcagattagtaccatccgattccgattctgatccgagcttacttctccttattggaatcggatacggatccattcctggcccaggagccattgcccggtcataaatatacagtactactccggaagaccccgcaagagcagcaaactcaaggaagccgacgcgacgcgacccgaccgatcaaggagattgcggagatgggcaaacgacggtcgcgatcggaatcggatgctgaccaccgcagcggtgcgtgcgccggcggagaggccaagcggccgcggccggagcagaagcatctctacctggcgctggacgactgggagaaagggtacaatctctacaaggttgacgtccacgcgatcggctccgcggacacggaggccgagtcgcaactgcccgagcctcccgtgctccagctcgaggccgccaagggcgcacgcgacgtgctgttcgccgccgtcggcaccgacatcctcgccctgtggcagccgaggtacgagacgacgcgcaccgccgtgtacgacacggccacggggcggctggacgccgccggccctcgccacccgagggcgctgcagcccatgcgcttcgtcgtcgcgtcgtccgccggcgcccgcgggctgtacgcgctgcacgggggcggcatgcacttcctggagcgccgcggcggcggcgaggcgacgaccgagccgcggtggacgtggagcacggcctgctcgtcgctgcgcctgccgttcgacggcatgcagcccggctcgccgcgccgcaccatgcaaataacctcgtacgccatgcatcccgacgggcgcaccgtcttcgtgtccgccacgagtggcaagcaccacggcacgttctcctcctccctcgacgacgacgacgacaacgagtggacgcgccgcggcgactggctgctgccgttccatggccagggccactacgacgccaagctgcgcgcatgggtcggcctccactcgccagggcacgtgtgcacctgcgacgtcccgtccaccaccttcagtagtgtggcggcggcgacgtcgcagccgccggcgtggcagctggtgaacgcggagcacctcttccaggaggatcatccggagcgcggcggcacgtcgctggtgtccacgggcgacgccgagttctgcatcgtggagtccgtgacgccgaaatggatggatccggtgtgggatcgcgacgagatcgacgagtacgtgctccgtgtcaccaggtttcgtctcaagcacgaccggcacggacagctccgtgcttcgtccaggtgtcgccgcgcttcctacagggtgcgcaagcatgactctgtctttgcgccgcaagcgttctggatgtaatcgtgttacactagttactaaacttactactacttgtaaattgtaagaagtccaaactttctcaatcacgaaaaaaaaaagaagaaaagaaaatgtctcgttcgtgaaaaaaccttgaacgacaccacatccgggatcagggagatgaacagcaggtggaaaattgcttgcctgcctcgcttacgagccgtgagttgtgacttgtgacttgtgaccgtgcgtgacgacgacagaggctgacaggcaatttgtggacgagcactgctacacgtgctttttttttaaaaaaaaagaactcttataaacaatgatgtttgatttaagtatataaaaattatagcaaatgcagatatactcatagtgttagtaatagataataagagtttagtaagacgaaattgtatagacttttccttcatggacctaaaccgccaggcccatgggcctcagcttctggagtctggaccagcgtaacacattgaacaaaacggaaagacagaaaataaacaaacaaacttgaaaagaacgaaaaaaataaaaataattgaacaaggaagatgaaaattatacgagaaaaaagagtagaagttttggagcattcccttgtcataaaatttagagacttttaggagaaaaaaaaattccatccaatctaccaaaccccatctcataccatccaaaatggtcgtatccaactaacaaaaacaaatttacatatcctatatacttatgcaattcatccccactaagttattttcctgcttcctggtgcagccacgtcacttcagaaggagaaccgccagatcagttttctacgccacgcacgcttgatccttgaacagacgcatatgctctccttcctgccggtgaacccaatcagccgactccttccatctccatgttgtcccctgagcttcctactgccgctgtcgttcgacctcccagcagttgcttgacgttctttctcctttgtaatggccgacttatatatcttctaccggctttccatcttattgagtctgtttattgctcaccttaattctatatatatatatatgatcctttgaagtctgaacaagccaattgccaatgcagcatatcgggcattctcgtggtctcatggcaactatacattgaccagttctttcaccttgcaagtgaactcctagcccattattccagcaagtctgacttggaagtcattggaaacaaaacaaggttcctccgatttatcttgctcgatattagtacataaattggccttttttttaaccactcgcacgagacggtgtgaacttctattgatagagcaggtaaaaattacaagattacaaccttggaaggtctaaccaggaaaaaggaaaaaaatataccaccacccacacaccgacagcgccaacacacaagcccgggagaaggcaagcaccggaccgatcgccgctagaccaacaaaggaacatagacgagatcaccccctaggggatgccaaaacgacgtctccaagaagagaagtgacgggagaaccaccgccgccgccgtccgtcaaggttcaaaggagccaagactaggctt

SEQ ID NO: 63047 - DNA, 2318 bp, Oryza sativa
cgactcctccaccccgctgccttcttcacctcgccagccggtcgggcaggccggtgtcgccgtcttcgcgccccagaccgtgtcggtgcccccaccgccgacgggagggagagacgaagccccgccgccgccgtccttgtggccgtgcggctttgccggcggccgctcgggcggcggcgaggcggcagaggcaggagtgggggagcgggcgacggcggcggtggtttctgcctcccgtgtcgcccgtgagggagacgatgcgggggctctctttcgatacgaatgctcaggttacagattaaattggccttaaggccccctttgaatcacaggaatgaaaaaacgggggaataggaaaaacataggattctgataggaatacaagtgtaaaacagaggattgcaaaacacaggaaaaacataggaatgaccgtttgattgagccgcaggaaaaacacaggaatttgaggagagagaaagactcaaaggattcttaacatgaggtagaacctcatgttaaatttccttcaaaatttgcatgggaagaggcattccataggaattttataggattccataggattcattcctttgattcaaagggctatataggaaaaattcctataggaattaaatcctttaaaattcctatgaatttcctttgaatcaaagggggcctaagttttgtcgtttcagctcatgccttttctccgtgcttttctgactccatgggcaagatttactatgtccctcactacgtgggaactctgtcatgtggtgtatctgtatttttgttctgtctatcctctacagggttttgatctattacgtgtactctgtttttcactaaaaaatatttcacttacccatgtttaatccccccccctattgtttttctacggatgggcctaataaatgatggtagcagatcttaatttctgggcgtaatatcattttaattaattccaatcaaaggttgttgcacttagaaacccagacttcatctgaagattcgctgctaagctgtttatagaatggagcaactgaaaacgaagaattaaaagggttgttccaagtagttcatcttttaaccttgcaggcacttcatacctcatatacattatttttgtttggtttctaagcccccagtgcatttgttgcttgaatcacagaaaactgatttcttagttcataaaagcactgggtcttcctaggaatatataatctagaatttcaagaggttcagcttccttttttttttgcataacacaattaattcattccttcgagttttacctcgcattaacatttatgttgtactgagaatgcgaattttgttctgtttgcatgctcattgttgctgacttgctgtggacagagtagactgttacatggaaaatggaacacacatactcacttgggcagtagctacaagcaagttaatcgatgtacaattttttctatcctcaatcaggatacattgattggtgataataactacttagctgtagcttcagtagtctccgtagaaaggattggcacttttacatttttagataatggatattttatacccggcttcatctatcaaaagatagactcatgccaattataacaaacgttctgacagagtaacacttggaaacaaaaccgagataaaagttcagacgactaaagaccgatgtgtctagctgataaccatccattggaactaaaaaattgcaaagctgatgactcaagatgttgcgatgccgcgatcaactgtgaacgcagatcctcatgccgttgcagcttcgcccattggcgtacccaatgcgtacccctgaatagtacctgcaaaaaagatttcggtccgtaattgtcaaacactaactcgtttcttgttaaccaaactgtccagaaaagcgctgctgctgcagttaacagtaaagtattttgttttttattaccccccttagaccactgttggaataactcaactaagtttgatggggtacttataccaaacaaaatatgaaccgctcgccacaagaacttggcaatatagcaatcaaaaaacaggtgttgaattgactcaggctgatgacagaaagcgcattttaaatcaccatgccaattcctcctagctaaattatctttagtaagaatgacacctttctttaagtaccacaaaaaaatttttatttttgaagggaccttaatttgccaaatatcctgtgaaactctaataccattactgattagtgcagcatacatcgatttgacagtaaaatttcctgaggcctgcaaagaccacacaaacgagtcacccccatcctg

SEQ ID NO: 63048 - DNA, 922 bp, Oryza sativa
gatggatctatatcagaagcagcaagtagaccgagcttgtgaatcaggaaatgcttagtgattactgttaggagtacatcattgtctaataaggttatacctatatcagaaccattagcccagttcaaccaatattttagcagaatgcaacacagtgttcaactgacataccagcagacatggaaacaaaactcacatggtattttttgaacaagtatccttgccttctctgcacgcttgagatttatatgggcacccctaccagcactatacctgctactatcctgcacaaggacacacaaaaaaaaaacccttaaagatcttaactaaatcatagaagagatgtgaaatatatgttgtcaaccaaggcctatatgaatattcagaataattaaaacaaaaatgaatcgtacttggttatattcctcaagccaagtttcttcatcacaagctgatagccatctgtctactttctccatgatatctttcctggttagggactcctccctcgcttttgctatttgtgtttcaatgctggaaagaagttcacaaggatccactagacctgaatatgaaattattttagaacatttaagatattcctcagcagcaattttcaattgtaagcaagagagaatatcagtagtataccagaatcaatcaatgcggttatcttctcaggtgctgtgctcatatcaggctccatatgcgcattactgcagatatcttctagctctaaccttttcttaagaacaagctccttcattctacttgccttttgtttagttagtctctcaacttcctcttctgtctgtattcaaataattatgttaataagtccaaattacagcttgtaaagaaacaagtatctcacagatagtagccgaacctcctgaattgtctccagcgacaggacactaga

SEQ ID NO: 63049 - DNA, 728 bp, Oryza sativa
ttgtatagatcaacttaatctgcaatcaaaaatgatgaaaaatttctatgttaactttgttttgttatgcatatgagttgaggatgatttgtgccgggtccttttgcattttagcttgatttaagggctcgtgctcaagtcccgatcctcaaatggctcgggtcggggctagtgcctggggagatccacatgtcgagactggccaggccgggaacatggtgaccgagggttatgggtgacccgattgtgggtttttgccgattcccccccggagttcaccacgccccggggcacggctcggttctgggccccgcttggcgattttagctgaccgaaccgagcccccgagggcaaggttgagcacgagtgaccttatttcaagttaagattctttagaaggaaaaacggcacagacacaacctttaggaaattgaaactgcttttattgaaatgctgaaataagaaaagtaaggttgtgcatgtgtggtagcccccggctaaccctgcacacccgaggggggtgcgtggttagcccgagcccgaaacctgacacccgaccccccccctcaggggtagaagcgacgaaggtgttcgatgttccacgggttcggcagctcagtgccgtcgcccgtggccagccgtacggagcccggccgggggacgccgatcactcgatacggaccctcccacattggtgagagcttgctcagtccagcacgcgtttggac

SEQ ID NO: 63050 - DNA, 1862 bp, Oryza sativa
  unsure (1)..(1862): unsure at all n locations
atgcgcccaagtgtccttctcaaattaatccgttaattaattgactaaccttttctctcttttttttttccaaaaaaagaagagtattgcattctacaaagtacaaacattctctttttttaacttctaaacgatgtattgcatgtagaaccttttcttatatagaagttatttctaaaaaaaagttaatttaaatctgttttttaagtttatataaatcaattgagtagattttcagtaaaccgttcaacctatataacaggtattatgactggtgttatataaaactcatttattatggttttataaaaccccgctcctatatatatatgtgtgtgtgtgtttagcacacatttacttaagtttttaaaatataatctatatggaatttttaattgttgattttaactacgatttaactcttcactactttcaatatttttcacatatgataaaattaattacagtttgaataaatgtgagatttaatggaatacttagaccatgaaacatgtggttatatgtcacaagttataacaatatggctttctaccattttttaccatgaaagtaatgatttctaaaatttattactttaattaatactcagttaattatgtattaatgaattttcttgtttcgcgtgccgcttaaaatcccaaccaaaccttacgaacgaacgcagccttaattaactaattgaaggatcaatctaacatatgatttgatcatgattttgttaatcggtattatgatcatctggttacatctagatataaactttagcatttaaatcaactaagacatgtacattctaaatattgaagagtgttccaaagcgtctaaatcgaacatgtatataatattaaaatccagccacacaaatacacagataccgtgccagtggttatatttaaaaggagagaataattgttctgaacctgaactatatattctaatctggaaatgagacagtggcttacaagctattntagagaacatattctctaaatctttgtaaattcaactaanagatggaaagtatccatacctgttaacatgaaaaaatcatgtcaatattttcacaaactgaattacatattttggcatcattttacggggcattgtagtataaaagaattgcactggccatggagtatcaagaagtcatttcaacttctggccggttctttctctaaatctcgaaaaccgcacaatgaacctcttgagggctcnntgaagctcttctacgcaatcatcacattacatgctagtagatgtttatgcacgatctatttctaggatgctctcaaattcttgcataagattcagaagcagctactagcatttatctttgaaatggaggtaccaatcgtgctctttcaaaaaagatacttcctcagttcctcttgcttgattcatcgatcaccagccgtagcatctaattaatctagctttcttcagttgacttgcagtaccaatgccattcctcaaaggatcaacgtgtcgcctccatgaagaacacatctacctctgaacccaaggctggatgatgacgagtcgacgcagctgctcttgcctcgcagcctcgccggattgtgtgtcaccgaaccatttcctatctatccgtgccatctcctcctgcaccgagggcagcatgaaggcttgctatatatatgtcgtgcacaatcggcgatcctatcggaaatgcctgaaagaaacacatcacaaaattgatcaaatcttgttcactaacccagtaaaattaactggagtagatgatgaagtattttaacagacgagagagacttacaaatccgaagcctcccaacctgtaggtcgggccaaccatgctgtaacct

SEQ ID NO: 63051 - DNA, 4180 bp, Oryza sativa
  unsure (1)..(4180): unsure at all n locations
aggggaaatttaaagtgggtaggagggaaagagagtggtattttcgcgtgcggtgatttttccgtgcggtcctcttaaatggaccgcacgcgaaaatgagcttattttaccagacacgaccagttatggtccgtctgcaatctagctaaatgggtccatgtccaggaaaatcgttttttattagtgtagctatgcctaaaccttattatgatgatatataagatggctgcatccgagcttgccaacccctatgcgcactcgcactaccattatataaatacccagtagcctgatatagattcacccaagggatgaccaggaaactgcatagcttagggcatccccaacgaaagccatagctataagtagcctcaggtgagccatacaacccgagactatacacggcatgggatacatatctcccaatggaagacacacttaaatgggccctacaaaatctgaggcaactgtttgaaagtactcgaatccagccacaatgtgtgtccctactatatttcacagcctggtctcctctttcttttttttttctccgcccgccagccagccaccccatgtggcctcatcttttctcgtcgcctcgctctccctctctctctcccgccgctcgtcgccatccaccacgtcggtaacaggatcccctctcccacgttgtccctcaccctccgcccgtcgccgcctctctctccctccgcacggcaagcaacacgcagggcaggatgcccgacatcgagcggggcgcaggacgcggtggtcgacgacgagcggctggtcaggaggccagatctggtcggccgtatcacagatccatcttcaccaggaccgccgacagctcctccatcatctcaccgcctctgactccttcccaccgccgtgttcctactcctagcgacaaggccgagggtagaagaagaaatctctggtgcgggagcagtgtccatgagtatgaggctaggcatgacatcgcccaacacagagcctagctccatggctcgatgaaaaggagccgaggagcacagggaggcacgtacctctactagggagcgcactagatggctccggctccaaaagcgatggcgagccgaacggcgtgaacaaggctcctcgccaacggcacccatttgggccgggatggccttaagctccgctagaattgaaaattgacggcaataaattgaattattaaaaatgacagcaagcttgagcgtttcgaaccacatccggtgaataggttgaaagtagatggcctaacctgagctctcctagtatttaaaattgacagtaagagattgaattatttaaaaatgacagcaagcttgagcgtttcaaccacaatcacaatataattcctcatgatttaatttttacacaatgaaaatttgatttgcgaattaacttcagcaaagaacnnnnnnnnnnnnnnnnnnnnnnnnnnnnnnnnngcggatataatagatttccgtgaaaatactcgagttggtttatttattcgttggagttttttttattcacaggtcagagaacacgtgcactatagagcattgaaaggctttgacagcaattcttgccagggtttaaatacaatacataaatcataaataaagcaccgactatttacgtccattgtgtttgtgtgcaccctgaatttcttataataacccaaaaagaaaaggtcaaattggctgcttttaaagctccagggtggagatccatttgctgcaattctgttgcttggctcaacaggcgccattgaattctgttactgccttcttagggaaagctgtaaaaagtacagatgataaaaacatattagtgtagttttaaacacactgtgcataccaacactttccagatcaccaaacttcccattgttttatcagaggcaagaaaccaaaagatagtcttgactaattattatccgaaatttttcagaaatatccaccaaaagtgcttcagcaaacacaatcagggtgaataaacaaagaaagattgaccagtccaatgataaaaacaatgaaattgcaggagccagttccctgcttaaattcatgcacaaaaagaggaggaaaaaacatcaagagagatgatgtgagtgaatgcaagagggaactatcaggtcaacactgcttttgcaacaatcttaacggaaataaaactgcttctgcaacttcactttgctagctccaaggtctcgtttgccccatcgctctcgtaatagcgttgttcataatcttgcccagctaggtgtgagttgggacccaggtcactctttgggtagaccccctcacagattttgtaaatgttttggtgattcgtgatctcactgaatctacccagtaataagaatgtgtggttgaagctaaaaaaaaactgatttgtttgagaataagaattggtcctgaagcttgcttggatgatgcatatgggcacatgggatacctccagagccctcttataactttgttgatcatcgtcataacctcctcctgaacaaagttctctacaccaataaatcagatactaatcctccagaccctataccatgtgagtgaacctaaagagagcatctccaagggccgcgacaagcctcgtgaacctttggtaagaaagagtactagaacatctgtaaacaagggaattacctatgcaaatgataatattttattggactattgagccatccaaatcaggaaaagagcttctagctagcaaccatttggtcagcaagaactagaaaacatctataaacaggggaagttgcctacgtcaatggtaatcttttattggacttttgtgcaacccagattaggataagagtttcccagtgatcgacttcaaatatgtggctcgagaccacgacttgcaaacaaatgctgggcttccttacacagcaatgcataatagaccacaaatggagccaatttgtatacttgtataataactgtgacaaaatagcaatccttttctataagaacagcattattacaataaagcctaactgaccaacataaattagaacattctgtacctgtttaaaacatgcatgattgagccttctgttgagcttctgcatcgaattccaaatatgttactgacagtattgactattgaaggtagaaaaattagaaaaaatgtaaagggaccgccatagaaaaagaagggcagtgaaacaaataatgtattgcctcatccatattgcaaaaaatcacattacctaccaactttccattttgctgtaacatgattatccttagcaagagctacgcctttgaactgatccacattaaaaattttgccttcaacaggactcatctacaaaatcaccatattcctcctttgtaaatgtgggttggttgggatggctgatgattgatctctccaatgcagccagcatagccaccttggccagtctggtttcatacttgtaatgaatacagcaatatatggttgtgaggcgggacagatgctctatgccaaacacaacattactgctgctggtgtggttttcttctgctaccatgcattcgaggttcagttgttgtagcttcggcaagcacccaatttcaaaagtcaactcaagcctgcaactttccccaccgattcggatacgttccaaggatgggaatccataactgctgctgatcctaagccttcctccctcctctgtaattacttcttccacatagagaatgagagagagcagggctggcagtcctcccagtgtactgacatcttcttgcgagagttccttcagatataaacctaatcgttggaggttgacaagtgagccaatccatcttggaaccctagacattggcgcctgattgatgacaagttcttgaagactcaatggaggagggcaccatggttcctggatgaagtcatctgctgatacggatgaaatatgaattgttagacaatgaaggttgtctctgcctagcttacatatggaagagatcattgctttcatatgacccttgtatctttctgccgcatcagcgtgatggccaggcataaatatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63052 - DNA, 7814 bp, Oryza sativa
  unsure (1)..(7814): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcttgggttatggactccagtaagtttcatattaatttctaaaatttatagaaaactatgagtccataagccagggcctagatgtggctcctggagcctctgcttatgactgataagccaatcaggagatgattagattgatgagactagctcacttctaaatacgtggtcgtgatatattacggcttagagcgttacatgtattttttcgatagagttgatggtaaaacgtagttttgtcaccgaacaaagaagaaagcaatcgctatttgattacttgtacagacagaactcacgctgcaaattcgtgtcgatcttgtacggatagacagtggctaattttgttcaccttgacaattccgtgaaaaattaatgatactttactgttggcctaacatggacagcaaatggagaatggtactttactgttagcctaacatggacaaaaatggagtccccatgagtgtggccgcaacacatgattggagtttacactgttcggcccatgttgcacgcaagttgattatccctggacgaactagttgaccaatgaagttagaggaagatatttttgtaaatttcaaaaacctttcacaaaaatctttataactatggcctggattagttcctaaattttttccccaaaacataacatcaaatctttggacacatgtatgtagcattaaatatagataaaaacaaaaattaaatatacagtttgtatggaaatcgcgagacgaatcttttgagcctaattagttcatgattagctatataagtactacagtaacccacatgtgctaatgacggtttaattaggctcaaaagattcgtctcacggttttcaagcgagttatgaaattagtttttttattcgtgttcgaaaaccccttccgacatccggttaaacatccgttgtgacaccaaaatattttctttccgcggactaaacaaggtctatctgtctttatattccagcaccttttatggtcgctacaaagcttggattaccgagatttggttgtgttaagactgttagccagtatcacgattgatatgacaggccaacatgaagttcatcttttcacactgacggtgtgtttagttcacataaaaattgaaagtttgattgaaattggaacgatgtgacagaaaagttgaaagtttgtgtgtagaaaagttttgatgtgataaaaaagttacaagtttaaaggaaaagttgggaactaaaccaggcctaagattcagcacttccttcgatttgcccggaatcccagccatatttaggccgagtttagttccaaactttttcttcaaacttccaacttttctatcacatcaaaactttcctacacatacaaattttcaactttttcatcacatcgtttcaatttcaaccaaatttctaattttgacgtgaactaacacacccctactccaaaagtgtcttgagttggttgtaattgtgacttcaatgacatgccttacctcgttcataaattgtgactacaggtgcctttataataaagcactctcttatttacttgtttcggtcataaatatttgccattaaactagggagtagatatttgatgttggggtgcgccggcgctgctcaattagaattcttgttagcaggatagtagtatcaggccctttctttgatgctttgctagtttcggagtcatttacttccttggagtttttcttttcttcccctaaccgttttttccttggcgttccttggcagtgacctgacctcctgctgttgtgttgtgtaattgaaattttactttcttctaatatattgacgtataatatttttgcgtatttgcgaagaaaaaaatgatgttgaacttataaaattcggatcatgaaccaatttgtcaagtgcttaatattgaacgtaatatggtatagatagatttggcttgaaaataactatcacaacaccatacacttgctaaggctgtgttctttgtgcgttgggatttgggaaccaccatagattccacaatgtttgatttgcacaccatacactatcactagcatagaaacacccattactgcgggtccacaattggctttgttgtcaaacgacaactgcgtcacgtcgaaggacgtggttctctcaacaatagtcggaagtaaagataattgtattacttggtcaaattttttcgggatcccccattaggctatttataaccctatggctcccttcttttaggttttgggcttataggggaatttacatggttgcccttatgatagggacattattgagggcacactgtgtcctttacatatacgggcttctaatgggccaacagactcggcccagtcatggcgaaggggctcctcaagggcacgacggcccatcgggccttcttctggcaaggcctggctttggcgaagctcgcgtgcctcgcgatatggctttcatcatacagccttcgcccgcgtagtcttcttctgacaaggtccatctccagcgaagtccgtgtgcttcgcaacatggctttcgccatgtggctttcacccatgcagccttctcgggtgtggagcgcaactgcgtcccctcggtcttcgccgtacgtcttcggcttgaatccttgctagcgcttcggtttcggcaggtctggtcgaaggacctcgtggtatacctccaacaagcccctcacgggcaagggtgagtatggagctctggctgagaccgtgcaaaatttatggtatggcatgaggcgccccctttcggccgatgttcctactgaaacctgttctcgttcctgcacaaattttgacacttttgttatttttgctagtgctttttcccaggcaaattgtcttggaccttcgccttctttatggcgaagcttttgtcttggctttactgcctatgaatagtgttgggctttttgggccggctatccattgtttttggctttttcacttgttcgggcccctctaacgggaaattaccgttccgtatacccccctagcgacacgtggcaagctctaattgggtggtaggcgaaccgtcgcgtgggtgggttatatatacttccccccgggtcgcttttacttttaccccgagtcactttcaccatctcctctaccgggagtattgccctgtctgccttttgtgttcaccggctcttgttgtccactttgactagcgtgatctcaactccttcactagcctttctgtacttttcggtcatggctcctcgtaaacctgctcctgcttcgaccactggtctagacccgggaaagatcgacgaagagcacaccgggtatcttggtgcttcgctcattgatgaggcggagctagcgaagctggtttcgatcagggtcgtgaccgaagaacaggcctttgcctctggcaaggcggtggtgccgaagcctgacgagaactagaccgtagtcttcgtcgcattcttcgatgcgggactccagtttccttgcaatgtcttgctaccagagatacttcggctttttgagattgtattgccccagctcagcccttccgctttggttcgggtcgccatcttcgactagacgtgccgaaccgcgggttttgagccgaccgccgagctgtttggagcgatcttctacgccatcgtaaattcgaagacggtggtcaccctagccggtacccgaaggacggttttcgggagcacgaattttaacttccaccccgagcgctccaatttatggtctgtgaacgtgtccatgcctaaatgggatcgtcattggatgtcgatgtggttttaccacaccatcccctttgaggccgcatcggacgcagccaagaccatgaagtggcagtgtagggccatcgcgcccgtccgaaaacccaaagtggtgatcgacgactcgatggaagcttgcttcaccctacttcggaagatcactcttcggcttagctgtcatgatttggtggaagagttctatatgcttcagattcttcccctttagcagacatggcaagtcgaagtaaacaaggaggaggaggcggatggcctaccgaaacttgtgctccccggaggggcgaattgtgagtttgctattcaattcaactttttttggtgttattgtttttgttatgcttccccttcttattgtgctcattcctttgcctttatttcgatagtacttatgctgcctaaggccgaaagtgaggcctgaagaatgatcggggagcttaccataaacgagcatagccagctgcttactcatcagatgggtggctgggcgaaccgtgttttctccggcgagctgccggcctgggcaaaccctatcaaggtcgtcatcattgacgaagatgatgccgtaccatctaagaagcgcaagtgagttaaaggaagttttctacgtgaaggacatggctagcaaaccaaagaaggggaaagggcccgatgagccaagacgccacgtggttctcccaggcaagaggaaaatcgtcggagtcaaggataagactgacgaacattacaatctgtttgagggacaacctccgttcgcagtgatggttgacccgaacatcctcctatcaaaggaggagaccccttactcacgtaaggatcatagcgaaggaacaatagtgaggagaaagtacgtgaggaagacagtgacataggttgttgtatggacgatgtaaattatttgtaatgtactgaaggtcaaacagcttggattaatttttaatatattctccttaacttcatgattttatttattatgaatcataatccatttaaatatgccatatgctaattatatgtgactatagatatttattaggatttttaaaccatttaaatatgccatatgttaattatatgtgattatttgtatttattacgatttttaaaccatttaaataggcaatatgttaattatatgttattattggtatttattaggatttttaaaccatttaaatgggccatatgttaattatatatgattatttgtatttattaggatttttaaacaatttaaataggccatatgttaattatatatgattattggtatttattaggatttttaaaccatttaaatagggaaggccatgtacttatttgacgagtgaggcctaattattatttttggatacaagcagctccatgtgaattcatgtgtatgtctgttcatttttcgctacaaacagctccatgatcttttgtattaccagataggacgacgtggccttgttcacaaatggttgacactttcgtgacgtaagtgttgtgttttgaatgccttgcaaatcatgtggctgacacgacactcactgtatcagtgttagatgtaggatcgaatcacaataactaagcccaaccagaacggggtgaatagttggtatacctaaaaacaaaaacttttggcggaaataaaagttacccttgaaattaacggatcgcggtctgaccgaagatgaacgtcggtttgaccgatgtagatcgatcggtcgaaccgccaagatcagctgccgctagctgtcgccgccgccaatctgaccgcccttatgccgccggtctgaccgctgcttgccgccggtctgaccgccggtatatcgccggttagaccgccgagacccggtaaacacaaatcgaagaacttttaaagtggatgacgactttattgattctctctgtgtttacaaagtacaccaacaacactccttacaaaaatttcgactaaactcgaaaccctaactcaaaactcaactcaattgctctcaaaagcgataccgggaagcctcacgctccccctctatttatacccgaggtaggcagtttaaagtcacgaaccaaactcatactaggagtcctaaacaccttaggaaaccctctagtacaagaaacaaactttacataaccaatcgtaccaaatttagactccctccaaattcgactccgcatcccatacgcacataatatctccatcgtatgccatatggaatctccatcaaccacgtgcatcaactctagcctaagtatcccgcatgatgtctgaccaccacggacgtcgtcttatccccaagccgactcccggtccatcaccgcaaatactctcccgagacatcgagtcacctacacatgaaataaacaaaacaaaccatattccgagaccaaactatcccaacttgactcattagtagcaaacaacagcattacatacgtatagtatccatctagaagccataatcatgaaacaatcacggatatccaaacaaacaacccgaaaccgaaaccgacacagagtcggtcggtcagaccgcgggctggccggtctgaccgcacgcataccgccggtctgaccggctaccagagcccggtctgaccggtcacataaaatgacagcatcctgtaaattcacttgtaaaatccaatcatctccaaaaccacttcgcaaattaattccaaataataaaaccaataatctccgatgccaattgttcatcacaaaataataataaaaacacctttgattttacattagatgtctgatattaacacatgtcaagtatttctcattgaattataactggtgatgaagtgatacacttactatataatcaatattttttagatggatatagtgatttttcagtactcactgtattatgaaatctggtctaatgcatctggggtatttactcaattttttagtttcatatcaacgaaaattggattagctgcaagcaatctagattactcccttttacaaatgagattgttaatatatttttgccctgttcaggtgaacaaccttgattcatatagggtatcttcattgcggtgccacaagtactactgcatctcagcaaactagattggtaaggattgaagggtttgttgtataaaataggccagatgattaacagctggaaccaacaagattgtaatataccctataatgttagcctactcctttttccagatgcaagatgctatcgtacactaaatttgggcttcattttgttctgcttttatgcctccaattttttatcagtgtactgattttttgttgagaaacacagtacaaacgcaggcgctcacaacatgcgcacactcacccctatgaacgcgcgcacacacaccctacccctatgagcacctccaaaagacaatctatcaaaagcaacaggccttgtacaatctttttattctaaatgactgatgatagggcaccatgcaggatttgtcgccatgttcttcctctccgtccacggctgcaagctctccaaccaggtcaccggatccccttatttgtagggtcgctaggtaaatgagttgcttccatgttctacttcaatagcatttctgagggcaacaattcgatgttggcaggttttaaatggaccaactgcatgtaaatacaagtttgcattgcttgctggaccgtagatatttcatattgatagccgcagggtgaaaatatctccatagcttcaataagagttgagatagttttaggaggtattatccctatatctaatatctatctcctaatttgtctttgatgtgt

SEQ ID NO: 63053 - DNA, 4987 bp, Oryza sativa
cctttggatatatgcataaagcattaaatatagattaagaaaaactaattgcacagtttgcacagaaatcacgagacgaatcttttgagcctaattagtccattattagccataagtgctacagtaactcatatgtgctaatgatggattaattaggcttaataaattcgtctcgcagtttccaggcaagttatgaaattagttttttttccatcttagactaagcaaagtatcgaccatataaatggaggagctcacttcacttctcaacccactcaagcaagctcaattgctcttcatacattactattagtagtatagtgctaagtggagtagtatagaatagtgttcggaagtcctcggagtcttcagaagagttttcggtatggctctagcagctcttgtaatattctgtaatactctccaaattaatgcaatactcttctttatacatctttggaactttgcttagtctaattactggtcttactttatatctgcattatgttaattgtgtaggtagcctaccagagaggtgtaatggtgttggtttaatgtctgatttatcagttgctctatttcgagtgcacggatatagagtagtatttagtaatgtgagcatggtgcttagattattaaatattattaattgggcatatatgttgcgggacagtagaggtgggccgttgatggtgacagctcagtacgggtattattcctccacgttagtgtatattcctaagacaaattcctgggagggtactccttcgttttagctccggttggacggccatgacaggctgtcgtaagaaactcggcaactcggggtggtctctcgaagtaccaggaggacacttttagggggtattggccacatgattgtacattagtagatgtaaagcgaggatttgagtgtatactagaagtatatgaatcgaatgctttctatttcttttcccactaagttagaattatttcatgatgaggatttaatcagctttgcttcgtgtcactctacccctgtattacacttaacccctgtttaggctttgacaattataagtagtatatgtataaagtgcattagcaaagttcactcttattatcttcccttgggattaaaaatatgatactttggaatacttccgggtaaaatgctacaattgtatatccgtgcgcttgcggattatatctgtaaccataaatatcctaggggaatactcattcccagcaatgtcgttaagaagtactaacaagcatttctagcgtcgttgtcggggaagattaataatgagttgactaagctaataactttatatatataatacctctgtatgagtcactatcctttgcaggctaaccttgattgcttttatttgtgtcgtgaaaagaggatagtgtataactggtttcaacttaccggaaaactttaacgagaatccatagtccttcttccggagagtcaagcctcgtgtcatccctccacagaagaggctctcttaaaagaaactagccatcccaacgtcaccaagtttcatgaatagggccaagaagacccttcgcgaattcgctgctccgtctgctgacaacgtgcctgttgacccggctgtcaacatgggacacatcgacttcgatcttaagagcagcctgataactatggcgcaggcaagcccgttctgtggcaagctgaacgaggacgcaagcgctcatctgcaacaatttctagagatctacagcacctacactgtaaagggtgtcagttcggacgctgtcaggcttcgtctgttttcattctcactcctggggaaggcgaagcaatggttctatgcgaaccggatgacagtcaacacttgggacagatgctccaccgcgttcctctcaaaattcttccagatgggcaagaccaatgcctttcgtaggagaacatcaagcttccagcagactagggatgagacgatattctcgaagcatgggaacgtctgcaggagtatgtggccacctgtcctcatcatggaatggacgactgactcattctgcaaagattctacaatggactcattccctcatctggaaatcatctggatgctactgctgggggtgccttcttctcaaagacggtccgtgcggccattgatcttattgagaagatggtatccaacatgggatggagcgaagaacgactctagaccagacaacgcggcatgcattctgtcaaggagacggagatgtttgctgctaaactgcatctcctgatgaagagactggacgatcaggagaaggccaaaccgcaagccactgtcaaggcattagactcgcacatcacatgcaaggtctgcgagaacactggtcactcagggaatcattgcccggagacccgtgaggaagccatgttcatggggaataatggctaccggccgcaaggaagccaggggtggaaccagccccgaccatactatcaaggaggcaacaacggcaacaataacaataacagtaacttcaatcagccctccgtgaaggacttagtttttgcgcaggctaaaacaaatgatgctataaacaaaaagcttgccttgaatgttaaagttcttgagaatataaatgtcaagctagaaggctttgcttccgctttccaaaaccagctgagcttcaacaaaatgatagactctgctggtgcaactagactctttagtacctatgaaggagacgggaaggattccggggcagcccgaaccttccctaaaaaaatgttaaggcgataaccacgaggggaggaaaatccactcaggatccgccatatcctaacactatagggaccaagcaagctagaaaggaggcacagcccgctagcataaatgaacccgaggaagatgaggagatgcagctcaacaagatcgcgccgcaggaatactgtgacacaacgcggctgccgtttcctcaatgttggaagaagccctccatggacgagcaatttgctcggttcatggatgtcatccaaaagatccacatcaacatcccgttggtggatgcattgcgggtaccaacataagcccgctacctaaaggacatcccgaacaacaaaaagccgttgcctaccatggagatggccaagctcatggaggagtgtagcaacgctatactccaccggctgccggaaaagaagaaagatccggggtgtcccataatttcatgctcaattgggacacaacacttcgatcaggcccaatgtgatcttgaggccagtgtcagcgtgatgccgaaggacgccttcgacaagctgaactatacggggttgattccaacaccgatgaggctccaactggctgactcctctgtctgctatccagtgggcatcgccgaggatgtgccaataaaagtcagggatttcttcatcctagtggatttcgtcgaacttgaggtggagttagataaggagacgcctttgattctggggcgtccatttttgagtaccgcggaagccaacattgatgtgggggctgggaacatccggttccacatcaatggaaaggagcagaaattcaactttagaccaagagcagagcaatgctctatggtcaagatcaaatacgacctgaatgcacggaacatgaaggaagttgaagtgcagccgccaaaaatggacagcctcgtaaccttcatgaagaaatacccttcatggtgaccgatctatcccaatcacttgatttatgtatatatcgacgaaaatattatgtgtcattgatatctacagccgatcgaatagatttactcttacttattcatgactgccgattgattcaaatatgacgtcggctcaaagataaatgatacgtcatcggtggctagccgatcggctatcgtttaaggatttaactgcgatttctttgtctttatttcttgttgattgcaggatcaaatcaactggcacgctcacgaatctaaaggcaagatttttggacctgcactgaagttaagcagatcttccaggcctcgtgttttcgcatcaacatttatggtattgaaatacttttcgagtatttgaatgcctactttacattatgttcatgttatattgaatatactgctagcttatctaggagatgctttggtgcaggtataatgtttgcatatgcaattactctatgtcatgacgatgatattagagtagtatctggtagtttagacgtcgtgtctagattacgagatatcattatttggggttatatgctgcggatgagaggtgggctgctgatggtgacagctcagtacgggtattcctccacacgtgtatatagttctaagttaatttcctggggaggatactcctccgtatttagccccggttgtatggtcatgacgggctgtcgtgaggaactcggcagtcaggggtggcttctcgaagtaccaggagggcatcacatagagggtattagctagtatatcagataactagaatatatgtatactatgtatactagaagtataggaatagattctctttctcttttctttccacttagcttagatattttattatgagaatgagtagcttactgcttgtgtgtcactctacgcttggattatcttaacccctgcttaggatatgattatcacaaataatatataaattattagtcaagttctctctacatgatcttcccacggtataaaataaatacgatacccttgtaatactctcgggtgaaatgctacaatggtatatccgtgcgcttgcaaatgaactctataaccataatataccagaagtatttatgcgccattgctgggaattatatttctaatagtgtcgttaagaaataccaacagtgatctaaccctaagttattgtgagatatgatatagtgatatagagttgctataatctagatccaagcttgatttaaattctggatgatttgttttttgaaatgataaatttgcatgttcctcatttgatataaattcctaccacagccaaatatagtttgca

SEQ ID NO: 63054 - DNA, 6543 bp, Oryza sativa
aaaaaagagggaaaggtatggctatgagaaaataataaattcttgctctcccaaaattagagcatgatgaaaaaaaaggaaaaagaagccataccctctctatgaaaagttaaaggatattttggaggaaaagcataagcacaaaggagaagcattttctttatctacattttgttttccatcatattttccgccatacattccacacactttgcacgatcttgatctaagtatgacttgctatctgctctagtctaaatttttgacatagtaatatatgtgaatgcaagtattcctcatttgatctttaccaagctccacatattcaaccttagtatagggatcgaaaagttttgtttcccttttgtcctttactcggaacgagcaaaggttcaagcttgggtggtttgttgacggttgttacagacaaattttgaccgtcaatataactaaaataatggagaattagctatacttacaatgcatatttgttttcaaataatatagttccacttgtacttggagaataacatgttgcaggaatttatcaaataaaataaagagaaagtgaagaaacctcactcctaagcaagcaaatggataaaatgggcccacaagtcaggtgtaacagtcggaaactgaccttaacttccacaaccacctaaaggacccacttgtcagccactgtaccgaaggggaggtcggttggagccgaccctggttcggccgaaccaggggcaagccccaaactgttgtttattagaacctttcggaagatcgggaaccctagtgcacatcaggagtagtatagaatagtgttcggaagtccccggagtcttcggaagagttttcggtatggctctagcagctcttgtaatctcgtctataatacattccgaataaatgcaatactcttctttatacatctttggtactttgcttagtctaagtattggtcttgctttatatctgcattatgttaattgtgtgggtagcctaccagagaggtgtaatggtgtgggtttaatgtctgatttatcagttgctctatgttgagtgcacgtgtatagagtagtatttagtaatgtgagcatggtgcttagattattaaatatcattaattgggcatatatgttgcaggatagtagaggtgggccgctgatgatgacagctcagtacgggtattattcctccacattagtatatattcctaagacaaattcctagggagggtactccttcgttttagctccggttggacggccatgacaggctgtcgtaagaaactcggcaactcggggtggtctctcgaagtaccaggaggacacttttagggggtattggccacatgattgtacattagtagatgtaaagcgaggatttgagtgtatactagaagtatatgaatcgaatgctttctatttcttttcccactaagttagaattatttcatgatgaggatttaatcagctttgcttcgtgtcactctacccctgtattacacttaaccgctatttaggctttgacaattataagcagtatatgtataaagtgcattagcaaagctcactcttattatcttcccttgagattaaaaatacgataccttggaatacttctgggtgaaatgctacaatggtatatccgtgcgcttgctgattatagtaactgttgaccatccttaaatcataagattttaccatcaatacttgcatataatgaaataaaatatagtatccaacttagtggtagggtttattactaatcatttccactagtgttggtgaaatatgtgtatgcgggtattttgagaagaaaacacatccgtcaagcgacaaactgtacctccgcgcattcaggacacatttacatagattggaggccccataagtcagttaaacacctccaaatggcccaatccatcgggccaatgggctgagggcctcaaaattagtgtccacgaggaaaaacgggccgatcagagccgtcctgagttcgatcgaaccgttcctgaggctgttgatcgccattttccatgtggacggccctgattacttcctgatggcagtttaggggcattttggacatttcacataagctgtaaccgtcatacctgcctataaatggagtagctcactctcatttccaacacacaactttgagctgaattacaagaggctctattgtattttttgtacattagaacaaggtagagagtgaggggaagctctggaggggtgcccggaagtttggcgctcatccgacttctttctcgacgactgcagtttcttaggaggaattctggaggagtaccggagctggcggtacactctgctccaggttcggagaacttcttctataaagtaagcatttgtgtttttttcttatgttatttaattacttagtctaagtaagatatatttccatctttgtgggttcattgtttagtattcgtactaaatgctctagtactaggactacggatattgaaggaagttcctgcgcaaatattagagtaataattaataacttagacgtggtgtctaggttagagattacctttgtttgttgtgtatcccacggatttgtcagaggtaggcggtaggtggtgacagccctgaatcccgtcccagtaatcctccacattcgggtacatcatagagctatagccggaaccacgctggtagaaaagcaggggttggtgcccaaagctacagataggaaattacctttgcttagcgtagataattaaaacacatagaaatacctctctagcctagcttgcctacctattgttgatgtccttggatagtcttagccttaggtagattacacacgttccctgagttcaatatccttttgggatcactcgaaggtgaagtgctacatcggtatttcgtgcgcttgcggatttatctgtggtcgtaagaaataccaacagtaaccataaatatgccaggactatttctggcaccattgctgagaatgactattcctagtagtgtcgttaacaagtaccaacacccaccattaaagcatattttagtttaattatggtggtacatcataatataattaaggacataattataatgattcccattgtgagctaattgatctatgcatggctaagtattgctaaaccaatcatctagtcaattataacccaagttatcaatgacataagatattcaacaggctaagtacgataggcatccatcccacatgacattctaaaacaataaatttaatagaaagcggtggattttgtaaaaataggttcaacgtgatcaatgttgtatgtatgacttgccttgctcttgagctgacgaaacctcggtaccacttcgaaataaactggatcactggaactggcggaatctagacgacaaacaaagtacacaagaaatacaagcaataaggctactgaaacaacaaaagaaaccaattttaatggatgttatacattttaacggattcactgcaacttgaatgggttaaaatggagctcaaattatttagttatgaattttacaatatgagctgcatgattactaataatcggaaaaccataatcatttattacatattattgcccaaagataaatagatcaatagaaatatatctccggtaagcaagtctcacgagttaatgactcaatgagtcaatacttcgtgacacgggaccatccaaacagtcaactgaaccggcgaacggaaccggcggcttagaacgactacggctaaaccggtaaactagacacggtttacagtagagatttggtaaacgataggccgataggaatttagggatgcacctagggctttgcgactcagctaccgagctacgggcagcgaaccaaccatgaagacgttgcgggagagcggtggcggcgatggctaaggctgcggctcagctaggcgacggctaggcgcacggcagtggcagctagggccgcagcgcggcggcggcgctagagcggtggcgcggcggcactatggtttagcgggactaaacaattagggttacggcaataacgctaggaaaaataatacctaaactaggggatcacgggaaagttcctcaccaaactgagacgatcggcgaggaggattcgacgatgatgatccggcggcaacacatgggaacaacggcgacgctagatgagaaacaaacggaatagaatagctaaattgatggttgcagtggcaaacacaccaatagagagggagaacggagtatcgacgacgcaacggcgacggcgggaggcgacgacagtggccggtggcagcagcggcttgcggctaggactaggcaaaaatagattagaaaaaggtgggggactaggacttatataggagaggaaaaataggagaggaggtgggaccggtggggagtcggattaggaggggaaaggaggccaactcggatggggagagggggagggcgcacgcggctagggggagagagagggcgcgcggccggctagggggagggagagggggagggattaggattaggactaggactttcccaaaccggaaaagaaatgcgctgttatttttggaaaagaacggaaacagaacaggaagctgacttagactcgtctcgtcatgcaaaacgaaaccgtggatgaagagaggagtgaatcgagcacattttaggaaaagaatggaaacagaacaggaaattgactcggattcgtctcgtcatgcaaaacgaaaccgtggacgaagagaggagtgaattgagcacgattcacgaccaaaggcgggagagaaaaaatattattaatttaaatcctgacaattttttgttgaacgaataaatcctgacaatttaaattaacaacatttattccgatggtttttgagtcccgttaatggtttttgagcaaagagaattcgggaaaaaaaattctccctgacattttcgattattaaataccttggtaatttgggttttatcttgtttaactaaagtaatttctatagacaatttattggtgaattagaaactaccgaaaaaggaaaactccgggtgtgacagtatatatagcatcgtcttttggaggacaaaatttaaattcttagcgaaggcatacgtaaccgtgccgtaattaattaaaggatattttgccattatgttgattgagtctatacttaatcgatccttctgttttgtcttgtattcctccgaagtcatcaacaacttatcaatattgcagactaatttaccataacgtctctattgctgaacttcaaaattttccaatcacataacaacggttcgttgaaacggtgaatatatatagaccacgttagcttcgtaaacatccttttaagagaaaaaaaactacgatatcctggtaagatggcagttgggatatcagcatccggcatgattatgtgctcgaaaaagtgtggactaagtcaagtcaaaattatatatgcataatgtgcttatttgatcatatatatttttccaaaagataatcgcatagagaataaatttgtcttgtgacatggaaagattggatttacagaatcaaacttcttggttacacactaatatacaccacgaaaagtgtacgagttattactattcgttctaacagaagatgttttgcctttttctatatattcattgataaaacattgtatatttataacatacttaaaaaaatattcatgcattgcaacaggttaaaggaattttaattttacatattacttaagtccacactcagagtaaaatattacactcatgcttggacctgtgagcaaaatttccatccctacacactcaggatatcctactctagaaaggaagttcaaggttgatctaaagagctggccattatttgctggatgaaaataggagccctgctatcatttttgcatccatgcaaaatctatcacatcatgatgtccatttatattgaattatagctcatgatgtcactataccgaattatatatcattatatacctcatgatgtcaggacgtatgatgtcactatatacaccatgatgtgaaatttggaaggtttttatgctatacgtccataaaaacattgtctggatatccttcaatctccaaataactctgtcactatatacaacatgcgtatagcttgtgcatggatgcaaaaatgatagcagggctcttattttcatcgagcaaatgatggcctgctcctttcgatcaaccttgagcttcctttcgagattaggatatcttgcggagtgtggacttaatatgtaaaattaaaattcctttaacttgttgcaatcactactagaagaattgtttttacaggcggcgaaaaatatatttcccaggtggagaaaagaacctctcgtaaccaaagacctacaaaaatagatgattcgaaaataatgttcacagccggcatctcggcatctccatcttcgtaggcattagatccacccgcctacgaaaatattttcagtgcacgaaaaaaaatctgttgtcagttggcctctccctctagccgacggctctctacctctatacac

SEQ ID NO: 63055 - DNA, 14961 bp, Oryza sativa
tgctgtctgtgccaccgccgcaggcggcggcggacggatctaggaggaagggaaggagaggattggagcgtcaccgccattgtctcctcttccgtctagatctgggagggtggggaggggccagcgccatatttgagatgaaggggggagggcagtgcggacggctgtcagctcccctccttggacgttgccaccgctgcctccttgcacgcgccgagccgctgacggccactggctcctccttcttgcatgcactgacagtcatcggctccacctactttgacgccgccgcggcctccttacgcgccgagccgccgacggcagctggttcctcctcgtccttgtgcacacggacggccgtcagctcctccatctcctccgccgctgccgcctccttgcgcgtgctgagccgccagctcctgcttgcgcatacgtgctttgaggagatggagagggacaggccggttggacgagtgaataaggataagtagtccgcatgtgaaaagtaatttttgctggcgaaccacttaagaggtctgctagcgaaaataaaagtatttttacgggcggttctcttaagtgatccgtccggaaaaattgatttttgcaggcggacgacgatcttacccccggttgctattttcgtaggcggccatttgggttcgagggacatatccacctgggaaaaaataagcatacatctgcaaaaatgattcttctagttatgaatacacgaatatttgttttagtatatatatatatatatataacatatatacaatgtttcatcaatgaatatagaaaaaggcaaaacatcttctgttagaacgaatagtaataactcgtacacttttcgtggtgtatattagtgtgtaaccaagaagtttggttgtataaatccattctttccatgtcacaagacaagtttattcactatatgcgattatattttggaaaaatatatatgatcaaataagcacattatgcatatataattttgacttgacatagtccacccttttcgtgtattaataatgccggatgctgatatcccaactgccatcttaacaggatatcgtagtttattttttctcttaacagcatgtttacgaagctaacaaggtctatatattcagcgttgttcaacgaaccgttgttatgtgatcggaaaattttgaagttcagcaatatagacgttatggtaaattagtctacaatattggcaagtcgttgatgacttcggaggaagacaggacaaaacagaaggatcgattaagtatagactcaatcaacataatggcaaaatatcggaggcgactccccgtcgggcggccgatagggaggggtaaaatcggggcgctgcagcgccacgtatgcgtgaaaaacactttaaattattttttcttttaaattatttatccaaatcatgatccgattgcaccattaaattcgttgcaattaaatctttaaaacaagaccacacatggatatattacaacgaaatttttttagcttattattgaattatttttaaatgttgcacgatgttccaccaggttgtcagggttatggataccacatacctaatagtagtcgactaaatttcggcaggacccaccacataccatgtcctatacggaaacaaccttcagatataggaggagtttcatataaggaaggatgaatagagtcctacatggaaacaacaaggactactcggattgtatccatattggttttccctacttctacttagacaaggggacacctattggtataaatacaaggcctcctaggaggagaggggagacggaacaatagatcaagacacaagatcaacatacaagccaacatgcgccaagacaagacgtcggatatcgacttcagagataagcatggctagtcccctacggtgtctatgatactgatatgagagatgtagcgctgtctttgatcttgctgaatgcggattcgaggaggaaggctaccctgttgtcgactacgagtcagcacttcagaccgccaagtcgacaacagttagataggctaccccaaatattgtactggtgtgattatggtgaataagagcaacgaccagcttcggccaacaagggtagggttattacctgacaattcaggggtccgaacctgtataaaaatcctcgtctccgtctcttttacctcaatcttgcatatatccgagtaccaacgatccccatactatgaaaataccggaatcgcgacatcaaacgtcgacacacgtcgacacaggtatatcggaattatttcactaagtagataaaaaatgttttaatcgtttaaatcagatgttgttttaccttatataaaaacaatgtttcagcaaatagtgaaaagatgtttcagtttactgcaatatttgaaccatacatagagaaacaaaaaatgaaacgaatttccttaatagagggtttccaaaataggtgggtgatttgttgtaaaagaatgtttcgttcactgcaacattagatcatacggactcaaacaactcaaatagatatcccagtagctgcccaagattagatggaaacataagcatagtaggaaacgtaaatacgttatctgcttgtctcgtctgtttgccatgaaaataggaacgaaaatatttaagcgaattgtcgaaacatgaattcggcaataataaaaggggtagcgcacgagacctaaaagtggatgatgcggagataaacgatttagacaggttcagaccctctcaatgagaggtaataccctactcctgtttggggatttgaatccgccgggtgtgtattgatctgacgatcaggttgtatcatatgccccctagagggcctcctgcccaccttatataggatggggggcaggattacaagatagaaaccttaaccaatatggtatctgtttcctaaatctactttacaatcttatcaaaccaggactttaggccgttccataatatacagggaaacataatacccaagtcatgatccgttacatatttcatagatataagttatcccctataaccagtcggataaccacgccgtgtgggtatggggtacccataatctccacagtatcccctgagaccttcatagtcgcaaagataatcttctctcaaaccagattactccaaagccgagtgcttcaatcatctttgccatggtctgccgagtacttttaccaaatctgaagactgtggagggctgaaaaataattaaatgtaaacttaggtgcatcgactagatgcacctaataggtgtagcccccgactatgtggatagttgaacaaactaaacatatagtcaaggagtaaataatccaaccaactgagtggttttgataattgtagtcaaccaagtgacttaatattaatacatagcatatgcggtgtgaatccctaaataatatgatccaagtgatataccgactgctttgcagaatatgatgcgtgcaatctaaagttgacaacatcgttgaaaattcacatagcaaaatagctataaagaagagcttgatgttgtgaataaagaaatttccaaagtattgggcatacaccatgcgcacactgctttaacatatgtgcttaagtccctaaaagacacatggtttcaccgtaactggaaatatatggcatatgtggtgtaacattcgagtaaataaactcccgtctggaaaatgaccaaaatatataatcagccttagccataatattggtcaataaaaatgcacacttacatggcaaaaaataatgatattgtatctaatcaattgcttgataaacccaaacagtgccatgactatataaaaaagtcagcggggcagctatataaagctttactgtttgacacattttaagatgcattgtaccaactcctaaaaagttgagtaactgcggtataaaaggattttaaggtatttggcacttgatcacgcgcactttggccctgaaaatataggctgcagacatattaggcctaggccaaaaaaaaatgccttcaacaccctttaaaggatgacgcatgtaacatgctcccgagtaataaatcttctgggtgatatagaccaagtgtagctcatatgaatagcttctgatctgagtgattatcccttatgggatactcccaaatagatataataattgaatcccaactggcggaagtattcggttgataacccttatgggggataataaatagtccagtctttgagcatagaaaatagacccatgatcataaattcatgttgcatgtatccagaacaagtccaaattgaaggtatgctacttgtgtttgagctagtaagcccttgagcatatagcttgtccttctgtagtagtcacaattgtccattgatggtagctgatgtagttggcatagagacaagacgaccaatataaagataatattgcccaccagaggtggcaaaaatattggtggtagtgaagatagtgataccaatcaaaagtgatgaagttgcacagccgtagaggcgaagaaaccagtcggcagcagtcaggtcagccagcaatgaagatgaaggcgcccagcgataaagttgtgtaaccatggcagcgaaataatcagtcgttgacagacgaggcagctggtgaagaagatgaggatgcccactagtggcgacataataagccatccgtgaagacgaggataccagtcggtggtgacgaaagtaagccgacggtgaagatgtagacacgcatcaaaggcgatgacgaaatccaccaatcatgaagatgaagaaaatagtcgccgacgacaaatgcaaccaacagtaatgatgataagcagcaacagagatgatcaaatatgatgacgaagttgtccatcaatagcagtagagtgggctatgttgaagaggcttgacaggatattgatgaagatgacgatgtcggtgatccagtcaatagcggtgtaacagccgatgataatgacgaagatgctcatcagcgtttgcatagtaggtcaaccatgaaggcaaaataacaagtcggcaatgacggaagtagccagaagcgaagacgtagtcacccattagcaacggcagagttgtcagggccaatgaaatagaggtgctgttgatgatgtcagtgacaataatccatcaaactgttgagaagatatcaaagctcgagtaatttccttgatgtgagcatgtgcataacgaagactgatgcaacgcttcttgatttacgaagatgactacagaacttagtgttatagctgttgtagatgcttcacttggaggaaagtagatgctgttgtccaactcatctaaactgagctgattggttgataactccaaactcccgaacatgtagattaaatcttgaatttgatactttaattatggcagcgtccagaaaccaaaattgccggtgaaataattggagttgctgaagtagaatgtctgctccgaagcaaatatgaagataatgactcctagagttgactcgttggctgattaattgatttcttcagcttatcgaattttgagagtcttgtatttgtgtagcccccgactctttggttagttggaaagcaactgaacatagagtcgagaactgtagcttcttgtcatcgagtagccatcacttgagtgaagatatgtgtcgaagatgtctgagtagaaatcttgataattagagaaccacttgttgtagtagaataacacggcattatatttgttaacgcatgccgagatgtcgaggttcttgtagacgtcatggtcggtgaagtagcaaagcttgcgaagtagaggcaatagagtttaccggtgccgaagataataaagatgaagccgctccatcatggtgacaaagttgcatagccgtgatgaagtgaacacgagtcggcggcaacagaagcaaaccggtagcgaagacgcgtagttgtgaagataaaaacaccagtcggcggcggcataaccagtcggcgatggaagaagtagaatgatgacgaaaacgaagacgtctttgaacagcagcaaaataggccagccgtgaaagtgaagacaccatgggcggcagcgaaggcaaaccggcgatgacaatgacgacagtcaatgatgatgaagacgcgtagccatggaggcgaacaaaccagtcggcgttagataagacgcccaacaatgaagacgatgacgtccatcagtaatggtagcggtataaaccagccgtagaagcgagagcagtagtcagcagcaaaccagacaaccgacggtgaagacgataaggccaatcaacagtatcagaatcatgcagccatgggagtgaagaaaccagtcggcagcagacgcagacagcttgcgttgaagatgatgacgcctactagcggtggcagcgacgtggccagccgtgaagacgataacaccagttggcgtcatacgaggcggccggtcggtgaagatgtagacgcccaacaacggcggcataattggccagccgtgcaggcggagacaccagtcggcggcggtgaaggcaagccggcggtgaagacgtagacgccgaccaacggcgcccaacaacggcggcataatatgccagccgtgcaggcggagacaccagtcggcggcggcgaaggcaagccggtggtgatgttctaactgatccattcctagagcgtaagagataagcttaaagccatgaatcccttttatgcatatctggatctggatcctgcagaacaaacatatggaatgagtagtatctgatgtaaatataatactcgaagatataattcaagtattttaaaatgtttataaatatatatttctcctcttgtcaattttgatttccccgagctgatgactcattacgtttaaacactctgtccgactagtcatagcccccaagcaccggaagtcggcctaggcacttcccaaacatgcatatgagtgacatgagttcgtcattaatggaataaagcttcacgaattagaatttaatactcgggtacttttgcaattgttaagagaagaaaataaattatctttatctctatgcttttgatttcttccgagtaatacttagcaccttgcgttactcggtctatccaacgagcccccgggtgctaggaatcggcccaaatgcaactatccatgacaaaccaaacggaaagcataggaagatagaactccataactcgataggcacttttgtactcagattatatcgcaagcaatcaaaaaaaatattatgaaaattgtttaaaaaatatgatataacatatgtagcccccgactcactagtcaacggcgaaccagttgatgtagtgaggcagaggaagagcaaaatatcatataaagaataaatgatgacttagctttgcaatattccccttgatgacggcagaaaggtggccgatgtggaaacgaggtcgtccatcaataacaatgaagacaccagtcggcggcgaaaaaagcgggttgacggtgaaagcgaagatgcccaccaacggcggcataataggccagccgtgtagacagggacaccagtcagtggcagcaaaggcaagccggtcggtgaagacgtggacgcccatgaacggtggtgtggccaaccaaccatataggcgaggacaccagtcggcggcgacagaggcaggccggcggtgaagtcgtagacgcccaacaacagcggcataataggccagctgtgtaggcagagacaccagtcgccggcggcaaagccaagccggtcggtgaagacgtggacgtccatgaatggtggtgaggacgtagacgcccaacaatggcggcatagtaggccagctgtgcaggcggaaacaccaatcagcggcggcaaaggccagccggtcggtgaagacatacacgcccaacaacggcggcataataggccagccgtggaggcggagacaccagtcggcgacgacggaggcagaccggcgatgaagtcgtagacgcccaacaacggcggcataattggccagccgtggaggcggagacactggtcggtggccaaggcaaaccggtcggtgaagtcgtagacgcccaacaacagcggcataataggccagccgtgcaggcggagacaccaatcagcagcggcatcgtccgacgtgttctatagagaccatggcaaatttggcggtggctctaacaatacatgtaaagagacaaaaatagtctctagttagtatcaagaaaattaatcctgtggatgtatatttgcatatatgcagcacacatatgttatttggttggccgattgatctcctgtagcatgaacattatatgcatccatacaatcagattattataccaatcttctgccatgcgtgcatacaggtcgcgggtccgagtccggatcgaattagactcgggcaacgaggtgcatgcaaaataataaaccacagatcaaactgagattggtagtagaaacaaataaaaagtgcagatgattatgggtattaatcaatgcatgtatgtatgtatgtatgtatgccatctgctttctgcttctttatatgttgtgacaccatcaggagtctgtggcaattggagtatttcacgtgtggcttccacattacgtctcctatacgtatccgatggcttgcttgatagtctcccagcacgatgagtcgtgcacaggtggtcggcagatctcatcgacctccagtacacgtattcgaacaaaatatcggagagtaaatcaatatatgattagaaatcaatctaatataaaatattgaaatgacaaaccagggattagaatcgtagttctaattgagattatcctcgaccgaaaaagatgtcggcgattcctgaaattgtttccatcgcccttattgacggaaatcttgacgcacccctacctgacgcgccaactgtctaaacatgaattcggcaataataaaagggatagcacacgagacctaaaaaagtggatagatgcggagtcaaaggatttagacaggttcaggccctctcaatgagaggtaataccctactcctgtttggggatttgattccgtcgggtgtgtattgatctgacgatcaggttgggtcatatgccccctagagggcctcctgcccaccttatatagaatggggggcaggattacaagatagaaaccttaaccaatacggtatctgtttcctaaatctactttacgatcttatcaaaccaggactttaggccgttacataatatacagggaaacataatacccaagtcatgatccgttacatttttcatagatataagttatcccctataaccagtcggataaccacgccgtgtaggtatggggtatccataatctccacacgaatcaacagaaagtgctggtgtaattagctaattaaccaatcgaaacagatcgctgctgttttaattggatgaactgatgtgatcgttccacatgtggtttgcacacgtgggcgcgtggcttgcgagtacatgacgatgtactgaacaaaagcgagcgcacgggtggcgagacacgcgaggccaggtgcaacattccaaacgggatcatcggtcgggctgaaattaaaggaaagtcacgctaaacgtggcacgtgcgaacaaacaggacgggaaacgcgtggaacaggaaattggaatcggacaaggcgatgtgtcaaaggcctgacaaaaacacctcgaatttttataaaaccaaattaaaaaccgactaaaacacagatctaaataaattaaatccaaaataaataatacacaattaggcccataattagaaggacgttgtggctggcctgttaagtgcgttgggcccatgtggcaggccacggcccaagtcggtacaggtgtgctaagagtcatcgaattcgattgaacggttaggatcgctcgtgatttagataaagcttgttcctcgtccacagccttttcggccgcaacttccgcctccccttcgtcctccccttcctcttcgccgtcatggtcttcgacattatcttcctcatcggcatcaaagtcggaggaggcgggggccagcttcacttgcccgcgcatatgcttcctggacgtcccctcgtcgccatcggccttgaagggttttgcccggggtggaagatcaccatcatacacccgattcgcccaaccggccacctgccgcgtgagcagttggctgtactcagtgaccgacacatcgccgatcatcctacgggcttcggtgtcggcctgagcaagagtcagcactgcgaaaacaaaacgtgtcaaaacatcaggcgtcgaacagataaaaaagggggggggggggcgaaacacaagtgcatttagagaaaatctgctattgtttgctaaagacttggctgtgtaatattattttcataagaaaacatatagcaaatcttctcttatcacatattttatacttattactgttttgctctaggttgctgaagtttctgtagagattaggatgaaaaatgctaggaacagaaagttttcaacctgcttccatatttttttcaaactcaaaacgaaattatgacatcagccactaaattattgcatatttttttcatgattgagtcttgtcgtttgtttttctttcctttccctcgtcgttttttttgataatcttatatctgatgttcgccctcttcgtcccctctattttttgaactagattcttgcggctcattgttcgacagagcgaaccatgcgggctcgccttgacggattcaagaactgtcttcgagccaaggatgacgaactgggccgcaagagcttggagatcgagggcctcgttaacaccctcaaagaaacgaattctgaaaataagcggctccaagccgagctggagaaggggagcgaggcgaaggccgagatcgaatgactcaaggctgagctccaaaaggagaaggatcaatccgccaccttgactgagtactataatcttactgagccgaagatggaggctcttcgccagaaggccctcaaggcagaggcgagcgctgaaaaagaggcggaacggttcacgcaagggatggtgaaagccaccgagtccaccaaaaccgcatgccgtacgcttcgccttgccctcaatgatatgggggagagggtacaaggagtccctagagaagatgcctccatctttgacttctcggagtggactcagcaggccggcagggcggtctcggattgcgccaccgcgtacggcgattgctgtgcgcgtgtgtcggcggccttcaccatgggcttgctgcagcagttcgggtgcgaacacgtcgccgaattccctaactttgcgaagggggattgggaggtcagctgtcaagatgtttccctcgcgctttgtgcctggcgcaagcagttctggcaaaaggatggccgatccactaccaaggcgcgtctgcttgaacaattggcgaaggcagaggcggcaaaccagggcgaagaggcagcggccggagagggtggaggagatgcccaagatcacccagaggtgtgaggccctccgcccgctctttagattttgtagttttcttttggcatttgccgtggagggcgaacaatgtaaatttggccaatggccctccctctttcgtattgtagccgaataaaacggcctttctacaaatagatcataaatctctactacataaaaaattgaagatgtttcccttgtccgtttaattagaaaaaagtgcaaaaaaacatataaaaagaaaaaaaaaggaaagtccgattcgtgataaaaaacataaaaaaggaaaagaaggaaactccgattcaatgatcgctcccatgcgcagttgcgcccaatcccgagtccgattacatgaaaatgtaaaagtcaaagcctcttatttctatttctaaagccacaattaaaattttccgacaaaattccccaaattcgaagaaccctaatttcgggtaagaaccctaagactcaaaatctaaatcaattaagctaagggtttggattacttaccagacttgaagcccctatgctcaccggagcggcaccgccacaccttcaccttcttgcagtcgcgtcgggttcaccgtgcgtgcgcgcgcgtgcgcgttcctctctcccgccgctgacgaggtccgggccactcggcgctcgccgtttgcgcgcctgcctcgccggactaccatgacgtggcatggcttggcggcgcccttaggtgcccccctcccccagccggcgaagcagtatccgctcggcggtcgtcactgcacgcgcgcaccagctcgccgaaccgctgtcgccaccttcgctgtcgttctgcttgctcgtcgccggagagaaagggattgggagaacatttgggagctagggttttgcccctctctcctcatcggcgcttcatccggcgcgtggacaatcggagccgtccatcagatcgttacacaacatgaaagcttgtatagaagattcatgttttttatggtatatttaatttttagaaaaaatatttttatgtggtatataagagaggatttgcttaaacaagagataatagcataaaaataaatatcttatgtagtgtaggaaagatcatttgcattaaaaataacaataaaatagtatattatatagcatataacatataagttatatcttttttaaaaatagaaaagtaaaaaaacttgaaacttttatacaaattttccaggttgtgtaagagatcacataaaatttttcatatttttatgaaatttctaatgagataaaacaattattaatcttgtatgttcgtaatggtatttggggtgttttttaaaagaaagcccaacccaataacgtatcataaaaaactaataaagttgtcagctattatagaaaaagataatatcgatgacagattattaaactctgctatatgatatagaataaattctctcctccctttttctctctctcccggggctcctccttcccggatggcccaagccacgctaggcccgcgcctcgctcggcctcgtggcctactcgcctccccgcgcgtgggccgccacctcgcccagccagcccacgccgctcgcccacacggtctgctcccgctcatcgcttgggccgctttctccctgctgggccaccctgcggctccccgcgcctcggcctgggccgcttcgcccagccggcccgtttcacacgcgcgacgcctacgatagcccgccctgcagccctgctgccgattcgtagtctcgtagatgccgattgtcgagtccagccgtaaggaacaacctcgctggtgataatcaaatttagcatgtcattgtgatttaggtcgaaattatagaagtacggggttgatcagctatatttggctaatactactagttaattagcttaattagcattaaacgtataggaataaggaagaaatcggctgccaagatcaagctggcagtcatacttgattatccttaatcaagtataattaattagcggcaagattagtatttctttctatgcagggtttgcatgcatgaagatggcaagtttattcctttttttgataaattgatcctggtagaaaacttatttcgaaacttgtccctataaaaaactatatccaggaataggctgtcggctcaacgccactttggcgctgatgttgttcctatcagcgccaacgggatcggcgctgacatcgcgccaacgtggcgggcgagacgtgacgtggcagggcctcagcgccaatgcacttagcactgacaccttgtacacgctaaatagactgatgtgcagcaatgaattaatggtgtcgctagtggtgcaaccggtagtttctttcctggtgtacgttaggactagggtttgaatcccaggtcagccattttcctttttttaaaaatcatcaatctacgtgcgtgcatattaaatcatcaatctccattttcgtttttttgtcttcaaatcttcaatgtacttttttttgtttaaattaatttttattaaaaagaaatatcacatttagtacaaatttaaaaagtagaagaatggattaaaaaattttagagtcaacttttaaaagaaatatcacttttttataaaaaagaaataagaagaatggatttaaaaaaactaagtaaaaaaaagtttagtaaaaacataaaaggagagggttctaaccatggtcactgtaacgaccccattcaagtacctaccactgagctaagccaaacctcattgttacatttgcttttgcttttacttctatttactcagtataaaggccagcgccgctgtagaccatattctgatgtgatgttgcgatctttttttccaccatgtatatatctataactaatataaatattcatatttttccggtcgtcacatctaattttcgtccatacacacaatccgatttggttagcaatagcaatagccatagaaaaaattgtaaaaaaaaaaaaaaatcagcggccgccgacaccaccaccgccgccggactgagaagagtcagatccaaaaacaaaaacaaaattcatccactctttgccccaaaaaaatcaatctcaatcatcacaaaatcacaacataatcatgcaagaacaacatacatacatcatgcctgccgccggatccgccctcaaccattgccaccgccgccgacgccaccgccaccgccggagggagccgccactaccggatcaacccgcggtcgccgccaccgccggcggatccacccgcagacaccgccgacgctgccaccgcttccggatccgacgttggggccaccaccgccgccggagggagccgccactgccagatccgcccgcggatgccgccaccgtcggagggacgctaccaccgccgtcggatccgccgttgggaggaagggacagccgtcgaggccgacgggaagagggagacggggagggacggccgtcgccgtcggctccgccacaccccgttgtcgccgcgccgtgccggcgagacgggagggagagggggagaaggagcg

SEQ ID NO: 63056 - DNA, 4549 bp, Oryza sativa
ggaatcgatgtgagccgttcctcaaaacaaaagggtcagatcgatcaagtgttgggagggcatcccacacttatgggccgatggaaggccagcgggtccaacaaacgtaattaaaggaggattttgaggaggtaaattagactttatttatcaaaattagcaattaagacctgtaaattccaagaaaatttcaaagggtgtaatcaatatggagaatttaataaaaattaaatccaattatatacctacctacttaaaaaatacccaaatatttcagaagagttgtatttcatttagttagaatttaatatgttttaattcaattttctcttttttctttccgttgcaacgcacgaccacttttgctataatttcaaagagtgtaattaatattgcagaaaaattatatttcattaaattacaattcattttcttcatataaatagttcaaatcaaatttcagtcaccatatcattatccggtgcaacgcacggacattttgctagtatatatatatatatatcaaaaacagagagcatcattaatcatttatatgtactaatgtacgcacgtagattgaacatttgaagaaaaaaaaaagaacgaaaaatgctgccgtgatggggattcgaaccctggtgctagggtacacaagcaaatgatcataccattgcaccacaattgcatttcttattcttttaattaccctgtacagggggttagcgcgatgtcagcgccagttccattggcgctgataggaataacctcagcgccaacctctttggcgctgagccaacggtctatttctggctatagtttttggtagagactagtttcaaaataagttttctacaaggatcaatttatcaaaaaaaaaaaaacgaagtttatttgatgtttgcacttgcacacaacgcagatgggagccctgctgcctagctagcggccggcaagattagaccaaggtgggtgatgagctacgtaaaccaagacgaactgggagtctgggagctgatcaaatgcatatttccatgggcatatgcgcgctggatgtgttgatgagctgaacttgacatattgccaggcgcatggacgcatggttgcttacactactacagaaagcgtttttgcatacgggcggaatcgatcttcacatgcggttggccggcccgcatgcgcgaaatggtctgcaaagatcaccatttgcgcatgcggccgtcgcatgcggtcacttaagacggccgcatgtgaaaatagatcttcgcatgcggtccatataagaagccgcatgcgaagatatattttcctatgcggtcgacctaagaagaccgcatgcgaagatctattttcgcatgcgggcgtcttaagtagaccgcatgcgaaattcaatttccgaatagctaaaataatatttattctagcattttggtgattcgtaattaatattaaattattgagggatttattatcgtatttcggagtagtaagcatataagataagacaagtgccgcagtaacaaacatgtaatacataaccattaattcaatcgtaatttacatacaaatatataatacaagtggcacagttttttcatcatatgtataattagtgtacatgttattacatatgttctttctcccactctctgagaggtttaaatttgtcgtccattgcgagttcactctggttgtcgtagaagagacctcttgcgttgcagacatcgcgacggatgaatcggcagaggtcagcggccacgttcaagatagtagtgtggttgaatcgttgtgcaatatatgggatttcggggatctgcacacataaaggaaaataaaacggtactcagtgagaagtgtgtgcgagatgggtttctttgtagagaagagttcgatgacctactcggttactggttgttttgtacctcccatttactctgagcatctcgcacacgtaataaccacacaagttggttcctggtggttgtttgtagcactgcgatataattatggggaccgatctcagtagatatatttagtatatatgtactgttcgataattagttgtattggtataaatttgatagtaccggccagccagtcctgacggataacttcttctgggatggaatatgtactggtccacctcttttgtggtagtacttgtgtgctatgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtctaatgatatgatcaattggtctttcggatatacaaggaataatatgcagtggtctctacatataagataggcttattggagacagaaaattccgaagaagataaattaattaaacaaaaagaagagagagcttacgtgaattggtaggggaccattaagacatctttgtcggcgtgcgccaacattgcttttgccaagtatgttgctacttatagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagtttcgtggaattgcatactgtacaatgaataaagaagaaatgagatttgttttatttgtttcgaatgaaacgtgcaacatgtaataaagagttcagacttacagacagaaagccgcaacgagattaacgtccattttatctagcttgtagagggcgtaaaggtcttggaaagagataaaaaatatcccattaggaccactcatgaaagcgcctttcctagatgccttcatataccattcgtgcattaccctcatttcccatggtagcttgttcataagataagttggcaagaatggcttgccatactcataagtttcaggcacatcggcagataaccaggattgcacttcatcttgggccgccagtactgacttctgggagtctgacaagacgtgagcaagttcttttctcttctcagaattcctgaaagctgaaaacatgaacttctccttatccttgtcaatctcctttgggtcgtatgtcgatatcaactttggaattatacgacgaggttccaaagtattagacttcggttcggatgtagtaccatctggtatgtgcacttgttctaccagagcagattggggtgtaggtggagaggtttgaactgagggcggagccgggggagcatgctttttagctggggaggtgggagaggcttgaactggttgcggggccgggagaggcggttgttgagaaggggagggtggtggtgtaggttggcgaggcggtgacctaagcggtggtggtgacggcggatgtcgaggtgacggtggttcaggaggcgacggtggtgcaggagcggcagctgaggatggggttgaagatcctgctgcaagaacggccgcgctcaggattatgtctctgcggtgccacaagataaactgattcactgcatcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgtccgatagttgttcttcgcatttgtctctcttcttataacttggtgcgtcttgtggaaacccgaccttccaactgtctttgaggacaaaccccttacacgtccagagtgttcagccgtccccaacgccgcagtaagctgatctcgctccctccgtgggacgaactgtcctgatctttctttctcgactatctgctgcaaattagtagtcacttcttctatgtctggagtctcgaatagtgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcggatgcataattaatg

SEQ ID NO: 63057 - DNA, 6232 bp, Oryza sativa
tccggacgaatccgagggagagagagagggaaaagagggggaatcgggagagggaaacgcggggagtaattcgcccctctttatggcgcgcggggaaggcgggatgcggcggattcggcggcggcggcggcgctagggcacgggcggcggcgggtgcggcgcgaggagggagatgacaggtgggacccacccgtcagcgagggcggcgggcgggcccgcctgtcagcggcgcgcgcgcgcgggggaggccgatgggccgcgggggaagagagagagagagggagggaacgggccgagccggcccaagaggggaggggggggggaaaaggagacttcttttagggtttttctttttataaacctttttaactttgttcatttcttttcaattattatttgtgctctgaaaattccactaaaatttgagggctccttttagaccaaggagaatttaacaaaaattctccgggccacatttgaatttttcttgcacgtattttagtgtttgccaatttcttttcgaattttaattaattctattattccttttagcgaatgatttttatttcgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagttcaatgatgcttccgttccagaacttctcatgattcatatcttcggagtcaacctcggacaagttatcaacttcatgtcatgcgtcgatatcagcttgtcattactagggtaccatgcttgttatcatgagaatatcatgcttgtcatttacttctaacttaccactattcacttcatgttgtcctcagttagcattcaacgtattcctgtgcaccttcagccttgatgtgttctttcccattggatcatctcccaagacatggcgtcgcctggtaaccggggcttgcacttttcactccgtgtagcatctgataccgagttgaagatttcactccttgccttcatagaaacacttttacctaggtcatcttgcttacttaatgacaaggtgactgttgtgggggaggcaattactatcaggggtcttccttgagcgatgcagagcatgtttctgtttatcaatcacctttcggcctacttctttcatgcttgagaacatctttgccaatctcttttatcaatcatctttcggcttatctctaacaggtggtattctttaatgtggattgcggacgcttctggggacgatgaggtcctttggcttgctgcctttcagtgaaaccttgaagtgtttcaccaaaagctatactgactgtctttgcctttgatccgaaaaagacacatctgaaactcttagtccaaataaatgtctctttggttaatcgcttgattttcttttccatcatcaggttggttattaactcgaggttagaatatagttcctctggcacgagaccctaggtctcctttgtcagtaaacaattatacacaggatcacatatccgcatcttccaaaagaatcctcttagaacttgtttttattacaaatctctcccatagtacatgaatacaaggcactgtcttaagcaaaaagggaaggtgcttaacatcggtacattgtttccactatgggttagaattaacatgaggcctcacaggtacggcgtttgctccagtgaccacaaggcgagtgacttgtcttcttcttgcataatggccggagtgatgacgcaggttacgcttcggctgtggacaatctctggagaaatgacctggttctttgcagttgtaacaaatcaatgccctttttactgagttgtccgtctgagaacgatcattctgacccggtgttggaattggtggttggaaatccttgctaacattggcatcagtggtaccatagttgctatcaccattggagtctttctcagagtcaaaattgctaaggttgtcattctgggttccaacattgatactatcgttgacatcttggtgaatgctactgacattgcacgctttattcgagtggccactaatggggcaagatccatggttgttggtggtatcatcatcattagtattgctagtgttgttgtctgcattgcgtccatcttcttggggcggaaactcttgatgcgcaacagaagatccggtgatctgaagtggctcagtgcgctgtctttggttaccacctggaaatactggcatgttgacaatccttctcttgcagttcgtcatccgattatgctcactttcgagttgcatggctttgtccacaagtttctcgaaatcttcataatcctctagaagtagttgcactgcaagctcatcttttaacccctgaagaaacttctcttgtttgtcttcatccgtttccacatcttctggtgcatagtgagccaaacgatagaactcgtgtaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataatttgcactgttgctggactgtaggcacttgaacgttggttgcccctgctgggttgttccaattctgtaatagttgaaaggttgttgccaacatgttggtttggttaaccacaacttggattagctctggtgaggtttcgttgatgcttttctcattcccattggcttgggttcttgagtcatcggatccatcattcccgtagcctttgttaccagtgttatccatctgtcacaaggtagaggttgagaggggaagcatacaaggaaagaatagaccagaactagggacaagaccttaaaggaactaactctttttgttgatgtgttgtttgttttgcttattctgcaagttgattaagcaaacaacctagcatggttacatcacaacccactgatgcaaaccacgcgctacacacacaagcaaggaacacacgactaacaacactaccctatagggtggcttaggttcagcgacaggttctccaagatcttcactcctgcttcacagctggcttcactgcttcctccacttcgctagcggatcctgcagtctttcggagcttcggcaaacaactgacgacatcttcttcttcacaaagctaaccaactagtactagttgaaatctgaagaaggaagaagagggtaaaccttttgcaaatagcattaggggaaggagaaaaagaggaactttcacaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcggatgcataattaatgcaagggaggtacaagggaataataatatagggattaagttttgcagtaaacagcatttaaaagacacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaggacacatcttcctcacgtgcaaacacgtgccacataccaccacggtatacggacggaagacgtgacatagttcccaacccatcctagccataaacaagagtaccgacccaatcccacctacggccgggatacccgggacaggcaggcagaactgagcccctagcagcagggcaccaaccctctgccatatgacatctcgactaccgggccgcagctcgtgtagccttcatttgtcctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccataaatagagtgtccactagttagggttttatttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacaccggcttcaacttccacgaagagcggatcttccgaagctgcagcgtctacacgaccaacggaaaagaaaaaggcttttactctaataaactccaaataacaagcaggaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaatttaaaatcgaattattgcgtcagccgaggggagagggcgcgcggaccgggtccacgggagtggggcccacgcgtcagcctctcggtccacggtggaccgggagcacgcggctggcggcggtcggcgccgtgggtcccgcgcgtcagccgcacccgcgggcgcgggcggctgacggccgggcccacctggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgacgagggcgacggtgctccggcgatgttcgggcgaggaggaggcgcggacggagtcggcggcaacacggcgaagcggacggaggtgtcgccgagtaaggaggaagtccggagcggcggcggcggcggaacggagctcggcggcgacggcggagagagaggagcacggcgcgagcacgaatccgacggcgagagcgagcggcgagcggcggaaacggaagagcgaagcacggggatcgaataaatagcaacgggagggggagagcgcggccggggagagaggaatcgcgcgcggag

SEQ ID NO: 63058 - DNA, 22194 bp, Oryza sativa
agggaagggggggggaaaaggagacttcttttagggtttttctttttataaacctttttaactttgttcatttcttttcaaatattatttgtgctctgaaaattccactaaaatttgagggctccttttagaccaaggagaatttaacaaaaattctccgggccacatttgaatttttcttgcacgtattttagtgtttgccaatttcttttcgaattttaattaattctattattccttttagcgaatgatttttatttcgggatgaatttatcaggacgtgacaaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatctgttcttcttcgcgagctcggacatttttttcctcaaagccattgcttcagttgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgacgggctttccatcctgatcgagagcaatcacgttgtaagtttccttgggtaatttatttttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgtctggctgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttggacataagtcccaatttaacataagtcccaattatacataaatctcaatttaacataagtcccaattatacataaatctcaatttaacataagtcccaattatacataaatctcaaattaacataggtcacaatttaacttattttcacataagtcccaataacttaatttcacataggtcccaatttaacataggtcccaatttagcatcagtgacaattaaacagaaatctccatttgacataggtgccaatttaacacatgtcccaattgtacatggatctcagttcaacacaagtcacgcttgtgcatacatcccaatctagcataaatctcaacttatacataagtcacaatttatcataggtgccactttagcgcaagtcgcattgatacataaatctcaatttaacaaaagtcccaattatacataaatcccaatttaacataagtcccaatttaaacataagtcccaatttaaacataaatctccatttaacaatccacaattaaacctttctcaaaattaaacaatccacaattgcacatatcacaatccacgatgcacaattaaacaatccacaatccacaattgcacatttcacatttctttttttaaaagtaaatgttatcgagcgacggcggggacgacctggcggcgacgatggcaacggcgaggggggagaggtccgtgcggcggcgacggcgacctggcggtggcgacggcgacgacgaggggggagaggtcctggcagtggcgtcggcgacggcgaggggcggggcgacttcggggaggagccagctgtagcggggacgacttggcggcggggacgacctggcggcggcgatggcaacggcgaggcgggagagttccgtgcggtggcgacggcgacggcgaggggggagaggtcctggcggcggcgacggcaacggcgaggggggagaggtcctggtggcggcgacggcaacggcgaggggggagaggtcctgacggcggcggcggcgacggcgtggggcggggcgactttggggaggagccggcggtggcggggacgacggcgacgacgacttgggaaattttggcagcctggcggctagggtttcgcgggagccgggacttagaaaattttggctccccgcgctccctatatataggcgcagatcatcgtatgcgggcggcttaagggaccgcatggaaaaatatctttccatgcggtcgacataagccggccgcatgcgaaaaagatctttccatgcgggctgttaagccggccgcatgcgaaaaagatctttccatgcgggctgttaagccggccgcatgcgaaaaagatctttccatgcgggctattaagccggcatgcgagccagccgcatagaaagatctttttaccaaaaaaactcatatttttttttctctaagtaaactgtccatatatatttttttcccaatatttcgccacaattatacattccaaatgtttttggcactaagaaaactcatgaaaattgctcaaaactcgtaatcaaatgttacatgctaatgattacaacataagggggacctaaattcatgcacgtacatttggaatacaatgagaactaaaggttacaaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacttgagccatacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccatatttcttgaatggtcccataatacgacctcttttctccactcgtgtcaatcgcttcgacacggatcccactattttgtgcggtgcttttcatgtccttcgtagtcgtactcaaggtaaatccattgatgtcgtaaccttgccatgaattgacaatacttgaaggcccacatgccagtctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgcttataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctggagcggacctaattccaaaggatcaaataccttctgcgaaatcgattgaaaaagtagcacaactttgttataaccacctttgtatggactggtttgactgccttatagcaattggtaggaacaccgttagcaacctatgacagtcatgcgtattgtatcccgaaatggacaaatccttcattgatactagcttcctgatgttcgatgcgaaaccagtaggcactctaaccccttgtaaacatttacagaaggcttttttctcttcaagtgtcaacaagtaacaagcaggaggaatctcggtcttcccatttggcagcactactgggtgaaggtcatgccgtatggacaaatctacaaggtcgttacgtgacttcaatccattcttcgttttactcgggatgtccagcaatgtgccaacggtgctatcaaacacgttcttctcgaggtgcataacatcaattgcatgtcgaatctctaggtccttccagtaatctaagtatttaaagaaaattgaatgcttcttgaaaggcgacgcagtaccgttgtcaccatcagctttcttcctctttactgtcttcttctttccctttccatatacaaccttaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatttgtatgaagttttctccagacatattagacatccagtcttccctttaatctgcccagataatgaaaagtttgcaggtaggtcattgatggtaacaaatatgatcgcacgtagattgaagtctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactggccatgtgctgtgcgagctgcttaagtcaccaaacgggttcattccatcagtgctcaatgcaaaccttacattcctaggatccttagcaaattctaggtgttttgcatcaaatgtcttccactggcgagcgtcggcgggatgtcgaatcataccatctatttttcggctctcttgatgccatctcatcaactcagcatcagtcgggtttgagtacagatgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatgatacaaagttaggcttaggaagcaacacacggaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgccttctctaatgcctgccaattctccaatcctcgtgacctacccgctagcacctctggttcaacatggcgtagcatatcctctaaatcaaaaccaccatcgaaatcatcactatcggtggaaacatcgacaaccattctttcacgcgaaatgtcttcgattataaaattctctgcctcattcatctcgaaacttaactcttcatcgtcatcttccggattggcgaattccccgtgataggtccaaaccttgtagttggcggtgaatccgtactccattatgtgacccaatatttcaccaggatctaccaacaatttctgattcttgcaatgacggcacggacaaaagatctttgtcatattctccctcaaagcatgctccttagcctgatcaataaatttagatgcttccttaataaatatcggctgcgttctccgcatctcatacatccatgacgaccgatccatctaattatataaaggcaaaaaatttacagataaaaaaatagaccgcaggtatttcatacaaaagtttaaatgcatttgtctcccaaaaaaatacaacaatacatgtaactagtatgtacaattgtttacatgcaaaatttgcccatcaaaacatatattttgaagctagattttgcaaaaaatagttagaacaaaccttgtcaaaatattaaaaaaactccactttccaccaacgaaatataacaaaaatggagccaaatgaagcaggatagagagttcttcacctttcgtatagagttcaagtaaaaatttcgagttgaaaacctccccccctaattggtgcttgctttacgagagagaaagcttcgttttcaaatggtcaagctcgggcctggaggagcatatatggccgatcatcgcatgcggctaatcaacccgcccccgggggggcggtttttgcaggcgccgccacaagcggcccgcatggaacctaccgaccccctcgtacagaaaaacgatttttgtagtagtgttaattgcgggctggcgcaagaggacaaatttaggctgtgtgatatgcgaacgtcgtcgaagcagattttttttttttgacaatggaatagaatatcccggcctttgctcaaaacgagctacaaacaattattacaaagttacacttaaaaaagagtgtagtccaacaaaacattgagaacacgcacttaaaataaaaaataacccatctaagataaggagaacacgttattgaagtctacttgtgaatctccaaccataattggcaaaaagttgcataactgtcgtctcaagcctacggcatgcaaccttcataaactcgccatcttcatcacacctttgtagctgagcccaacaccggagccaatatgttgccctgaaaattacctgcatatatgtaatagatggtgatttgtcaaaaaccaaatcattcctgcttaaccacagagcccaacatattgcagaggctcccacaagtataagcttactccttttcttgtccacccccaaaagccaaccataaaaaatatgtgatatactactaggagggcatagaccaaaagaatattgtattgctctccatataaagtttgtataatggcaattcatgaaaagatattgaatattctcatttttcattaaaaaacaacatcttaaactacctttccaatttcgtcttgctaaattgtctttggttaacacaacccctttaagtaagtaccacatgaagatcttaatcttaagcggcattttaagtttccaaatcattttatttctctcaatatagccattattaattaaagcaagatacattgacctaaccgagaaccttccattctgattaaagttccatctaaaacaatcagaagaatgattcaactggatatgtacaatagaggcacacaactcatacaaaaaaataagattctgaccaactaaagctctcctaaaagaaacattaagtggaacagatctcataacactagcaattgaagaacctttccttcggacaatggcatataaagagggatacttatctttaaaggctaagttatctaaccatttatcttcccaaaatctagttgttccccactattcacaatccaggaacccatgtttaagaaagtatcctaaactttcatgagacctgactaaaactgaccaaaaatgagagtcaccttgcttcttatcaacttcagtaatagacttattatgaagatatttcctcctcaataagtcttgccaaaccccttgttcattaattaacttaaacaaccatttgctcaaaaggcatttattttgtatttccaaattatgaacccctaaaccaccctgatctttgggctggcaaatgatatcccatctagtaagtttgtactttttcttatgatcatctccttgaaaaaaaacgagatctataataatcaattttttgaagtacccctttcggtatctcaaaaaaggaaatcataaacatagctaaacttgaaagtacagaattaatcaacaccaatctaccacccacagacatatacttacctttccaactactaagttttttttcaattctttgttcaataaccttccagtctttgttacccagctttctaaaatgcattggaataccaagatattcgacaggaagagagcctaacttacaaccaaagatattagaatattgatcgtaatgatccttcgtttgaccgaagcaaaataattcacttttgtgaaaattaattttaagaccagagagcttttcaaatacggataaaatcaattttagattctttgcttgctgtaaatcatgctctagaaaaatgatagtatcatctgcatactgcaatatagataaaccatcatctaccaaataagaaattacaccatttatagaaccaacatctttagccctcttaataagtaaagcaagcgtatcagccactatattaaaaagaattggagataaaggatccccttgcctaagacctttatgggtttgaaaattattactaatttgatcattaactttaataccaacatgacccccttgaataaaggaagctatccactgacaccatttaggggagaaacctttcattcttagcgtcttttgaacaaatgaccatttgaatttgtcataagctttttcaaaatcaatcttaaagattacaccgcttttattcttgcgatgtaattcatgtatagtctcatgcaaaataaccacaccttacataatgttcctccccggtataaaagcagtttgagtaggactaatgaccttctaggcaacactcataattctattcgtagcaactttggtaaaaatcttgaaactaacattaagtagacatataggcctatatagctgaattttcatggcctcaacacacttgggtagtagaataattgtaccaaagttaaaagagaatagaggtaaagtaccgttatgaaaatcattaaagagatccattaaatcatgtttaataacattccaaaaaacttgatagaactcagcaggaaatccatcaggacccggtgctttattatgttccatttggaaaatagcctccttaatctctttctcattaaattgttgcgttaaagcttcgttttcaaaatgagaaacttgaggaggttttttttatcagatcgtcttttaatagactgagatattgcaaacgtatcatgtagaatatgtacgtcaaaagaccagggcatagcgtatatgtatctataggtatactagcaaaatacccgtgcttcgctacagtgtattaaaactaaaaatatttatttttagccaaagttattttcacactgtttggtacttttgcttgataggaaaagtctcaaatgataggtgacgccgctttttttttcttttttttgggattatcgttcggtttttatgttgtgatttgtactccgttcacgattaggattttgtatcatctttgatttttttcaagaaaaagtgcccgcgcgttgcaacgggaagaaaagatgagaaaattgaggaggagttaagaaagatttacttaattaactaaaatacaaatttctggaatacttgtattttttaagtattttttaagtaggtaggtgtttaaattaattgaaaagtaaagttagtgtaggaaataaaattgatatggctagatttaattttaattaaattctctatagttaattacactttctggaattttcttggaattttcagagcttaattgctatttttaataatacaaatatcatttcagcatttatttaaatagtaatctaaataaaatcctcattacacctgggccattttcagcccatggccaccctcagtccacagccgagccggcccgctttcattccttattctcccctcctcctcggcccgcggacacgcgtccgacccagcaagcaacgaaaaactaattaccctccctatctcactgtcgtgtgggcccatcactacagtgtcatcccctacctccgtcaagttcctcatcttcccgacgcctcccgatgtcaccgccttcataaaactcggccgcatcctttaagataatatgaaattagttgaggggtttcaatccttatattctcctctttccgttttcccaaaaatcaaatcaaatctgcttcatatctagctgagaataaagccctatccaaaccctatttttcctactgtattacgatgcaacccatgttatttttccgcgctaactattggagacgggcaacgcacacacgcgcgagagggggaagagggaatcgcacgattgatggacgaaaataagtgtgacgaacggaaatttatgaatctttatattagttaagatatggtcgattgggaaggcacccaacatccaacaattgaattatctgctgtttactttgttctatttataccttctatttctttgcttttttgctcagaaagtaatctttcgtcgtcatgtaagtacgatagttatcttcttttatctaaaaatattctttacaaatgtaaattagtttttgattccatgaaagtgaattgattgctttcattaaccggttttgatcttaattttaacgactctattaattataccgtaagccgttaggtaatcttttgttgaaaaaaaaagcgtcaatacttctcaactcgagagaccagcactccatcttcactaatcataaattcacaattcctaatctctgttgttcgtgtagtagcagcaagaagcaatttccgatataattgtaaatgatgttttagagaatattaagtatggttgtcgaagtgacaactgcgtacgtcgaaggacgtggatactcaatagtcactggaaacggtgaagtgtattatctttcttttattttttctggatccccgttacatggccctaggagcctatttataaccctattactagttcccctattggggtttaggtttaacaggggaatttacatggttgcccttatgaaagggacatttacatgggtatatagtgtaattaaggtatatgggcccctaatgggccgactggcgaacgctggcccagtggcctccgggcttgatcggctgagatggcctcttgggcctccttgaagttggacttgctacggcaaagtcatccgccttcgccatacactcttcgccatatagtcttcgcccaacatgccttcaaccttgtgggataccggtgcgattcttcacccttcgccatctttgcttcatagtcttcgccatgggggcttcacctcaacagactcgacgtcttgggcttgaacccacccctggttgcatggtttcggcaggtccggtcgaagggtctcatgacataccgccaacaagcccctcacgggcaagagtgagataggagcttcggctgagaccgtgcaaaccatgtggtatggtatggggcgccccctttggaccgacgctcctgccgaaacctattctggagtcctgcagagaaagtgtgcattatgtgtacgtgtacttttatggttagtaacgttttctaggtttcgcgtcttgcgaacggcgaaaccgtttttaattttctctaggccaaaatgaacagtgatgggctttccctcttacgattgggtggggagacgaaccgtcgcctgggtgggctatatattcccccttcccctttttcaccgccgcactctcgtcattttcaccgcgagcgctctctctttctccattctttcctttcacgacgccctttgatttcctagatctttcgcttgttctcccttttcgccaccgcgcacacctttcaccatggctcctcgcaagccgaacccagcttccgcgacaagccctaatccaggccgaatcgacgacgacaccaccgcctttctaggggcttcgcttgtggacgacgacgagctggcaaagcttgtcagcgccagcctgctggtggaggggaaggccttcgctccgggaaaggccgtggtgccgaaacacggcgacaaccggacgatggtatttgccgtgttttttgaggtggggcttcagtttccatgcaacgttttgttgccggagatccttcgtcttttccaggtggagcttccccaagctgagcccatcggcacttgtccgagtcaccatcttcgactgggcgtgccggaccgccaggttcgaaccgagcgccgagcttttcggcgccgtgttctatggcaccgtgaactcgaagacagtggtcaccccagccgggacaaagaaaacggcgttcgggagcgtgaactttaatgttcgccccgagcgctccgatctatggccggtgaacgccgccatgtcgaagtgggatcgccattagatggcgaagtggttctaccactccatccccttcgaggccggttccgacgcggcgaaggccctccgttggcggcgcagggcaatttcgccgaacaggaagcccaaggtcgccatcgatggcaccatggaggctcggttcaccctgcttcgcaaggtctgctctcggcttagctgccgcgatctggtggaggaattttgcatgcttcggattttccccctctcccaatcgtggcatgttgtggtgaatgaagacgaggaagttcacggcttgtcaaagctcgtcatgcccgagggggcgaacagtgagcctctgcatttcccttacgtacttgtgactcgctctttttgttcaacgcttgatgtggcgatttttcgactttctgcagtgttgacccttgctcaggttgacactgaagcccggaagatgatcggcgacgtgtcgattactgagttcagccagctgcttacgcggctggcggccggtcgggcgaaccgggtatatgtcggtgaactgcctccccggacgaagtccttcaaggccgatggcgatgaggggccatctaggaagtggctgcggggcaggtgaagttggccccccggaagtgcagggcccctgcctccaccgactctgatgctgatgacaaagacactgtcatagatcacgacgacaaagaggaaggggaggatgtgggggaaacggaggttgtggccgaaaaggccacggacgaggccgccggcaaccgcgccaagacgcccagctacactccgactccgagccccgagcacgttgggaccggggtggagtcgaacttctccctcctccgccaaatggatatggagggggtgaaggcgctggttgcgatcgccgcaaccaaggtgacgaaggggggttcgatcaagaaggcccccaaaaagaaagggctcgttgatgtcgctcgcatttttagcgacgacgagtcttcggacgagacccctacttcgcccactggtcggagcttgggtctttcgaccgctctcagcgccatggttgatgcaggtggagctcggggggagtgtggccgctgggctttggcctttgctgaccggattgtcagggtcgttgctagggtctttggcagtcctgtgcggaggactgtggttttcgccgcttgtcattgagaaggggaagaagacggtcgtcgagacgtctgcttcagagtattctttggtggccccccactgcgcccctgctgacttcgagactggcgcggaccttatccccttcgtcgagggggtaagtaatctcgtgtctctggctggcagcccgagcctattcaccgagctgaacgagttcgacgaaggctattctgccatcaagcgtttggcggttcgggtatgttgttctcctttttgtttactttcagttgtccgtcttcgacggcttatgttaacgcttgtcctcttcgccctctctttttcttttgatctagattctcgcggcccattgttcaaccgaacggactatgcgggcttgccttgacgggttcaagaaccgtcttcgagccaaggacgacgaactgggccgcaagagcttggagatggagggcctcgccaataccctcaaggaggcgaaggctgagaataagcggctccaagctgaattggagaaggggagcgaggcgaaggctgagatagagcgcctcaaggctgagctcaaaaaggagcaagcacattctaccgctctaaccgattactacaatctcatcgagccgaagatttaggctcttcgcctagaggtcagcaaagcggaggcgaacaccgaacccaaaggaggcggcggtgaagcttggtgatgatggaagtgttgggatacgcgtaggctacgatagcataaatcaaaattttctatcgcgtaaaccaggaaccatgcaagtattagatcatagatcgttaccactcgacgcgctgcacagcggaagaagacgctgagaagtcgaaggaactctcgcgaagtagcgcgcgtcgatgtagaggaagtagtcgatcgcaccggctcgaccttctcctcctcgtgctttctcctcgccgtattcccacgccgatcagcaccgcaaaccagcggcgtctctaccggtatccacacgtacagggacggaacgccacgcgcagatgtgcttgcacccgcgcgtggctagggttttgctcggggagggaagtgatggctagggtttctcacgtattgcaatacctccgccggtcacacccctcacgaatatataggatccatcactcgggcctccaaggcccataggactcctattcggatccctatccgaattaagcttatattggatccctatcaaatccccttattccggcccattaagcatgcgaccctgtatgttcatatatactcggctgtaatctgaaaactccttttcggtccacgcgtcaacagcggcccctagcagaacgtattgacccaccgggcatacataaagatcatatcggttgaacctctagtgtatacttgtataaacccctttgcctcacgatatcgattaagctcaaggctagatatgtggcatcctctaatagctaatcattcactcgaacctgttgatagattatataacttgtgattgacccctcaatcacctttggcatggctatgcacttccataatctacaacatcgaggggcctagagatatctctccataggaggggcaaatcccatcttgattatacatatcccactacatatttcatagcatacccgaaaactacttttatagctacccatttacggagtagcatttagcagttcttaagtaagctactacacatgttgagaaccatgataatctcaggtctaaggattcaacaccaacactaaatgagatcactgatgacacaacacatatggctcttgcagtgtctcatgttgggtctatccaataacatgttcaccaacatgtgtccacattattaatttggtatctctataccatgatccatgagacatgatcatcaattaaaacatgtgctgatcatataaacatatttgttccacatatgatatttgattagggatcctttagaaatagtaacaaacaacataaagagtctcatgaaagaatcacatattcattaaccaataaggagttatctatttcaaggaacaatgtcggataaatatgtaaacaaagtatgtgatacaatcatctctatgattgcctctagggcatatcactaacaggaaggagcagcagggcctcgctggagatcaaaacgcggcggcgagctcggtcttcatggcgacgaagtgcttcccggggtcttcggctttggggagatggctgctgagcttgctattgaccttgcggagccgagagaggtggcggcgctgactggcgacggccgaagcgacggcgcacggcggctggagcggcggccgaaggtagagagagaaggggctcccggggagagcaattccggcgacggcggaagacaggacttgagggagaggtagaggacaacgagggggtcctttatataggcacgggagctcgggtccaggcccaaatcgacggaaaaactacgggaaattctagggatcttcgccggaaaaaggaaagattgatccgcgaaattggaaaggatttccgtagaaacttttggggatttcttggggaaaaggaagaggagattaagaggattcattcccagaactaatttggaaataggagcaacggggaggtcggatttggaaggaggaggcggcggcagtgcatgcgcacggcggacagtcggctcttcctgagctggaagatgaacagtggcgcaggaaggcaaaccagacttttggctgggcttctattgcacagcccgatagaaggaggaatgcaaaccagactttgggaagggataaggccggccgaatagaaggaagaatgggcgaggactaaaggtgaactggtgtgattatggtgaataagagcaataccggcttcggccaacaggatgtagggctattacttgacaattcaggggcccgaaactatataaaaatccctgtctccatctcttttaccttagtctcgcgtatatcctagtaccaacgatcatcatactatgcaaataccggaatcgcgacataaaacgtcgacagtggcgcgccaggtagggcgatttttggtgcttcaaggtttcgatgagatgggtttacgagatggattctccaacaacaagctactcggcgacttcggctgtgggaaaatctaacctgatcggagcatatcttccgacgagattgggactaccgccgccgcggagaaccatgatgtcggaagcagcctaaccctcgacgcgtgcgacatcaactggtgcaaggcatcggccggccgagtccaagccgaacccgacaccgattcctaccaaccaagcaagtgtgtcgaggagccaaaaatcaactgccagagtagtgctaccatgttctgactaggacccgatttttagtcagttgacacgggcgtcaactcatcacggccggcgtcaagtccaaccaatttggataacgtccatatgtgcatgcatcagatcaattaacagcaagtgcatgtgtttactgcattcatgcggctgtacacctggagaagtaagattgcatcgatctaatctactccgaatacacatgtcagaaatgtaattagtaggttaattaatttaattgatctactaatttcgtagatatatccggcatatatctacacaggtacgcattattttatataaaattttccataccaatattcagatcatacaacattgtcggatttataatttattatgtttacctagagcatgttttttatacaatatctgttgcgcgggtgtccctgatgttaaatcgactacgatctaacgctggggactcgctctgtcttcttctgtataaatcatgcttgtttacagtttacataatgccctgatatttaatctgctcgttatatcctgataatgctagaagattcatgcagttttttgagtacatactcgatattatctgctatatatcttgtcttctagaaaatatttttcaggaacaattgagcactcgagtaggttgtggtcaagtacaccgcattatcgagaacgatctcgacaaatgcagagtcgtcgcgcccaacctaccaacgaaaactgacaacctatctcatagcaccggctgtggctggactatttgagaaaaggttgttaacggataattcctcgtgaacgttgtcggctttattacctgacatgattgtgaacggacatccggatatgctacaagttgggtgtgtgagtcatgctagccacatgagatgcgcatgtaataaaccaattccagcgcctccataggtgttcgagagtcgaggtacgactacagcaataacgcagcggtcctcgtactacgacttcaaatgatcgagagacacctactcactggtcctcaaccagtcaattgtagcgatctctcgtacatttaattctagtggttgagttacgactactacctggttctgaccagaggtgtagtgattctcccattacctctacttcaacaaagttgatatcaggtgcacaatatcgccaagtgttttacccagagatcccttaccacaaaagacacctagcgttgaaacctatcctaatgtccctttacgccgtcttgacaaagcctctgaggaacctaaggaaacttcggctggggacgcccagagcggataaggctttgtcggatcctttagagacgaaagaccatgtaagatctggtcgtgtaagagttctcgccgtgcgtattaaccaagccgtgtaatcgaaaatggattttccaacttcacggctgggggctaggatcagtgcttgttcaaccgaggcaggtgaaaggtccaagagccttatcctccaagaacaattcgccgacaataaggctaggggctagggagagtgtataactcaacaaactgactgatcgaagtcggtaaaagagtagacgctcatatacaaaacattggtctgtaagtttaatgcattttcggttttccatacatattataacatgttaccctttgagcgttcgctcgggggctatttctatctaatattcttttctgagtattgattttaggaaaattctattcgacattatcgaaggctccatgtctctatggttctacaccaagatcgactaaggcgagtacgacaaaattcgacaaggcttcgtcgctgattctacgccttctcgatcactcgagaacagttggtggatctcgacaaggaatacggaatgaagaaatggtgtacccaccgagataaaatttcttgacttcaatccaaattctcgattacagcaagacgggagacttagtcgtatgctttgaactttcttggttgacgtcagagattgactcagacacaccctttaggtgcccgcacgaggctgataaaggaagtctaacgttatctctgaattcaccaagaacggtcacatgagctcgataacaattactctaaggtctgcgcgcggttgagaatatgaatttgttcatttgcatcgaagtctggggctactgtcagggttatggataccacatacctaatagtagttgactaaatctcggcaggacccaccatataccatgtcctatacggaaagaacctgtggatatgggaagagttccggataaggaaagacaactagagttctacatggaaacgacaaggactactcggattgtatccatatttgttcccctagttctacttgcacaaggggatacctatgggtataaatacaaggccccctaggaggagaggggacacacccaccatagaagacacagacaacatagacgccacaaagctacaagccaatacaagccaacatgcgccaagacaagccgccggatatcgacatcagagatacgcctggatcgaccctatccggtacgtactgaggctagccgtagggatctagcgctgtctctgacctcgccgggcacgaactcgaggaagaagactaccctgttgtcgactacgagtcagacctacagaccgcaaagtcgacaacagttagataggctacccccaatattgtacttggtgtgattatggtgaataagagcaataccggcttcggccaacaggatgtagggctattacctgacaattcaggggcccgaacctgtataaaaatccttgtctccatctcttttacctcagtctcgcgtatatcctagtaccaacgatctccatactatgcaaataccggaatcgcgacatcaaacgtcgacaacttgggcaccctaagtatttaacaaaattgaaaccagctcatttaatgattaatttaatatgtgaataattactgaaatagtccttgtattattaaaattaggaattgagctccgaaaaatccaagaaaatttcagagagtacaattaatcatggagaatttaataaaaataaaatccagccatgctttatatttaggaaattttatttcccacatttaacttcacttgtaatttaaggaacatttaatataaattctattaatattttattaaatactttataaatcctgaaacgaaaattcaggctgtgacaaaggcgaacgatgtaaatttggccaatggccccttccctttcttactatagccaagaacggtctttttgatatatggaatggatgatccaagtttagccaattattatgcttgatgcctttggcatatatgcttgcgtcattttcgcattatttttgcatactagagagtgcttactctttttgcccacttttacgtttcttgtggagtcttaactttgcacttcgtcatttgccctttctgcactgttttagcagggtgtttgccgaaaattgtgtgttcggtccccctttgggaattggcgaaacaagaacgagaagttcgtggcggcgaagggtttgccaaaggtgcgatgcccgtttcggcctgtttactgcgagatgataataaacggcaacagctacaaggttttgaaggttgccggctgaatgcgggcgcaccccgggagaaccctggaagactacgaccgtatccatacagaacgtctggaggacatggttcgcttttggcgaaaccatcagaaaacagatcgtcaggaggcgatctcccaatgtcgttatagtctagtctgtgtttcgcccccttccctcttagggtcgtgtataatattagtagtgatgacgaacctgattcgccaaatcattccttagggagtgaggattgttgtgggggcgaatgtgtaatttatctgtaagctaggctgtaaagccgttgctttctttgtctataccatgttgtaagacttgtattcttcgattgttttttcgaagttgataaagatgtgttttacttccttttcgctattctttgcattgtcacttttcgtgctttcgttaggtcggaacgtgttggcccatttgcgtatattagcgaaataggtctgctgacttttcagctttcggcttccgttttcgatctgtagtattctgcgctgataggagcgcttgtgttttcatattgatcgagtgtaacggtgttcggttagttgtttcccgaaacaagtcgtcggagtacgtcacccaaggttgtttcgacaggctcggattaaagggtgaatgccggtgtccattcggccacgaagtcagctaggacttcagacttgatggcagtgcgggcgaggaaatgtaggttgaagggagataactccgccacccacttgctgagccggctagtaatttccttgccccggagctcttagcccaaaggatactgtgatggcactgtaactttgtgggcttgaaagtagtgtttaagctcgcgcgaagccatcactagggcgtaagcaagcttctccatttcaatgtatcgtatcttcgccccttgcaaggcttcggagacaaaatacactggtttctggcctgactctgtttcttggacgagggccgcactgaccgccaccggcgaggctgctaggtagagtagcagttcgcttcctagtgctgggctgaccaaagcaggtggactctgcagatattgcttcaactcgtcgaacgctgcttggcattcgggtgtccaggtaaacttttccgcgccccggagagtcttgaagaaacgcaagcctctttcggccgcttttgagaggaatcgactgagtgccgcaattcggcccgcgagcttttgtatttcgcgtacgctcgacgggggcttcatttgctgaatggcatcaattttctcggggttcgcctcgatatccctttcagaaacgagaaaacccaacaaattgcccatgcgaacaccaaaaacacacttctcaggatttagtttcatacccgccgcgcgtaagttgtcgaaggtcccctgtaagtcggacgcatggtcgaaa

SEQ ID NO: 63059 - DNA, 2008 bp, Oryza sativa
tgatgaaggctgtcttagagatgtcggctggattcatgtggatctggtggtagccggagtacgcatccaaaaagctcatgagttcgcagctagttgtcgaatccacgagctagtcgatccgcggtagggggaaatggtcttttgggcacgccttgttaagttctgtgaaattgacacacatgcgccctttgccgtttgatttccgcaccagtatcgaattcgccaaccactcggggtgatcgatctcctggatcaccccagatttgagcagcttttgcacttcggctttcgctgcttcttggcgattagcagacatcttgcgcagcttctatttccttggcttggcattcggcctgaccgccagatgatgcatgatgagatatggcgaaacacctaccacctcgtcggggccccaggcgcagatatcaatgtttttcttgagcacctccaggatgttctcaacttctctttcgcccatgtcgcccccagcgatacaagtcttgtgggattggcatcatcgacctgcaccttgatcaccctgccatgaggggcgcgcttcggcgtgtgcttcgcccggtcatgcggttcggcctcatcattgtggactgctctgttgattacggccaaatcgccctttgatgtagccgaaggttgaagcccattgaccacgatcactcttgcagggccaggcatcttgagcttgagataattgtggcgggagatggcttcgaacttgttcaaggtgcgcgactgaagatggcattatagttgtatgggatgtcgacaacgtcaaacagtatttgctctttgcgcctcttttcacttgtgccgaaggctaccaccaattgtacttggcctaggacttgaactgcttctccgtcaaaaccgcgaagcgaggccggtgcttgggtgagggctagggttggcatccccatcctggcatatgcttcggcgaagatgacgtcggtcgaacttcctccgtcgactatgattcgccggacttcgaagccaactacctcggccgagatcaccagggggtcttgatgcgggaacagcactccttcggcatattttggcccgaaggaaatctactgattcaagtatcacggggcctcttcgcttgccgaagtgatgttgtgcgccattcgcagctgcatcttcttttgctgttttgacagttgattcggcgggtcaacctttgtaatcacttggattactctgcgctgcacatcttggcgctgttcggccgggggtgcttgctcttgaacagcttcgtgaggtgcttcaacagctactccttgttgcggttttggatcttgcgcgttgccatgctgtcgaatgtttcggcattgatcggtggtgtgcgaacagcgtccatggaaggcgcagtaaaggtcttttctgaccttcttgcgaacgggctgttgatggctacttgcttgctgggcgtcgaactccttgcggagggcttgaacttcttcaacaaccatcacggccttgcgtggatggtcggttctgaatttcctccaagtcatgggagcttgacctggccttggcggttgtcacaccccaaagttctcctcccaagcctaaaatttaatttataaatgaccctaagaaaatgcaggtgcaaatcaagagaaaaccctaagaaggtaatgcaaataataatcagatttgacatgtggaatttttcttgagttctacatgtcgaaattcattaacaggatttttagtggaattttcagagctctagaaataattttaaccaattaaaattgagcaagcaatattttaattccagggaaaatccttttttttcctttttctttttcttttttcctctctttttcctcctttttttcgaatgggccgtcggcccattctctcctttccttccccctcctccttgctaggccggccgcaggccgaggcccagccaggccgtcccgccgccctcctctccggggtcaccgacaggtggggcccacctgtcgggtccttcccc

SEQ ID NO: 63060 - DNA, 1891 bp, Oryza sativa
cctcccgtgtacttcgaaatagtcgccgaggtttctccagcagcagagcaaggcaagtcatgcttgtcacttgaacatgttgatcctatattgcaaatgctctattgttttctttcaaatattgcattgttttataatattactatgggatggttacctatggttaccagttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttctgatatgtcgtggtggcatgtgggcgcacggaaacgtgtcgtggggctgtgtcttgtgggtacagttgtacagctctgatcagagtaaaactattcgaatagccgtgcccgcggttacgggcggtcaaccagattcaccgtgattagtctcaccttagtgtaatcttttgaatttggataatttaggtggatggttgggcctgtcgcaacgtgggttagcgctggacagaggatgtttaattaataattacaactgtttgaatctttcagcttctgtttataaatgctcgctttatgcaaatgaacctgcttagctatcccttgttgaatccttgcatcatacccctattcctgtatgacttgctgagtaatattgacaaataaaagttccacaagatgctatcgaacaagtggttttttcttccccttttaccatcactattagcctacccttaactatactccattgcaccacacataaagtgtatttttgcatatattattctaagtgtgaaatggacttttcacatagtttatgggagactaacggtgatacaatgaaaggtaggggtgaaaatggatcggattatatccgatctgatccgttccaaatccgtcctaaacgaggatggtatggaattttagaaatcggcggatatggatgcgaatgcggatagtaaggtgcggattctgattcggatgtggtatctctaaaaaccgataaatgcggattatctggtatttctatcggattatcccataggtcgtttgccggataatccgaaaatatcaacccatgtaaccactctatctgggcatataacatgagtcggcccatccaatgacctaatttatcaattaacctaaacttccttgtttgaggcttttgccgtctcatcttacacttaagtttatgaaaggtcgtttaatgattattgtattgctgtcccttgcattgataactcaatgttgtattgattgtataaacatctaacatctgataaatttaatttgtttcccgaaccgagtctgcaccgactccgcaccatttccaacatccgaaacaatccgctctgcatgcgcacatatccgcacccgcttcgaatctgcttaaaaaatggtttagaatatggttgttgatgtgaaaacacggtggcctgggagatttgcttaactccagtgcaggtccaaaggttgatgagatgcgggtgtgccaatcagtttgatcctgcaactcacaagatatacaatagcagatcaaatagccgatcggctgataagctgatggagtagttccagtcgatgccgatactagccgatgtcaatagggttttgatcaaacggctatatgtccaatgtagataacgatataaagacaatcggctgatggtaatgtaatccagtagaaaccaatcggctaataatgatatgagagcataaacactaat

SEQ ID NO: 63061 - DNA, 8061 bp, Oryza sativa
caatgaaacctttattgcgatcggctaaaaccaacttgtatgtaatccttgtaagccgatgcaacgcccatgtaactcattggctgaaaccccgatgaaacccttattagcaatcaagaagcaggctagagatcatggttctaaatacgacttagtagatcgaatgtactaatgcatcactaagtatgaaaagaaacacaatatctagacaatcaagcttttgactaatttttagggtggtggataccttagctaatccaatctagtaaatcgatttagccgataccggcataaacccttaagcgagaatcagctgatatgactaaatcgatatactaaaactagattaactaagatatatgataaataggtaggcaaaaatatcaaccgaaccagagcgatccaagaggtcgaagcgatgcagccttgaacaacaccattatagccgatacaattgccaggactggcggaacgtaggacttacccccttcgccgaagatcgaaagccgatgcaaccccgcgtcaagtgctaaggtttcgccggatgataaataaaaacctcgggaaagagggtggctatacgccaagagtagctgtattgatctatgagataaattaaaattaccacatatgtacatatttatacccatgggtagatactagtccttgttggacaagaaagaaacttttcgaaagataaaaagaaaacataaaatccttatgggacactaaacacactttcctaaagataaaaggaaacacaaactcttcctaattaatagataaactgccatgccacatcttccttgaacacggtctcttctagataagctttctttaattgattaattttcttaatctgattactagcgacttgatgactctcatcggctgattccagaactctgaagccaatactaactctaggccgatcaggacttcggggcttaccaaatttcactgttaacaatggtgtgaccactatccgtccgaatccgatccgtttccacccctaacgacaggatgtcgttttagattagtggtactaggttataatattctaggaaagagggagttatatttacatatattaatgatttaagatttgatggtttaactgtacacattttaaaatgtcatatatattcgagaagctagtagatagtaatgctttgttctgcatctgaccgtatgtgtctgttgtgatgaaatgactacaaatcgggtgcccgatttttcctaaaaatcaggcattattttaccccttatgaaagagtgtttcagcactaagtgaaagaatgttttagttcttgaaaaaagtgaaacgcaatcggatcgccagatgaaacaatttggttcaataaataaaactaatgatttaaagccattgaaagatcaacaagttccgagtgaaatcgaagacaaaaattgaaacaccataaaaaaatccaagtgaaacactttgatctgactaatgaaacaaccatatacatagaatgaaaacattgaaacaatcacccgaaaaaagaccagctaaatccacttcaggttagccggatcatcgacggtagatgctgcccaagccacggaggagacgtggctaatgatggcgtgcagctgccgaagatgatgatttggctgatgatgccctacaaaccaccaccaccacccactcctacagccactcaggacatagccattgccgccgttgttgcatagactcagctaagtctacattgccgccactgcagctgcctgccaccgtcacccctattagccaccgccttgtcctgccgatatcttgccttatgtttctgcctgtcactaccttgcctccacctttgcctcctcacagatcaaaggggatagagaggagagaaatggtgaagagagagataaaggaggggaatagatgagaccgagagagaaaggagggatgtggggcgcagggcgcccgatattttccttcccaccaggcacccgagccaaatgctaccatatataactttcaatctagttagtaatagttagtaatgaaagagaattaccatttctaatatatacaccctctggaaagtcctccgggattgccccttctatccgcaatatatttgttatttgaccaatttcttcaactggtgcaaaattactctgcatggatatatagatccaccacatacgtaagttattagcaatggaaattgaactgattctccaatttagttttagaggaaaattgtttctccaagggaaattaatgtatttctctccaattcattgcttagaccccaaaataagtgctacttgctcttctaacttgtttagcataaatcaatgcttgagaaggaaacaactatgatgtatgataggaggatgcatgattaggagtaggatgggacaaagttttgaatataacatgtacttcctccgtttcatattataagactttctagcattgcccatatttatatatatgttaatgaatctagacatatatgtgttcctagatttattaacatctatatgaatatgagcaatgctaaaaaatcttataacctgaaacggaggtagtagtacttagaagaatactcttttcagacaaatttttaatcctaaaaagcattcatttttacaggacggaagaaaatttatattataggaagttcaaagcaataaattgctgctgcattttgtgtaacgtatatgcaatcatgcttgcctgccctacctcggtgggacgtaaagattgatgactgaatgtgaagatagagtccacaaacgcatccagcaatttcttggaagcactgcttcctgcagcagatgcctccctaagtttggttttcaatacttgctgaagctccttgaaacgaggtggctgtatgtatcaaatgaacgtattaaaatggaatcatatgatcatctcattgtacatatgcaatgcaacagtaaaatatacatttttttttggcccaaacagtaaaatatacaatctcaatctcgttgttgcatgcttatagcagtagagctagctagctctggaataattgatcagttcagttgttatatgcagagagacagaaaggagactagagaggctaactacggagggaggtgtggtttagtactgtgcgtacgatgtgcgcagaggaatcatgagtcgccaaaggcttagtcctggtgatcttggctggccttcctccggtgctgcacaggcgtggttgaagagagaagccatacatatgcatggatgctatggtcgccattgttgcaagcttgttgctcctaacaactcctccttttataaggctattccaagagatagatatagtactcgccttctgtcccagtatgacgttgttgactttcacgtaatgtttaaccattcattttatttaaaaagttatataaatattatttattttattatgacttattttatcaccaaaaaaactaaaatcctagcctgtacttttacatatttatactacatttataataaaacgaatagtcaaatgctatgcgaaaagtgaacgatgtgatctattttagctgggttttcgcaacagaacaaggacaatcctccaacataaggattctgacatattcacgtgtaaaaatatctagatatttatccaccctaagcttgggtatgttattattgcatatttattaattagagatgcatactactactccctccgttgtttataaccgatagtttggatagttccaaaatataagtattcgtggattgtttgggcgtttagcagagataagaaaaaagaactttgatatccttcattaaataagactttattaggttagattggtaattctatatattaaaaaataaaaagagaggtgattgattacacgggtataaagtaatacgaatagcacttaaattacttagatttcggtacaaatttcaattgttagaaccatttatattgtataaccgaccaagcaagcatattatattcaaaatagtggtactatagtacttcctctgttagtagaattacgtgaacaatgctataaagttttataatataaaacgttccatctccactctactcacatgaactacaataggcctagctaacaggtaccactggaccaagcagattgattggctcaacgaaattgccacgtgaatttttgtaccgtctggacgatgctttcaccaactttcactggccatctctctcactcaagagtcacggtcggcacatgctagaggccgagatcctggctaggagtctgtttcaggagttttttccaaacagtttaattaacttttcattcagattttgagaagctataattatagaattcagaaaattaattagaaaatataattaagttgagaaacttagtttctcagaagctgactaccaaccggctgtttcttaaaactttaaactacccaaacataccgtacgaccgaccaaggtttgaaatttcagtaatttcgaccccatcggcaaacacaaatctccccaaaagttccatttttttatcaaatatttctaaatctgttcaaattcagtcaaaatacgttacaaattcaaatcacttcggtctgaaaaatccagaaatcacgacatttccaaatttcggtaaccaccgaaatttcggtggggaccaaaattgaaaccttgagagtgacccggcctgacttgcgcacggggtaacatcgtcggatcgaacgacacgccaccacacaggatggataagctagcgtgcggcggcctcaaatatcatccgcgtcaacgtcgtcctcttcctcttcctcttcctctcggtgcctcaaatttcttccgcgactctcattagtcctcggatgccggccggtgtcgatcgatcggcaagctatagatagacagatgtggcacggtcgatcgacaagcaagcgggcgtcgctgtcgggctcgtgtcttttgtcacctggtaatattgtaccgatcgacgatcgagcttgctgccgaagtcgatgggcatttgaggggacgctctcttgtctccttgctctctctctctctcattccatgtacagggtaaacgatgaattggatggacactaatagttgccttatcgtacagcttccactgatgcagcttgatcctctgacctttctcctcacttaattaatgggtctgtctcctaaaataagtaataacaatttgtagagttaggtacagacattaaggaaatagttggaattaaatataggagaatatcgtgattttctattaaagaagacacggcaaaggaggtccccgttgttattgcatgctttatttaatatataaagaaaaatgtaattacaatagaaatattaaaaaacactgatccaatacatggctacatctttatctctctctctctctctgctagcttgaaaaggagtagaagatctccttttaagagacacctccaagacgacatggaaactggcttgctttcaaaaataaaaccatttctcactttccaaacttttcaagtcaccattaaaattttctcgataaagcatctttctcggtagcgaagatagacaccaaacattatattctccaaattgtctgatgttttccagaaaatcctaacaacggcccagcaaatcttgaaaaggggcactcaaaatttagatgcaacatggtctccacaattccatgtccacataaaacacacccgcggtcacaatcaggaggtgcatattttttatgatctagcatgtatcttttattcagtggatcctttaatgaaagccagccaaaagcttttatgttagacatacatttactcttcaagattcaacagcaaaaccatccacaacttatggatgtgcacaactcatgttctcactcgcaaaaaaggactagttcacagctacacatcttcaaagagaagattaattatgtacatgaacactacacgcattcagaagagaagaacaaagaaacatacaagagctcctggccgccgcgcacacgccgcggcgctgttcgtctccgccgtcgcgcggactgggcccggcgttcctcccttgagccgaggacgagtacgccgactccgacggtgacccggccgcctctcacccgtcggcggcagccgcctcccacccgctgccgacgccgtcgacggagaggggaaggggaggtggggaagagaggggaggtcgctgccgccgctcgccaccccaatactacataaacgatttttgtgtacgagacccttggtaggttgcaaacggaccataacttacagcatctggaaaaatcgagcggcattttcgcatatggctccttaagacgcctgtatggaaaaatttacatacgggcatcttaaggagccgtatgcgaaaatcgatttttccacaacaaaggtttctctttttaatctttgactaaaacttgtaactagtgtttttccctcatactaacttcaaatgtgttgattctttcctaaatgtttctaaaatcatgctctattatgttattgtgttcctactgctattagtttggccaacttttcatgtgactttgttttatcaattaaaaatttgaatttcaaaaaatggcaacttcaaataatattttgatgcagtaaatattttcagctgaaaaagtcatgaacataaaagttgtagaactcaattttttaaaaaaaagttgtagaactcatcaagatatacaacttttcttttagtcattttttcatccgataaagtgatagtaacattgttcacacaatttacatatctctcttacagtttataaaaccatatgagagatatgtgaaattcgtgaacaacattacttatctttttgttgatgaagaaatgataaaagtaaaagttatagatcttagtgagttatacaactttttcagttgaaatcatttagtttttgaaaattttgtttgaagttgtcatattttgatgtttaaattcaaactgttcaaacaaaatcatgtagaaaaatgattagaacaaaagttgtagatctttatgcgtttcacaaatttgttgttgacaatttttccagttgaaatcatttactaccataaaattatttgaatttcttatattttaaaatttaaattttatgtagttaaatcaaactcagatagagaaatgacgaaaataaaattggtagatctcaacaagttccacaactttgtttttgacaacgttttcacatgagtttatttagtatcacaaaattcgatttgaaattctcatattttcgcatgtggccccttaagaggtccgtatgcaaaaatagatttttgcatgcggacttcttaagtggttccatgcaaaaataccaccccttcacatatttttttcatctccctccactcttttttccctcccaccacttcaatttttttcaacccatctcctctctctctcccctcacctctcctactattatttactttcctctctctctctttttctctccctttctctcctctcccctctctctctctcttctctcctctccctctcagagcgggcacaggcggcctggagtaggggtggtgatggcgtcggtgggcggtggatccggcagcgctgccctagggagcggctgcagctgcggcggcgacagcgagcggcggatccggcggagcggagtattttctcacgtgggtcactaaagaggcccgtatatgaaaataggtttattttcagatgcaggctttttaagaggcccacatgtgaaaattcatttgcatgttaaggttacagttcgcgcctgcaacctacagggtcttcgtcccgaaaaatcttttctatagtagtgtcctccctccattgtttatagcaaatagtttggatagttctaaaatataagcatttgtaatttgtttaactgtttagctgagataaggttaaggataaaagattttgatgtctttcattaaacaagagattgttagtacaaatttcaattgttagatgtattcatattttagaactgagagagtgtatgtttgaattatataatagagccggccgcttccatctccacttaattcacataaac

SEQ ID NO: 63062 - DNA, 10652 bp, Oryza sativa
cacttttcgtcacttcactggcgattttttatttcaaatattaataaaacagtatttttaattaccatacaatatttattttgtgaaattgtgcgttttatcatgctaatataattcacgtgacatttgattaatgtcacttcagtttgaattaatgacgtactccctccggttccataattcctgacattttggacaaggttgatgtcaaacttttgcaactttaattatcaataactttagaactattaagtttaaaggaactagaacaacatatatagattcgtctttcaaaataatgtaagaaaagtaaacatgcatttatttattgtatatattattttaggaaaacaaaatgaaatacatattttgaagaccgtgtcattatccaaaacgtcaagaattatggaaccggagggagtagcaaattctggtcaagttggcaagaatctacctatgtagtatagcattactccctccatcccaagatgtagcaatctaggatgggtgactatgaatctggacataagtcttaggacagaggttgctacattttcggacagatgcagtattaaactaggtgaaaccctacgtggtactgtgggagtttactatatgataacaataagtaattataatgtgtaaaataacttaaacaacataagtttatataaacataagtttatataaattgatgtaatttaaatttaaatagtatatacaatgatgactcaaatataaaagtaagatggtgtggccttatgagagaataaaagaaggaagataatttagactatacatataagggctaaaaaagttgagatgatatggcttaatgagagaagaaaaggatagagataatttgaaccacggattaatcgcataagcacaattcatctgatacgacttaacgagagaaaagaaaaatataatgacctaagtgaggatgaactatacataggtatatagtgtattataaaaaaatgatggagagatatattgaaatattatgtaaattatgtgggatgatttaacattattacattttaaatctttaaaatttaataaattattaaattatagataatatagcatgtttgcatgatacttaaatgtaatacttgttagtagatgatgatgtggtatttttacactttagaaattagtgtactttaactttatatatagtatatagtaagagaggattggttgttgtccacaccagtttaattggtgtggtaacctcgtgcaacaatgctaaactttatggcgtgacgacttcgtcgtgcatgcatgcatgtatttgtagacaatgtatatgtttactagatgaataccccattgtgttgctgcggagaattaagttgcataatatatacaaataaaatataatttgattatcaaaacgaaaacaatttgatataattttgagcctgaaaataaatgagattgcatgttttatgagagaagaaagaatagacaatttagaccatagatcttttatccaaaggctagaaataattgaggtggtgtggtttaataagagaagagagaaatatcatgaactacatttagtggggatgaactatataagtatatataagtatatatatatatatgattaccttggttattctaatttgcaaagaagaaccttgctttcacataattaacaacaatttgtcataatataattatttagataactttcaatatatgtactgtttttggtaaaaatatactgatatgtctttatatatagttgagttcgatataatgctgaatgttattggtgctcgtctatgttgacaccccgttcatgttgaataccacgttgattatattgcgtggatttttttttggtataggtgctcgtctatgttgacactccattcgtgttggcgtgacattagttaaataccatgttaattatattgcgtggattttttagagaagaatattttttacccgatcggatatatgcaatcttttaaattgggacttagcttctcaaacaatctaatctgaaattcgctcctataaagatgtgaagtcagtactactcaagtcactacaattaataggctatatgtccttttgctatattgcgtggatatgaggttccgttttgaaaatagaattttatatggtctgtcaataatatattattttagaaatgttgagaaaacaaagcgaaattcttcacaggctttttttgtcactgatcgatccagtagctgtcggtgggcggtggctacggctggtggccagttactatgatcctgattgaccatgagcaaatcgtgcaacacgcgtagggtaacgagagacgctagctccgcagcctcatcatcccccctctccatcgtgcgccacggatgtgtgctgctctgctcgggatcttcatctaccgtgtgcgggcgtagctaggtggtagtttcctgatatactcgaaactactcgctccgtttcacaatgtaaaattttctagcattacctacatatatatagatgttaataaatctaaacacatacacatatctaagattcattaacatctaaatggatacagacaatgctagaaagttttatagtgtgaaacggaggaagtaccaccgattttggcccaaggacccctacctcctaaattctgtctcaagagtaagcacaagaaatgaaaagaagccagcccaagaaagagaaagagaaaacatagcagaagccctaggctgatcggctgggacgcgaccctccactccttgcacgcccgtgagagagccgcaccaccactattctctggctctcgcctctctccactcctcacctcgccgcgccgccgttttcctgtatcgatttgcagagggtagaggagggcagacgggcgacgtggcataggcaaggaacttgctccccgcccagcgcccagctggcttccccctcatggtgccatggcgcccccaccggccccctgaggccctacttgatatctctctctaccaagtcctatcatcctatgctgtctggttgtttgttgttcgatcttggagcgtgcaatggaggaaaattttgatcttggaagagtgaaacaaaacaatgtagtttagctctgagtaatctgcgttcttgggttggtacaactggagaaggttcaaattttctcaacatatagaagatcatgtcttgattaattaccgatattcttcatcgctaacaggcctagtagtccggcctgattgagatataggatgtaatctcaatcgggcctaagggagagcccgacactgatgaatgtcatcggtgatgggctataggtatatacacctctattatgtctatataagtacatctacaacgatgttaatttaggcccgattgagatggcttcattttaacggcccatgttgcctaggcatatgagcggatttgtactagtggctcattttgcttcacttgttctgtgtggagatcagattctatcaacctaatcagctgtttgagagcaacagagctgagcgggagcaccatcagcatgaccgaaaaccagctactcaccttgattaggccaaacctggttcatctaatttgtcacattggaaaatatatggatcgtctgaaataaatgttactcatgtttctttatttgtaccatattctcaacgtattactacttgtatatatcattttaggtgtttgaaaattttgatgtgtaatatgaacttgtgaagtaggactacctatcgaaaaatttctaactacaccagccactctggctcattccggttctggcagcatgctaacctagctagcttagggcaccagcaatgtacaaggagagagagagagggggggggggacattggccatcacggacgggaatggagccaacgacgggggttgcggcagcatgtgcggtcatatgtggcagcatcgacggtgatcgttggttgatctcgcggcggcaacagtgatagcagttgcgaacgcgcgcacgggcgaattcgacggcggtcctggctggatctctggcggtgtcggcgacggtcgaggttggatgcagcgtcagcgatggtggtcgcgggcagatcccgcgacggtgcgaacgagcggatccagcggcggtcgtgggcagatcttcgacggtcgcgggtggatctccggttgcggagatggcagtcgcagggggatttctagtgatatccatgcaggtgcacccatgctctctcactctcccacggcggactacttgctgcttctcctcccttacgggggcaaccaaaagatttggagagagacaaagttggagcagagaagattgaattttttattctttatgagtggtccttttgtataatgcttacttaagtaaagaatagctataaggatcatctccacatacaacgtataagtagatatcataagcataatgccctttccgattttcatattgtggatgccctaactattgagttcggtgtgcgtcgtcctcaggcgtacgtgcgtgccgctgtcgggctcgtgccgcgtcacccggtaatgtgtgacactgatgagttagccgccgaagacgtacgactcgatcgatcgacactgagcggacactctcttgtccccttgtctccttgttctctcctgcacgcggaaacaatgatgaattggatggactataatagtagccgtacaatgttttaattatagtactttgtctaatgcagcttgatacttcgtggtggtactatatatccgttttaaaatatggcaatacagtatcagatggaacatatctcactaatataaataatatggcaatacagtatcagatggaacatatctcactaatataaattttggacagaccctttgtacagattaataatactaggatgcatctcatccgatgctatattgctatattttggaccgatgtagttcaatcaaagcatgcatctaaactattttacgattagaaaaatatctgaattacccactgaactatcacgacattatgaattgtcctctaaatcccaaaatcagacttttaaaccccgaactatttataccagacaaaataacccccgcgaatcaatccgatgcagttttgtcctacattacgtacgtacgcgtggcaatccagttagcatttttctttttaaaaataagtggggtggagcagttagactctcacctctctctttactctcttccccgaccattaacgacattgacgacggcgccgtcgtcgccactccctcttcctttcttcctcgctatcgaccacggtaggtgacggcattagcaggggagaggtgcttgcctgtttccgccgtgtcggtgatatgggcccgggggtacctatgctgaggggaagggatcctttcccgtcagccacgtggccgcgtggcccaagccccacatcggggggttggacgcacggacggtgaatagcccaggagcgtccgcgctcccccagggggctcggggtatctcgccatatccctcggccccgaggggctgccttacctcgaggccctcgctcggcgccacgtggtgaccgcgagggggatcgagcaggcgggaacgcggggactgccaggcgcatttatgggcagcgccccaaccgcccaccggaagacgtgcgtcaagcagccttgaccggtctgcgaccggcgtgcgatcggtgacagacggatgtgacaggcggcagcgcacccacgccctaccctgtatcaggcgacgtgggggcaggtataccccgtcccatcgacagcaggggatcgacgtgcaggtcggtgcaccccacgcgcgtgaacccacgaagtctccaaaaatgtatgagggaatgataggggatgtcccccgtgtcaggcgaaggacttcgctagggaccacctgaggacgagcgcacacttcacttccggccaaaggattgggaagctgttcaacccagaccgatgtgggcccctctccaaggtagggaccgtagcggcggtgtatgtggtatctccttgaactataaatggaggaccttgcccagcgagcaaaggacgactcttaagaactctagctctaggaagagactagaaaaaccctagttgttttccctgagatttggattccttgtaacttctcgaagatcaacccatatataggagtagggtattacgcttcatagcaacccaaacctggataatctctcgtccccgtctggattaccatccactttgcgagcttagccccgagcgaatccgattcgctaagtagagatagcgctcctgatcatcacgcctaatcctctggccgaactcacaaagggggggtctcacgtcctcccgctagagatggtcactcctcgacagctggcgcgcaaggtaggggaaatcccgcgcgtttgtgaaggagccgtttttcttccgccccaagtttccttccatcctcaacgaccatggtcgaggtagtggaggaagaagtggtggtgtacactcccactccgtccggaagtgaggacggtagcgggagtcgtaatccccgccaccaccgccgggactctccgacccctcctcgcgaagccccagacggcggaaggaccccaaccggttaggaggttcggccctttccctgccggctgatgggggaagggcgcgccgcgccggggtacaccgccgcctcacctacgacgacggcggcacgccccaaagcgcgctccaggccgtggaggctctctacggcaccctcccgtcgttctagagccgaagaccccggtccaacggtggctggatgatgtggccaacttggtcgtagccgcacagcggcagctggccactaacggctggcccttaactgctggtacctcacgtacctctactgccctctcctcatcggcgaggaggagggcttgtcggtcagccatgatctcacggcgatcgacaaccccgacgtcgtcgaggccctcgaaaagccgaggcgttacgatagtctttacggggaacaggacgcccgaatcaacatcaagcgtcacagggatgagcgccgcgctccctgcgcgggggaaggcgcctccttatcaggagtgtcgcgccaccccgcgcgaggcggccggccccccacgcccccgtccggtggggctgggtgcaaggcctttgtggcgagtctccgaaacgtccggtggcccccgaagttccgccccaacctcaccgaggagggaggaggagggaggcaaagtagacttcgtgggccgagggcgtgggccgagggagagaggacagcccgaaaggaaggaggaaaggagggagggggaaacaagccaaggagagagagggagggatttgggccggtaggggcccaaaggaaggaggggaaatttaattggtttttcatttaatttaattgattaattgaattttgtgactttaaaaatttacttcttgagctccgaaaattcacgggaaatttcagagaatatattagggcacagagaatattacaaaaatatttccggccatgatttttaaggaaatttttttaattcccttaataattcacttgattaaattactttaacttttatttaacttctagaaaatgtactattaattgatttgtaatgccgaacgaaaatcggggtgttataaggacttccctaaaaaggaaaacaactgcggcaccgttctaggaaaggaaaggaaacggtcccgcgaacaaaaacggacacggttgatcatgcaaaatgaaaccgcggactgagaaggcagtgaattgggcacaattcatgaccaaaggcaaaaggaagaattattattaatgtgatcttgacatttttaaacttagcaacattacctccggtgctctatgaattccgctttaagtccggttagtcatttttagagcaaatagaatttgaaaaaaaatttcctctggcaattccgattattaaatatattgttaattagggttttctcctggttaaccaaagtaatttctatagactatttattagtgaattggaacctaaggaaagggaaaactctgggtgtgacattaacctgggaactagcttcacatgagtatgtgtttagagcatttgcgatgttgtagaactctagcttattttttcatgtctcttgagatgtgtaacctggtcgccaccttcgtgtggtttgacggttgactagcacgttgagtcctagtagtcctagtaatatctcctatgctctgtacttgaggcttcgggtttcataacgtgttagctttttgatttgatagggcatcgatgaagttggatggttaccattttatttagattttatcgagaccccatccaactaaatatttcacgatgtcatttgaaataagcttacataatatttaactcggggtgttatctatatttttttaaaaaaaatataatcatttcgttgaacaaaatgaggggatgttcattcgggtgattaaaagagtttgccattgttccaagtgctatcagccatcagtatcaggaaactcaggtggtcacgtacgacacaagggtttagaatcaacattcttgccccatgcatcaccagtgaagttgcttctgccatgccaagaccagttgactgataccttagtaacaacctaagtctgtgtggcctttaatcagtttaagaagcaaaaccaatttcaggcaagctagcatctgtcttgtgatagctaggtatgctcggcaatttacatccttaagctgtaactgtggtggtcttcgttttgtagttaattaagatttaagaacatacatcatgtagccttcacatgaagatttaagttgctgatcgaatcctacaaggcacatagagttaatttccaaatcctttttcctggcactgaaccggaagagctgctcctagctagcctcccaaggctcatggaaaaaaagcgtgaaatttgcagttttgcactcgaacgacgtaagcattcaccacgctctgcacattattcctgggatttttcgtttctttatctaaggagtgtatctgtactttgcagagagtagtatccaagaggctgtctcgttttatgtttaccactgcgttaaattgcattcgtttgaaatgctaatatgctaattaattaaaaacaaaagaaccacaaaaatatatagcgaaaaggagccgtaaggatgatagtgccgtcacgaattattgacttaaaataatcacagttgttgtatcttcgccggaccggctgaaagccggccagaatgtattaagacgcgggagcttacaattcttgtaccgtacatgtcacctcggcagtaaatatattatacaattcttatttatttcttgatatatgaatgttccatgaaaaccgtaggatactctttatgataatgttatctttaccaatttagtaaattgtgaaatctgtgcgcatcaaatatacttagggctcctttaaatcataggattgaaaaaatgtaggaacaaaaaaaaactcaggaatagtataggaaatcataggtaaaactaatggttgaaaaacatgggaaaattataggaacgatcgtttgattgatacaaaggaaaaacataggaatgttaagtattaagttaatagccatcaaaatttgaatggttttatgagggtaaacattgtctttcaatagtgttttgcctcgatcctactcataggaaaagaaaaatgagctcaaggtggatgttaattttcctatggaattcccttaaaatcatggtcataggaaattttcccatgcatttcctatattcaattcctacaaatcaaagggatgaacagtaccaaatcccataggattattgatcctatgtttttcctccattttttcctatgaatcgatggaggccttaatgtgctgaggccgtgggcgggtagcgcgctggctttgcttgcctgaatagcattgcgacgacgagcatgtgggcatgggtgcgaagcagcggcggcgagcgtggcggcgcgcagggcgtaggatgatcagatgacgctcggcccatgacatcgcgctgggatgacacgcgcgcagcgtgtgacgggcgcgcatggagcgcagctgcgctgccgtgtcgcgctttgcattggcgcgacgccgacgaagcgacgagctgcggagacgcgcgcgcgcgcggggcggcaggacagcgcgccgcgcggcgcggctccttgggaagacgtcgcgcgaggaaccaatcacagagcaggaatcatatcacaagtaaaaaaattattttcgcagagaatccttttactgcacatatgctacggtccataaggaaatctgccattgcagtaagtcaggagggacctgcatcacgaaaccaccggtggaacttacttttagaggcggtagtcgtaatccagacacctttgaaatttgtctgttttcacagtgcactaagattgttactgatattaggaagggtgtaatcctaatttattgcgtacaaagctacaaaacacttacagatgtagtaataaaggacacaagattaatcacagtatttgtaatatcataagccatatcgaattgtcagaaaatgtgcctataggtatggattatcgccaaaagtttggcagtaatttatatgcttatacaagagtcatgtcttcttgtatgtagttcttgggatgaatgtgccatgaaa

SEQ ID NO: 63063 - DNA, 5575 bp, Oryza sativa
  unsure (1)..(5575): unsure at all n locations
tgtaatgtaatgtcaagaatataaagaatgttgtaattaacatgctagttcgaatatcaaaagtaattttgaattttattttatctaattttctagacagaacagtcacgatagtttagcacatattatagaagaaagatgattctagagagctcgcctgtgaagtgtttatttcctcgtcatgtacaaaggaaattatccatccatcatcttcatttgctccattgacctttggaacaaaagttgctcccgagcaaaactgatttttaccaagatgatgatactccacatttattagatctccaccaaactatctcaagagttgcaaaccatgatgttataagatatttcaaaaaagaaagcagcaagacaaagacattgttttcttatatatatatatatatatactaccttgttgttatcttgaagatgtagttttgcgaaacctccaaattttggtcgcactacataaaacgaaagtaaagttagcacatgatgaatagttgaatatatccttcttggtcagtttttttaatatacccttagatatggtagatccgacatgatatgcaatatttaggttatgcggcagaaatgttattgtacattttcattatattttccttgttgaaattttttatcctaatcagcaaataaactgtttaacttaattttgtcagttcaacttagtgctgaatatatttaagacaaatgcaatctttgctgagaaaatacctgttccacagccaccttccaggctcccttggacatcaatcacttgtgcatatgcatacttgtgatgcaggccagcatatttgttattgatcactgggaattccagagcaacatctgtcccagttaagtatttacctgtgacagccctgcttttcatgtttaatctccactcatataagcgaggaaaagatttctcactgggtccttgattagctggctcttcattagccgtgtgctcaagtgttatgccagtaattatggaacccggcactcgaaatcctctgatgacaacctaataataaaaaattaaacaacgccaaattatattttgaaagtgtttgcacatttactctacatggatttgatcttgaccaaatcattcaaacacttcagcaatttgattgtttcttcactgagtgtgacaaaaaggctcttgatttttaatgtgtattatgataaaaaaaaacataccacaaccacttgtttactgacaaaatggcctctatgatctaatcatccaattcaaataactgctaatctcttggagcatacattttagtgtagcagttcaattgtgcaacacagcttcatgtcgatagaaaaagcactatacaacaaccacttgatacgctacctcatgatcttcctcaaagcaattgatgagatgcaatgtgcaaaatggttctacatcgaaccatattactgaatctgcatctccatgacggggcatgactccaattcttgcataactttctgtttcaaaatcaatcaacctatagaatgttatataattaatatgttagaaacatggaagattgttgtctcaacaatagtatgtctaacataggtactcacggagctcctcttagaatcctagtaaggtccactgtaagaggcatatccatgataatattgtacctacatatggaagaacggattaatcatacttttgatgcaaatgtagttatcttattttgcatttccaaattgtttctacattgtattgtattgtattatgttgtattatattgtattgtattgtattgtattgtattgtattgcattgtattgtattgtatttgcagccactgtcaccaccgcctcatcaacctgctgactgctgtccatccaatgccactactgctgcgctgagttgctacttctttccaattcctctatatgttactgtgagccaatccaccaagcagagaagcacaggggaagaagaaaatgaagagaagaggagtagaggtagatagtttggagagttgtgttcaatataaggttttcggttgaaattaggctagatgtatcaattttaaatacaattcaagtttaatagtgggcgcttcaaatttaaccttttgattggtaagatgaaacaaaacattgtaatctgggattgatctatcaagaaataagttttatgttctaaataaaagttgtaggtatcagtcatatttttctaatggcacttgtttcatttattttagatcggttatttgtaagtaattgctaaaattttgctaacatggtaagaaaactggtgcagcaatccttttatttcattttgataattataaacacataactaggtcatttgcataacatgaaagttgcaggtactcttctatagatgctccagatgtacttaatgttttcttttgtttaatggtataaaagcaattgctagaatagcgagcaagcaagggtttaggtagttcataaataaatttctatgttttggggttttaaaaattatatcaagaaattagtgtgttgtttatttactagcattgcagttttttttttaatttagatgcatgttatttcgttctttttgtttggaggattctgataccaagttaccactaaggttaaggcaagtgcacggtaactatttgtatatgatgcgtgaactagtttaatttaattgtttcacttttattatgttgtaattattcatgtgattacgtgtaatcttgaatttggtttcatcttatcaatcatgttatatattcatgtttcatgattctgctctttttttggtttaatatcaagtgccacgcatagccacggaactgtaatttggttctttattcatgacacctgagttacattgaacctaatactcaggttaaccagtaaatgctaaaatgatattcgcgtaaaataaaaatagtttccgactcgctcttttttataaattattccgtacacattttctagttccatataatcttgctgagtattttatactcatctttgtgctttatttggtttttaggtatcacgtgacaccagcatgcaaggacgggaatagcacccaacatcgatacacttatgcacatatgaaaattaaacttagtttgtaagattagattaacttggtttcattatatttggatagtttacttcatgtttatgttattatggttgttcctgatacttctaggatgttgttgatggtaccatattcattgatgctggtgtgtttaaatattcttataattgctatcgtgcgtgtctataaatataaatagaactttgccatggtttttaatcaattttagattttagactaaaaaagtttttatgtgtggtgttgatatctaacactccagatgaatagacatagggcataaggcagttaattaatcaaattctcttagttacttaagaaatcaaatgacccattcattcctatgatgtttcacaagtgcatttgaaccatttaagatataggtctatctaaatggaagtcatgcactctgaaggacgggactacagagtgcatgtgcactaattagtgttaaccacatatcatcctcacaaatgctaaagttaatatgtactctcttgctataaagttttggcgtaaaccgccacatcggatccaggggtgtaaagttttggcgtgtcacatcagatatacggacacacatttgaagtattaaacgtagtctaataacaaaacaaattagagaatccgtccgtaaaccgtgagacgaatttattaagcctaattaatccatcatcattagcaaatgtttactttagtaccacattgtcaaatcatggcgtaattaggattaaaagattcgtctcgcaatttacacgcaatctgtgtaattagttttttttgtttatatttaatactccattcatgtgtctaaacatttgatgtgacagagtgtaaaattttgtcaggggatttaaacaggacctctatgttccatattgatcatcataaatgttaaagtcaatttacatgcataaatgcagtaatactacatgtgaagtgaaggggccaaggttatatgatgatcaatttggaatttttgagttttggttatatgatgatcaatatggaatggatggaatatatctttcctacgcaggaatatacattcttgtaataaggaaacgattcctaacacctaaactaaaacaaaattttctcttaagttacttttgtaatatatgcaaattatttttatactttattgaatttacttctagatgtctaaaaagtaatttaatggagtctaaaagtaactagatatgttatataattaaattgtaatttttcatcaaaatataatcatgtgatatcttttataaagatttaatngcaacgaacacaacagtgtaatcggatcttagaaaaaattgaagcttatgtggtaggaatatatatatattttacttgcttgagggaagtagaacagtgcactagttaagctagatttcccggaacaacatatatgcagacaacatatcatagctcgtaacgggatgctcgttaggtcaaaaatgtgcgtgcgtactaatttgattacacacactcttaaataagatagctttcaactaattctagttcatttattaacatatatcaagctgccatgttttgtttgtgcgaacgaaattattaccaagttactggtcactggcaaatgagttgttacttcctcgtttcaaattataaggcgcattttgttttgttaggatgagactttcactaacaactagccacccagtcacgcttcgcgtgactctgagcgctgtataggagttgacgaccgatcttgataattacggaataatttctatgagactattctctctgttctcaaatataaggatttctatattgtttaacaaagattatgtttgatcatataaaactttatatccctttaccgaggaatgataggagtttagaaaaaagttgagagtaggataaaaaaaattgaatggaaagtgagattgaaggtaagttaatctataaatccttatatttttgaataaattataaatatttgtgatgcttatatttgcagatagagagtagctacctttatgcttttttgaagggattaaggagagggcaataaaattaaatgcgagggttgtgttttatttttatttttgatagaaagtgtgaaggttatggttgattgagataaagaagtatatgaagaaattaaaaagataatggttgtagttaattgagatgaaggaatatgtaaagtaggataaattttatatactgtcgctgcgggtgaatgagacgagctgctggtgttctccatctgaaactatctgtatatgcaccggtgtgcaccgatggatgcacaggagctattcatctggaactttcctgatgtgtgattggtatacacaaatggatccaacggtccaattttattcctcctctcatcctaaggctattattcttcacatgacgtggcttattggttttagaaagcttgttgctttcacatatgtagattactatattatgatatcatttaaatgatacaaaagcataata

SEQ ID NO: 63064 - DNA, 3557 bp, Oryza sativa
tacaaaagcataataataattaaatacttttgaatacaaatctaataataaatataattgtatcattaaaattatatcgtaatagaataattgttggtcaaagcctatcgtaagaaacaaaatatgtcttttattttaaaacggcgagattaatactttagtattagcaattattacttaacattaattaaatatgggctagtagcttttggagaagttttatctgtcatggtatactattttttcagagaagggtaatttttacccggcctttatttccaaccggatatatgcagccttttaaatttggaacttatcccctcaaacaagccaatataaaattcactcttacaaagatttgaactcaggaccttagggtgttactcagggcactgcaatcacttggctacatcatggtatatgatggtcaatatgcttttttatatgtttggtgaactattgtaatatagaactagtgccaaattttgatatagataaaacaagaaaacatgtttttttgtttgaaaaacagttggtagtggcattgaacttacattttagtgaccccaatttcatggcaatatgtacatctttctagcttgagatcaaccttccgttcaagtttctttccatcctctacagaatgtgtttggcgtgatcaaatgtacttagtacttttttttggtaaaaggatatgcagaaaaagaattgagattacagagctaccaaacctgagacaactccaatagttaggaagggcttcacaatgttaaacccatatatgactaactctcctgaccctggggctacctgcgcccatagaaaaattggatgcaataaggtaacatgaaatagaattaatgtacaaatcaaataattataattaagcatcccaacgtttcccatggtcactcatattcttagcacaagcatacattttatgctagatgttggcctaacatattaaatactccaagaactgctgaatttagcattaataaaatggtaaaaggtgacaaaactataagccagttctttaccatgtttgtcaaggtaggtcaatctgtgaatggcacttttcaagaaaaaacaagtgctgcactattgaccttttttccactagttgataagcttaaattatctctctaccttttttttcaaatttctttctctcctgctcttaagatagtaatgtgcttgtaaatttcatcaaaatggaagacaaacagatgttgagacttatagccaaaagcaacgcaaaacaaaactgaaaagagatagtagaaggcaagtcttctgtagaaaatgctggtgaatatggaacaattaaccaagaataaaacaaactgatacataatcttcatgtattcagattcacatgtttaagaggcagagaggcatatgcagagggaccaaccttggggtgtgctgtgaatggcatgttccactgaccatcgacgacccagctacacagtgtgccaagattgtccaagtcaatctcgtagggaatgtcattctctgccactgagaaaaccctctcggcgtgctcaaacacaccggtattactcatgtttctaaacaccttgccaaacctcagctacagcaagatatgcaattaatgatcagtgtcacttgaacactacgtaactacggtgccttagcatatgacactagaacagaagaaaatgctattatcaaatctttatgacccagagggtactatggttcactagagatgtgtggtagtggatcaagggcgaaaatcaaagaggacaaaattgaaattgtgaagttgcaaatgtttgtcaacatagaaaatactccgtgtttgtttttataagacctgtaattttttcaatcttcctgcaaaattgaagtcttgcaccatgagtttgttgaatatgttcaatgtttggacatggatattacatggcctctctcctgcatttatcagaagaatctcactaaccatgtcacttcagctatctataagaagtatgagaagcatggaagttttaactcatactccctgtggcatccctattttcaaaacagaaatcaacatttgaaaatatttttcttatgatgtcaactccgtccatacttgtttgtaatatattatgaaagaagccaatggtaaaactataatattgtataccgtgtagcaaactaatatgtattacttcctccgttctaaaatatgggatattcttgttttccataaagtcaacaattaaaattttgactaattattgagctaacaattaatatatctgtattgtgtcatgcatatagtgccattagatttgtatttgaatgtattttcatccgatgttaattttgttactattaataatatattataaacaaaattagtagttgaagaataagaataaggctggagaccgtgtaaaaggctgttacacataatattttcaaatagagggagtttctctttattgtaaactctatattcattctagctacttaaagtaataattatattttgatagagacaagagtagtaaaaagttccttgccgacaaaaacagagggtgcaagttatttacaaaccatgttcaaaatgctggctgcgattatggcaagagggtcacccttgattgctgagaggaagcatggtctctgacgatccctttcagtattaaaagtgtcagattgcacgtagcggttgttgtatgagactgaccaagtgtttccttctctgctcttggtgaagtagagggcatgcagcatgccttctccctcgacccagatgtcttcagactggccgaagattgagttcaccttgtgcaaggctccaaagagagggttggaacctgcattatattggttgagttttaatctattcagaactagagcaaattaagatcaaactttgcgaacctaataatagcattgtgaaaagtaatactgtgaactagcatctgagcacataactgacgtagcacaaaagtcaagagttaagggcttaaactacaatagttttcgctagcttgctagttgctaatgaaagattgaaagaaaattaccatttctgatataaacaccctcaggaaaatcatctgagatcgtcccttctatcctccatatctctgttcttccaccgatttcatcaactggtgcgaaattgctctgctcatggatagatccatcatataaattagcacttgcaattcagccatttttccgatagtccaaactacaccccttaactattggatttgtctaataatataagaaacatccattaactacaaaatcagatattttataacccctaggccttcaactattaaaacaagtcaaaattcaaccataaatgtaatgatattatacacccagttttagtagcggttttcatgattttcacaacaaaatatatattttttgacttatattaaaccactttctacctatctgtctaacttggtttttttatcgtactatttggatttcaaatcatgaatattaccattaaaatcaggttgtattctatttcatccggttatgggaatggaaagctgtaaaatatctat

SEQ ID NO: 63065 - DNA, 10636 bp, Oryza sativa
tggtttccatcgatgggaatataacaaacatgcttgtaaaaatagccctatatttataagtagaccccttaagtgacagccggcgataatcgattttcattggcggtaccactactgcagatttgatcttttttctatacaaaacccacaataggttgtaggcagcccataagtgctcccgcatgcaaaaaccactctcgtgggggcgattgatgggcagcatgggataatccagatactgtgattatacgacaattccacaacacccccattctagacgaccatgcaagggtgcaggtagctaaggtccacgctgaacatgtcacgttcgagctagacatccctaaaccagaggggatcgaacttttgggagatgcaatgaaccagtttgtcttgtggcatcatcgagacatcatccttgccggacaaccaccatctgccctagctccatcccaaccaatgacagttgccgctcttgcaccgacctccccgctaggatcaccttccccacaagcttccttgcctctagtaaggtcaccacaccatccaccatccctaccagtttcgattcctccggtaacgtcaccacatcattcacgttctccacctacaccttctgctcaagtcccttgccctcccccttcgccacctaccgaacaaccatctcccattcaccaattaatctcctcctacaccacaatttgctctcgcccaacaagtcccacctcaccaagtaaatcaatctggccccatttctactacccttgaacatcgcaggctcatacgaaaattggtttccatgtacgaccacaaggaaatgtcaagagataaagagaggttcctgttttcaatcttcagtgggagaggttgggcaaagaagaagaaagaagatgttgctgagctgtaaaattcctagaagtcagtagtatgggccaaggatgagttgcaatcttggctatctgtagatgtgccccaagaatataaatatgacaagtcattcttaccatggtacattatgaataatctaccacgacagatgagggtgatgcatgaatggtacctcaaggtatctagaaaggccctaagcttcattagtgtcaaggtcccacgagacgatttcatgagtaaaaccaatgagatctttatcatcaatttccgggacctacacgccctcttcaagctcgataagatggacatcaatctcgttgttgcattttgcgtgtaagtgtttttacactagtttgttgtaagtgaaatgtgtgaaagaaacttccttttcaatcaagctgcattccataggtcacagttctacgacacagaaagagcgaggcaactcgttggctatatcgagccaacaaggatttgcaggccacacaacaaactgtacagcttcttgctaatagcccggaactaacagataagacaccggaggaacacaagcatatatcaagaaattgcacaaggaagaagattgaagtagcttgctacttgggaaccgcaattctcatgcactgagacaaaaacatcataatggtcccttacgctcttatataagcagcatctcttccatttgattattttttttcttgtaatacaagataactagcaaatgtcatctctaattcatctatcttgtttgcaggaccactatattttattcccggtatatccgagggaccacttggtcgtcgcgcttgatctggcacactatccaagaaagcctatatggagttcctcactatttcgaatttcaacgtagtaacataccacctcagtacctaattgccgttccgaaatttgaaagtaacacaaataaatgttttatcggcacagagcacgtaaattttatgtcaaacatcacaggccagtaaaggatgtgcagaggaaaaagcttcatgtgaagacggactggccggtatgtaatggcgtgtgccatgcacacaaattgttgtaatcattactatttttaaactgactggtgttattatcatgtttgttgtgtttcaagcaaccctaggcactaacctatgtggatattaagtgtgcaagatgcttagggtcaacaggagatgcacaacaaacaacaataacgtaagtccggagattgttctctacatagattatttagtcacatttcatttcctgactttcattgtcttcgttttttttcacagatccctcaaataatccttatgtagcaaaccggttcaacaaacaaacaatttcgaacatatgcgctgacctatgccacttcatatgtcgtgactgctgcaatgcattagggaatcctatcttaccataaaattataacccactaaatcctaaatcttaacatacaaagatatcacaacattatacaataatcttactataaagttataacccactaaatttaaaaacttaacatgtaaagatggcacatcatcatgcaataacaagatacaacatcatcatccactaacaattattatatttaaacatcatgcaagcatgctatattatctataattctatcattaattttattttagagttttaaaatgcaagcatgttaaagcatcatcccatatatttcacataatattttaatatatctcttcatcatttttgtaatatcatatatacctatatagttcatccttacttagttaattaatgttatttctctcttctctcattaagtaatatcacctcagttgtttttagccttagttgattaatctacagtccaaactatctccctcatttttttctctcataaagccacatcactttacttttacatttaaatcatcattctgtatactccttccgtcccaaaatataaacatttttgggtctcgacacggtctccgagatactactttgattaacaatatctatggaagtaaaatgttttaaataaaaagagttgcatattatgatagttcatttaatgataaatatagtaacatcaaatttatatgattaatctttttagtttttttgctattaatagtcaatatttaaaaagtttgacttggcactattctaaaaatgtttatattttgggacagagggagtattatttaaatttaaaatatcataaaccccatcaacttatgtaagtttatactatctagtcatcttacgcattattttgactcattgttattatagtaaattcccgtagcaatacccgggattcacctaatttctacgattatcagagcgaactgggcaaagaagacaaattcaagcccctgaaagagagtaggagaaagaacgtatacttataataattatacacacatatatatgtacctcggtgggacgcaaagattggtgactgaatgtgaaggtggagtccacaaacgcatccagcaatagactggaagccatggttactgccgcagatgcctccccaagtttggtggtaagctgctgctgaaactccttgaaatgtggctgcaagtatatatatcgacaacgcaattaaaataggatcaacattagaggaggggaggtcgttcttacattggatgtgatacatttggtgaaatgatcagtcgcattaggccttgtgattgatggtcttggtgttccagtagtgctgctccttctgcacaaccatggttggagagtgccgccatacatggatggagatgctgcggccaccatattgatcgtacgtacgttgtgcgcttccttgctatctaatttgtgtgacagctacaactattgtttcatccactctatttgtcagaggaattcggcaagagacgctcacttttatagtaacctagtagctaagtactaccgtcgaggcatgaggcatccatgcatgggcgcatgtgccgtatttaagacagctttgccccagtaatcaattgtatggtatttttaggacttataaatttgaccacgcggtctatgatattatcacatgtatttattagataaattttatgcatgcattctttcattttaaaacagtatttgaaagtttttttttttgagaagtatttgaaaaatattaatggttgaaatttcatgagtccattaactaagctttgtgtatgtcagatatatatatagttcgatcggatatacagtgtgattttgcaatgcgaacatgcatggtccattgactcatgatcgagttaatcaaagcagccacacagtaatgttgacttcgatcttggaagccacagtagtgtttttggtgtagaatctggcattagttcacccttcagcaaccaaatttgacgatctatggaatgattgtatataagacaacgcgcagggaggcggcgcctacgtacgtatggcgacgaccagggcacacgtacgcttatataatgtcacgcccggaaattcactagtaatttccgaacttattagtgcataaaatcctcgtccagaaatcagccgaggtatacaaactgacaatttaatatacaaatccatcataataataacgttacacacttacaaaagaaaagaaaacagcagcggaataacggtctagcgatagcttcagctccactcccacaggcagctcaactggggtataagtcaaacgtcttctccttctggatcctttttcttcaactgaggttgattgattattgcaagaatgagtataagccaaacgtcttctccttctggatcctttttcttcaactgaggttgattgattattgcaagaatgagcatatgacatactcaacaagctacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctacacaggcccaaccatcctgaacaaccatacccggctgtacagatctaactccaaaccaggagctaagcaaattattaccaggtataacatccataataattgtgagaggtgtgagactaatcacgaaaaacattgctcaacccgcccataaccgcgggtacggctattcgaatagttttactctggccagaggtgtaccactgtacccacaagacacagcctcaacatcatgtctaccatgcgtcgcgatactggaaagtacccgaatagaggctgtaacaataccctctgcacaacacaactcaccacagtgcaccattcctggatcataattacccccttataaaacagggcatggactccccagcgacccccgtgggcttatctccgccacttctcagtctggtgctccgcaatgaactatgctatacaaaaggtaaagccgttgcccacgctggcttgtggttggcacggttaatgtttcacaacagtagctcgcgaaccggtccttcattgccatgagcacgaccttcaaaaccatgtgcttacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaggctaacacgcaaaaccaagaaaaagactaataaaaaccaaataaacagtaaaaaacaagcataaacagtacatataaagtaaacaaacatgtagatcatgattttgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggatgcgactttggaggacatgtacacgtagaggacgacgagacgaacccaacggtactcaccctcgaaccaaacgacgaacaacgacggccggcgacgaggtctagcggcggcgcggcttcggtcgacggcggcgacggggctccggtgaccggcgacagcgaggagggagcggccgagcttgcccacacctcggcgcaccttacggcggtgacggcgaccggcggcaacggcggaggcgacggcgcgacacggccgaagttcggccggcggcggcggcgaacttggcggcggcggcggagaggctacggggcacgggagaccacgggagtggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttggggtaaagatagaggaggataagaggaatatttcccctcaactaaattggaaaaaggagcaacggggaggcgagatttggaaggaggaggcggcggcactgtgcacggcacggctggctcgggctctgcctgagttggaagatgaacagtagtgcagggaaggaaagtagacttcttgccgggcttttcttttctcagcctgattagaagagggagcaaaaccggactttggctgagagaagaagagaggatgcaggctcgggttgggccggcggaagagagaggaaggaaaggaatgggccgattcagcctaagacaagggaggagaattttattacttttccaattaaaataatcacttaaatgatctttgaattgttaaaaatacttccaatgctcaaataatttcaagaaaaatcctgaaaatactgggacactcaaagtacttaacaaaattataattagaccatttaatggttaatttaatatgtgggtaattactgaaatgctctttgtatgattaaaaattaggaattgagctccgaaaaatccgagaatattccagagagtataattaaccatggagaatttaataaaaattaaatccatccatgctttaggaaattttatctcccacatttaatttcacttgtaaattaatgaacatttaatataaattctaataataatttattaaataatttataaatcctgaaacaaaaatcaggatgtgacatataatgtaggatcgaatcacaacaactaagccaaccagaagggggtgaatggttgatatgcctaaaaaccaaaacttttagtggaaataaaagttaccctcaaattcgacggatcgcggtctgaccgaagtagttccaccggtctaaccgcctggaacacgccggtctgaccgagatcgaactccggtcgaaccgctgagatcgtctgccgctccctgtcgctgccgcccggtgtgaccgccttgtgcccgccggtcttaccgccatgatgccgccggtctgaccgccggtgcgccactggttagaccaccgaaacccggtgaaacataaatcgaagaactcttaaagtggatgacaattttattgattctctctgtgtttacaaagtgcaccaatagcactcattacaaaaatttcgactaaactcgaaaccctaactcaactatcaactcaattgctctcaaaagcgataccgggaagcctcacgctccccctctatttatacccgaggtaggcagcctaaagccacgaaccaaactcatgctagaagtcctaatcaccctaggaaaccctctagtacaagaaacaaactttacataaccaatcataccaaatttggactccttccaaattcgactccgcatcccatacgcacacaatacctccatcgtatgccatatggaatcttcaccaaccatgtgcattgaactctaaccttagtatcccgcatgatctctgaccaccacggacgtcgtcttatccccaagccgactcccggtccatcaccgcaaatactctcccagcatctcgagtcacctacacatagaacaaacaaagaaaccaaaccatattccgagaccaagctatccccaacatgactcattagtagcaaacggcagtattacatacgcatagtatccatctagaagtcataacaatgaaaaaatcacagatatctaaataaacaacccgaaaccgaaaccgacacagcgtcggccggtcagaccatgggctgcgccggtctgaccgcgtgatacacgccggtctgaccggcaacccatgcccggtttgaccggacccaaatccagcagtacctgtagatcacctatgaaatagaatcatctccaaaaccacttcgcaaataaattccaaatcacaaaaccaataatctccaataccaattgttcatcacagaataataatcaaaaacacttttgattttacaatctcccccttgataaacacattggcaaacttatcaaaaatgttttggtgtttggaaaaaataaaaacaaaagtggtaaaaagcacacttcatacaaacgtacacatcgtgctcaaaaatccaaaagaaaacttccctcacttttgaaaagaaagaaatttctaatcgaaccaaaaacaacatgctcttctcaactcatttgcttctccaaaaattttcaccttgcttctcccccttttgacaatgatttcatcaagcataggaattatgttcattaatgtttaagagcttagcatacatatagcatatcaagtcatgtgttgcaataaagagaagatgaacccatctataatataacaagcatgcattaaccatgaaccaaagattttacaattaagcttgaatcaactatcaaaattcatgatttcatatgatttataatgcaacatcttaacaagcacataggttgaaaaataaacactaaacacatataccaattgcattaatcacactttctcagatgagcttttgcacaaaacaaccaagagaatttttttaacgttttctttttcttgagcctttttgcccatatttttctcttttattcggggtacgtccctgtcgtcaagactgtttccagggatttggtacccattattttgctcacatcgaatacgtccttatcgtcaagactgtttccaaggattcggtattcatttttttcatattttttattctctttgcacaacgagcaattaattcaataaagcatataagtagagcatttatagatcaaaccatatgctagcatcaacattgcatattagcttaattcaagtatagaattaaagtgtcatgcatcatctcccttaaaaacaaaatctaagtctcataaaaagactagaatacatacaagctatgctagagacaaataaaccttcaaagtattgctagcatgcacaagaaaataccatatgtatagatcaaagctctcttttctcaatttttctcattgtcatattgttgcttgataaaaccatgtgatacaaaactcccactcaaatcatgccaaaaggatgaattattcccaattcaccacgaagaaaagcaaaacgattagaatccaaaggtttagtgaaaatatcagcaagttgcaactttgtgtccaaaaactagaattcaacatctcccttgtcaacatgatccctcaaaaagtgaatacgaatatcaatgtgctttgtgcgtgaatgttgaacataattcttagccaatatttataggtactagtattatcacaaaagagaggtactttctcaaaagtaagaccataatctttcaaagtagattaaagccaaagaatatgggaacaacaactagcagcagcaacacattcagattcagcagttgattgagcaacactagattgtttcctagaagaccatgcaatcaatgatgtaccaagaaaatgacatgttccactagtacttttcctatcaattctacaaccgccaaaatcagcatcggaatatccacttaagcatatagaagatgaagtagaataccaaattccaaactcgagtgtatgattcaaatacctcattattcgtttgaccgcttgacgatgtgaagcatgaggagaagcttgaaagcgtgcagacaaacacacagcaaactgtatgtctagcctagaagcagttagatacaacaaaaagattcaatcatacttctatactccttttgatcaatagcttcaccatcttcatcaggatccaacacaactgtagaaccaattggtgttgaaattggcctgcaactctccatcatgaaccgtctcaaaagatcctttgtgtacttcgtttgatgcacaaatataccttgagatgtttgcttaatttgcaatcccaaaaaatacgataactcacccatcatgctcatctcaaattccctgcgcatagtatcagcaaacaccacaaccaaagcgtgagttgaacaaccaaagatgatatcatcgg

SEQ ID NO: 63066 - DNA, 1366 bp, Oryza sativa
ttcacctgggtaaaaccttgagcaacaagtctaactttatttctcacaatcaaaccatcctcattttgtttatttttgaaaacccacttgattccaataatattttgaccaggcacttggttccaataatattatgcccagaaggtggttcaactaaagtccaaactttgtttctctcaaaattttcatgttcttcatgcatggcgttaatccacgattcatcagttaatgcatgtgaaacatctttgtgttcaaaagaagcaacaaatgcagaatttgcacaaacatcatgagtcgttattttagaccttgtagtccgctcacctatattactaatgatttgtttcggcggatgtcgtcattgaatatgcaaaggaacagcgacttctgaagttgattcacgttctgtatcagcactggtcgaagttgtaatctctagaggaccatctcgatcagcatcaacagtacccgaacccgacaagcctggccggtctgaccgcaccccctgtggtggtttgaccggtggcatgccggcggtctgaccggcctggcgctcggtctgactggccgagctgacctcgtcgtcgtcgtcgctctcgtcttcaaaaatacgaccatcctccccctgaacctatgacaatatatctgaaatatcgggtctagtacctagactagcctcatcaaaagaaacttcgcaagtttcaacgattttgttagtctccaaaataagtacacaatagcaacgagaatgtgcagggtaaccaagaaacaatcgatcggtagaacgtgcctcaaacttatacaaatttctagatttcaagacaaagcatttgcaaccaaaaacacacaaatgtgaaactttgggttgacatccaaatcgaagctcataagaaggtttttccaagtttggaccttaagaaaacccgatttgaaatatagcatgcagtgttaatcgcctaagcccgaaattttctacaagtttaatattcatccaacatcattctagccatctcacccaaaacacggtttttcttttcaccacccccttttggtgcggaacacgaggagaagcaaattcatgttcaagaactctttcattgcataaatgttcaaatgaagcatttttaaatgcaacaccattatcacttccaattcttttcaaagagccaggaaattcaagatccaatcgaagaaactaaccacgaaagtgttgaaaaagactcgtccttagttgccatgaagaaaacccaagaaaatcgagaaaaaatggcaacaattaccaacacaaaccacttttcttcaacatattgcattctagctggaccaacagtgtccaatgtaatagctgtcccggtgcatccgtcat

SEQ ID NO: 63067 - DNA, 965 bp, Oryza sativa
ctacaccccttaactattggatttgtctaataatataagaaacatccattaactacaaaatcagatattttataacccctaggccttcaactattaaaacaagtcaaaattcaaccataaatgtaatgatattatacacccagttttagtagcggttttcatgattttcacaacaaaatatatattttttgacttatattaaaccactttctacctatctgtctaacttggtttttttatcgtactatttggatttcaaatcatgaatattaccattaaaatcaggttgtattctatttcatccggttatggtaatggaaagctgtaaaatatctatttttttagttgatgggtggttttctaagaaacagggagttcaaaagcatgtgatgaaaattaattggaatctgaagtgttctcccctctactatacctctaaattaaaaaaaaaaggttcaaaacaatttaatattatgatttcttttttcaggcggtgctcttcagcagccatcagcgaaaattggtttccatcgatgggaatataacaaacatgcttgtaaaaatagccctatatttataagtagaccccttaagtgacagccggcgataatcgattttcattggcggtaccactactgcagatttgattttttttctatacaaaacccacaataggttgtaggcagcccataagtgctcccgcatgcaaaaaccactctcgtgggggcgattgatgggcagcatgggataatccagatactgtgattatacgacaattccacaacacccccattctagacgaccatgcaagggtgcaggtagctaaggtccacgctgaacatgtcacgttcgagctagacatccctaaaccagaggggatcgaacttttgggagatgcaatgaaccagtttgtcttgtggcatcatcgagacatcatccttgccggacaaccaccatctgcccta

SEQ ID NO: 63068 - DNA, 755 bp, Oryza sativa
  unsure (1)..(755): unsure at all n locations
gcacgtgccacgtttagcgtgactttcctttaatttcagcccgaccgatgatcccgtttggaatgttgcacctggcctcgcgtgtctcgccacccgtgcgctcgcttttgttcagtacatcgtcatgtactcgcaagccacgcgcccacgtgtgcaaaccacatgtggaacgatcacatcagttcatccaattaaaacagcagcgatctgtttcgattggttaattagctaattacaccagcactttctgttgattcgtgtggagattatggataccccatacctacacggcgtggttatccgactggttataggggataacttatatctatgaaaaatgtaacggatcatgacttgggtattatgtttccctgtatattatgtaacggcctaaagtcctggtttgataagatcgtaaagtagatttaggaaacagataccgtattggttaaggtttctatcttgtaatcctgccccccattctatataaggtgggcaggaggccctctagggnnnnnnnnnnnnnnnnnnnncgtcagatcaatacacacccgacggaatcaaatccccaaacaggagtagggtattacctctcattgagagggccctgaacctgtctaaatcctttgactccgcatctatccacttttttaggtctcgtgtgctatcccttttattattgccgaattcatgtttagacagttggcgcgtcaggtaggggtgcgtcaagatttccgtcaataagggcgatggaa

SEQ ID NO: 63069 - DNA, 1845 bp, Oryza sativa
tccatacggacgtccccaccatccttaacaatgataagcatgtcatcatgcttttcaatctgagcttcaggctcaatggtgaagtgggactcatgtggctctttttctcattcatgcttttttggtagagctcaaccaggtgcttggggacacggtagttacgggaccaatgccctctgcctccacatctatcgcagttatcctgctttaccccaaatgattcacctgtaaccttcttgagttcgccttttcctctgggtttacccttactcttgcccttgaatatgatacttcccttacctttccctttcttctcaccatggcctcttttacggccacgcgagtttccaacaacattggcgtgtgcttcaggcactgccatagacccagtgggtcgagcagaatgattctttagaagaacctcattctgcctttctgcaactaacaggactgagataagatcaaagtacttcgggtactttgagttcctgtattgttgttgcagcactatgttgttgggatgaaaggtagataaggttttctcgatcatctcagtgtcagtgatcttcaggccacataaacgcaactgagaaatgatcctatgtagagcagagttatatgccgccacagacttgtagtcttggaagcgtagggtgatccagtcatgttgttcctgtgggagcacaattgacccttgctggtcaaagcgatccttcagggattgccacaataccagtggatctttctcaaacatatactcagacttcaggtctgggtggagatggtggcgcaaaaaatgcaatgcctttgctttctcggccttcgtagactccacagtgccaacttcgggcagcacaatagtatgatcgagacccatggagtcgagtttaatctcaacatccaatgcccaagtgaggtagttactatcatccaaggcaagctcggcgaattccttctttgctatgtctgacatgttctgcaacatcatttggtatttacaacaggtaaatacgatgtgcagggtcgacatgaattggtcatgcgtaatcttcaggattactagtgtgtgtaatcttcaggattatcacacagtttcccatataatctttcctagcaaattaacttaagtaatcttcaggattacagattgcttgattaaatattatcaatcatgctaggaaatcaatttcataacaataaaataaatgttatgaaagtcatgcaaacagcaaagtaagcatgtaaaacaaaacgaagagcatacatgggcacaacttcatgtgtattgtgcagtctgtaaaaagtaagataaaccatgtagtacttccccactatgagcccacgcttcatggcggcagacttagtggcatcaagggcccatatgggtgatgtccataaaacaaaggacatccataacgacacttcagggtcgtgcagaaggttcgtttgcctccgatatttggcggcaacggcggcagagccgttcattaagttgctatgctggtgcttcaggcacctacatcacctctagcatttgggcgataacggcggcagagccgctattgcgttatcgaatagtgctaatgggatgtaccatctcaagcctttggacggtaatggcggcagagccgccatcatgttaccgggcgttgctgagaggatgtatcaactctagcaattgaacgataacggcggcagagccgccatcatattatcgtgtattgctgagaggatatcagaggatggtacttcaggtaccatgttcttctgcttatttcaactatagcagaagaatgatttgcatatcaagagcaagatgatcagtagaaattgatttcttacctg

SEQ ID NO: 63070 - DNA, 34683 bp, Oryza sativa
  unsure (1)..(34683): unsure at all n locations
gggcggggcgccgatctccttctggcgaccagagcagggaaggcaaggggatcctggtgagcatccacatcctctttccgattcatctctctctcccagcgcgactacttttgtctggaatttgcttgcgttcgttaaccctagcttctcttctagatctggaagaatatcttctcttaatttcagagccttaatcttaatacaagtaacagtttgtttgttcccccaaaagtttgggggttcaactgaacccccatgtcccaaagttggatccgcacatggtgttttggttctgattccagaacgaaacttgatgccatgggaagaggggaagagtagggggagagggaaaacgaacatagaactcgtatgcaacccaagtgttaacatttgcttgcttacataaatgttgttttctatttgattttgggcagcttgatagtagtcgcaacatgtagaagtagccggagatccatcacaaaaatatagagcataacacttgtctatgaacaaaaaaagaaaaatgcatcatgaaacaaagcattcttcttcctgaacaataggataataggtgatacatttattctgctccctttaataccttgcggaagaggatggacctactaggtgaataaaactattagagtattttgtttctagatctctcaggttactcttattacaaaaaaaaaaacccaaatattttttttctagttctctcaggttgctattattacaaataactttttccaatacatttagtaatcacgtaatgtattaagcataagcccaccaatcatattaggaatgtaaacatagactaatggtgtcttatcagaaaaaggttgtgccattggagatcaatagttattactcgcttgaagcctagaagcttctcacctaaattgctgcaagcagtccctatataggaattccttgcaaataattcatcagtttatagacttatccaaataacaatgaaacaagcaatatttttttgaggaaattgctggcacactgattnatatagaaattactgtaaaataattgctcctgagcttgtgtttgtcataaatgttagttgttactgtagatgtttctttccttaaaagtttccctaaacattcttgcttgtttacaggaattcctatatgaacactgttgccagcaatttgctttttaaatattcttgcttgtttcattgtgacattgttatttggacctgtctataaatgaatgtaattattttacaggaattcctatatagggactgcctgtggcaatttaagtcactacaacaaaacatgtgtttagagacatcttatttatagtctagagacgttttgaacccgtctttaggcatacatagagtcgcttcttcaaagcgtcccagaagcgtctccgttaggaccgtctcaaaattataaagacgctccatatagcatctctacaagatctgagacatgaaatagcgtccctacgttagttgagacgcttttgtaaatgggatccaataacgtgtctcatggtgcgtccttatgagtaactgagacgtgtacatacgattcattgtaggatgccatgcttggcatatttacagcattcacatctgagcagtatatatcgccatcaacatatataccaaaatgacagtaaacagtaaaacactccaatagatgaaaggtaattatattaaggacaattgtgattcacaagtcagctaaacagccatacagaaaaaagagatttgcgtcatctcttagaaaaataaatttataactgttcctaagataattcttgctttatctcctcccttcttcacagcatgataaaatatatctataactgttcttaagataattcttgctttatctcctcctccttcacagcatgatgtagcaatcctttacaatcttcagtatcttctaaaatgaattgtgtaaaccaaatcagtgtacatgataagatttctaaaaaatgtaagaaagctagctaagtttactaggccataaacagagaattagacaatccatacatgtattgattcatagaagatacacccatcacatatttcatatttgtcaggagcttattcctagcattctttactagcttcagtaaagatttattgaaatcgacccttaataaagtaaaacaaaataaagcacttcaatttgtatatttctgaacaaagagactatagccatactacagtattaacatgagaatattctcctacagatatccaacaatttaccttaatagctacttgttctatactttttatgtggctagaatttctcatcatcactataagtaacaggtaaaaacttatgatggccatacctttgacactttagcagttgctctccctcctgcatgtaaatactttggaaacttcagcatatagaaagcaaatctcccattttggaccagcatctctattcctttactcatatgccaccgaaggacagtatgaagaaccatcgcatcattcagaactagtgtccgagatccaagttaaacaagcattaataccaatatttgtttcaaagtgaatcgattagaagattgagttgagtcaaagtaatgcctctctgtgttttaatgtgattttgttgctaaaactacttaattaatgctgaactaaagcaggggaaagaacacagcgttatgcaatccaatactccaaataatttttttgcaagcgataccaaattaccaagtgattatctttctgaacaaagtatacaacaatcccaaagtatcatcatcagaattttttcctaaaaatctgcaaaaaaaaaagttaccttcaacaatactcatctgtatttttgtgccttcttgaagctaaaattccaaatgtagtcatcagatggaatggaatcagtagcaaaaaagaatttataatgagcccttaatgatcgacatattggtattgattgatccacagaggttcacaaatcatcaaattgattatcagatctgcatcatgcaagtattggtattagcattttgtcaaacaactagtacgatggttcattcctgaagcagaaagaacgaaaggtacagatcaatatttactcttttatacttctgcaggattacgaaataatccgatggggtagaactcaacataaagtctggacaaattgaatcacacaaacaaatcaaagcacctttgtagttccttaagccttacagattaggggatgagagagcatacctaccaagctaccaccgtggagttgttgctgggctggtgaaggcaactgagggagggacgcgttggcgatggggagtcgctgattaggcggcaaactgccagcggtggctcccatggcgaggatcagagcaggcagtggtgggcggcggcctgaggaggaggaggcagatgtggcattgactcgccgaggatgaggcgccgctggcccccggtcgaggacgagccggcggcaggcatcgagatggcgactggtggaagataggcggcggcaccaagcaggcagttcgatctagatgggagtttgttgcagcacgcagagaggatgaggacgtgggtggtttccaggagaaaaaaaaattcaatccaaatcttaatttttgagaaatcaatgtaaaactagggcgttatttaaaacgtctcataaaccgtctttattggtggggtagcctagaaaatagagacgatttaagtctcgtctccagccaaaggtcttcatttgtttgttttgttgtagtgagtgagaagctttctggctcttagtgagtaataactactgatctccaatggcacaaccttcttctgagaagacgccgtcagtctatctttacatccctaatatcattggtgagtttctgtacgatttcttgtttattacagtacgctattaccaaatgtactgtaaaaagttattttgtaatattaacaacccgagagaactagaaacataatatttgggaataacatattagaacacatatgattgaatagaagcaatggccatttttttttcttactaattgttattggcatcttgttttcatgcaggatattttaggatcatcataaacttcattgcttttgctgtatgttattccaacagggtgctctttgctatcttatacttcttcaggcgagtgttttaactttatccacacactacttgccttgtgcaatttgtatatctatgaatttaacatcatcaagatctatcagctttttctgcgatggattggatggttggtttgcatgaaagtttaaccaaggtaatagaagcatttcttatgtgttcaaagtcttcatgtagtttgtcattctgcagagaatattatttctaattttttcccttgtgccttgagactttatagcactagatattttatgaagagtaaattatatgaacttctaaaaaactattgtctgctcaacagttaaatcttggtttatctttactcattatctgatcagttaatgttattctatgtatcagcatcaacatttggagctgtgctggacatggtaacagataggtactcctcgaataaatcattgaactctgtatatgcaaggtgaatacattctgcagcctgaaataatttcactgttcaaattgctcctcctcagggttagcactgcctgtttattggcacttctctcccaactttacaggtataaatgaaagcagaaaatacttcaattgttgtaccttcgatctagatacctgatgcaaactgtatttgcaagtttctttgcagacctggcttagtttttttgatgctgcttgggttggatattacaagccattggtttcaaatgtataggttagttttctataccagtttttcagttagtgccactttgtagttttcttcacctcgtaggtgcatcctcttctgtaaggtattaaatggagtagaaatgcagaataaatgtatcacttattgtcttattgttcaggaagacaaaatgctttttttcatgatgcatttttttcccatagacaagacaaagtgttatgctctatagatttatgatgaatctctagttactgctacatgttgctaactacttggtggtgtttttttactagtatgttcctatcaggtaaaactagccacaaggatgtgaaggacactggcaattggcttctaaaattatattatggacatcgaccattcatggcattctgttgtgttgcttccgaggtacatgattaatctatatttggcagtatctacatggatgtttggctgcttacatgctggactatgtgcaacatgagtgctatgctggatgatttttttactagttcagctgaagtatgggcatgaattgaataggatgtgttgatgtgcccaaaaaactgaatggcccaacgagcctatcttacatctgcacatatagcaccaaatagtcatttgatatagttgaggagtcaccatctctgtatgtctagcacccttatacactcttgactaaactgcacttaaatgtttcaccttctaacataggaagtttataaaattacaggttctgtacataattctttttctgtttgctgatgagaaatcgacaagcttgcttaatgtaagaagacgatcatctctactgttgcttaatacaatcaagtcttgttgcagtagttaacatctggtatttctatatgcaacaggtgtgcagatgctttctaaagggaagtcctctcactttcttcgtttttatttcaactctagttggttgggcattaaaacaagtgatcaatatcatccaggtatccagaaaccaacattaaaatttcttgcagttgcaggtgcttgatatttgtacatctgcaagtatttaagttctaattatgacactaataataggtttgttataaagctgaagaaaaagtgttgatgcactggttagctcatatgctttacattagggtttagctagccctggttaataggagatacattatgcccaaattataggttcacatatgttgctaaaagcctagagcaggtgcttattgtaacattctattctttatttagagtgtctatttatatgattctagcagtactaatagcgacacattaataagaagtgtggatcgagatgtcgactaccactagagttgggcacttgtaggatcgagatgtcgactagaggggaggggggggggaggggtgaataggcaatttaaaactaaatgacacctaatataaaactaagggtgtgtttggttcccggtcaaggttggatgggatatggcggtccagttttttgtttggtggagtgaatatggcgatccagttttttgtttggttgtagggatgaaagttgatatggtgatccatttttttgtttggttgggggagtgggatggatgagtggttgcaatcaccctttcattagaggtggtgagtctacccctccaaattctcacccaaaaattatcaatctactaaaaaaaatctaaatagaaataaaaaagcagaaagaaataaaaggggaaggagaaaaacaaaaaaaagaaaaaaaatgccatctcgaaatcgtcggccgccgctcgccttctcgaaatcgccggccgccgttcgccttctcgaaatcgccggtcgccgccgcctcgtaccctctctcctcggccgccgccactcgccctctctccttggacgccgccgctcgccctctctcgccggcgccccccagatccggttgtcgccggctcgcctcatctctcgccgccgagctcgcctcctctcttgccgccgagctcgcctcctctctcgtcgccggctcgccctagccgccgccgacctcgcctcctctctcgtcgccggctcgccctagccgccgctgccgagctcgcctccacggtcgtcgccttgcctggttgccgagctcgcctcgtggtgagaggggtgacgcgacccacatgtcgctcgtccctgctcgcccgagcgctcgggcggctgcatccggccgaatcggccggatccccccatccggcatctggggggaatatcctccccgtgccgccccatcccacccctgcccaggaaccaaacacccacaaaaaatgggccgccatgtccaatccacccatatccctccatccaaacacaccctaacctaagttgctaggctcggtgagggtcaagtctaactaagcaactaaacctagggtgatagtggctcaagtatgtctataggaaagcaaatcacactcctaagtcaagtttagcaatcctagggtaatatgagctcatgtctctaggaatgtaaattgcacaaatgtaaatgcgataaataaaagagacaatgagacaaggaattttttaccgaggttcagaaactcaccggtttcctactccccgttgaggcgagcccaactccacccctcaaccacgaagccactgcacgcccccttcgtcaaggggtgggcaaggcgggaaccggcccacggagaggactactcaagcctcgatcactcgggttagttcttccttcactccgaaggtggtgaactccaaaccactcacaaccggcgtcgggccttctccacaatcttctcggagaggtcacagggcaactccttcacaagccgtctaggagactgcaacctccaagagtaataagcgatgacccggcttggagatgatcaagcgccgcactagctctacaaatggaagcaatgcacttgactcttggctaaatcaaccctcaaacacactagatggatgaacacaaagctcaagtgggtgtgtgagagatggaaggggtgtatgcaattgaagtgggtgccaagagagtccccttgctgctggtgggggagtatttatactcccacccaccaaaactagctgttgggggcgaaatcccccaattttgtgtactgccggtctgaccggaggtgtgtggccggtcagaccgttctactctacaacggctagttttctagccggcctgacattgggctccaactgcctggccggtcagaccgacatagggtggccgatcagaccggcctcggctcggtcagaccgcccccagctcggtctgaccgaatacagctccggtggctctagatcggccactccagagcacgcctctcgactaccagggggccggtcagatcggcctatagccggcggtcagaccagcctctaaccgccggtcagaccggcatacaagccttggtctgaccggtcctggtcagtccacacagagacaacaagcattaaggtgatgtgaaatttgagtctaaatgcgaacacaagtctaaatgcatagtgacctaatgtggcaatttaaatcatctctttgctaggtcattaacccccttaatagtacggcaaagctataaataaactagcacaattttgatcacccaaactcctcgatcgaattaaaattcaactactagtttactgtcatctatcctttgctttgcccccatcaatttttagtccaccatcgataatcatccatgcgcacatatgatgtaaacctaactcaaaacatataactcgatataacggttagtccataattagcgtttgtcattaattaccaaaactaacaacgggggcctagatgcttcaatcccccctttttggtaattgatggcaaacacctaaaacatatataatcaaatttaaagcacatggatatattgcattgaaaagcaaatgcttcccctaaacatgtgcatatcaatcacaataaacaaattaggaacaaatgcacatttcagcatagctcaacacaaaaacaccatataatgtgaacttcacatatagatcattcaattgcataggatggtcacgaatatatcaaaatcacatccaccgtccatcatagcacaaattcacatccataaccttccaaattatagaagttcatccatatatcatccaagtcacaaattgtccaaagagggctcacaaataataacctaggctattacatgaccacgaagggtccaaataacatagagttcaaaacgaaaaaaacacaagatatagcccaatacacatacataatatagcccatccaccttaacctactaaatatgtaactaacctcactaccactactctcatcccacaaaacagtacaccattcaccttaacctactaaatatgaggtgactaacctcactaccactactcccatcccactaaagaaaatgcaagctagattcttctcccccttttggcatcaagggaaaaaaaagcttcactcttgaggaggaggacgagccgaagaggaagggcgaggagcatcgcggcgacggtgatacacaaaggcatgggtgctttccaacatttgaaccctttgatccaacactcccacccttgtgctcaatctccccacggactcattcaggccaccaacattcgaatgcaaaccacgcacatcctcgtacatggcttcatgtccggtggtgagcctttggatgttttcacttagggtattgatggccctaagcaccgggttgaaatattcatttggttgtatcctaaaatatgcatattgaggatggaagaaggtattgggatcatatccatgaggaggaggtgccgcacttgtgcttgcgccttgatcaaagataggttggtgcacttggggagctctaggaatggaaagttggcggcgaggcttatcctccttgtgttctttcaaattatctccagcatgccccaactttctttgaatcaagcgcatgatatagagagcatagtagatgccttgtccaaatgtcccctttgaaatggcaatgtcttgcatcattagattaatgacgtcaaagcgacgaccctccatgatggcatcaatgacatgccatgcgacaacgcgaatgttgtcattgttgccacaccttgggagactagtggctctcacgatgcggttgaccatattagggatggtcctcaaacccgccaccttcccataggtgtgccttccccatctttatagaaccgggcatagtggtcataggggaaaggattgtgggtgtgctcgtcttggagatcatcgccgttgttgaaacggatttgcaacaagtccttgaactcacgccgggtgatggagcactgtagggtccccgacatccatttcatagcatcatactcgccggacacccacacagtggcatagaactgtcggatcaagtcttcatcatagggttgcttcaaggtaacaatcctatcaatgcccactgcctggaacatcccttgtagatccacaaattccgatgtctcactgatatgtctccaagatatctacttgtggttagcaaaagctttgcttgcttatgcttgctcatacacggacttctgtaagcgtgtatggaaccttggatcgttgcaatcatttggcctccggaattgattgtgatgacggaggatagtgtactgttggggatttctcaagttaagcacaaactggatgggctatattatgtgggatgggagtagtggtagtgaggttagttacatatttagtaggttaaggtggatgggctatattatgtatgtgtattgggctatatcttgtgtttttttcgttttgttgaactctatgttatttggacccttcgtggtcatgtaatagcctaggttattatttgtgagccatctttgaacaatttgttacttggatgatctatggatgaacttctataatttggattgttattgatgtgaatttgtgctatgctggatggtggatgtgattttgatatatttgtgaccaacctatgcaattgaatgatctatatgtgaagttcacattatatggtgtatttgtgttgagctatgctgaaatgtgtatttgttcctaatttgtttactgtgattgatatgcacatgtttagggggagcatttgctttttaatgcaatatatccatgtgctttaaatttgatcatatatgttttaggtatttgccatcaattaccaaaaagggggcgattgaagcatcttggctcccgttgatagttttggtaattaatgacgaatgctaattatgtactaaccgttctatcgagtcatatgttttgagttaggttcacatcataggtgcacatggatgattatcgatggactaaaaattaatgaggcaacgctaattgtggattaacctttttttagagtgtctatttaactttcatgtttcttccctgagcgcagatgaaaacagccgcagatatgtgcgttatgttcgatttgaagcacggtaagtgagcagaaacggacaaagattcgtttagtttggcgtttgacatgtggaagaaaaattcatgaggcttgatgcaccgagggcatataaacctaatgtaagattttgacatttctttgacctggttgagggcatgcagacattaacggcgtgaaagaaaaaagatctggtgtatcgagaaaaacagggttgccatgtttttcctacagtgatgaatttgcgtgatctttgtttctttatcaggttgatgtttgttagcagtacttttagctggctgtgtgaatacatttctcacctctgaaaatttggagggcatgaatccggagccatcatttagcattttactccgttgtaaatttgtttacactaatctccaatgaaatgtatttacattgtctcctctattgcgtactgctgtatcacatttataaacagctgtcgcgcccagggattcgacaacccgaatcaccggctagctgtgcatttaacctctatccaggcatcaatcagagtacacagatgataatttgatacagctccacaacttacaaaaataacaaaataaaactcatacacagcggaaaaactaaagaactagacttgatcttcacagcaacgcgaagctttctcgataactccacaggcaaactcttgatggccggcacaaacctaatcttcatagaactcaccatctgaaccaacttctgcttcttggggattgggaaaaagaagcaagactgagtacaaccaccgtactcaaggataacgtaaggataacgtaagggtaatcaaaggattggctcaataggatattttgtagtaaaagcagcatttgtaaatcataagatgaaagccgtaaacaatatataattgagcagtattaacatcatcactgtccaacgctaaaccacgttgtgacaggcccaacccaaaaccacatgaactacaccagttcattaaggcaaattattaaggtgagactaatcacggtgagctagttgaccgcccaataaccgcgggcacggctattcgaatagttttactctgatcagaggtgtacaactttacccacaagacacgattccacatatgaaaccatgccccgaagtaccgccacgatactgcaaaggggaaaatcatgataaaaccctccatataaccacccctaaccaacacatccacctcccgtccccactccaaaatccaggagccattgccaatatcctacgttacctggatatgcgtctcaagtcacgtatctgtatcggatacgtcgctggatacggatacgtatcggatacgcctcgatacgtatccggcatgtatccccaccatccacgattttcaaataaataaaaataatcccgatacatctccgatacgtatgaaccctaaatcagtcgaacaaaacccatagccagcattgagcgagccaaatcccccacacccagtgctgcctgccctaggccccaacccaagctctcgctctatccggcgtggctgcgtcgtccccggcttgctgcgttggcgccgccgccgtccaccgtcgccgggttgcgcctccgccgtccgcagccgtagcgccgcgcctccaccatctgtcgtcgtcctgctggcatagcttcgtcgtctccgagggcgcaacaccgccgccactggtaaatctcctatttccctcttcaggaccccatgttcgatctacattctgcaaagcaacaagacgataatggggcttcaaccacttcagttacattgcatgaaagcaacaattgtttttgggaagatgacgtatcggcgtatccgtatccgtatcgccgtatctgggtaacatagggagcaggcagcccccgctcgtgcctaggtaaatccggcagcagcatagatcgcctccagtccatccatactccatcacgcttacccttgccaatggtgcgctagctagaaaagattatacttaagattcagcctggagcccatctggcttgtggttagtacaagtatatcttctagggattcccgagaaccggtcattatttgtcatgggcacgaccatcaagtgaaacatcatgcatgtgcccacgacccaccaagtaaagcatattttaattaattaaccatatgccaagaaggcatagcatcatcataaaattaaggactatattatagtgaatcctaaagtgagctagttgatctaagcatggctaagcaattctagaccaatcatctagttaaattattaacctaggctatcaatgaatcagggtaaacaaaggctgagtatgggtagaaaccatcccacatgacattataaaagtaatgcaattttgagagaaaagcaggggttttgcaaataggctcagtatgattagtgatatctgtataacttgccttgctcttcagctgacgggacctcggcgaccacttcaaaataaactggagcgtcggaactgctggagtataaacgacaaacaaggcacacaataaatacaagctaaaaggctactgaaatagccaaaagaaaccaattttaatggattcttgacattttaacgaatttactacaatttgaatagattaaaacggagcacagattacttagttatgaattttacaaggtgctctgtgttatttactattgacagaaaaaccttaatcagttgacagggattagagcccaaaaggaacataggattaaaggatagattgactggcaagcgagccttacgagataccgactcaacgagtcaattcgacgtgacacgagatcactcaaataatcaaccgaaaccggcgaacggaactggcggctttgaacggctctagactaaaagacgactcaggacggatgaacgaaccataggggaacaccttgctaggtttcaacgacgcacggctgcgacacggcgacgctagggcggctcagctcggcggctacgtggcggcacacggcggcagcggcggctcggcagggcggcacgcggcggcggttcggctagatggcggcagcggcgtctcggcggcacggctctagggctagggcaacgacacatgacacaaacgctaggaacagaaagacttaaccctaaaaggacggagaacctcatcggaaaacaacggcgagcagagggaggacgacggtagcggcggtggttccggcggcgagctcgggatagacgacgatgacgctagaaaagattgaacggaaggaattagatagatgaattgatgaacgctgcatcaaatacatccaaagtaaggagaacggagtaccggcgacgcaacggcagcggctcgtggctcggcggcgtcttgcggctaggactcgggtgggggtgaaaacggtacggaatttttccggattccggtcatgttttcggaaacggaatcggtctgtcataattttttcagaatttctcggaatcagaatcgaaaacggaaatattttctcggaaatagaattgaatatgataatagcagtttccgtcggaacccggaaacgatcggaaacattctggaaaaattgtcggaatttccgaagttcaaaaagcccatagattcaatagtccataattcatccctaacttcctagcccaacccaaatcgcagtggcatctaccctaactagctaaccctagaggagagagacagtgagacgcgacttgcgagttggaggcggagcaccggagtggcggctgcggcgtccagatcgcggcatcgcggcgcgcccccgtgcccaccgcccgcgccaccgcccaccggtggtcacctggcccctgctgtcctcgcccccaccatctcgcgccgccctcgctcttcgccgtttcgccaccggccgccgccaccatctcgcacctccgccggctggctcggtccccgccatctcatagcgccgtcccgccgcgtctcgccgtttcaccgctgccaccaccaccgacgacgacccgacgacacctcaagccccactgcagtctcttcctcaccgccaccaacgccgacgactcctcgcctcgtagcagccagcagcccagcggcaacatctgcgcaaccagcagcagcaggtgttattcctcattccttaacctccacctctgtcactctgtgttagtgttactgtgtaggctctatttatttgagtgaatgttgaatgattgatgtctttttattttctttgtactaaggagcttggtaatattacgttctatgtagggagcttggatactgtgtaggctttattttctttatatgtttatgccttcttgcttctggattttattttgctctgtaatttagtagaagttattaatatgctctattgccatcagccaagcactccaattatagaaatactgctttgtttgtggggaataatacaagtgcagctgaaaaattttacttgctactatgtccagctaaggacagactgtggtcttgagcctaaaccattgatttgatttcttttatgctgcagatttgtgatggaatcatcacatgcaagtagcagcagtgcaagtgtatgcaatgcgggcattgtagctttgcgagcatcacaaccaactcttgcaaatgtaggagatcctaccacaaatgtggttgcagcagcaagagtagaagttgatttgacacaggaaactaccgaggatgcaaatgtccctccagcaaagaaagcaaagaagtgtagttcagaggtttggagccactttgacaagtatgagaaaaaggtagtaggagatgatggaacagagattgtagagctttgggcaaagtgtaagaagtgcagctatacaactcgtcgtgagagcaacaggggcacaacaatattttggagtcacttagacaagaagcaccaaataaaaagtggccagcagcttctaaatctaaaaaagagtgaaagcggcactgctgttgagacttacaagtatgatgaggctgttagcttgaagaaattttacttggcaatcattatgcatgaatatccctttagtattgttgagcatgagtactttgtggattttattaagtcattgcaccctacctttccaatcaaaagtcgcataactgttaggaaacatatattggatatgtttttggatgagaagaagaaaatgtatgagtactttaaaactcttgcatgccgctttagtacaaccatggacatgtggacctcaaatcaaaataaaggttatatgtgcatcactgtgcattggatagatgatacgtggtgcatgcaaaagagaattataaagtttatgcatgtagagggtcatcactcagggaaaaacttgtgcaaagagttctatgatagtgtactggattggaaccttgataggaaattgcttgcacttactttggacaatgcatctgccaatgatgtatgtgctaggggtttagtagaaaaactgaatgatatacaacccttggtttgtgaggggatctttttccatgtgagatgtttgaatcatattttcaatcttgttgctcaagatgggttgaagcaaatttcatctagtgtttcaaatattagaaacccaattcaatttgaactccccactgcagtggtcagaattcatgaagtgtgcttctgagtgtgatggttagacactacttgtgggctgtctttggatgttccaacaaggtggaattccacatatatcatgttaaagcaagctattcactatagaaatgcttttaataggctctttctttgtcatagaagcaaatatcataaatgtgccccaaaagatgatgattagattatggcaaagtcattgtgcatatgcttgaagagattttatgattctactttgatcttctctggcattagttatccaactgcaaatctgtttttttagaaaattctgtcaaattaagatggcagtagaagaatggtgccgtagttctaatacaatcatagcaactatgggcaagtcaatgaaacctaagtatgataaatattgggagaagtccaatatggctctttctgaagcttgcttgcttgatcctaggttcaagagaacacttcttgagtattatgcagataaggtttatggtgtggtagccccaaaacacatggcggatttcatggttgttattaataagctatttgatacttatgcatctagtcaagcaagttcaaagagtccagcagctacaaatgtgcagaataatcttttagtgagtaaagactatgatggggagagcgatgatgagcttgatgcagatgttcaacaatacttgcgtgctagtactgcccctggaataggcactaagagtgagttagaagtttacttggaacagccactattggaatggtacacatcagacaaaaccacatttaatattttgcattggtggtcactcaagcaacatgagtttcctattctcagtttctcactagacttgctcgtgatgttctggctattcaagtatcaactatagcttcagaatctgcattcagtgtcggtggccgtgttattgatccattccgtagcagtctagaccctgaaattgtgcaagctctgatttgcaccaaagattggactgcagcatcaagaaaaggtaatattcagctgtttgtacacattttttaatgcttttactggtccatattcaaatttttgagttaatatgtgattatgaacatttaggtggaaatgtggttgggtctatcttactgagaaggacatggagaacctggagcagaacttctgtgccatgttgtccttggtttgtgcttgtatcactaacatgtctatatagtgactaactttgtacttttactaatgctctatcattttttttgaaggctaatggaacagagcaagagacagagacagtggaatgttctaatgaggatggcattgcgccaatggatgtttgaagaaaatgttggtcaatttaattttcaagttacatctaatttcaagtttccatttcaaattagtgtactcctgctgcacaagtggatgagatatgttttgtgatgaaccatgtactgatgtgttttgtgattgaactatgttttgtgatgaactatgtatttatagtgtgatgtgttttgtgattgaactaagtactgaaatactgatggactgacgtgtcatgtgtgttgctgttctgtgatgattaatgaactattgctgttctgtgatgattgatgaactaagtattgatgggctgatgttcatttcctggagtgataggctgatagcagtatagcacctgaattgtgtataccttataggcttataccattctgttttgctttattcttttagaatatttgttatgcaaattatatgaagttatagaagaatatatttttgctgttgagactaaacaattagacttgatatatttgtgttttatgatgaattgttgactgttgagacttgcgaattggacttgacaaaagtttgaagctcagtttaaggggtttttgtattccgataaatttttgttaccgtatccacgccggttcattttcgctctgttttcggtttcgatactattcgtttccgttttcgtttccggtgtttccgattccgatttcgaaaaaaaatatgaaaagactatattaggaaaaggaggagtcctagagggagtaggactaggagggagggagtccgactcaaaagggggagaacggaggcgcgcgcggcaaggggaaggggcgtggccggctagggagagggggagggaaaaaaggaaaagtaggggactaggactttcccaaaaaggaaaaacaatacggtgccattttaggaaaggaaagaaaacgaccccgcgaactgacacggatacggttcgtcatgcaaaacgaaactgcgaactgagaggggagtgaattgggcacaattcacgatcaaaggcaaaggaagaagtttaacttgacacttttaactttgcaacattgccttcggtgatctagtatttactctttacgtcctattagtgattttcagagcaaagagaattcgaaaaaaaaatctccctgacaattctgattgttaaatgcattgttaactggggttttctcctggttaaccaaattaaattcttgaagccatttattagtgatttgaaacctaatggaggggaaaactttaggtgtgacaacaacttccattcagaaactaatttttgaaaaacttcacatcaatttatacttgcccaaatttctcttgatttggaatggatttatcttttagatacctagaggttttatctgcaaattttcacacaatctataatttgattaactttcactaaatttgaactcatttggatgggacgaacgatgttgttgctcccctgctgcttgccaatgtcttgtcgtgcatgtacgagcgtcaagaccatcatgcagtggagaatagacaagcattgccctcgtcatggtgtgggataaccatgaaaagatagggggacgttccagacaactaaggaacacgttccaactaacgttccatgttttaggaagaggtatacccatatcattccatgtatttagaaaatggcgtcccacattcctcgttcctgttcctcgatccatcgctccgggaacttttgtgacttagctattaaccgtcaacctctattattatttaaacctactttcaccctatccaccccatcgctaattcatcgacattagttccaatgcctttgtgcatttcacctatcttcagaacctagctacataatctcttctaatatattatagttcttattttaccactgatctatataatgtatctttacctttagatacaatctataaagaataacacaaccacttttacaggtgcagccacttagcatgctcattttctataatatgggtcactgatttctttgatagacattgaaaatatttatagaatacttttctgcagagaacaacaaacacaaatttgcagatctttgcttttgcgccaagaatgtcgacttatcaactcacataaagaagcacatcaaaaaccttgcacatttttttaaaggaatactaccaagggtcacccattagtttttgttatattaatatgtacaaaataatacaaaatgtcaaatattacaaagtttataaccaattaaaaactgaagataaaagaggttccttcatcctacacccatgcaggcccggctctggggcagggtaaagagggtgacggcctagggcccgtcgtggctaggggcccatgtctaaatatgtatgaatactgtatgagccaaagtggtatttaagattagtgaataattccatactagtatctactactcttggttatcaacataatactgattagtgaattaataaagattctagattcaacaatcaaaattgtatgtatagatagattcttgttgataacctttataattttaggtgctgaaaagttgtaattttagtcgagaagcatttttatggtgctaagtaaatgggaaaaataaacaagatcagtttaagtgttgatatttttctatttctaagaacatatatatgaattgttatcaatggtcatttctctctatgattagatttgaaaacacactttgaaaatgaaggggttgtttagattgtagctaaaataaatcttactaaattttggcaatgccaaaattttgacaatttagcaatattgtcaagttttggtaggatttggtaaaaaaactaaataaatgtatatttttgacaactttaccaaaaattgatatggtttaaaatgatatcaatctgaacaacccaaaaaattgtgaatatacatataacaagtctcactgtaggggagagagggttaagggtcatcttgtcaagtttgcgctagggccctcaaaacttaaagccggccctgcacccatgcaggagaactaatccgaaggatggggattcacattttgaaagattaaagcatttctctgcttccaaatatgccaacattcaatagaaaaaaattccaagaagctttttcctctaaagcgcaaccttgccaaaaccaccatctgaaaaaaaaaattccatgttaagattccaagtaaaaccaatcttcctccaacaagtatcactgaatgggcaagaaaagaatagatgttctatagtttccctcacactcagagaacagagagcacaagttagatctgcatcctcatgagcacaatttctcctgtccaacatgtccctagtgttaagacggtcacaaaagagaagccacataaagactttgatcttgttcacacagttcgttttccaattccaaacaaatggtctaggtggagagcgaccaatgaaattcaggccataaaacctttgcgaagaatatgtactgttatcccaaatgaaagacatgcatctcctgaagcattagacagaagcagcctttgcaataattcctgtaaaaccgaaaactcttcatatgactgcgatgagaggggcagttggaaacaatcttcaaactccctttgagcaaagcttttcacagagtcagttttataaaggcactgattgtaaaggctctcaaaatactgacatctgactattccattccacatgtcctcccaaagagtgactgaattaccattaacaactgtacattgtgcccctgctctgtaaatatcaatcaagcttatgatatctttccaccagaaagaacccctattaagtgccacattgcctgcaccatccaagtaaattctatgttgtcactatgaatgagaccttcatgaagcaagacagagtggttagctcttttatctacttctcatccttttataccttaaattaacaactaacactcaatttccattacagtacttttcaaaagagttctctgtgaatcacttaaaaccactcatggacgacgcaacagtgcagattcaggtccaggcattagaaggcccttcaaccaacatgattcttcacagatcaacagaccattgttgcaacttaaagaaaggatgggcagattttgcagtgaacaataacatcaagttgcaaacagtatgcattttgcacttctacaaaacaagccatctgggagcaaccatagatatcttctgaagtccatatcaatgttgtatgatatgatcctttcggtgccagcaaacttccctgtatccattgaacgtgccgtttatgtcctatagtaccagtattatagtacttagccttgcgccttatgggtgtgtttggttgctcatatggatctagcccggctcatctcccttatccaggctaagcttagctaggctagagacataaagatgcagttgtttggttgcctgtattgaatgagccaggatgtggttagatgtgcatccatgatccatccaaacaaagaaatcaaagaaagagtggacaagaaattgaaggtgggaaagggaagaggaataccatccttgcacttaccttagatcttgacggagagagccgaagatgagagggtgtgaggaagacgagcagccacgacagagggagacgagcagccgccggcagagggagatgagcagccgcggtggagggagacgggctggtggcgacggagggagacgagctggtggcgacggagggagacgagcagccgcggtagagggagatgagctggtggcggctgagggagccggcgctcacgcccagcgacggagggagccggccctcatgcctggcgacggagagagcgctcgaggcgggagatgcgctccaaaccctagcttgtctttcggttggaagaaatgaggaggggaaaagtgcttgaggcaagctgcggtgaccccatcgcctgctggttgtacgcgcggatgcagtgcgtgcatgcgtgggtgcagccttgtggttgcacgccacgagccaggccgccctgcgaagcttgaatcggccgtttcccctcagcctggctcgacggacctttttgcatctcctaggcctagctgagacccccatccaaccaaccaaacatgcggtaggctgcacgccaaatgcgggccaagtgcagtccatgcaaccaaacacgtcctataaggtcgctgtggacactgcacttatgaatctattaggtcacttacatatgtatgcactgttggagagaccaaacaaccaccatgctcatctatgagcagttcaggtgcttacctataaacacctgctattctatatttaattcattttcttctgttggatgattaagcacggttgtatagctgcacgttactactgttcccatcactttcgggcaggcggcgcgccaatggcgtgccccaccctctagtatagttttactctaaacattatgtccaatctaccacctcggccggtgtggttcaatccacaacacgaatagacagttattatgcttctatctgaattaatattgtacctccgtggttcttaagaaggaagaacggtccaagaactgatagcagtgatgctgcaaattcattgacaggaaatgtgttgcgatgttgttcgttaattacgtagataggtggcgttgatgtgagcccaccaaagttcaaatccaacctatatgaaatgatcagtatactacagcccccatgttaactaacaagttttaattcaacccaccaaaagaaacgacaaaacctaaagttatgattctctagaatgaattgttcaaattgccctcgatccgcactctttcatacatgtgttctctaagaaaacatttaaaactcttactaaaccaattactttttgatgatcaattgccaacagggacaataccactcaatgtagatacatactatcatgtaggagtagtgtggtaggctggtacccctgcaactgtaatttagccactttctgagccattgaagcagaacagaccacagtcaagcaaaagatgacaactgtcaactcgggcattgttagtcatgcgttcaggctcaaactccatcagtagtgtagctttcagtccagatgccttccatctctatctgaatacatgacggaatgcctctcaacatgcacatagccatcactctcctagtttttttgcctttgtgtccccaatttatatgtgctactatgcgcaaagaagaatataatagtactaattaaaaacttagcttttatttgacaagtgatttctccgccattgtacatcacggtttcagcagtgcccagttgcctattatattgcacaccaatgatactatgcattcaatggcattagcgtgcaatacactgtggggcactacgtttattgccaatgtaaaaaatataaatgttactacgataactattacttactatatgacaatgtgaaaaaggtctaattaaactaatttttattatatgacattgcagttgaaattcttttattatttgaatatataaaattgtattactaccggtattttaacttagatttaaaatattgtcatatttgcttgtatatagatttttcatgaagaaattgtgcacattataattcaaatttacaaagatgtagcatgcacccatttataaactatctaaatgttgttatgaatagcacttgtcactactagaaaaacgatttttcatagcggcaacgagaaaaaaccgccatcgtagaaaatcgggcgggggtggagggtcacggaccaccagcgaaaactgattttcactagcggccacattaagaggtccgccataaaaaatactatatttttcaaagcggagctcttaaatgttcgccagcgaaaattagcgttttcactagcagctactaaagagattcgcttcgccaacaaaaaaaaaaacagatccggcagcgaaaagcaaagcctcgctaaaaaattttggcggcattttaaaccatgcgtgcaagattccttcacccacccacgcatttaaaactgattttcacctacccacccactgccagaggccaccacccacccacccatgcattcatctctcctctatctctttctcctctccacccaccgcatccctctcctcctcccccacctctctcccctcctcctcctcctgtcagcgacgtcgacaatggcgtccacggcaggtgtgggcggcgaggccctcacctctctcccctccctctccctctcccagatctagccagagggagggggtggccgccaccgtggcagcgacggcaggcgggttgtggcggagctaacgctgacgacgacgtgtcggacctgtcaggcacgggccaccagcgaaaaaaaaaattcgctggcagccgtcttaagccaaccaccagcgaaaatggatctttgctggcagctagcttaagacgacagccagcgaagatgaattatcgctggcggttgataaccgctagcgaagatcttgatcttcactggcctttactttgtggctgctctaaattccactagcgaaaacccaaaatagccgccacgaaaaatgggtttcgtaggagtggatatttatttgagggcactacacgaaaaataatttttacccttgtggacaaaaataccctcttataaccgtttgcaaaaaattttatgggtggaagctaaagaggcctgcctgtgaaaataaagcgaatttcccaggcggacatcttaaggctccgcctagaaaaataagattttcgcaagtgagacgttaagtggtccgcccacaaaaatatggaggccctattaaagttggttcagtcccccatctcctcctccagatcctcttgtcccccacctccatccctattcccccaccaactcctctagcctaacccccctcctctccctcaggccacaatgacggcgcctagatccgcgctggctgcaacgacgccagtgcgccgcctgcgagatgatgatgaggacgacaatgatggccgtgactggaactgccaccggttgcgacgacgccttgatccgccatcgggtggcctcaggcatgcggatccgtcgccgtgcggcatcgagcgcatggatctgccgccgatcgtcctcgggtgcttggatctgccgtgggtttgctcacaagcggtgacggctttgatcgataggtgcgttggtaggtcatggtgggggctctcaggttgtggcggtggcttcgactgacgatgaatttttcgctttgtgttgatatgtgatgcatttcttgaatagatttcatgattcgataaatttattaaatggattgggggcttttgaatgtgctcctatgcggggaatcttgagttctctaggtttttttgcgctatgtaaatattttcgaaggcggacctctttaggagtccgcctgttaaaatcggttttcgcaggtggccgtctacacatctatgaaatacactattttaataggtctttgcctgcaggcagttggactggttgccagaaaaaaaaactgatttgtctaactgtaaaaatgatttttttagtagtgatacacagattaaaaaaaacttttacaaataaggaaatacatatccatctaaacagatgtcacatggcatataaatagggggttttctaatccgtgcgtacgcgccggcgagggaacttgcgtgcgcgcgcacggtttccgatttgacctagacacacatggctccttttcttttctggtagcgtcgctggaatacctaatagaatttgttttggataattaccgtaattaacataatttgttttgaataattatcatgtttaaggtcagcttttctctttttcggaaggttgttttgttttttactaaaagtttgaaaatatctatacataaaaatgaaactttccaattaaatttaaaactttctataaaaaatttgaaagccttatcccatattttcaaactttctacttgaaagtttcaaactttgtactaaaaaaatttaaactctaatctcaaattttgaaaattttgaactctaaattttaacttttcagttaaatttcaaaaactttcaacttgaaatttgaaatctttcaactcaattttaaaaaagtttcaactcaaaatttaaacttttaggtcaaaatttgaaaactttcaattcaatatttgaaaactttgaacttagatttgaaaacatgtgtagtgaagattaatgaaaatatgaaaaaaaaacgcataaaaagaaaaaggaaaatgtgacaagggaaggggcgccaaatcggaaagaaaatcagaaaaaaaaagaaagcgcgctaggaggcgagcgccagctgacgcgcacgcgcaaaatagcaatgttgtataaatagtgacgcttttacaagtataatctttattccattgacctcaaatgaataaggtaacaacaacaccaaatattaggtgaaaaaacaacggccatgaaaattccgtggaattcttaatttattcggtatggcattcattaatttaaacccatatatatacctaaattcattaacactatatgaatgtgggcaatgctagaaagtcttacattgtgaaacggatgaagtacaacgtttaaattaatccaatcaccggaattaatactagaactgagacggcaatctctagtcccgctccagcattttcatgttaacctaatcattgaattaacatttttagttagtaaaatgtcaccatcacaggggtaagtgatccaggttgttgaacatcaagcagtagacgatgtatttaacagcagtaggatccctccaaatttcaccacgagagcaacgaatcaacccgggagaggatcctgatatgcaggaacaagaaaagtgttgacgccttccatgcctaagttcatagatacaaatcgcattagcactactactaactgctggattgcggaacgagatcctctgacctatagcaatctacgtcagagggacgtccgatgctgctacgccgctcgatcggcatcaaacggatcagaggtgaacaagcacggcagataaactggcttcttttatgcccacgctgacaaaatcaacccatgagttctacgccgatagtgccgcagcgcagcatcccgcggcggcgccatccgtgttgggtgccgctttgagtgccttcgccgaccccttgccgccggggccagcacttctggccgggatttatttcgcatccccgaggcatccacgcagtactccagatggcgcaggcggtggcggtgcgctccagggcggcgtacagccgtacacactggtgttccggccacacgcacctgcgtgcgacgacgacctgcacgtcgctgtgacgccatcgttctccgcgtcggccgacgtctctgtgagcgagtaaactgttcgattttgtcagcgtgagcagtaaaagaagccagtaagtctatcgtgcttgttcccctccgtctgatgccgatcgagcgggtgtagcagcattggacgtctgtctgacgtagattgctctacgtcggaggatcccattccatttatgagtaatttcaccatttaatattttgtacctcgaggtaccataaaattttaatacctcagatactttctattgtaaaatttggtacctcaagatatctaatatctcgaggtaccaaaatttaatatgcaaaatatggtaccttgacttaccaaatgttggatggtaaaattacacaaatattttttaatatatttttaaagaattgttactaaataatttttatcagcttgtatgatcatttaatatctgaaactaaaacgtaacatgacacatatattgatctattcagttgtagtttgaagtgaactgcatacatcttttgcttttatcgtttgaattaaaatattctatcagctggattctaacgtagatttgaaatatttttcaaaatttctgatgaaaatatattaaatgaacgaattccacatgttatattccaatttcgtaaagatataatccaatttttctggttgcgaaaagcatcactactaattatggtgcttgtgtcacctttctcatcaagagcctggtattcatttcacttgacaattacttctagcttagcaattccttctcctataacatgcgataggagaaagaatagagaaacaatctgcagagttactccatgaatgccaattggggaatagaggaacatgacatcaccggggcattgcccagtcacgagcttgtgtcgtccagacctcatcagcgctactgcagcatgcagtcttgatgccttccatgtctactggatatatgatgaaatgcctctcaatatgctccatcatatagtagctatgcaagtgttagtgtgttgtgttggaaatttggtcataattcggcatattttaatccaaaataacaagataataaacatgatatttacaataggatttgatccagtgatagtggtaaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataattgatactaggcaatcattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagcccttttcaagggtctcttctctcagtcacacaatagtttgtttcaccatccaaattcacgggatctccaatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccagagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcaatatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacatatttgtcagcttcgttcacaacaaagcctgcagatgtaagcgtggtgtcaaacttctcatgccattgcttaggtgcttgcttgaggccatacaaggatttcaatagtttacacaccattccctcctgaccttctagtacatacccgtctggttgatccatatagatctcttcttccagctctccgtttaagaaagctgtcttaatgtccatctgatggacgagaagaccatgagaggctgccagagcaagtagtactcgaatcgtgggcaagcgaaccactggtgaatatggggccaaaaagtctcccttctttgggttacccttggccaccagccttgccttggacttttcgattggaccatcaagcctaagctttttcttgaaaacccatttgcattctaccggcttgtacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatggggcatgacagtttctttactagaagtgctaggtgtatatttcataggaaattcattctcaaagaatatagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcggctttatagattttaaagaaatgcaatgcctcatcctttgttttcaatagatacacatagcaaaatctagtgcaatcatctatcagtgtcatgaaatatttctttccccctttagtcaacacgccggtcatttcgcacaaatcggaatgaacaagttctagaggtgccaaattcctcgcctcaaatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgtgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcgtcagaaactccgaacttggcctcaagtgcatcccacatttccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaacatagaagcactcatcgctgtcaaccacaatagtgcacgcgctttccatctcttatagtttgaaccatcaaaggcatgt

SEQ ID NO: 63071 - DNA, 8160 bp, Oryza sativa
gcctactttcccaacgcgtgtgcacacctcgtcggatgggattaccgtaccagcaacagcttttgaaaatggatgaaagtgtgtcttcttcttctcgcgggagatcaaatccattctcattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaattccttaatcaaatggattaattctcaaaactcttcatcccattgatatcccatagaagaatgaattcacatgaattcctagcataatgagccttggaatttatttgatttaaatggattaattacccaattaaatctaacatgttggtctattcgaccactgtctttctttctttttagttttcctttggctgcccagctagctatatttgtaggtggaagattgcattatacgagttaaaacttcacgtcatatagtttcagcagttcctagttgcataatgcctcagtttcaggttataacatgttttaactttagtcaaaatcaaactgttttaaatttgactaagtttatagacaaatataataatatttatattaccaaattagttttattaaattaataattaaatatatttttataataaatttatcttgggtcgaaaatattattattttttttataaacttagttttgaccaacaatcagtctattggtaatgttagtacaataattataatattttctgcggccctataatttgctattatcatttgaataaaattacattactcggatttaaacttatcttttttaaaagaaatatatatgcttgtatgtagattatacttcaaatttgcaatgatatagcaggtggggtctgttaaaagcataatttttcttttgctattagaatattacctcgaatgaatagggtgagaggagaaacaacagttattgagtctaaaaccacaattattagaaaaaaaagtgtaacttttattagttgcacttcccaagaagacactgattaaatccaatcaccagaatgatttctataattaactcaaccatatctattctccttctccctcattgtcatgctaattaactgaattggttaacattttctgtttgtctttttaagaaaaagagaacgagtcctcccccatttccattaaagaaatgagcactgagtttctacaaggtttccagaaagataagagctaaaacagagagaattcaggagtacgcatgctcaaagaactactaacatgcatcctcttccagttgcaaactgggacaagaagacgccatcccatcctttcttcgcaccatctgcacctgcttccagacgatcgaccacaaagctcgaaaaggacaacaaataaacgaaccatcgttaacattctcaaaaatcaccatcgcaggggtaagcgatgcatgttaatagacagcactctgccaactatatatttgacaggtgttggaaccctgcaattttcaccacagaactaaaggatcaacccgggagaggatgccagtgcacaggcacaagaatagtctcgatgtcttccatgcccaagttcatggatacagatgtgactgtgccatgcaatttcgcttaagctagctttactactagctacctgctgagtattattgctagctttctatctcacatatatttgaccatccaatttatagatcaggaagatcgagatcccccaatggtttcgctggcccttctgtatgtcacccggtgacctcctagccaaggtaataaatagtgttcataatgcccataatagcggccgctatagcggtagtggacctctaccgctaccgctacaaggtagcggactgaagatagcatgttgtaacttagcatccgctataacgtttcgctaccactatagtagcctgttatataacgcttcgcgaccgctataacagcccactattgactttgttggaccgttataatgcttaaatgctattcttcatatatgaattgtagaactttacattgtttatcttatttatcttatccatctatatgttatttcatattttttatgttatgaaatataggaatgtattattaattctaatttttacgtgaaattgatgttaatattgatatatttatggttattttcttatatttgctattggaacttagcgtccgcaatagcgcccgctatccgtaattcgctacacagacactaattcgctaacaacccgctatacgctatttattagcttgctcctagcgtaggttaatacgccctccaccggaccactttctgtctagaggttacaaccaatctaaccaagacatacgtatttaattggagcctacgaaatacaaccaagagcattaagacttttatagttatatcttcaccactaatcatttatctaagaattgcaagaaataaagtgtcagtgggactaagggagtactatagctagtatataaaatattaccactactataaaacattacgtaaggactgatcttatatgtgctgatttacgtaaaaatgatatctatgaggcatttattgtgtaaacgagtcttttaacaagatagaaataaagaaccggcacctataaccactcattggtgctggtttataataaaaagggttaagtccgatttagccccctcaactatcacaaaagttcaatttagctctcccaactctaatactagatgttttacacctattaactttttaaaccagacccaataccctgaccgaaccaatagtagtttagtcctatgtattatgtaacatatggatgttcatatgggacgcactgtcagccccctattcattgtcttcttccccctaattaacaccccccacacacacacacacgcgagccgcagatctcccaaacatccgcttctcaaaatgtttcctactcggcgagctgcacttgattatgtgatgcatgcatcgtttggttcatccaggttgcactgatcttcaatttgtaataaaaatcatagatcgaacagaccaacaaattaaataacgaggaaacaatttcaaatgggcaattaagtgacaagaaactaaagaattaaagattttgttgtatctaggaaccaacaaatatgtagattatcatatacccgcatggatggttcatccgattgaagataggaggttgggccaattctgcatattatgtaaatagactatactttagaatatttcacaagtcttagttgtgtacgattatgtcaataaatgaggaaaccaagtcgtgtctgagagggtcctctccctggtaaccctgccccctaacctatataaggtgggcatggtcagatcgtcgatcaatacaacacccccggtagattaaatcctcaaaacataactaaggtattacttttcatcgagaagatctaaatctgtataaacctttccccccttactcatccactttagatctcctatgtcatccactttagatctcctatgcaaccctgttttttcattgccgatttttagaatcaacccttagcgcacttagtgcattactcagatacgaggcaaaacctactcttttttttttttttgcgtcgagttttcaactgacaagtgctactggatcaactttgggagccagcgactttgcttttcctccgagccagcatacgcggatctacaggtggtcccgtcagggaaggaccccacgtcctcggttccattcggactcccgtacaccgcccaaacctactcaatgatattctctgagtgtgctacatgtatgagttttattgattaattgagtttttcagatgagagttttttttttgggggggtttgagactagttccagctggcatgtatggagaaacatgtacatctgcattgaaattttgtaacatactcaaaaatcttgaatttttggagaaaatttttcgcgacaagatttccttttggttcttattgcatttttctaaattggagcatttcctatttttatcctttttaaatttatatttctaattaattaggttgtgtttttatttcaaaaacattcaaatccgtttggtaatctaaaagtttattttaaaatttctttgtcaagttcaaaaagtcctcaaatttatctcctcaagtttcatctcctttaaatcctatttcaaatctatttataaattgcaaaaggctcctatttagtttgggccgaagtcccttcattcggcccaattggcaaaagtctatatggcctccctcctccttcctgtgagccgccgccgccaccactgcaaccagccgccgccgccgctagccaatccgccgccgccacctcacccaaccaatccgccgcagccacctcaccgcgtcaatccgccgccgccacgcgtcaccgaaagccgtcgccgaccaacgaaaccgccatcgtcggccaatccgacgaggccacccggcgccgcttctctgcatttaaatcgaagcacgctgtgccgtcgccggtttctcttctatccaccgcctctcgccgcctataaaaggacgacgaggttccctcttcctccccacacaaaccgagctcctcaagctctctctctttctctcccatgtccggccattagtgccaccggcagatctccctcaccggagtttcgcaagccaagcccttgcgccaccaactccgcctcgccgaggtgattccatttttcccatttccccttttcctccaccttgagataagccgccgccaccaccaccttctcttatcgccggagctgagctcttgtcgccgctgttccggccacccctctctctccctccgccttccaccaccctccccgggtgcgcgttgctcgggaacaccatctccaaccggcgttctcacctccaggccaccggagagccggcgccttgcttgccctcctctctgttacctctcagctgccaaacagaagaaaaaaaaaagaacgagaggaagaacaggaaggagaaggcattgacaagtaggccccactgaataataactccctttttcttttatttgttttttaatctttaagagctcatatctcttcaaccacaaatccaattccaagaattctttgatctaaattcatccaatttcaaatcctttattttgataccaaatttcctatttttaaaattttatttaaaattctttatttaaaaaccttttccttatttatttatttatttactttctaattctaaatttattttaattaacctttaaaaaaatatatatattaaatttatttgatttattttatatccctttaattttaaatttcttgtttgaaaaacctttttaaaatttaattttcctttaatttctttaaatgccatttcctttcaaaattcaaatatcttttgaccttttgtatttgcctctcttcatactccaattttgttattttcttttaccatttatttgtagtactttttttttcttataggttttatttgctatcttttacgtatacgtacgttagacaatacagaagatctcatcgacatcacaggagctggcgtggatccagccgactacgctgaagccttcgaaagtttcaaggcacaaggcaagacaattaaaattttgagcacattaaataatcaacccccatatttactttatgcataagttaatcatatgaataacactatggtggtttcaaatgatatataatgcttttaaacattgttatatgagattatggaaagatacactgaacatcattttatgtggtttactattcaaacatcttttacaaacttagaattcggttaaaatgggcatttgtgaatgttgatatatgatgaagtttgttggtgtggggagtttggaaagttttgggtggtttaaccggattataattacccccttataccatagaaatgacatagttgcgtccatccacacgatcaagtaattggacttagcctagtacattgtcccactatatgaaagactgttggttggctcactagaagcaggattggggtaaacgcatgtgtaaggaggttgggggcatggttaacaacggtggaacccgtgaaagcagcaaccaagtagccttgcttaggcccagcaagtgcccgactgctaggacggatcaatatcccactcgtgcagtaactagtagtaagtgggaccttcgaacggctctggtgtcctcagccttgcaaactgttgacatcgtgtgggtaaagctggacagtctctgcagaggtgaattaaatcatttgaatgtccgtactcccgattctggagttgtgtcataagggtgattcctactcctgacatataagtagttttaaacataaaatagtggtaaagataatgagaatttgctgttatatttattttctctttattttaatatcttatgcttagaaggatcatatttaaatttccatgattatgttcataacatattataagtgtcttgcagagtacataagtactcattcttgaattatttaacatatagaagaaccgtgttatgaagaagtcccagaaggtagcgaggcctactacaacgacgagtttttctaggcttaatctatactcaagcttatgcctgtgaagtttagtagctttgggtttttctttgtactttcaaataaggttgtaatagtttgtatctttaaaaccattaacagttgtataattagtttgcatgaacaaatttgtataattaatcgaaagctgttctgtatatcaatctgtgcgtgatcgaaatcctggacgatcacgagtggactttcggggcaccaagcctaaattgggtgtccccacaaatttctatggtaaaaaagtaaacaatgtggacaaaattaccagttctacaaaattaaaattaaggaggacaaaatggacagcgtcccgtcaaattaaaatcagtacacaatgaacaaaattagataaattatactaaaactagtctctactattataaaaagttgaagatatttttaccggttctttagtacgtcatctatgtataagtcggtttttaaatttgtactgttttgaaaatacatatccgtatttgagtggaattttaagtttgttcgcttttggaaataaaaaagagtcgtataagaaatcttttttaaaaaaactcgcatgctaacttgacatgattttctagaaaaatatatatccaagtgaattctcacactgaatttcacattgaacaataataagattaaaaatagccttcgcccgttgcaacgcacatgtattttttctagtattaaaaaaattgaaagtgcattccaacttctggcaaacaaagcaaacaatgggaatatcattactgttatgcaaaactaagaacatttttctgtatgattaaaattgttactagaaataaactgaaatcaccatcctcccaaatgaaactggtattcaaaaataaatgaaaaaagaacgttctgctaaattaaaattagtattagaaaaaaatcagatagagattttctttcagcaggaatatccatacgggacttgttataataaaacaagcagggtgattagcgatttccaggaacaatgcggctgcttattccttgaaatcgcgatccaataaagtgcggcgcggtagctacacgctgggagaaggcgggagccatgcgctgggattgggatttgggagacgggcgtgaacaatgtgggacgatcgagcaaaagtgttagatagcaacagagaactcccacgttatagtttcaccgtagtcagctgagacgccggagaaaatagtcctgataccttccatttctaagtagatcgatgcatggatccaaatgtgcatgcgccagtgtgctataattaagtttgacggacttaaccatggagtacatatataggtttacttaaaacccgtgggatcggttgaagattaggggcgccacgtcagcaaatttacaaaaaaaaccctgtatttttggtaattacatactggtttccaccaacatcgtccgttcgatctcgcggtagagccgatctaaccgtccacatgtccactatggcggccctttctcagccgtgggatcgttgaatcggcaatcaacggcatagat

SEQ ID NO: 63072 - DNA, 2944 bp, Oryza sativa
  unsure (1)..(2944): unsure at all n locations
ccagccatcctcgccctagccgcactactaggctcgcgcgcgcatgacctcacctgccgccgccgccgctcgcccgccgccgcttgcccgccgccgctcgcctgccgctcgcctgccgccgccgccgccgccgccgcggctgctcgcctgccgccgtgccgctcccctcgctcggcacaccaggccaccttctcccctcttctctcctctcatctccaggccacccaccgcctccctcttcctctccctatcctcggtgagctacagatccggttcgggggtcatcggaatcgatggtctcggccattggtctcctcgccggtgaatcgttttgatacccttctgcatacatttagcacaaaatccacatggtaaggcaatggttttgacttgccattaagcatttgcattgcgtttgctggtgtttttacatgatcccccatcttgccttaggttctgtggagaaattgatgggctaggatgaggtgtaagtcgcagattacagagaggacgactttcattctgcgcatctaccgtcatactgaacaagttatcgagctttctcctctcttaatcagggcgtgcgatatttagattatggtgagtttttcttgagttcagattatttcatatgaatttagctgtcagaagttcgatggttattggttttgttgctgcattgtatggcactccttgatagaataacatcaggaagaaaaaagaataccatgataggtgttacaaggctataagtataaggtaatatgagagcattctgcaaacaggatatgcaatggaaggatattctttttattaactttggtaaaatacctgccaatagcccattattgacatcaaaaccccctagctctaatactgggagcataacacgctgatagacagtgtgcaaagcttttactggtgtctaatttgttgcacaaaattattactacttcaccggatttatgtggtttgttgtgttggtccagttcagcaaagaaagttggtaggatcatggagaaaatgaatcgtatggttattttttcattgcttggtggtgtttcacacaactcaatctgctgccatatatccataaaacaaaacattcagaaatgtagttatttagtactatcctaaaacttacattctgccaaaaaaaataacttttagcgtgcctgttatttttataatttaatgtgtaaatgatgaagagtgcaagcatctaattttctcctctgccttgacacaagagtttaggccactagaatgtcctagcagcactgaaaatactctatgcatataagcatataaattttccatgtggcacgtgtccacttatgccacattgcttctggttatgtgcacacacatattcaaagggccaaataaatatatatggtaccctgcctcaaggtccacttcaatccatttttatattggtagggggccttagcctaataaaagtatcccatattcctactatcttctgttaggctttcacatttaactattttattttgtcgacatcgtttaacttggtgttttttccccttttcctaagtggttggttgatactattacaatagtatagatacacataatggagccatgtttcaggttagaacttccaatctgcatcttttattgttatgttcaccttcaaattttcatgatgttcaaatgtgcttagaaaatcaagaaccaaagatggaagacattattaagctagaaacaaattacagccttgcagagttaaaagacttgaaagtggttgaccatgtctcaagacccaacactttcatcttagaaatgttaattgaaagctttctcaatgacattattttccatatatcaattactccaactaatctggtactagctactgtatatgcatagtgaatagttagtattgcttaaacaatgtctgggaccgttatattcgttgtaagcatatatttcaattgttttcctatgatggtcagtcaaaaccagataatcaaaaaagagataaaaaactactctctattggttatttgattttcaggctttcaagagattagactactaggcctgcataatttgaaatgctatttaataaactatatatgtatttaaatgttcagaaatttagttccagtttaaaatttcaggtgtatgcaatgttgaaaaccaccaaatctgggcatttccttccaaacaacttctttgagatgaaatagattctgggcagttgtttcttccaccgtccttcattatctttgtactctcgcatctaaattatcctatgtcaaatgtgcatatgatttagttcacagctaaatgcatctaaagggccaacaccagatcttctgcaggtaactgtggcctaacatctaaagccattagtagtacccatgttcttttttagttcataagtcctggtactgatgtggtgatgctaagaaaggtttatgtgtgatacaattaataagatgttaaccaccaaaaagaatacnaaaagctgtgcacttgtgcattaattgatactccgtaatttgtgtttgcagacgcagcaaaaatatattagagtacaaagggtaatttgtctttgccaaaagaatggagttgattttcctatcttcttaataggaaagaattcaagtacatagtctcttctaggtaatttcttccagagtttcagtgctgtctgggattacaagcagtcaatgcctcttcttaagtaatttccttcagtgtcgtctgggattacaagcagtagatgcccgatgccacaagtgttagcttatatgtgagaaacctacaaatacttaaaattagatgctactgccgaacctacaaatctgttctcaattctgatgggtttgatgcttgcctaaaagtgcagaaaaaacaaggttggtatgccgcatgtcttcactttctaccacagagttattgcacgttt

SEQ ID NO: 63073 - DNA, 1801 bp, Oryza sativa
  unsure (1)..(1801): unsure at all n locations
ccgatccattcccccaccatagccaatagagatccccatccccttccaccccagcgcccgcccgatctccgcccttcccgcgcgatcccgcgcgatggcgctcgatctcccgcgccgcgtgcgccatctcgatcccctcccatgcaagccatctcttcccctttcgcgcgcgaagatctcttcccctctcgatacaaatccacccaaaaaatctccatctactattttgccagccccaaaaatccggtaagattgacggtctccgcccccactatccgccttccctcttccccctcgctaatctctcatgcccgcatgcgacagatttgtaccgaaaaccctagttcccctccaccaacagccatctctcgccggaggaagagggaggttgcgccacctccaccaacacccttgtacatgctatctttttatagaattcccagggggggtgttaaagagaaaatatattttgtaaggagatatttatggcaagaagatcaagggatcataaaatatcaccatgtacaatggccaatagtgtgctctccaaaagagcaaacagtgaaccatattaatattaatgtgtatgattttttatataaaagatgaagcatgaaatttatgtgctaattatacactaaaatgatcttgtgacaagttattgatgcaagtttatttgttgcatggttagttactggtttttaagtatccaactctaggggatttggacccatgtgcccacatgctataagtttcagtagcttgttttagttacaattgcagcagtggtggatccaacataaaaaaattagttatgatgaaactataatcttcttgatttctatataggggagtggaatctcgtcctcctggtgggttcgttaatcttatcaatgccccatcaaaccatatgcatcatgtcgccgaagggagtccatcacagcctatcaatgttgagaatggagatgttgctaggacagagaaacgcttgtcatggacaaacgatgaagacttgagattggagtggcctaagtgagttatttatttgtcaatgtgatgtacatcacttgcattactaacaccggtaaacatctttttcctaaaaattgcaaatcagcgcctagctaaacaactcaaataatcctacagaatcaattttcaagaagaatgataaatattggggcgatgttgctgcagcttacaacagcactaccccaaaaagccgagttaggcaagttaagcaagttaaggatcattttggtaaaattaagaagaaggtagggaatttttgttgctcttggaaggaggttaattcattatatgccacgtacctagaatgccagaccaaaatacactcaaaaaccactaactccaaaaattattagaaatttcagcagagtctcccctaaaaatacggacatccacgacaggcagttataagataactcaacaacaatataatccacacaatacaaaccatcctagctccacaaattccacgtgaaagtaaggaccagactttaaatgaccgttacaagttctacgcaaaacttatgctaagcaaaaacgtaatctaaaactgaatttcaatagtgtgcaataatagtgtagttcaagggtgttactcccatcccatgccgatcaatatcattagatatctaaaaaccaaattaaacacaagaatgagtaaataatactcagcaagtacaatattgaactagtaaaacatacacatgtntaatgcaataagaaaccaatatgaaacttttgttttcctttaatttaaaacgaaggagacaaa

SEQ ID NO: 63074 - DNA, 2807 bp, Oryza sativa
ttgattcaaccctgtactagggcaagggctaatttgtttaagtgtggaaagaatcaccattctgcagatagtgtgtttactagggcatgtcgtgggtgtggaaaggctggacacatggggttggtatgcaagcgtaaaccaaattctatcatcaagtggcaaaggtctagcccctattcagcaaccttttcgagaactagctaccctcgcggttcaggttcttccactagtactccccgtggtgctgttcagatgatgacagcttatccacttccttaccagcggttcacacataattacccaccaccaccattaccaagacagtattggtccatacctcaatctcttgctccacatgctccactctagttgcctgcaccgcctatggcgcatccttctgcttcagctccacctcaccagcaggcctcaggctctactacctcagctatggctggagtctacaacatgcctgcagggtcatcccttggtcgcccggatgtcattacaggtacactttgagttgattcgcatgatgctctaattctgtttgattctggtgctacattttcctttgtttcaatcgagtttgtgaaaagagctgatctatttagtcaagaggtctctcgatctgtccaagtcagctctctagggggtataatctctagttcagtagtatgtccaggttgtacaatctctattgatggggaagaattcgtggcaaatctaattgtgattcccttactactctttgatgtgatcttgggcatggattggttgaaccaatatcgtgctttaatttcttgtttctagaagacaattaccttggaagctccatcaggcgaggagatggttttccaagggagcgcgcctccgcattctcttttcgtgatggcaaggttatttcctgggcagcgtgctgtaaagatagtgttattatgagccttagccgagaaggcatccaagcctttattgattgaagatgttcctgtagtgcgagattatccttatgtttttcccgcagaattgctagggatgccacctgagtgtgatgtagagttccgtattgatcttgttcctagtacacgacctatctccagagccccgtaccggttagctcgtcctttccaagaagagttgaagaaacagttagatgatctattatccaagaaattaatccgatggagtgtgtcgccatgcggtgcacctgttatttttactaagaagaaggatggaagttggggtatgtgtgtggactatcgggccttaaatgccgcgacaatcaagaacaagtacccattgcatcatattgaggatttgtttgatcagttaaagggagcaaaggtgttttctaaaattgacttgcaatctggttataaccaaatacgagtgcgagaagaggatattgaaagaccgcattttccatgacatatgggcattatgtgtatagagttatgtcttttgggctgaccaaagcttcggctattctatggagacgatgaatagcatgttgcatagctttctagataagtttgtggtggtgtttattcatgatattctgatttactccaaagatgtagatgagcataagcatcatttaaggatggtgctagggacttacgggaaaaccaagttccatgttaaattaaaaaagtgtgaattttggcttcctgaggtggttttcttagggcatgtaatcaatcagcggggtatctcagttgatcgagcaaagtttcaagtgttgtcggatgagaaaggccgactaatattaaggatgtgaggagctttttgggtatggcagggtgctaccaacacttcgtgaaggattcgcgattatcgctaaaccaatgatgatgctcacacaaggatgtgaagtttcaatggacggaccaatgtgagaatagtttccaacaattgaagcataggttggtaactgctccagtgcttactttgccccaacctggtaagcgtttcattttctattccgatgcttcacgagtaggccttggttgtgttcttatgcaagagggcaatgttatagcttatgcgtctaggcagttaaggaagcacgagcataattagcccactcatgatcttgagcttgcagcagtggtctttgctctcgaaatttggaggcactatccgtatggagaatcttgtgatattttcactgatcataagagtctaaaatacatctgcactcagtaggatttgaacttaaggtagaggaggtgggtggagttgattaaaaattacgatctcaacattcaatatacaccgggtaagacgaatgtggttgcagatgctctaagccataaggtcgttcctccaactgtgagttttttataactgattttgaacggatggatatctcctattattatgccggagcggcgagtactgagtcacgagtcattcttgagtccacaatacccaacgagtgctagaggcccaacaacatgatcgattgctgcaacaagttaagaaacttgtaaaggaaggaaaaactagagatttcactttggattctttgggagctatgcgattccatgggcgtttatgtgtcccacaaaaagcagaaatcaaggaagagattttgcgagaagcacaccgaacaccatatactatgcatcctggtgagaacaagatgtatcttgatctgaagaagatctattgatggaagaggatgaaagtggatgtggccaagtacgtggcatcatgtgggttatgtcagcgagtaaaggctgaacataagagtcctgctggaaagttacaatcattggaagttcatgtatggtcttgggatgata

SEQ ID NO: 63075 - DNA, 16848 bp, Oryza sativa
  unsure (1)..(16848): unsure at all n locations
tgatactcaattgaaattcagtacggcttttcaccctcagactgatggtcaacctgagcggactattcaaactctagatgatcatgtatctttcatggaaaggcagttgggaggatcatttgccgcttgtagaatttgcatacaacaatagttaccatgctagcattcgaatggcaccatatgaggcactttatggaagaaagtgttgatccccattgtgttgggattccataggggagagagctatgttaggacccgattgggttcaacagtccacaaaacagatagcaaaaatacgacaacacatgcttgcagctcaaagtaggcagaagaactacaccgatgttagaagacgggaattggagtttaaagtgggtgatcaagtacttctaaaggtatcccctaccaaaggtgttgtgagatttggaacaaaaggtaagctcaaccccaggtatattggtccattctcggtagtggaaagagttggaatcctagcctatcgcctcgagtaaccagagtccatgaaaggtgtacattgtattccatatttccatgttaagaaaatatttgagagaccctgaacatcatattaccgtagagccggtgaccattgagccaagatttaacatttgagtctcatcttgtaagaatattggaggaatctgagagggtgctgaggcatagaactatcaagtacatcaagattctctagacgcaccagaccgagcgagaagcaacttgggaacttgagtcacagatgcggaagaagtatccagtgttgttcacacatggtgagttatataagtcctacctatgagttcctttctgtacttgttcaaggtataactggacgaattcgagggcgaattcgattgaaggagggaggaatgtaataccctatgtcctagagtatggttgggcgaattcgagggcgaattcgattgagggggaagaatgtaatgccccgggttttgaattaatatatttcgaggaatattagagcgaacgcgcaaagttcaacttttaaaccattgtttgaataggcgatcaggaaccgtggatgcgtagcgctcgtcgagtagggcgaaatagactataagtttgtggtaatctgagtcctgagttatttccggtgatcgatttaatgtgggccgttcgatcttcattagcctctccctattttaaccaatagaaaggaaaaaaaggaaaaaaaaaaaaggaggcatcgctagcagctagccctagccgccgacgtccgcgtcttcacctctgcgctgccgctgctgtgcgtctgacgccggttgccacagccatcgtctccttggtgagttgctgctgccgatctgatttttgtcttgtgttgctgctgctgccgctaggactgctgcttgtgctgctgcggctgctgccgatctgcttgtggtgctgccgatctgccgttgctgctgctattggctgctgctgcttgttgctgcagaagaacaggaaggaggaagagaaggggaaaaaaattagaagaagggaaattcggggagtttggtggatatttccaaattctttgtttttcttacaaaattagtactgctgggtaatctgttttagtccttagttgtttctaatttatatataagacgatccgtttctggtagctcgaatttatttttatcgaacgctaggctaaaatcgtatttttaattctggtattaaaccatcggattcaggttagttgtcctaaataaagtttgtagtcatcgtcgatatctttctaacaccgctggtttcgttcgattctgataaatggtctgggagaaacaacaaaaacagtactgttgactggatccagaaatcaggacagcaattcgttttccttaatctgggattttcagaggcataactgattttgtgctcaacatgaaagtggtagacaagtttgtctaatgtccgaggttgtattattttgctagagtttcgttagacggtttgcgagttacgcataaaacagtaataaaacagctataggttatttaatacaagtcagtaaaaatttatatgaattgagtttcaatttttagtaaattccttgtaactatgattagttggatatagtggtttatgcgtagttttgctcccaggtgtggagggctccaacgttggaggagttgagtcgaattatcgaaggagttaaggcaagtacaagacggacttgtgtgatggataaactgtgttacttagttcggtttcatttacccaattattattcaaagattcctattatcaattgtgtggtttggtattatgctacgtattcatatttcacttcatgttcaaattcacgacgttattcatatttcattcttccggaagtttttgttacattattcaagtaccatgcgtagtcatgggagtgcaatttggatctttattcatgatccttgagaaacgttgatcacgcttgctcggcttaccggtaatgctaagaggatattcacacctgcccgggagggaactactactttttgtctccttcgttttaaattaaaggaaaacaaaagtatcatattggtttcttattgcattaaacctgtgtatgttttactagttcaatattgtacttgctgagtattctttactcattcttatgtttaatttggtttttaggtacctaatgatattgatcggcatgggatgggagtagcacccttgaactacactattattgcacactattgaaatttagttttaaattatgtttttgcttagcataagttttgcgtagaacttgtaatggttatttaaagttctggtctttactttcacgtggaatttgtggagctaggatggtttggattgtgtggattatattgttgttgagttatcttataactgcctgtcgtggatgtccgtatttttaggggagactttgctgaaatttctaataatttttggagttggtggtttttgagtgtattttggtgtggcattctaggtacgtggctacctggggtgttacagtctcatgattatctgatggctagggcaataaaaatatatgagaatgatttcaaggatggtccattcttgtttatgcattgttggaatgaacttaaaaaccaaccaaagtggcatgcatatttggagcagcttgacaagtcaaacaaaggaaggtagattacaatgatgccattccccttgatgacgaagatagctttattgtagtcagttcaaaattcatatgcagtccctatttcatgcttattaattgcagccaatcaaaaaaacatgtggtcaatccaaatttccatgctgattgcttattagttgcagttagtccaaacaaacatgaagtcagtccaaatttacgtattgtttgcacttggtccaaactataatgcaatcaacacaaatattctttgctagcagccaaggcagtgaaattggcaagcagtacaatagtacaattaagcatgcaaactactagaacctccatctatatatatttattgacccttccattgtgaaactctcaaaccaatccattgtttcattctgaaagtaccatgttagactcatcctcaaactcatcatcctccttagatgatctagacccatctaaatttcttgacaaatacatctctgaccagaatgtcctagactcctttgctactcgaattgtggagaagatcaggccaagtttgcagctgggctagtccagtgccaaggtggaacaaggaatacctttgcaagggatcatggagaaggtcaccgacgtctagtggctgattattttgtagatcggccactctactatgagagaatgttttgcacaagatttcgtatgcgaaagcatatctttttacgtattgtgcaagccctagatcagtggtctccgtactttactcaaagagaagattgttctggtcgcacaggcctttctccacttcaaaagtgcacagcagcgattcatatgttagcatatggaacccctgctgatgccttagatgaatacttgctaactggcaagagcacttccttagagtgtttggacacttttgctatagggatagttgaggtctttggtgggcaatatttgcgacaacccacaagtgaggatatagagcatatactacaggttaacgagtctcgtggctttccgggtatgctagggagtatagattgcatgcactggaggtgggggagttgtcctagagcttggaggggccaattcacccgtggtgactacaaagtcccaacaattatccttgaagcggttgcttcacatgacctttggatttggcatgctttctttggtgtcgctggttctaacaacgacatcaacgtgctgaatcagtccccctctattccttgaataagttagaggggaggctcctcgggttcatttttctgttaacgggaatgagtataacaatgggtataaccttgctgatggtatatacccagattgggtcagcttcatgaagtctatatcacttccacaaacagggaagcataaattgtttgctaaacgtcaagaaggggcaaggaaagatgtggagcgggcttttggagtgttgcaagcccattccaatattgtgcgtcgtccagcgaagaagtggaaacggaagagtgttgggaaaatcatgctagcttttgtgattctcgacaatatgattgttgaagatgagagagaggatgcgatatgtgacattgacctcaatagaattcctaggacatcaatagtcctgcctcctgaagtaacttctggtgataatccatgttttactgatgtgctacgttgaaaatctgctattcgtgctcgttctgtgtataccgaactgaaaactgatttaattgagcatatttggcgtcggtttggacataggcagcagacataaacatggtagggtaataagcatgtcgtttctttgccttttctttgccgtgtgtagattatatcaattaacccttgtgtctaatttatttcaggaacatgctctgctcagtatgtccaaatcatggtgctgcacttcttaaaggtagcttatatgaactaaatttagtgctaggccagattacttacagacacattctaatgattctcttttcttccttgtgatgatttacttgaactaaatgtactcctagtccagactactaatagccacagttcagtatttctcttttctttcttacgatgcagtagcatggtgttttgttattgcttttacccgctgaactcactttgaatttacttgttatgcatctgggcatactgcaaactgttacgaaatggtgatgaaattctcaatttttatgccagtgcaactatttctttgtaagatataccaaccgtagaaaaatgcatgtactgattactccttttagtgaggtttcattgaaaagagatttcattgtttcatttattcatcaaatgacaaactactcaagatgttatgtgttttacttctcccattaggttgatgatagctcaggcaatggtaatatgatgcaatgatcctgctatcaagggtctatcttcgatgaagaaatcattctctcacttgttggacagcatatttatatgtacttttgcttaatgccctattgttgatgtgactaatatccaccgttgaggcagagggagtcgaaatcgtgggggcgcaacggagttggggtcgtcgcggaagccacgatccttggtcttacggggacatttaccggctcaccgccccctgcgatggtgaacaaaggagtgaggtgagcgctgggctgggagagtaggggcacgatgcggtggcatgcggcagggagtctcgaggaggcgcaacagcgagtgaggtggtctggtggtggaagcgcggtagcggaggcactggtccagcagtggactacggcggcagaggggattcnggcggagtgaggaggaaggaggattcnagcggaaagaggaagagtgaggangcggcagggattggcgctggtcccgtggtggactgcagcggcagcggggattcgggaggagcgaggaggcagcagggattcgcgtggcggagtcatcgcgcagtcggaaagagcggtggagaggaatcggtgggattggttatgatttcctacagcaaggaggatacacggatgagattagatgagatagcagatgaacggtagtgattgatctgagtgatttggcatgtaggattggaggggtacaactcctcctgtttatattagtatagatatagatatgttgagcagagcccagctgcccatactacacgtcaatactgagaattcaattgcaaaaagatgcgctacagtatgctatcaaactattcagtaaagacctactcacattatttcctttggctctgctttgtaaatcacttgttgaactagttttactattcatcaatgtatatatactcatttgttccattatcttaaataaatacgcatatatgctatatgatgagtgagaaagaaaacaaacaggagcatagattggatcgaaacaacgcagcctctaaatgcaccggttctttggtttatatgggttatacctgtcatgcaacagtcatgatactggacaactgaagttgttacattttacaaccagagaagaatatgataagagataaaacaagaatcagcagacaaactttatacatctctagtaatttttatatgagtgaactaaatatatcttaagcggggaagacaggattgaccgacaaaaaggtgcacacctaaattatcagaacaaagtaggaggtctaattgtgactgcctagttgtgtacccgcactgatacgcaaatattactgcctattgatgcattgaattggcaatgataatcattctaggcccaaaagaatttacaatatggttgcacgtacgacaaacattccacgattacaaatcaaaacccaattccatcagacttgagaaatgctaaaggtcagcttgtataacatgtgagaaccacgcatggtacagagtcccgatcgatccaacaaatccatattcgatctgcaaacatggctgaactacatgctacacagcagcactatgttgtgttgtaggatccgctttattaggttggtagggccattgattctttctctcttaacagcatgggagagtgacatgaagacgcacgcagtcaggactaaaagcatggctattagtcacgatttgggtgatacatgagcaaaggatgtcggaggggcgagctgatcatgcttctagcggctagcaagcagggtgctaggcaagagtgtccgtgtagaaacttagcagaatcggcttatttgatatttttcttgagagtttgttgggttaatttactagttttgaatctgtcttttttatttaatctccccttcattttgtcaaattattttctaaatgtttgactcagactctcacatgcgtaattaataatgatgatacctacatgtacatgccagtgataatacatgtcaataccagtgatgctatggtatctggaacctatgttaataactggcagtggtaattaatatctgtaggtaccactaatgctacctactacaaataaccatgatacctcgagttactacatataataatactacttctcagtatcaaaacaatatcattgaggtttcattatgaagtaacctagttgacgcgtgtacatacatatatgcttacatgggccaaaatggcatgcatgacctatgttattgtcaaatacctagtgtacaccgctactggctaacacgactttttggatccccatcacactccaaaccatggttgttgtagaagagctatgtgcctctctctatagcttacggacagacagaagggatgagttgtgaaccgccgagcaggcatcctgctaggcaattaggacgtgcatattgcaccacacagtctaatcgatcggctcagcataacatcacctcgtgatgcccattttctggacccacatggcatgctagcctgctctgttgtggttgcctatagctggtcccctgtaaaccgagccgaaaccccattcactaaagccttgtgcacggcgggttgaacattataccatgaaagatcacacagtttaattcgttcctaacatgcggtcatgagatcattgaacaaaaaggtttaagagtgaccaaaatcatgagagatcatccaccgccgccaggcccctcccaaccgccactgccctccccaccacccgatctgctgtcgccgctgaactctccactgtccgagctcgccatggcccttgtgcacgccatcaccgctgccaccgccctccccactgatggaatcgccgccccatgaccgtcgaccaccagtcgtcaggagaaaagtcgagagagagagggaggagatgcaacatgatagacggtctgagctgagccctcgttgacgccgccgctgctcttgcagtcgcccaagaggttagggagagagagtaggttgaggagataggttggatagagatgcagattttttttgtatatctaagcacatgcaagcttttaattatgagtatgagcaacctacgtttggaattttatttgtagacaaaatgtccatgtgaccatgttaatctttcgacctcatacctaaccaaaaaatggcctttttctccattgtttcaagcaataacgtggaaaacttaacatgctagtagagtaaactctcttatttatcagccaatagcaattgtttagatatcttagcttgcatattcagattacactaagaaatacgcatgggatagatataagcaaaataacacagtttatatcatatataaacatgtaagctatgaacaaaccacctaattaagtatatcaaacaatatttcaaagtaataaaactcaattcaatggcccatcatattaagtgttggatatccggttcgatagaactacattgcacttgagaatcctatctatatacttagatctggatttggcttgctcgcatttaaatttacagtgttgcatatgcttacatgcaaaaaaagtggggggggggggtgagtgtagagagaggggggaaaatgagaggtgagagagaaggtgaggagatagggatgaagccttagaaaaatttgaagatgctgagagagaagagaggagaaatgttagacttttaggcagatctctatgagacccgtctgcaaaaatgtatttccgcatacggcctcttaagaatccatgtaggaaaataaatatatttttgcaagtgagcctcttaagcggccgcatgcttttcgcatgcagcacttaaaccgtttttggggaatgatttttgcaggtgatagcagttatggctcgcctgcaatttaaaggagatattgtctagaaaaatcaattatgtagtagtgaaagtttcagaaatgttagatgacatcatctactactcctatcggatggactattagaaatgagagattaactccaactccttgtatagtaacgaaccgtagccgacgttttgtatttgtttaatttgtatctacccattagagagatgagctcgcctctaactgtttgttcctttaatttcagccatatctcaaacagaatctcttcctagcgtattagagattaaataatattcctccaaaaaaaagagagattagataatatactcaaacggttcaaattgaatctttagagatgatcaattggggatgatatggtttatatagaagtgtttgatattgctctatcagtatcaagaaagcgatgatcaggcaagaggaaaaggtttttgtgatgtgtttgctgatcactctgccagtcagcgcccgcgcatgttaagctttgtattgagctttatttgctattgtgggccatccatattttgatctaattgttcaaatcagcttattcaacacaaatgatcctgaaattttctctgatgatattctaggacatttttctacatggttctcgagaatcacaggctttcattttacatctagcagtgctagtactacagttaacttgcagttcagttaactctgcgcagcgtttctgaatcaacttgagctctgcaacattctgcttcgagtctaccactaatggtgagcaacacccctgatcccgatgcctctcagacacacatacaagctctgcctggggctgtcatgacacagctgaatgcgcgagcacctagccggaactgaagaatgtgtagcgcaatttcagttctgggcatcatgaggtgccgttttatagctccgaaaattcttgcacagccatatgttacctactgattactagcctctatcttgaagctgatggtttagtcgcatgagatataattaatcgttcaaccggccctcttaattgctcatatcagagacgtgacaatagtactgttggtctgttgctcgtacaggcatgcagcaattgcaatagcactcgtaattaaatccactacataaattatttgtcagtaatgtactgaaaattttcaatagaaggtgtgctacatagctacctttcaggtaagctatttgcaatatgttagtagctagatttttttttttatagttttgcagtaaccaaaaattgcatacatcacgcggttcattttctttggaaagttctttttctctacgatttttttttggatttatacgttgaagttcttaatttatcgttgtttgaatttgaatgtgtctaatttaaattgagtaaatgtttatcagttctaaattagttttatacctatattagagaatcctatattcgaacttttatctaggaaagacgagaaagtgttttaaattaggaatgacggaagtgatgaaagtgttaggttatatctaagttatgagaaaagtgaagtgaaaaataggcaatcaccttaaatatataaattaactcttcagattaaccgtacttataggcaaaaaaaaaacatgtgacaagtaatctacaacctcatcaagtacaatacaatattttctttcagtgattttccccaaaattaatagtctccataagacacgtaatatcaacaaatactaataggataactaggtgaaaccccacgagttgctacgggagttcagtactcactccgtcccaaaatataagcatttttgataagtcaaacattttcaactttgactattaattgtaaaaaaaataaaaaagatcaatcatgtaaaattaatgttactagatttatcattaaacaaactatcataatatgtaactcattttatttaaaacaccttgttttatagatattgttgatcaaagtggtatctcggagaccgtgccgggtctaaaaatgcttatattttggaacggagggagtatgatttaatgagagaagaaaatgagagataatttagaccatgtatgaattatctaagggctaaacaattaatatgatatgacttattaataagagaggagagaaataatattaagtaagtgaggataaactatataggtatgtaagatattataaaaaataatgaagagatatattaaaacaatatgtgaattatgtagaataataactaaatgcttgcattttaacgctttaaaattcaataaatcatagataatatagcatgcttgcataatatttaagatgtaataattattagtgaataataatttggtatctttacatcttaagttttaaaatttagtgggttataactttatagtaaaataggatatatagcactatttaagtaccttaaatagtcaagaaggaatctgcagcaattaaatagctctcgctaaagaaaattcaggggattgcaaacaggagattgcacgcgaagcacaaattgtgaaatcattgtcatgattaatattttgtgatgaataattggctttacaaatgatttattcgatgaactgatttgaaaagatatgtggatgttggtgtaagtgcgtgtgactaatgagtcaggttatgatatatgtgctcaggaacggttgctttgtctgattgtgtgcaggtgacttcaggtcaaccttggtcaatgatgaggaccgagattatgctcagggaggatcagaggtccagtgcggtcgggatatcatgtgagaaggtgactagagtcagaattcttggaggaaaacttcggtcgatagtgttatcgggtctagactcagggaggaatgaggtgtgagtgcaagcgtcggtgttcgcgaaggagattagagaattggataagtgtatgttgctacattacttcggtttactgtagcatatgttgtatgcatgtgtgttgatcaatgatggcagggcttggatgttactccctccatcccataaaaaactaatctaggaccagatgtgacctatcctaattaacactataaatatggacagtatttggacatatgtctagatttgttatatcaggataagtcatatttgataccatgttggttttttatgggacgtaggtagttatgtagcaggttaggatttggatcctctaccttcgaggggtgaaggcacggtggtgcagtcaaaccatcctcgccatccagcaaaaataagtggctcacattcatgcatgtatatacagagtataatgggccagcccattagtccgtgcagtcaagccagcaaatgaggccgagctagcgttgccacattatggcgcgaaaatgtccgcggtaatggagccgtggagggaaaaatggcatctttactctgttttggcgccagaattacataattctcttcgtctactcttttcacctccatttctcttttcagttccaaaaagattttgtgccctttttcttgtcacctcttcacagcctagctttgagatgcaacaagcttgtgatcggtcagatatggcagaagaacccacttgaagaccatgtgtttgccgcggtgattagtcagtttctacaagagagatggatgaaaaggcggatggtgagcaccatgagttcatcaggtaaataaataccaactctatacttgtcattcttcaagcatggctgcattttctctatagtaataatccacttgtgatttttcagagaggggatgatacctagtacactacctcaacttggaacgaagttttaggatgagatggaggcttgggagttttggaaatcttatggaggtaacatcggtttggaggttaggaagaggtacgcgaataagaggaagtctgatggtaaagttagatcatttagatatgtttgctcaaaagagggtcatcggaaacaagataaaagatatcattaaataaaatgtcctagagctgaaactagaaccggttgtcaagtaagaattggccttatactagaccaaaaagtaggaaattatgaggtgactgatcttgttctagaccacaatcacatcctttatccaccggaaacattccacctaatgtcatcagaaatgaatatttcagatttgcaagcttttgaaattaagacaattaaccgatgactccggaattggaccaaaagctgcacatgagctagctagccgtcaagttggtggatcatttaatcttagctacacccttcgtgatcaaaaaaaaattattcgtgtaccaagcaacagagggaggtggcatatggtctaagtcggaagtatgttgaagtattttcaagacaaaattgctgagaatccttctttcaaatatgctttgcaaatggattgtgatgagcaaatagcaaacatattttggactgatgctaaaattatcatagactatgcacattttgatgatgttgtcattttttatactacttttggaacaaataaagagagtagatctttcagtgtctttgttagtgtcattttcgagaaacatttgagtctttcaagtggttgtttgagacctttgtaaaagcacataatggctaacaaccgcaaacaatttacacaaaccaagatagtgcaatgggcaaagttgttgaagaagtgttcacagaagaatggcatggattatgtacgttccacataatgcagaatgctatcaagcatttatctcaaccggagaatgaaggccaacacctacttctaaataacttgacaaagtgctagtacaagccactggagacaattaacaggctcaaaacctcaaactcaaccatgttgcacagaaaataactataatcagctaaatgttcatggcggcatgagatgagcaagcgggaataagcatctacattgttttgattctattgtattcttctttcttacttgcatatagagactgaacaatgaacaatgaacaattatatttcacatactcatttgttcaatcaatggaaaaacgtaaaaccagcccatataaaattcatcgtcttcgaagagatcacaatggagggcgcttttccttttttttttaatggaaaggagagttttgtttacacatcaacttaggatttttctatcgaacactagacgaggaattcccccatccaactgtgttacagaatcaagcatagctcgcaagatcgttaccaactccactgcactctttgctagccaattcagttttcacttttcacttcaggcaatagccacattgtcgccttaatttcaaccaatagctaagctttataaatactgcttgtcccgcgccttcttcagtcttggtaccaacaagctacagtgaatgagattgttggaatttgaagctatttcaggagtaattgcaaaaactatgagttttgtttcttctaaaatcgatcaaaacatatcgtaaaattcaccatgacgacaaaaggtacctgacatggttatcacgaaccaaaacaactatgcttccattcaccatgacgatgtcatacaggcataaccataacaatgattccgatgtctcaaagcctaacacatattatctctagtatggtatgatgaatgtggaaaacctatatatcataactgaagaattaatatgaattctttacaattgtttcactgaaatcaaattgtgttttgattattattttgtgatgaacaattggtatgtgaaataattgattttttatatttggtggataattgacgaagtgggattggtttggcccagcacagtggtggtcgatcagattggcatatgttgtgcagtcaaattgaccagtccgacaatctgaccggctgactctgactcggtgttggttttacgttgtttatttggatactcgtaattatctcgtgattatgattctagatataatactgttgtgtgccaatgttgagtatcacgatgagggtcatgccgtggaacgagatgcagagttgcatcgtctcacgcctgatagggcatagagggagatgccggggtcgtcgtccgcctccggcgtcgcattgtggtcgtcatccgcgaaaggcgcgccaagccaaaacaggcgcttgcacttatgccctggaataaatttttcatcacaattaaaacaaagaccagcctcacgatgcgagtgcatctcttcaggtgttagtgtacaacgtggagtgcgtccctgttgaactggtttaggtgttgttgtcgtggtattgatgcgaaaaacacacactggcctgagagatttgatttactctggtgcaggtcctaaatcttacttttgggttcagggcgtgccagttggtttgatcctgcaaccaacaagaaacaacgaaaccaaagttaaatctataaactctagtcgatcggctggattgctgatgacgtatcattcatatcaggtcgatgtgatatggatcagatcggatatggcaaagaaaaggttaaatctacgttatctcaataatatataatcttggcttcgaaatacgcttaaaccaagtgattgggatagatcggacagcatgccgagatagaataaaccacttatgtctaaaggtattttaaagcaaagactatatatattcatagcatggccgattggcaaatccaacgtgtatcggctagtgctccgatactactttatactaagatatcaatatagattaaatatactaaacaagaatcaattcaatgttagggtagcctaacagactgatatcggcttgatatattttatccaagtgaggtcttgatataaagggcagattcagtatattaagtaaacaaataagaaacaagataactaaaccaggtaagaccgactgaaactccgatactatcccaattaacagtcatgaagcaggctagatattgtggttctagatatcacttaatagatcaaactcaactgatgtagcattaagcataaagaaaaacataaggtctagacgagccaatgagagccttttcgggatggtggatatactatataatctaattcgacgatagcattggaccctatcggctgttttcgatgatagaggctaaccggtgagatcacatagtaaggtcgatctatattatatagcatatatgataactcgacgacttgcgtggacatgattagagtgtcataaagatgtaagcactaatcccgataacacaagccgccataacaagctttacatcttgtcggagatcgaaactgatgcagcccaactcgaaagcaagaactcgtcgaaaataatgaaaagtaaaagggtggcaatgcaccaagaatgtattgaaatgatgttgttttgtacaaggtattgggtcatatttatatccataatacataatatgtccttgccggacacaactccacttcttattacaactcaaaaagacgaactagtcccttaagcggactcttaccgaaaatatgtataaggaaactaccaaaatatcctagtaatagatacaattgtcatttttggactcaatccatacttagcaatacttgtatagcacttcaaccaatcccggca

SEQ ID NO: 63076 - DNA, 32637 bp, Oryza sativa
  unsure (1)..(32637): unsure at all n locations
tttgactccaaatccaatctatgatttaccacatttggtcgttaacacgtggtcctaatgttgtcgcttggttgccaccgaggttgggcgcgcccagagaggcaatcctcaccggagttcggagggggaggccgggaggcgggagggccggatgctgggcagcgggtgcacgacggcgcggcgcggagcgacaacttggcggcgccggcgcccagagcgaaggcagcggttgcacggtggctggcggggcgcgcgcgggtcttgtgggaggccggacacggcgtggcggctcgaccgcgcgtcgcgcgagtcgggaaggcgccaaggcgagcaggccctggcgcggccgctcggggcttcttccggcgtcggtggcttggtgctggctgcgtggtgcgtgcgggcgtgcaccgtgcgtcgtgactgcgtgagagtgggaggccgggagacgggagtaacaagagttagggttttttttgttgcctattgggccaggctttttctgatgggccaataaaactgaatatctactcttctctgggccaaattctagggtagtcctaggcctatatggactactctctgggcccgctaatgaaccgacgccacggcggagtgccataggcgcgttccacatgagtgtaccactgctgcgcttctcggaggagatgaaacgctacggtccaaaccttctcttcctctatggttcgatgctcgcggaaaaattgttcacagcggctgatccacgttgccggatcgccatgccgtcgtattagggaaaatcccacttgtagtagcggggaacccgagcgtcaccgtgtgtttccgcgtgcggtgtaggcgacggtagtggtctcatgatccccttggaggactcaaggcttttgattgccgtcgagtgttcttggagcgtgatgttgatctttttaagctcatcaaggatggctgccatctgcacattgctctgactcgcagattgctcaggaggagtcgacatcatcacaggcgtatgacgttgctctgataccaagttgtcacaacccggcacatattgcaagcggtagttggggaacaccggcggacgctgtccgggaccgcgagaccggcgaggcgtggtggcggaagaaagaaataatgcgcagaggagagacgcggcgagagaggagaacagagattggaaataggaggagatttaactgatttccttcttaacttaataatccggactacaactccttaaatagcaaatactaatcctaacaaccggctaatgactttagctaatgacaagcacaagataaatgacagaagataaatctatctccagctaatccgaagacacgcgcacgttactttcgcccgccgcgccatccttcttccttcgtctccggaactgaatttcccacatgacattcattttgagggttcctaatttcgtacttgtcgaaattaatttttagcccagtcaaataaatggagaacactgaagagagatttcgtggaaatcagtggcatatatcccaaatggttcccatgtctagtagaatgacggatgacacgcatgtgtctcactatactctctccgtactcataaagaaagttgtttagaacaatatttaagtcaaaccttggaaatataaatcataaataactgtctagttgttgaatttgaaaatgtaaaaattatatgaatagatttgtcttgaaaaatactttcataaaagtatacatatatcactttttaataaatatttttatagaaacaagaagtcaaagttgtgttttagagaccgtgtcgctgttctaaacgacttcctttatgaaaatggagggagcatatgtgctagaatgtccattctagtgttcccgaagcatttgattgttggctgccaattcaaagttgttatgtctccacgtctaatatctctgttttagatgagaaaccggccgatgtgtgatccggcgagtttacagagcaggcttgcagtgattataaccagacggttcctatttgcctctttgtgctatttgggcacaagaggctgggtgtggtttatactttataggtgaatgtatgattcagagttagaactgggtataactaagcttttctagtgtccgatttgtaggtgaatgtatgattcagagttagaattaggaacagtaagctctagtatgatcttcatgtgtccaaattataggagaatgtatgaatcagaattggaacacggaataactaagctttgtgcttgtttttggcccttctgtacatgtacgacaaggtaacctcctatagctagcaaattaatgatatataaagcattaacattgctaatggctacgattctgaaactagaaatgaacttgactttttaagaggtaggagtatgttggtgcactagaagatatgcatgtgtgtatgcaatgaatgcgtacaatacattagcattattattgtgtgctacagctgtaaaatttcggaggatgtcagtaatgttacctgttcaaatttcggaggttgtcagtaatgttacattttcttttctcaaaaaaaaaagttggacaaatttttggatacttatgacacgcttttcaaactgctaaacggaacgttttgtgtgaaaactttctatatgaaagttgttctaaaatatcagattaatccattttttaagtttataataattaaaacccaattaatcacacgttattatcaccttgttttccgtgaaacacttaatctttatctccatctttattttcaagaaattcaaacaccacttagtttgcaccaaatgacataactgggtccatgatcattacaatatcttgttcggttgttctttgtgcagtatgtgagcatgttatgttgggatatacagaaattaaacgagctaggatggccacgtggctccacactagcagctctcccattaaattttactggcgctaacacacacacacacatatatttaactagaaaataccctgcgcgttgctgcgggatatgagtgcaaaaagtagtaccgaactatgtaatttcgaaaagggtgataatatgaacaaacacattctgaaaatatgaacaaacacattctgaaaatatgggaaatctcttatatgtttttgtaatcgaggagtactgatattatagaattgtagtacagataatgctatagctgcaagatgaagaacagaatgggaccctaataaaatatagcaagtcttatgcatatgacataatgaagtcttcatatggaaggaaaatataataagtcttccgcacagtaaaatcaccgtaggtcagacagcatatgttcacctgtattttgtgttggagaatatattagtagtacaacagggatgtgcttgtaagataatggagtaaatctttaggaatgtgaagaataagtaccatttttattatgtagattggtcaggcagattggtatgcaatgcagtttgtagctctatgctgtttggagtggttcataagatattgcagttagtgttaaaggcaaaagtattacaagtcatgagtggatttatctatcacaaaaatcaatataaaaataatgaaatgtgtggtgttataaaataatgtatacactttggttccctcaatggagtcttcaggaaaatcagcctttccctctgtatgttgtagttttttgctgcatgaaatagtttcaaaaatattgtagtcagtattatagttgagttatgttattctatgttttttccaaagtagtacatgcccttctttgtaatgtttgagaacagggagatttttggtagtgtaaaaggaaaaatgttccaaggttggttgtgagttgatatttgttaatcagaaaaggcaatataaatggggttataaaatataccttctggtttcctcaatggagtctttagtgaaatcaatggctctctttgtagttgagctgcagtaatggataataatcatatgaatgattttattaagcataatttttttgtatatttacctggttttttcagttggagttttatcagccaaagatatttcaggtgtacttttgcttgatgctcctgtattatgaatagttgtgctgaaatttatttggcatcagcagttagtactatatatccaatgtgatgtagaggctgggttttaatgaaaatcctttatctaaaaaaaattatggtgttgtacaaatgcaatgaatagaacatttgatagaacaacaaaccttgggttatctgtaagtggtgcaggtggtggaagctgtagtacctctttgttcttcaaaggcttgattagttttatattttaatttaattagtttgaaatatttgaagtaatatggaacaggatatctgaagtaatatggaacagtagtatttactaagctctccatctgtgagcatagggaccgacatagtaggctcaattgtgaaactcttcttaagcacatagctgatagggaacttagaagatgtatcagtattcatccctatagcaaaaatttttgttttaccaatggcattattgagtgctgttggatgatcggctgggtctatcttcatgttttgggaagcttgggctgcatcaagctctaccaaatctttagcaacaaaagaaaatgctactgcatctaaactccctgattcatctgtaatcgtgacagggagtttgtacctgaagcattgtacattagttagatacatctagagtggttcttcgaatgaatgtataagagtaggagattgtacattggtttgcggaatgaaacttcgcaagcacatcttggtgaatcagaattgttgctgtaccctttatcacaacgatggcatcctatgtaataccatttaattgatgacagtatggcagttatttttgcagtagtactgtatgtagctccacccttatgtaataaaaagtattaaatcttggagaaaggaatccatggcatggtaataacaatataattttttttcttttgtattgagttgtacctgaaaggctgaaataggcatagctgatatctcacttaaggtgtacatttttcctgctgcttggatcggggttaaacgtataaccttagggagttgttgctcaagagttggacgttcccattggtagcttcaaattgcaaagagataggttggcatcttttgacgtgaaatataatacatattgaacaggaatattcaagtgcaaatggtttgaaggggttaaagagaattacctagtgcgaaactctctaacttgaggtgtgtccaggtcaatatatatttcagtagcagagcttgaagatgcttctgttatagctgcaggtgaaagtgaagttgaaatgttctgcattctttgtatgggagggcatttgtttgggtcaaagaatgaacctgaaaattttcctgcagtaaggccagcaaagatggctactacaatttcatcctttgatttatggagtgttgcatcttcgttgaatgattctccatattgtccccagagtaggacatcttgagtctgttccctgcaaaaatgttgcatataaacaattgctgagattacacaaaagtaaataatgagagcattgattttaacgatcaggtttggaaaaggtacgtactctaggttttgaattttaattctcctaagttttttgtctgatgttgggctcacaaaatcatatggaccaatataactgattactccaatcaaatctggaggaatattcattcaaaaaaaaatctggaggaataagccaaaagaatgtgaagtgtaataagtatgattcaatgtggaattaaagatagcattacctatgagaggtttggaactgatatttttccctagaacttcatcaaatgggcagaagtcaaaaaagaactttggtatggttaatcctctagattccaggggttgaattcgtgtgtcatgtttaaactggagaatgtagttctggcactggtagatattggtctttctttttgcatcaatggcaacagtattactaattaggtagacagatcctttatttagcaaggggcggaattgctttgcaaacctttttggcacagtgatctatgctattgagccctgaaaaattattgtgcaacaattgatatggctagtattaagtatagcaaagaagtagaatctagtattaatatttggtggaacacataagagaatgacatacatgttcatccaataggatgccgtcaatgctgatgaggggatctgcagattttgatctcatgtttatagcatcccataatcttattagacgtccaaaaactttgcagttttgctggccaacagatatatctttcaatgatgtagctgggttagccattgaggtaaatctgaaaaaacataataaagaaaaaatgaaacttaagtgaatatatgtactgagcaaaatatggaaattgaagtacagtaaaacattatatttacaaaactaataacgaaaccaacctatgcatcacaatataccttatcagttcctgtttctatttattaggttgaatacctcggaatatactacattgtgtgtgcaattttcataagaagcagggctgttctctattagaactttcaaaccattaggtgaagtcactctcgagaatgcaacatataattgaccatgggagaacacaggtgaaggtagatagactccaactctgctcaaggtctgtccttggctcttatttattgtcatagcatatgaaagacgtattggaaattgtcgacgccgcaatttgaagggccacttggattgagttgatgttgtaacaatgcgaggaatatatgcttttgtacctttcgcttttcatgtgattatttctccctctatcacacggtttgttagttgtgtgacaatgagcctagtcccattgcagagtcctcttgatggatctagattacgcaaaagcattataggaacaccaattttcaagtgcagcacatgttctggaagtccatttatagaaattgtgtttagaaactctgttggatatagtgcctctatagcagtacagttagtagaactgtcatcaattgtatctgagctataatatgacatctcacttgcttctaactgagcaatcattctattgtttatttctgaaaccacctcatttgtaggtgctaaaattgcacgctcacacagatatgatataagatttgatggttgacatcctaagttgtagacaaaagaaatcaatccatctagattcctacagtttggtgatagaagaagggactgaggcatctctatgaacatgttcgttagttgctctgggacatcaacaaaaggttctgtgccatttcctattttcaaaagccaattagaaaaatttcttaactcttctctatcttgtgcggaaatagatgcagaggtaagcctcatattttcagttaactcaagaagtatgcactgattccacaaataagagttaacaatgcatgatctcaaaatctgttgctttgtagcattttggatgactggcagtgtctgcctgaaatctccaccaagaactactgttataccaccaaattgtttgtctaatgaatttgggtttgtttcagacaatatatctcgtagagttcgatccaatgactcaaagcaatatttatgattaacaggagcttcatcccacacaatgagagatgtttttttggatcagtttagctaaatttgtatttttctttatactgcacattgaatttttagagatttccaatggaattttgaaacgggaatgaggtgttctcccacctggaagcagcaaggatgcaatacccgatgatgcaacagctaatgctatctttccctggcttcttatagaattaagcaaagttgtccataagaatgtttttccggttcctccatatccataaacaaagaaagtccgtccttcattattgatggcagaattataaatagcattaaaaacttccttctggctgttattcaaacctgaaatagcttcatctatagtggatggcatgttataaacatcgtagctgagctcatctagtacaagtctattctgtgctgaaacacttccaatatcatctggtagtggcaaactaaaatgggataagtcatagtcagcatctcttagcagtttatctaactcaatgagaagaacagatctaacataaggattggtggagctgctggcctgagaagtgttgcggggcattcgatatgatatatcttcgctcatatatgattcatgttcactgaaaagtcttgtaggatttgttacctcacaaaagagtaacattgtaacaaaaagttgtcgcagttgggatggtaaggcccattgagctgcatctttcaaagcatttgaccactcttggtcatcaccaaggagacctaatgcttcacatgctgcccgaaatgtaggatattcatgacctgatatagttctgatttcagcaaaggatctagggcccttaacgatgtgcagtagcattcgcagatagtaagcttctccttgtgaagggtttacataagcaatgtggccaattctacattgagaaccacgacgaccatcccaatatttgccttgattgtgccatgtccaatgttcagggtattctatatatgtaagttgcctagcagaagggttctccctattagcttctaaccatgcagttagtttggtcgtagagctgtttggatcttcaatgacctcttcaagatcatcatcttctgtgaaaataacattattctcaaatgggagttggacaggtaggcgttctacggagggatctgtgtggtggatgtcaaattgttgcaatcgccaagcagcatcatttggactgacacaacgacattctagataattatctatttcattgatagtttcacttgatgattgtgatcctgaattagagtgaattccaacccttgaacaatcaaatccctttgttacatacttaaaaagatatttgtgcatgccatcataattaactttctctagatttatatgtgcctaaaacttcacaaccaaatcaacattatgaggaacaacaaatctgttatcaacgtcaactccattttttgtaacagttcttccattgtttggacgtgcatactgtgtaaaaccattttttaatatagttgtttcttcacagaattccttagggtagaattttgtgcattttccttcagacatgcagattgaagaagtgttgtgaggaccgcaaggtccatgcaccataaaagaagatacagcctcaaatcctatttggtcaattgcaggatctggtaattgagctgaaatataatgatcaatcttctgggaatctaagggttctgttttggccaaccatatgattatgtgaacatgaggtaaaccacgtttctgaaattcgattgtatagataactgcatgaaaaatgatatgttttaagggttgcatggtggtaacatgcatgtttaaacctacaaaaggaagagaaaggaaaatttatcttttggaaaccaatgtaaaatttgatacctgcatttatagggccaaaaaatttgtgcttctttatatcatccattaaaatattgagcttcattttgaaaacactattgacaatatctggacgatcggaaggttgttggccaggaattgatgctaaagcttctctaatttcaggccaagcagaattcgatgtgaatgtcaaaaaaagatcagggcaaccatattttctacaaatagcaatagaatcttgataattttgatacaaataccgaggtcctccggtaaatgaagatggcaatattatcctttgcccaacagaagatccagatgtaatacctcttgagacagaattaatcaatgagttgaatggtgatgatctatatttactttggaaggctggtgtgagataatgtgctatccggctcccctcgacacaacaataaaaatctacttcataagattgtgttagccttttacaccgtaacggtgtattgaagtctcctggcctatcatgcaacctatatgcatagcactctagcattgtaactttattccgttgcatggattgagtgcgtgctgttgtacgatatgtgatgttttcatgataaccatcctctccatatgggaacaaaagtggatattgcatagccataaacttgcggtgattttcattgattagctacaaacgtgatgcacgatcttggattataatatctcgccctacatcagctgatccaacatcaccaacaatcaggccaacaacttcagaagcgactggagcactataaatatctccatgtgcatccggcttaccaaataaccttatgcaaaactgatcagatgcgtctagggatattctttcatgtgctgttctgaatagttgaacaatgggattatttgtattcaacatttctatcaaggatgcaacaatttgttcattagcatggaaagtgacacgggaagatgaagcaatattgatccggtttgagatctcatgttctatatcaaaaatatataattgcacatattctggacgttgaccttgtggtgggagcagagaaccaattcgatgacagacttgaccactaattttgaaaacatatggtgttcttccatcatttatggactcattaattttagctcccattgaagtaattgcaaacatgctattgtattgccgaatatgatcaaagaagtggttagaaagagtgctgttttgtgaggtcaataaatccaacaatggctgtggaggaggttggtagggtgacagccatattctccctcctttgcaacacaaattatatgatggatttgaagtatgtctctctctacgtgttcgctcctcataccaaaaaaaagcaccacagtggctacaagaatgatgtggaccaccaagattcaatggttcaaatatagtgcctgaaaggtgtgtcattggtatatgtgaaggaatctttatagcaaatggataccttaaagtggttagatcctaggagtagaaaagacaacttatgcctgtgattgaatgattgattggatgtagatgaaccaatatgaatatggggttcattttgtgctatatgattagaattagaagattcaccaattaaccgtgggcgtaatattcgttgatctgcagaggttgatgctagggaaaaatgatgaaattgataatgtgagtcatttttttcgtctgcataaaatgctgacaacttgtaggaatgttaatcttctaacaaacctttgttcctatttgcatcgataacttgcctacgcctacgtcgagattcagcagcaacagtttgattaggacgtgggatcgggatattagaaggctgctggcgtggtcgaccacgacgacgtataattagtcgagaagaacctgccgtattatccattctacccgagagcataaaccaaggaatcctataagtcgaaagaaataggtgtactataactgaataaaatcaaactgaacttatcttgtaaacaattgttgaacttacaaaaagataataggtcaaattgagcattcatcatcaagagtagaaacaaaagccgggggaaagcataagggagaagaggcacatactagatttatctttcctgaatgaaaatccacaggagccacataacaattcaaaaggaaggccgtcggtaccacataaacaaatacccttctgtagacatgagagattcaaactgatgaaaaaacctatcagaagatcattgtactccgaataaatccaataatatgtacctatgcaatggagattcagatgaaacgaagcagttggtgcaggtggattgcagaatttcattggcaatataagcgaagggccgcaatgatatcgccatggcgttatgagcaaacaaaattaatgtcttgatgacggtgatgaagtctggttttagtgggcggcggtcgttaagcttctctcggatatggaatcggaacggcgcgggaaaaggagaagcaaccgtcgttggggcggtgtgggtcgcaaaaccaaaggctgggtggcgctgnaggggcaaaggggggaggcgaagagtggcgcaagaggaggaggcgaagcggatcancgtggatgcggtgcggcgtggatgcggtgggggggttgggggggcggcggcgcgagatgcgggagaggggaggagcgatgcaggagaggggagtcgatgcgcgtgggccggtggagcagcgcgatgcgggagaggagaggaggggagcgatgcgcgagaggaggtggggctggcgagtagcgatgcgggagaggagaggagaggagcgatgcgggagaggaggtggggccggcgtgtagcgatgcgggagaggagaggagaggagcgatgcagaaggaaggaagcgctcgatgcttatccaacggtggggataaaaagggtgacgtggaagcaccaggaagcagagaattgtagtagtggggatgatttgtataggtatataggattatctttgttcaaacaaacatgttgatggaattaaattttaaaatacactgttcatttttatttttctcagaaatattgcaactctattggctgaaattagggatattaggcatatatatagaataacagagtctagctggtcgatcgtgacataatcctttatgctatcggttgagacattagttctactgtccttcaatctcgtaccatgtatgtaagtaaagccctcgtttgatcctatctttgctccatgatttaataatatagtgctacagtaaacatttgctaatgacagattaattaaccttaataaattcatcttgcggtttactgattgattctgtaattagtttttttattggtgcctgaatactctatgcgacaccctatataatacccgatgtgacacgccaaaactttacacccctagatctaaacaccacctaacttctacttattagcaaaataaattgttttctgtaccaaaagattgtactgataaatatggggtacatatatacctctgagcagagcaacttctcagagactgtaaagctactcacataaaccactggtcaactaatccatcacacatcatcatacaaatacaatatatagtacataccatctaatctagcctacagaacagttcataaaattctcttcactacaatatcattccatatcctttcagagtaaaaatattcgctgaaactaataataatcaacgtgccatataattgtctgaacaggcgaatgagctacagttgaacacgtatctattagcgaacaaagatgaacagtgaaaaccagtgaatcctccaagtcttattgatctcaaaatgtccccttttatagtggggatttacatatgcacaagcctaggatactcctaggaattaaggagcctaggatactcctaggaattaagggtgatttaagccactaaatatggatgattatgtgtcacaaattcaccatagtatggcggttacaagtcacttgattcctgccattgttgctctttgatgagcctttgatgagataaaaaatgtctcatgatgcttttgtaacactcccccttttgatcgagtccatcttgagatcaacttgttctttaattccttcgaaaaaccctgtggggaaaaaaaataggaataatgtgattggtgattactctatcagaaacctgaaaggtttaaggagtaatccatgccatgttttatctctagaaaaacccctgtgaggaaaacatgagataaggcataagcttgtatctaacattgtctcattaaaaactttgtatgagaaaaaccggatggtaaaaactcacaaaaggaaaaagagtacaatgtgatgtgtttcaacaaagtacatcattcagagagtctccccctgaagcttgcaagtctctgagtagtctcataccaattccccttaacacacctctcgaacgaagaagtaggtagggatttagtgaagagatccggcagatatcgcaagactttggctgtaagatgtttatttctccactttgctgaagctcatgcggataaaacaacttaggagcaatatgtttggtgatattgctcttgatgtagcctgtttgcatctgtgtaatataagcagcattgtcttcatagataatagtaggtgattctgatgaaccgatgccacaagattgctcaatgtggtttatcatcctgcggagccacacgcattcacgtgatgcttcaaacagtgcgatgatttctgaatgatttgtggaggtagccactaatgtttgtttagatgacttccacgatatggccgttcctccatggaggaatacaaagcctgtttgtgatctggcgttgtggggatcagacatatagctagcatcagtgtacccaaccaaactaggatcagcagttttctgaaagaataagccaagatccttagtgccatttaggtacctgaggatttgttttccgccggtccaatgacgcttagttggagcagcactatgtcttgctaatagattgactgcaaacgcaatgtctggtctagtactatttgcaagatacataagtgctccaatgagactgagatagggatattctggtcccaatatcccctctccttcctcccgtggccggaaaatgtctttttctttatcgagtgatcgaacaaccatgggggttttgtttggatgtgctttgtccatattgaatttctccaataatttctggacataggcagattggtgcactaaaatgattgagtgaaggtgctcgatttgcaaacctaagcaaaatctggttttacccaaatccttcatctcaaattccgccttaaggtggtggcgggcttcatcaatatcttgtgtgttgccaatgatattcaaatcatctacatacactgatatgatgcaaaatcctgtggaggatcttttgatgaatatgcaggggcaatcatctttgttggagtaacctttctgcagaaggtactcactcagtcagttataccacattctgcctgactgtttgagaccatagagtgatcttttgagctttacacaatacatcttgcgatttgcgcttccattcggtatagagatcccatcggggaccttcatatatatgtccgaatctagtgacccatataagtatgttgtcacgacatccatcaattgcatagatagacgattttgaattgccagtgaaatcaaatatcggaacgaaattccactagtgactggagaatatgtttcattgaaatcaatgatgggtctctgcgtgaacccttgtgctacaagcctcgccttatatctcaccacctcattgttctcattccgtttccggatgaaaacccatttgaaacccacggggaaggttttggaggtgtaggtattacttgtgagaatacctctcttttattgagggaggctaactctgcttcaattgcttccttctatttgttcagtccgagtgtttctaccttggattttggatctggatcattttggatggtatctgcaactgatgatgcaaagtatatgccgacaattgtagtcctacggttgaatgattctccagattcaacatagtttacggaaatttcatgcaccccagttgacggctcagtatttcccaatatgaccgcattggggcgttccaatgtcccatcatcaaaaattgagtgcactgttgatgtgggaagtgaatctgatgaatccacttggtgtctctcaacttgaggttgagtttcatttactgtatcagaggattctatcctttgtttcctcgtgcgcattcgaggatttgccgtacttctcccactcttttgaggaagggagttgaatagttttatttggtacctctattcttttcggcacattccttgcgggaatgtatgattttgtgactcttttactcacagtaaattagtctcacagtaaatgagtctggcaaattgtttgcagctacctgcaaatcaatgatctgtggtacgaagatcctcctttagggtgtttaaggcatccatatttatttccgggcattcagtgtgatacttgaattctccccctaatgcctggaaaaatgatcttcattgaagataaaatcagcgtatcgggccgtgagtaaatccccagtaaggggctctaggtatttaataatcgacggggataaatatcccacgtagatccccattttcctgtgaggacccattgatgtacgtttgggtggtgagatcggtacgtatacaatgcaaccgaattttcgcagatgggaaatattaggaggatcaccacgaaccaattgcaacggggaagttgtatggtatacagttaggcgcaattgtattaagtgaccagcgtgtaagactgcgtgaccccaacatgaggttggataggttacaattttgcaataatggtctggtaatgagttttattctcttgataagagattcgactaaaccattctgtgtgtgaacatacggtatagaatgttggactttaattcctaaagccatacaataatcattgaaagctttggaagaaaattctgccgcattgtccaatctgattgatttttatctggtgttcaggttgatctgctctaagtctgatgactagtgcaattaattttgcaaaggcatggttccgtgccgataagagacacatgggactatcttgtggatgcgtctattagaaccatgaaatacctaaatggcccagacaatgattgaatggggccacaaaagtcttcttgaatgcattcaagaaactttaatggctcagcctttactttgagatatgagggtctcaaaattaatttcccagttgcacatgaggtgcacacaaaatccgaggattctgggaattttctatcactcataccatgtccatcattccaatgccgggatgattcccataataatctatataatgtgaaatttaaattcataagaataaaagcaaaatatagaagaacacacatgaatatgtgtgattgttatatgtataaataggggtagcaacatcatgtctattattataatggttactcatgcaaaattaaacatagaagttatatggcgcctaattaagctctctataaatgtcgttggaagaatattccacgagcatgtcgtcgatgtccaaagagccttcctcttcatttgctggagtcttggttttgctcggttcccctccttcaggaatggggtccatagctccagtctccagcacatgagaggcaaagtgtgcttcatgcttttggttggtctgtgtatgacccacagacttcatgtatagatcaacaagatgtttaggggtcctgcatttcttagcaatatgattatagcaactacacctgtagcaggcggttttgttgccactatcattatttggcttcgaattgccttttcccttttgagcgttcccacgttgctttttgccctttcctgaggaatttccagtctgtgtattcccattgggaacttgtttcttctcattcgcatttacttcaggcaatggtgcagtgcccaacgggcgctggttcgagttccatacagtgagctcatggttcttttctgcctgtttcaatgtctgaataagtgaagagtagacagtgaaattcttctcacggtattgttgagtgatgatccgttttgatgggagcattgtagacagagtcttctcaattttctccgcttcagaaggttcattcttacaaaaccggagtttagagcatatcttatgaacagcatggttgtattcgtctatagttttaaaatcctgtagacgcaagtgattccactcgtgcgatgcctcagggaagataatcgccatatgctgttcataacgatttttcagagatgtccgtaaaactcgtgggtcctcctctaacatgtattccattttcaaatctgggtggatatgattccttattattcttaaggcagagaattttgacatgttagagggggggacggttccatctgctgtatcgtctatacatctgtatagtccattggttgacagactcactttgagatccatcgcccaaatagggaaattggaaccatcgagagcgagtatatcgaactctttggttgccatcttacctacattgtgatagccaaaattttgagaaattatggcatggttggaaaaataaaaataaaatagggcgagaataaatttgcaaagtaattgtataataaaagacatggaaatgcttaaacacacccatatattaacaatatcagagaagtacaaagtgctgatggcaaatgtaaaactctaattatttgctaaaatttaaatgaccaaaaggtcaagtactataatgtaaatgcagaaaatataaatattattgggtgatgggccgaaaataatgagtattttggccctccaccactgtaggtccatggaggcgaggagggatggcgcaggggttggcggcccatcagtggatggcaaatgggccggcctggccgccgcctcaagccaccgccgtcgccgcccgcaacggaggccgcccctgccgccgctaatgtggggcacagccaccgccgtcgggggccggcgcggctgggcgcagtcgccgccgcggaggccgtctccgtcgagcaccggcgtggctagagcacggccgtcgccgccgacggctcgccgccgccattgacgctgtgcagctgtggctgccatctccgccgaggactccccccgacgccgtggacgttggtcccgccgccgcgggatgcagcaaacgccggtgacgcccgcaccggcgccaccctgcaccctccgccctcccggaccctttactcccctttgctcaggccttccccttcacccaagggtgggggatggctaggcttgccgccaccgcttgtcttggccggggcatgcccggcttgatgatgcgacgggggttggggagcgatggggccagtggcgaggcggagctctcgccgaagccccctgctgccatgtagaacggtggggctctgtggcatgcagcaagggttcctctgaggaggaactccggcgggttggccggtgtcagtgtgtgcagcagtgtctccggtgtctccggcatgcagtccggtgatgatggtggagagatgacgcggcggagatgatgggtccagccatgatgagggcagaaggccgtcaccacgtccggcatgtccagctgcggtcgcacccatgcggtccacccatgggacgcacagtggtgcggtgcctctaccagaattctttctggcgctgagcacatgtccggcgttgctggagaccctcgacgagtggcgagggtactggagtcggtgctgccggctccggagttcctttgggcagcctcttcctccatgtccggcaaagccaggaggaggagacggggggccacggccggcattgccagcacgacggcccctgccgcgtcgtgtacgacgcacgggagcccgaaggatcgtctcgagctgttgcaagagacgacgaaggtggcgtgcacggaggttgcggggaagggaggagtcggcagtgaggggaacaggacgagccattcttaccacgcacgtgccggtgagtcttttcactcttctctcttggtagagctgctaataacgtattagagaacaaagatgaacagtgaaaaacagtgaatcctccaagtcttattgatctcaaaatgtccccttttatagtgtggatttacatatgcacaagcctaggatactcctaggaattaaggagcctaggatactcctaggaattaagggtgatttaagccactaaatatgactgattatgtgtcaaaaattcaccatagtatggcggttacaagtcacttgattcctaccattgttgctctttgatgagcctttgatgagatcaaaaatgtctcatgatgcttttgtaacagaatcatcagttatctcgcagtttgacgtttgtactccaattaactgatcgatcaaaacttgtgattggtttcaaacataatggctgctccatttcggcagaccgccaggcccatatgactgagggttgtgcctaccttggttatagtgagcctgtcgtcagtgacgaaccgggaatgacaggacaagtactgaaggtcaacactcctgtatgagccacacacagcatatttcacagaaatagagatggcacacggctataataaccatggtcctgatgtctccaaagcctcacacatatgatctccacaatattatccatgtatatatatatatgaaactatacaaacatcgacacttagcaagttatggtgcctaaacggtttgatgaagatgcgatccgagagcagtgaaacgaaatcataagtaaaggttcaccaacaataagttgaggaacatagtgtttttcaggacactaggttggacaacggtgagctatatatatacaccgtaggatcctttcctacagtttttgttaaaaaaaaatcagctctcagtcgcattaattcagctctcatcaattcagctcagcagggactgaaatttttgtgggaagaaacggaaccactgacgatatattagggccttgtttagtttcctaactttttcttcaaacttctaacttttccatcacatcgaaacttttctactcacaccaacttccaactttgttcctcaaacttccaatttcaattaaactttcaatttggtgcggaactaaatacggcctaggtcgcatgcatgcatgtggagaagatctcttctttgtccttaagaaatagtactaccaccttggccaacttgacaatgtaagaagcccgaggccaacacctacttctaaataacttgacaaagaactagtacaagccgctggagataattaacaggctcaaactcaaccatgttggacagaagatagctataatcagctaagcgttcatggcggcataagatgagcaaacgagaataagcatctacattgtcttgattctaatggattcttctttcttatttgcatatagagactgaacaatgaacaattgtatttcacatactcattttttcaatcaatggaaaaacgtaaaaccagcccatataaaattcactgtcttcgaagagatcacatgggagggtgcttttcctttcttttaatggaaaagagagttttattaaatgaataaatatttacatattaacttaggattttttctgtcgaacactagacgaggaattccccccatcgaactgtgttacagaatcaagcacagctagcaagaccgttaccaactccactgcactctctgctagccaattcagtttttacttttcacttaatttcaatagccacattgtcgccttaatttcaaccaatagataagtttcataaatactgcttgtcctgtgccttctttaatctttggtaccaacaagctacagtgaatgagattgttggaatttgaagctatttcaggagtaattgcaaaaactatgaattttgtttcttctaaatcgatcaaaacatctcgtaaaattcaccaagacgataaaaggtacctgacatgattatcacgaaccaaaacaactatgcttccattcaccatgacgatgtcatacaggcataaccataaccatgatcccgatgtctccaaagcctaacacatattatctctagcatagtatgatgaatgtggaaaacctatatatcataactgaagaattaatatgaattctttacaattgtttcactaaaatcaaattgtgttttgattattattttgtgatgaacaataggcatatgaaataattgattttgatatttggtggataattgacgaagtgggattggtttggtccagtcatactgcacagtggtggtcgatcagattggcgtatgttgtgcggtcagattggccagtctgacagtatgaccggctgattctgtctcggtgttggttttaggttgtttctttggatactcgtaattatctcgtgattatgatttctagatgatttctatgcgtatataatactgttatgtgacaatgttgagtaaagttgggaaagaacttgtgctgggatatggtttcttgttgattaatgtgtaagtgtgtcttgatgatgcagtagcactgccggtgatggatcgggaatcaacttgggagaaaataatgtccgaacgattagaatatcatacgggatgcttaggctaaagaacaatgcacgtggttgatagagattccatgtgacatacgatgggagattgcgtgcatatagaaagtgcagtcaaatttggaagtagtccaagtttgggaatattagagtttaaattgaaaagatataagtttgtttcttgtacgggaaggtttcctagtgaactaggacttcttataaagattggattcatggctttaggcagcttacctcacatataaatagagaggaggttaagacctctcggtattgttttttctaagagttgagtttagagtaaagttaaggtttcgagtttagtcgaattttgtgataggagtgttattgttgcactttgtaaatatgaatagaagcagtaaagtttaatctattttcaagagattttcagtttgtatttgctcgagtttggcggtcagaccggcgaatcatcggcggtcagaccgatggcatagcttcggtcagaccagcgacttccaggcagttggaccggtagcgactacaggcgacgacaactaggcagacggtcagaccgaagtgactacaccggtcaaattagaggcgtctatgcggtcagaccggtgcaacaactccagtcagagagatctgcatcggtttcgagggtagcttttagttcagttacatgttttcggtttttggtgtttctaccatttaccctagtaggcttagttcttgttgttttgaaccgtgacagcaacaatcttttctgggaggctgaataaagtacaacaaacacagaacatggacgacgaggtgaaattcaactatcctgaaggtatctgcaagcacagcgtgaccgcggcgatggctggggaggccacagacggtgtcccatggagggcacatcgtgtagctgccaccatcgtcaacaaagaactcgattgatgtgaaccgatccactcctggtgcaatgagttttgtgtcctatcgaagctccaggtctcttaacaatacataggatgcggcttccacactggtgcagttgatttattcggaagcatggcgatcctgttgcctcccaaccccagtatggtgcatgcagccagtcagatcctacaaatgaatcatatcactgtcagtttatatttgaaagtcaaaacacgaaatacattttaggggctagttaaaattgtgttacactcagtaatacttgctaactactccgtatgtaagatgattttgtagtttccactaccattgttggccaaactgacatggcatggttattggtgctgcacgtgaggatgtatatgattgaaatgcacaattttcacatgtatcatttttcacggtatctaaagcgtggaatagagatatttgaaccatttcctcaggcctccgttactttaataaatggattctatatcaagctatagctattgcattaaacaataaaagaaactaatagaaatcaaaggaatgggacagcagtaaattgagaggaagattcttctagttttcttgttcttggaaacattcataattcgagagctacaaaaggagatccatcgtttgcaatgaaaactacataaaaagagctctagaaaatttaaaaatcagtctaggtgtctttaacacttgcaaaaaagaatcattattggttgaccattgacttaacatttaactagttgtatatatcactattggtttgatacaaaggatggcaatgtttcaagtacgttaagaatatagatgtaggacaatttatctagaattacttaaaagcctatttcctatatcatatttatatctcatgaaattcttgagccgaaagacggatgcgtatgctatgtttcatttgctaaacgatatcaattgaaattgaatggtgtattaactccataaatcatatatagcaataaatatataagcaaaatcttttattttagttagaagaaaagtttcttccatgattgatacctccttcttccatgcattcaccatcaggtggcatgtcttgcagatgtttctataagagaaaggcttccattattttgagaaatggatacaattcaaatatagatattgcatttgcactaaagaagaatataagttttcttgttcctgaaaatattctatctcctagtcgctttagagaattgaaaattgtcatgccttttgattcttctactagtacttggaagaaagttatggaataaaaaaaaacttagacaatttaaaaatcaagcaagtgtattaatacatatgcgaaaaaaccattgttaacccatgattgtttggaagatttaacttgtataaatcatatcagtttgatacaaataatggcaattgtttcagtatgttaatggtacagatgtatccacgatttattttaagagctacttaatagcctacttctaataccatatctctgtcctgtgaaattcttgagccaaaagatagattgcatatgctatgtttcatttgctaaacgatatcaattaaatagtgcatcaactccataaattagcaaaattcttttattttagctagaagaaaagtttcttctccgatttatacctccttgttcccctgcatccgtaaacaagcatgtcaaatgaggattagtgtacttgagttttgcataggtcttttccaagctccccttctcagcctcaacccataaagatctgaaatataaaaaaaagcccaagtgaatgctgggatttgtagcatggacatgtatgctaatatgatttaaaaagcagaatatatttttttttaacaaaaaacgagaggcaggaggcttggctcatatattagtaggaatagaacgtttaggacattgtaatcccttaaatacgaggaaacaaatcagatctaatgattaatttaaaacggggaacatgaactattgttataattgcaaataagttagatggattgcaaataagtctagtaatccacctgcgtggtctaatcaattgaaggttgacaaaatgcatactggtatacaggacatttgttaagccaactatggacaggtattgagcaattaaaaaaatttcagtttggcaaaaattcaggaagttgtttctttaagttatgaaagttggctttgtaatctgacagattgtggaaatgcgacgttctagaggcattatcatttaccataaaatttttatttgccagaattatactaagaatttggcctatgaaatactccaagaaccaatataaatggttgtggaattttttagatgatataaatggttgtggatgtatagcccgaccttaactaatctgatccattgcattgaaaagagtggacagttcatgcacatgtgtgcatactgtaaaaaaaaaaacataactcttaatagggtacatgagacctttaaagcaatagttaaaaatacaataacaggctgtatgacaaatacaataacaggctggagtaaaaatacaataatagggtacatgagaccttaaaaaaaaacataacttaccaccctagttgtatgacaagtacaataacaggctgaagaaaaatatcgtacaattcaaattagagaggatattataatcttaaaaggtaaaaccaactatgatatttcaaaattataattcccatattaatcacataatatatctgagatttataataaatttatggaacatatgaatagttttttacacataaactggctgtgtagtttaatatctagtgatagcatatgtgtcccttttttaatggaaggcaccagagaatcaatggcatgttttccttttataaattggtcctttccttctttttttttctctttccaaatactaacgtgtaaagtaatggtgtacagagacagaattgaccttcagattgtcaaatagcctttgaccctcaaaggaaatagtcaaataggaaaataataccatcatatcatataagataaatggttccaatgaattgtagttcacctcaaaatgctcagcatagaacagaacaaaaaggcttgtaaaaataaactagtttcttactttgattcaggaaaatagtactcatcatcttttgagtaatctactttccaatcaagaaacttccctggaagtggcttagcagcacttaagggtatcaatgaagatttgacctgcataagaggagcattaggcagtttgttcttgtatagacaagaacttacaacagcattaactgtttaaggggaaaaacccacacctctattgtcaggatatcagactgctgtccgaaaacgaaacaaaaggatgtaatgtcgtcgaaggggatgtcaaccttcctacacagcttgtccttggacatttggaatataactgactttttgtggtagaagaacttaacaaatatgtcgcattcatttgtccgagcgaactaaatgtgttcaaaaccatgaacagaatcatcatgatcagcacataacagcaaacattttatagaaaaccaagagtacattcaggcatatatacctttttgttgccaatgtgaagtgccaggacaggcaatcttgttggctttatctggctgtgccattcaagctgatcttgtgcagttttgagttggcactcagaagtaaagccttgaccccactgcggtataagtctgagtctcatgaagttaagaaaaggttcatttaacttcagttcaagatcttcagctcgcagctcatctttcttatcatgtgcatcctctaatatttctcctctctgcagagttgttaataaaaagtttaaaaggcttaatgcgagtcaataggctgtaatgctcatgggacatgccaaatgaaaatgattttgagggaaacaaaaacctcagttagatgcgtgtggttgctgccaccacctggaccagatatttccattctgagatttggctagggcctaaactttgcaattatagatctacctgcaagaatggtcttgattttagatagaataatgtaaaatttacacaagataatgaagagtagtatgcccatccctatgtagaacaaatatagcatttagttgggaaaacaatctgcatttgttcatatcattgcagaatctttgaaatgtatacaaaaaggcatgattactgagatttatactctgaaaatgacattttagcttataatgtaggaaaactgactccatacgacgctaaacatgttattgcgaagcaattgaatggtttcaggatccaagaactggttttacaatcatgcgcactactagtatgcaggcacctagttcagccagatgagagaatgtggctactattttttttataaaggaagcttttattaatctcagacgattacatcaagttgatagaaccatataccattacatctatttgtgcttagaattagttgcattgtaccatagaattgtaccttatttctcctgttctctggcctacatctgcacacgtaatttgctgtgctgatgtcaagttgtctaatgttcaaagttatgttcaggatgctcacatgccttcatgttggtgttggtacagcaacatggaaattccactggcagcagctcagttcgtaactgtgaattggctgtcgaacgatgactttttctcggatatggttttctagtagcaaatctaattcttctatatataagttgcactgcgggggcatgaattgttcaagtcactacatacattatgatacatatacgccccaaattgaacagattagcacaagtatacgccctaaactatctgaacagaatttcgcccaaaattcaggcgagatcccgtcgaaaaataccaaatgcgtcttaaaacttgtcaaactagagccgaaacggcaaataaccacagattagcaagtgcacgcagtacacgtcctaaattacttcaatctaagaaccaaccataattgcagcgtgcctggtaatgtctgggccagaagaatgtaaaagcgacactgatcaaatagaagtatatagaacccgggggtgaaaaacctaagcacggaaacacggatataattccgcccttgcggtgagtacttccctccagccgatgaaccaatcaaagggaaccacagagaaattcgtcttacctccccgtaggatcggagagtggctcggtccgcggcggcgaagatgaggaggaggagagcagcaggtgcggtgtggcttgccgttcccggccacggtgtggcgagtggcgacggggtggggggagggaacgaagcggctgcggacggcgggcgcagccggtggggatgggaagggccctagggcggcggaggcggtggcggtggcgcggcgtagcggaagaggagaggtgacgcgcgggacgacgggacgagacgagacgagggagacagttcgtttatggtgtcttcttctcagcccactcccgtgcccagtggacggaggaggaaaacgggagcttcacgtgtaccgcggcgcaggcaaagccggactccaccgtgtttcttccccttctttccagctaggcaaattttgctagacaatttgatgatttcgtggttttagccgtagtacaccgctcgaactcacttttagggaataacactacataaacatggtaatttaccaatggacactgcaccgattaccataataattttcggttgaagagtaaagagaaatcgcttgaaatataaaaaaaaaatcgttgggcccacgtgtcagctcttctatctctcttctcttctcttatctctctatcttctctcccagaagataacgcggctgctggcctcctcgatcgagggcgcgcgcggggaggaggcggcaggcgggagtggagggggcagggaggtggaaggcggcggcgggtgtgtcgacgaaggaggccacgacgaggaagcgtcgggcgagcagtggcgaggccaggtggttgtggtggcgaagcggcacggggcagcgtcggtcgtggggaggaggagggagacgaaggacatcgcgtcgcttcgcgaggcgttcgccgcgccggtggatggggaggtggaggacttggatgttgcggcagcgaggtgtgacttctacggggtgttcgacgggcatggctgctcgcacgtggcggacgcgtgcagggagcggatgcacgagctcgtcgcggaggagatgggcgcgggggcggcgccgcgcgagccggcgtcttggacaggcgccatggagcggagttttgccaggatggatgccgaggtgattgccggctgccgagccgagagcggcagctgccggtgcaaggggtggaagtgcgaccacatggggtccaccacggtggtggccatcgtggaggagagccacgtcatcgtcgccaactgcggggactccagcgtcatgctccgccgcgacggcgcgcccgtgccggaggtgacggtgaccgataggtcggacggcaatgagtgcctcatcctcgccagcgacggcctctaggacgtcatcagcaatgaggtctcgtgcgaggtggcaataggagagaagagaagagagataggagagctgacacgtgggccaagagtatttttgacatttcacgtgatttttctctcctcttcaataagaaattattattctaatcggcgcggtgtgcattggcaaattactacgttcatgaagtgtttcccccaaaagtgagtccgggcggtgtcctacagctaaaaccacgaaatcgaagtgtccagtagcaaaatttgccttccaactaacctcttttccgcaatcgaagtgtcctgtagtaaaatttgccttccaactaacctcttttccgcacacgcgcacgtttactgaactattaaaaaattatgttttaaagatttttttaaaaaaaattgcttcaaaaaattatattaagctataaagaacctgtgtttgttattttttctttattgttctcgtttctttctttagagttgtaggctggttttttttttttatagttgccatcatttcggagattccatagtgcagtttgagtttgtcgtggaagcttcagaagccctccttttctctgagcaaggcaagtcatgctctcctttagcatattgaatcctaatttgtgaaaagtattttaattgaaattattgtattcactttattaaatttaccgagttataattgttttacttatcatttcctatatttccttcactcctagaaaaatcattttcgccgatgttagggttttctttcgcaggcgggtactgttggtaattcataacgtcacagatagaatccgcaagcgcacggattaccgaagtagcacttcccctatggagtattccaagggtatcgaatccaagggaacgtgtgtgattatctcttcctccggttcatccaaggacacaaagctaatgttggcaaagggcagagagaatttcctaatgagaaacagtgtctagggaaagcttaagtttaatcctaacgcaatacttcaggcaccggcaacccgctgttcccagatgatgctctactacgtacccgggcagggaggacttaagtgctcttgagggctgtcaccacctctacacccacctcaaacgtactgtgggatacgcagcaaccactggagattaattacccagacaccgcgtctatgcaattaataactactctagtgccgatcaaacactaaagtagtcactataaataaatggactatagtgaacaatgatcccgtatgctaattaggaactaaccaagaagtaattctcactaatcaaaccttaattactcagaatgatatttctattaaagcagagtaataaataagatacaaaagtaggaggagattaccgacaactccgggattcctccgattccttctatcttactctctccctattctaatatacaataaagtacactagagcctcttgtaattcagctcatgctttggtgtgtgtgaatgagggagaggagaagggtatttatagtgtggaggtgacttgagagagtggagatcctccaagcatccaatgagcatcttcatcctcctagtgccatgtgtccagctgatgacggttattcaggtaaagtcggtaactgccggcctgtgaagtttggggccgaacgacgcagctaggggttcggccgaaccacttggttcggccaaaccctttctggcccgttttgctccgaattttctcatgggctttggtggataaccccttagcccaaatgtacatgcaattggcccatttgaatgtgtttcattaggtttgtgggtccaaagctccataggctggaaaatggatgtttaattcacctcctcctccatgtatcttttgtctcaactttggtggttcgtcacctgcatccaaatatgcaccaacactcgtggaaatggttagaaataaaccctaccactacattagatgttttacttttatggttttatgcaggtattgacggcgttattttggcacttaacagccgtcaacaaaaccccccagacttagctctttactcgtcctgagtaaaggttatgtattaatgtggaataaaatttcccaagatataatacaagtacacaaattattctaagccatacttgtacctgtgaacttttcaagtgtctaacttaccaccttgagcaattgatgaatggaacggtcgtgactcaagtcctccttaatcctcctgtcaatctcttgggggtttttatatatttttgcaaagtagctatacttctcaaatgaccttctctcatatcactcatgtgaatttatttgtggatcctcaccaaggcatgtttgccgaattgtccctattctaagaggttgtataggtggggctcggtagggatcaatcggggcatacatgcatcacatatattgcaaagccaaaataccagacccaaggagataccaagtcatactctctgatcaagaatgtgcatgtgtgtgatatgtgcatgggtatgtgtatgtgtatagcaagttttgtggatggaaaaaggaaaataaaagataacaactcctttgatatacctcctcctctaattttttctctttggagatttaagagagtgcatggctatctcttttctttttttttcaatcatggcccatactttgtatgagcaagatttgttttttcatttttttctctttttttttatcaatgctccatacttgtatgagcaatactttttttttccttcttttgcatagccatgcctctctctatctctgtttttttctttgaaagaatttttggaggaaaaggcataaatgacatggagtatttattttgtggataatgaataaaataaataatggatgagggatgctagcttccagtgtagaagtttagcatagtgtgtgtatgtggagtgtgcgtgcgatcttgatcatggaagtatgaaaagcatctcacacgggtcacaataatttgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63077 - DNA, 12098 bp, Oryza sativa
tgttgcttggaagggattggattcatgccaattgttgtattccttcgaccatgcaccaatgcttgattcaatggcaaggcgacaaggttgagattgtaccagccgacaggtcagttaatgttgctagtgccgatctagctctttgggagatggatggccttgattgtttatccaggaagatttgggttggagattttctaaaagtgtccgattctgatatacagccgattgaagatgaagaacccaagctattattttgagggcgtcgtggagggttcaagcgtctacgccaaggacacggtagatgatctcgatgacaagcaaggttagggttttatgtcggccgatgatttagaagaagtggatataggtctgggtgatcgaccaaggccgacattcattagtaagaatttgtcttcagaatttagaaccaagctgatggagcttttgaaagagtttagagattgctttgcttgggagtattatgagatgccaggactcagccgatcgatcgtcgagcatcgattacctttaaagccagggattagaccacaccagcagcctccgagaagatgcaaagccgatatgcttgaacctgtcaaggctgaaatcaaacgtttgtatgatgctggttttattcgtccttaccgatatgctgaatgggtttctggtatagttcctgttatcaagaaaaatggtaaggtgagggtttgcattgatttcagggatttgaataaagctaccccaaaggatgaatatccgatgccagtggccgatcagttggttgatgctgcttcaggacataagatactaagttttatggatgggaacgcaggatataatcaaatctttatggccgaagaagatatccataagacagccttcaggtgtcctggtgcgatcggcttgtttgaatgggttgtaatgactttcggcttaaagagcgctggagctacgtactagagggctatgaattatatatatcatgatctgatcggatggttggttgaggtctacattgatgatgtggttgttaaatctagagaaatagaggaccacatagccgatttgagaaaggttttcgagaggactaggaaatatggtttaaagatgaatccgacaaaatgtgcttttggtgtatcggctggccagttcttgggatttcttgttcatgagagggggattgaaatacctcagaggagtatcaatgcgatcaaaaagattaagcctccggaaaactaagacagagttgcaggagatgatcggcaaaattaattttgttcgaaggtttatttctaatttgtctagaaaactggaaccttttacaccattgttaagattgagagctgatcagcaattcacttggggggcaaaacaacagaaagctttggataatattaaagaatatttaagttctcctccagtattgatccctccacaaaaagggattcctttccggttatatttgtcggccggtgataagtcaatcggcttggtcttgattcaggaacttgaaggaaaagagagggttgtgttttatttaagccgtcggctcttagatgcagaaacaaggtattctcctgtggagaaattgtgtttgtgtttatatttctcttgcactaagttgaggcattacttgttgtccaatgaatgcactgtggtatgtaaagccgatgtgattaagtacatgctatcggctccgattttaaaagggagagttggcaagtggatattttctttaacgtagtttgatcttcggcacgaatcaccaaaggcgattaagggacaggctgtaaccgattttattgtgggtcatcgtgatgattcaatcggcttggttgacattatgccttgggtattattctttgatggatctgtatgcagtcatggttatggtatcggcttggttataattgcgccttggggggcaagttttgaatttgcctatgctatcaaacaccgtgtgactaatcatcaggctgagtatgaggcggtcttaaaagggttacagttgcttcaggaagttgcagccgatgctattgaaatcatgggtgattcgttgttggtgattagtcaattggcaggggagtatgaatgcaaggatgatacattgatggtttattatgaaaagtgccgaacgttgataagtgaatttaggatggtgactttgaagcacatatatcgagaacagaatatagaggctaatgatttggctcaaagagcgtcgggatataagccaatgacaaaagatatcgagatagagattgctacaattacagccgatgattggagatatgatgtgtttcagtatttacagaatccatctcaatcggcttcgcagaaattgcgttataaggccttgaaatatactttattggatgatgacctctattatcggatgattgatggagtgttgcttaaatgtttgagtgccgatcaggcaaaagttgcaatcggcgaagttcatgaagggatatgtggtacacatcagtcggctcataaaatgaagtggttgctccgacgtgctggatatttttgccgacaatactggaggattgtttaagatattataaaggttgtcaagattgtcagaagtttggagcgatccaaagggcgccagcatcggctatgaatcctattattaaaccgtggccttttagaggttggggaattgatatgatcggtatgattaatccaccctcgagtaaaggacataagtttatattggtggcaaccgattattttaccaagtgggtagaggcgattcctttaaagaaagttgattctggggatgctatacagttcgttcaagagcatataatctatcaatttggtatccctcaaactattacgactgatcaaggttcaatttttgtatctgatgagtttgttcaatttgccgatagcatgggaattaaattgttgaattcttcaccgtattatgcacaagctaatggacaggccgaggcatctaataagagtttgatcaagttgattaagaggaagatttctgattatcctcggcaatggcatactcggctggctgaagcattgtggtcttatcggatggcttgtcatggatcgatacaggttcctccttataaacttgtttatggtcatgaggctgttctgccatgggaagttcgaatcggctcgaggagaacagagttgcaaaatactttaacagccgatgagtattataaccttatggccgatgaaagggaagatctggttcaatcacggctatgagctcttgcaaaggttactagggataaggagcgtgttgtccggcattataataagagagtagtacccaaggacttttcggagggtgaacttgtatggaagttgattctgccgattgggactcgggatagcaaatttggcaagtggtcgccaaattgggaaggaccgttccaaatttataaggtggtatctaagggagcatacatgttgcaaggactcgatggagaagtttatggccgagctctaaatagcaaatacttgaagaaatattatcccagtgtttgggttaatgcatgatcgactagtgttgccgatacatgatagccgatgtgtttgcatcgcctggagatggccgatattgttatatcgcccttagttgcttttcactattgtaatcggttgtggtttgccgatctacaaatggccgatattgttatatcgcccttagtcgtttctataattttgtcaatgttttcaacattgtaaaattaggggggcacatacatagagaattgcaaagaaaaatgagagaattgaaatttttgaacaagccggcacaaggatggcagcaaagtaattagggtgtcttagccgattacaacagttttctacaaactattacatggaaatcactgagacaagtatcgctggatagccgatatagccctttgcctaatttgatctatttcttcgatagcttgggcgtcttgagcatcggttccaggaatgactttcaaggatttagtcatctcagcaatgttcttgatagctgattttagccttgccttctgttcttcgacagcttgcatgagatcggttaacttcttgtgctctagatccagtttagcattgcattcttgaagttgtgccaagagttcaatcttgtgagcttcaagccgatcaacattagatttgatcgggccttcagataactgatcaagcttggctttctcttcatgaacacgctgccgattggtttggattgtagcctcgatgtccttgcgctcccggcgatcggataacctctgcctggctttctccagtttgaattgatgctgctcgaggtagacagctggagtaagagcatcggctaattcgtccgaaagaaaggcttggatatctgcaaatcttgcccggattgagccacagttggtcaccaggttatctagtgatgctcctaaccgatgggagatgtcttcgagtgttttcttcatatcatcagacaggagagctatcgctttactggtggtgtcttcttctgtttcatcgaggtaatctttgatgtcaaaggagaacagatcggctaagacctgcaagagacaatatcatggatgattaaggatcaagatatgattggccgatctcaaatttatgttaataaaccttactggaatagtaggtgcagctaattgttcctcctcttcaacatgatgactgcctgcagtcgatggagtgtggccgcctgattctgcctgcacaagaggggaagaaggaggaggagactgctaaagggataaatattagatataatcagcccaaatcagttaatgagatgataaaagtatcttactgtaggagctggtttaagggttgaagtagctgatctattcctcacagcaattttctttctctatatttattaaaattgtgaggaatcggctataaagtaaatgactgcaaaagtggacagataaagtcgcttacctttgccaattgagctgaagcagaaggggatggaggagattgcttaggtgaagccaatggtgttctttcagtatcgcttatttcggctgcagcttggtcgatgtcttcctcgatttcttcttcatccagagcttgttcaatggatggatctagggcgggtagatcgtcagctggcttagctttctttgtcttagccttattcttcggagccggggctgaagtatctgcagccgatgatctggttctccgcttcttgccggcatcggctggttctctgatgagtcctcggggaagtgctgaggtctttggggcattgtagccaatggcagaaggggatggcccacctccatttggaattagacccggagcatacttaatgaccttgccgctattgctctggtgaggaggagaagattctgttgtctgcaaaacagaagaaaagttagtcaaggttcaaatcggttgattgactattcaagcaagattgaagaaataaagattaacatgagggatagcatcagggaataagtctgtcatgtacatggaagccgattgatggaacagatgcagcttccactcgccccaccatctgtcaaatgtcctgctcctgaaccttgccagctttatgttctcgatgctgcccaacggaggtccagggatgttcaatagctgatccatcattaaagttgaggagatgtcgcctctgcattggatcttgttggcaaagtacagaccgattggcaattgtcccattccaagttgtctggccgatgacatcggatgataaaactcgtaagagacttggatatttctcccttgatggatgccgactgggaggatacatgggctgatagcagtagtaaagatttctctggattgctgaaacttctcatgattaatatcctcgaacctgaaatcggctggcagttcgaaatccattgagtcggcatagaagaaccaaactcgggcatctttttggaatccatcataaaagctgaagaaccagtccttcagaagttcagccgataactttgctcctgcatcggctggtgtagatgcatattctccgtatgacatacatctgcgatgggtgtgttcttctccatcatcttccacaatcggctccaaacttggaaattcagcttctgtcacagatggccgattgacaactttcatgactaccaggttcagctaggattgcaagagccaccatggtccacctgttccaaccactgagccgataattatcttggccgatgcgttgtttaatatctggtatagatagccgagaaggattttgcctaagggaaattgtttcttcgttactagggcctcggctaagaattgccagttggttgtaggaccgcagcttgatccgcagaaaaggaatttttccaaccacatcagcaaaaaagctacgtgctctctaggagtgactggccctttgcccatatatgctgtgatatatcctgaccaacccccaatgctcttagttttgaactcaaaagtgttcttggtgttcaggttcatagggttagctgatgaggttacatctaggccagtgagcatgataatatccagcagcgttggggtcatcggcccttggttgaaaagaaaagcattgagagtgttggaccagaaataagttgcagcagccattaggggttcatctttggccgaatttgctattgtgagggctagggcttggctgattccgatctcatcccaatgggcttgtttgctagccgatatccgcttataccatacaggccagcttttctccaaagaaggccaggatttgaaggtgtttttccaatggcttgtgtttggattggccgacctaaaaggggttctgttggtttcggctatgataaactcagtggggtctagattgccgattggaccgagaaagtattgttggtcatgaaacagactgggaaccgcaacaagattggaaagatgctacaagaatagagaagaagaaaacaagataaggtgagcgaaaaccggtctgatgaacggaaaagggggtctagccgatggggacttacctcagcgtattcggctgatgatgcggcggtcggattggtggaggtcgacatcgtcacgggtgaagatctggccgggagtggaatcgcctagaaatcgccatgcgtgttgaggaggtcgccggagagagaaaggacgggatctgtttaagcggtgaaaacggaaatcacgacgtgaagattctttggggcaacggttagtatttaaagtagagcgataacggacaggaaaacagcaagtgcgagtttctctcagagtcggtatatggcaaatccgaaacattatccaatattccggacttggggggcatgtgttaacgaccaaatttggtaaattctatcactattggcatcggaggtgaagatcagattgaagtgggatccaaaatgaagatcgttgcggaaacagagtaagagtcggctgcagtccaaatcggctaaggtcaagtcggaagagttcgagtcggacggggctagccgatacagccgattctgataatatgactcggtgtacgtcatcgggttcaagttgatgtgcttcaagatggttgccatgcatggatagagtcctgggaaggcaattgtatctattaattaggatattctatgtaatttccttagatatatgtttgggcaaaagtctgccgtaaagacttatgttatcttagagtttgttagagataatagtcatgtctgttgtggacgtatcttgtaattctcgggtataaatagacccgagccctatgtaaaaaagggacgacatccaatacaatctcggcgtatcgccaccctttttgctttacttttatttcgacgagttcgtactctcgggttgagctgcatcggtttcgatcttcaacaagaggtaaaacttgtcatgacgacttatgttctcaggattagtgcttccatctttatgatactctaatcttgtctatataattcgtcgagttatcatatatctcacataatcttcgataatatctttatctaacctataatcggctaacatctgttaatggaaggcagccgattaggttagacaatgacgttaacttagattatgtgatatatctaccactctatgaaacttccagcggcttgattgtctagatattgtttttcttttcatacttaatgctgcatcaattgagtttgatctattaagtcatgcttagaattgcaatctctagcctgctttctggtcgccgattagggtagtatcggagtttcagccgatcttatctgatttaactacttttattccatatgcttaatctatatgttaaatctgccctttatgttaagatcttgtcacatctaagtacattaggcttctgtttggtatattctacttgctttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgattcaagtatatatcgatataaggattatatatcattaatatctacagccgatcgagtagatttagttctgatttgcttattgatatttgccgatcgatgtacgcatgacatcggcttgaaataaatgatatgtcatcggcacctagccgatcggctatcatttataggattaattgcggtttctttgttctatttcttgttgattgcaggatcaaatcaactagcacgctcatacatccgaacgcgagttttggacctgcactggagttaagcagatctcccaggcctcgtgttttctgtcaacacgcttttggcacgcccggtgggacgaattagaagtcagaaatcaatcttcctcatggccgagaagctgccaccttcgccatcctcggctagcccgggtactgttaaagagaaaatccaaagaccaggattgagcgaagtcaatgaagggaatattgtggctattgatccggaaaagctcacacctgaccagaagaaggacttcgaagcaatgatgcaacaagcacgagaacagttcttcaaatcattcacacagactcgcaagggaaaatttgtttaaaagtacaaggtaaaggtggttcccgatgagcctgagaccagtacctttaaggagggagaagggaaaagagttttagatggctcggctcaagagaatcagggtgacgactctcagggggcacatgcagttcaaggtgatggtgctcacgagccacaacgaggaaatcttaatcagaatggtgagacagcacaagatttcttcaacaatttccaagatcgagtggactacgccgtacacaatgctttgatcaatcaatctggagtgttagtcaacaccttgtctaacatgatgaagacgatagccgatggatcaatagttgagcatcaagctgcaggcccggtttacttgccgggaggtgtttttccgaattatcgatctttgatcactgatgttcagccgcttgctcaggcagttcttccgagtgcaccatcggctcagccgatggcaccgccattgacttctttgcctgctccatcagcgtcgacaccaggccagccgattaatcctcggctattgatgagggagcagccacagcatagcggacagacggtaaatcggccagcacaggatcaggtggctgctatgtttctacccctccaatctactgtcaattcgattcagcagacgccaccaaggcaacaggttgtgcagccgattcaacagactccaccaaggcagcaggttgtgtagccagttcagccaacacttccgggacaacaaactatacagccgattccgcagcaagctttgatgaatcaatcggctgagcaatcagctggacacgccctgaatcaggttgttccagaacatttggttcaccatatacaaccagatggtacgacgatgcctcagattgtgccagagcacttggtgcaaagtattcagccaaattaacagaatttattcagccaaattaacagaattaccaatgaggcaatataatcagtttgaaccaatacagcaacagtcgcaaggagcaggtcaacaacgaccatgggctgatgtaattgccgatgtgatgagagaacaatttgggcttaagccgaaagatactggaaaattgtatcggcaaccttaccctaaatggtttgagaaagttcctcttcccaaccgatttaaaatcccagacttctccaaattttcgggacaagatggtgtgtcaacttatgaacacattagccgatttttagctcagtgcggcgaagcatcggctgtggacgctctcagagttagattattccggttgtccttgtctgggtcggcttttacatggttttcttctttgccgtatgggttagtcaatagttgggccgacttggagaagcagtttcatagctatttctatagtggagttcatgagatgaagttatctgacttgacagcaatcaaacaaaggcatgatgaacctgtgcatgagtatattcagagattcagggagatgaggaacaagtgctttagcttaagtttgactgatgcccagttagccgatttggcttttcaaggcatgattcctccgattagggagaaattctgatctgaagattttgatagcctgtcgcatctcgtacagaagataacattgcatgaacagaggtttgcagaggccaggagaagctctaagagggttaatcatgtctgcccttacatgtatggatcggatgatgacgatgatgactccgaaatagctgcagccgaatgggtaaggagtaaaaaggttataccttgtcagtgggaaaagaattctggaaaagaggagagatatgattttgatattaccaaagctgacaagatttttgatatgctactccgggagaagcaaattcaactccccgctggtcatgtaattccatcggctaaggaactaggcaaaaggaggtattgcaaatggcataattctggatctcattctactaatgattgcaaggtctttagacagcagattcaagtagccattgaaggagggaagattaagtttgatgattccaaaaagccgatgaaggtcgatggtaatcctttccttgttaacatggtgcataccgttggtcggacagccgatgtgggacgagcgagaggtttttgcgtgaattcggctagaattataaataagtatcagaggaaatacgacaaacaacaagagaggcattatgaagaagataatgatggtttcgatccttattggaattgtgagttctttcggttctactggaacgaaggtatgaggctaccatctattgaagactgtcctgagtgcagtgatattacagagagttcaagccgatcgtacaatagaggcaatcggctgaagcaagctagagttcccgttcatcaaaggttgggcccggcaaatcaaaatgattacttggaggaagacgagaacgcgaagactcagtggtgtccttctgatatttttacaaagaatcagaaaagaagggttcaaaggttgaggaatagggagcgctttcaggaggtcgagcaagaaattggtcatcggctgaggaaagcaaagccaaggaaggagtggcgtgttaagaatcaagttcttggagccgatgatattgcagccgatgaagcaaagaggttggcaaaagggaaaagtattgtaacggcgccaattaacatggtctttactttgccagccgaattcgggattgaccaagccgatgttgacgaactggaagaggaattggctaagttggttctatcaccagaacgagcagtttttgaaaagcctgaagggacagaaaatcggcatcttaaaccattgtatataaatggctatgtcaatgggaagccgatgtctaagatgatggtcgatggtggggctgcggtaaatttgatgccttatactacgttcagaaagttaggtagaactactgaggatctcatcaagacaaacatggtgcttaaagactttggtggcaaccaatcggaaacaaagggtgttctgaatgtagaattgacagtcggcagtaaaactatccctaccacattttt

SEQ ID NO: 63078 - DNA, 24446 bp, Oryza sativa
  unsure (1)..(24446): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgggaaggaccatacctcatcaagcgcaagtccaggacgggatcttttcgcctagcgacactcgaaggcgaggagttcgaccattcctggaacgccgcctccctcaagcgcttctatgtctagaatgggtggcacccaaatcgccaacttgtaaaaatgtacatactatcatgtaagcccttcggcactatgtaagcctttcggcaaagaaaaaaaaagaaaaagaagaaagagagaaaaagaaaaaaaactggatgtagggctattatccaccatggaggcccgaaccagtataaaatctctgtgtcctccgccttcttcttacttttcgtgtgattgataatttgtggaaaaaccccaaggcaaacgcctgatcagcgaaaaaggccaagggggcgaaacgaatcggccgaagcattgctcgccgaacattgaaaccgcaacagcttgtctcggaaaataaatagccgaacgacgttacgaccgatcagtataaaagcaaaagcgtttctctcgacacagaacgctacagattaaaaacgaacgacgaaaagctgaaaagtcaatacacctatttcgctaatatatgcaaaggggccggcatgttccgacctaacaaaagcacaaaatgtgacgatgcgaaaaatagcgaaaaggaaataaagcacgttctttattagcttcgaaaaaaaaataatcaaagaatacaaggtttacaacccgatacaattcattttacaagtaaattacatcttcgccccagtgatcattatccctccctaaggaatggtcggacgaactaggttcgtcatcactactaatatcatacacaaccttaagaggagtagggggcgaaacacagactaaactgtaacgacgctgaaagatcgattcctgacgtttagtcttctaatggtttcgccaaaagcgagccatatcttccaaacgtcttgaatgaacaagatcgtaatcttctaaggttcgcccggggtgcacacgtagccagttggcaaccttgataatcttatagctacgaccgtttatctccatttcgcgataaacatgccgaaatggacattgcgtcttcggcagccccttcaatgccacaaatttctcgttttgacttcgccagctcccagaagggggccgaatgcacgattttcggcggaccccctggtagacagtgcagaaaaggcaaaacacatcttgaatggtaagagtaggcgaaagaaggggaaggtatggcataatgcgaaacgagtgaaataaaaatatgccaaagacttcgatcatcaaaaggtaattaagattatgtcatacattccaaatataccaaaaagccttttttaaggtttagcggcagtttgccgaatatacaacggttcgccacatctagcgaacaccaaaagaaaactatgaaaatctaagagaagggtggagggcctcacacctctgggtggtcctgggcatcgcctccaccccctccggccgccgcgccttcctcttcacaaaggtccgccgcctctgctttcgccagctgctccaaaaggcgcgccttagcggcggagcggccgtccttctgccaaaattgttttcgccacgcacgaagtgcaggtgaaatgtcttgtgcactgatttcccaatcccccttcgcgtacttggggaactcggcgatgtgctcgcagccgaactgctgcaggaggcccatggtaaaggccgctgacacgcgcgcacagcagttgccgtacgcggtggcgcagtccgaaaccgatccgccggcctgctgggtccactcggagaagtcgaaggctgaggcatcctcggtagggaccccccgccccttcgcgcccatgtcggtaagggcgaggcggagggtttggcaagccgttctcgcagattcggcggtcttcgccatctcccgcgaaaaccgctgcgactcctccgcggcgctcgcttcagccctgctagccttctggcgaagagactatcttcggctcagtaaggttgtagtagtcgatgagcaccgccgaatgggccttctctttctccagttcggcctttaagcgatcgacttcggccctgacttctttccctttctccagttccgattggagccgcttgttttcagccttcgcctccttaagagtgttggcaagggcctccatctccaaatttttacggcctagtttgtcatccttggcccgaagacggcttttgaactcatcaagtcgggctcgcacggttcgctccgttgagcagtgagccgcgaggatctgggcgcagaatacgagcggcgaagagaacaagtgtcaattgtaaaaacaagataaaggaagggtaaagataaaaaaagggggggggaacgtacccgaacagccaggctttttatagcagaacacccttcgtcgaactcattcagttccgtgaacaagctcggggcactggcgggcagtacaagattgcttaccccctccaaaaaaggaaggaggtccgctcgcgtctcgaaatcgccaggggcgaagcggggtaccgagatcgaatattccgaagcggacgtctcagcgacagctctctttcccttcacctcaatcagcggcgatgcaaccggctgaggcggaggattgccgaatactttcgccgcggccgtcacaatcctttccgcagaagctgaagccccagcggcggtactaccgtccactcccgcggcgtcgaatggaggaatgggggcggccgaaagatccaggctgcgaccagcgggcgaagtcagagtcccgtcgaaggactcgtcgtcgctaaaaacgcgagcgacatcgacgagtcctttcttcttagccacctttttgccaggacctcccttcgccgctgcacctgaagagaacgcaactagggccttcgccccttccaaatccttccgatgaaggggggagctgttcgactccaccccggtctcgttgtgaccgggacttggggtaggagtgtagccgggggtgtcgacgcagtcttcgaccgcctcgctcgcggccttatcagccacagcctccacctcctcctcttcatctccttcctcctcgccgtcacgttcttcggcatcatcctcgtcgtcagcgtcggagtcagacgaagtaggaacccttcgcttcctgggggcaagcttcacttgtccgcgcgtccgctttcgcgaaggccctgcctcgtcgtcgaccttttggggattcgcccggggaggcagttcgccattgtaaacccggttcgcccgcccagccgcttgatgcgttaacagctgactatactcgacggccgaaacatcgccgatcatcctgcaggctttggcttcggcctggtcgagggtcaacactgtaaaagtagagtgtgaagctatgtcaaaagtcaaataaggcgaaataacaaagcacagcagtaaatagcaaaacaacagtcttactgttcgccccctcaggaagtatcaggttcggcaaaccgtcgacctcttcgccttgttcaaccgcgacttgccatgactgggagaggggaaaaattcgaagcatacaaaattcctccaccaagtcacggcagctaaggcgggagcaaaccttccgtagtagaacgaaccatgcctccatggtgccgttcacagcaatcttgggcctccggttcggcgcaatcgccttgcgccggcaccggaaggctttcgctgattcagaaatagcctcgaaggggatggtgtggtagaaccacctcgccatccaatggcggtcccacttcgacatggcagcgttcaccggctagagatcggaccgctcggggctaacgttgaagttcacgctcccgaacactgtttttttcattccagccggggtaatcaccgtcttcgagttcacggtggcgaaaaatatggcgccaaagagctcggtgttaggctcaaacccggaagtccagcacgcccagtcaaagatagcgatctgaacaagcgccgacgggctcagctgcggaagttccacctggaagaggcgaaggatttccggcaacaacacgttgcaaggaaaccgtagccttgcctcaaaaaatacggcgaacaccactgtccgattgtcgacaggtttcggcaccacggttttccctggggcgaaagcctgcccctcaaccaacgctccggagctgaccatcttcgccagctcgacgtcgtctacaagagagacccccagaaaggcggtgctgttgtcatcgactaggccgggatctggccctttcgccgaagtagggtttggcttacgtggggccatggcgaacggtgcgtttgcggtggcgaaaaacgagattcggcgaaacgcctgaggggtcgaaagatgctgtgaaaggaagagacggaggaagagagcgctcgcggtaaaatggaaagtggggcggtgaaaaggaaagagaagcgggaatatatagcccacccaggcgaccgttcgcctaaccactagtaataaagcgccacgtgtcgcaagggtaggtgaaatggtaaattcccatcgaccgagcggcacagtgaaaagcccacgataggaaggcttccgttcggcccaggaaaaaagaatatatataaaaatcaatcgcaggaggcgaagcgcggcaaaataataccagccgcacaaataacaaacttcattcgcaggaataatgtaggtttcggcaggagcatcggtcgaaagggggcgccgcataccataccacatggtttgcacggtctcggccgaagctccatctcacccttgcccgtgaggggcttgttggcggatggcatgaggtccttcaaccaaacctgccgaaacccatggcgaaggctatggaacaagaacggcgcaaggcgaagagtcgtacaagcgccaggccagaggcgtctcaggcgaagggtgcagggcgaagactatctgccgaaggaggatgacttcgccttgacaagttcgcccccgtgagggccgaggaagcctttccggcccaacaggccggcgatcgccagacggcccatcagaggcccatgagcccctataacattatgtacccctgtaaatgcccctttggtaagggtaatcatgtaaatttccctgtacaacctaaaccctagtagtaagaacctgtaatggggctataaatagtcccctagggccatgtaatgggggatccccaaggaaaattcaaaatttagtacacttcattttcccatccactgttgagtaaccacgtctttcgacgtatgcagttgtcgttttgacaacaatatcaatgatagaatggtaccttgtagcttgtaaaataggaagaccttgtcaatgtttttgatagacgatgtgtagttcaagactccacagcacacctatggaataggtcatccatgttgggtgggtcccttctatgtcggcaaggagcccagttacagattattggtcagtgatgtcaaaactcatctgtgtcgaggatgagtgtcattagtaacaggtccagactagaggcctgtggtgagtgcctgtaatggtgcttttgtgtcgaggtttattatgtcccgtcaaatgggaggtctatatgatgggatgcaagcccctatcatggatgtcccgttcacgacgtcatgttctatagtggtagcaatttgcaagggatcgcatgtaaaaataagtctatttaccaatacggtcatcttaaggggccacataccaaataaattttcgtatgcgtgtctcttaagttgtccgcacgcgaaaataccctcttcttcacagattttttttcccgtgctctctcttttcgctctcaccacttaaaacttttcgtctcctctcctctcactcttcctctccttatgtctgttcctctcctctcctctgatactctcttgtcttcctctcctcaccgagtgtgcgggagcaggcggtggggttgggagcaggcggcgccgccgttgatgacaaggaggtggccaggagtaatgccgcctagcgtggatctggcggtggcgacccatccccacgcggatccagtgccggtgacgacgatgggcggcgggggcggcggatctgacggcgacgacgagaggcgcacggtggatccggcgcggaggacggtgggctctggcagcagcagtggcgccgccctgcgtgggtccgactgatgacagcggcgagctagggttcggccgattcggtttttttatttttttcgctgatattattttcgcatgcagccgatataggtgaccacatacgaaaataccattttcgcacgcggttgcgctggtcgcatgcgaaaatccgattttttgtagatcttttggcgcatgcgattgtgctggctgcatgtaaaaatgatttatgtagtagtgggacgtagctcaagattccattgtttaacaaacagggttgtatgcacgaattctttgctaggacgatttacaaatagttgagctaactccgcccgattggatcaaatagcttcccgttacccagatgtgcactgcctatatatattttttatgcatttcttgaactgctcatattcaaggtagtttattagccaatttgagaatatcaatgatagtatggcagctcgaactttgtaaaataggaacaacttgtcagttttgggtagatgtctaggtcgatcaagattccatttgtttcacaaacatagctatctgcaggtattccatgtcaagtcaattgacaattaattgagctacctccactcaattatatcatatagcttccggttacctacttcctccgtcccattttaagtgcagccatcagttttcgtgtccaactttgatcattcgtcctctttattttttttataattagtatttttattgttatgagatgataaaccatgaatagtactttatgcatgagtttttttaaaagttttttaaaaaatcaactaagacaaactatattaaagttgggcacgaaaaatgatggttgcacttaaaatgagacagaggaagtacatatgcattggctataattttttggcatttcttcaaccactctcatttactgtacttcagagtatttgagcaagtttaatactagtagatataagtgttgaatatataagcacgtaatgatttaatttgttccataaatacataaataaatcatgacattgtcgatgtaaactagtataatcacatcataggatctatacatgtaaacaagacagtaaaggatgaacagatcgaagatgcgaaacatgttgataccgatggttttggaaatccggttgctcggcaggaagaattcacggtaccgtcccttaacggtagcgcacagcacgcgagcgaagaggaagacgagccgtatgaacgaatagggagcagtcgcgtggagcgcttcccaaaaacccaaaaatcttattgctaccttcttctagtgcaaaacgtagaaggcgcaggtttcggagagctgctctcccgattgccattgagcaccggcgagtgggatggagtagactacaaacaacaacgtagtacggaggaggaggccaacccaagattgattccacgtatgttgcgaggaggtggcggctcaaattatatagagatatcaggacacttgatcagggcgcctacacgatctccactctgcataaccgaaccgaaccagataagtcacgcgtaacttatccgaactccacaccgtttcacacatcggattattcggagtgtttccaaaaaaaaaaaatctgaattttccgcagcaaaacggactccacaccgtttcactcatcagattattccgagtgtttccaaaaaaaacaaatatgaatttcccgcacatgcctcaagtggctaggagagcatcctctcctagaatgggctaagaccgatctattaattcaaacaataagtccatattaaacccgagttaaactgacatgtcaggagcacgtgttccccctgttctctccgcctcacatgcctcaagtggctagaagagcatcctctcttaaaaggaggtcttcctctcattgaataggcaaggcggtactaaactccccatgcatgatatcccatgaggtgggcttttatgattttccaaagaattaaacttcgaatgggctaagaccgatctattaattcaaacaataagtccatattaaacctaccatatatatattttagttgtaatgttgccctatttttgttttcctctttttccctcgcctatgtaactaatgcatttgctttggagcatgcgtagagctagattttgcataagagctagcacttctcattttttttatctcgtcttggcataagctatagttggcttacactccctccggaaagttgaggtgcaacttttataacttctactaactccgttccaaaatgtggatgggtttcatcccatcctagattattatatatagcaaatctattctacacccctcccctagaataactattctacacccccctcccatgggccaatcccatctcccccaccattcatatggcccaaatctcccctcccacctcagtcaaaggctagtcaaagcctcctcccgccggtcaaacccgagttaaacccgcccattgactccctctcccacccaccactttgctgttcacgtctcgcaggaatcccgcagtaacataacggttatcgtgtagtaacaggacaactttctcgcagcaacaacatcgaaaaatagttttgttaagcacttttttacagaaatcatggtgcagacgaattagaaaaatactatataatgtgagagatattgctctctaaagattgagatttacttttttttagttctcatcacgctggaacggcgtagtaacgttacggtcaatgtgcagtaacacgactaccatgtatatttatttgtgtgataggacgattgagtcgagatctgctccctctaattcctctacgccctctcccatcaccgatgcgcctctcagctggcaggcttcgcaaggccatcgtcaatcatagccaacgacatgatcaccgatgctgacaaggctcggcaggcgctgccgattgctacggcctcctgcgtactcaggagcggtggattcaccgcctgttggtgggctctaggcacccgctgacaacttcaacctccagtggacttgggagtggcagatctgctgccgatagggtttgttaaacgatgacgacaattgtggtctcctaaaggctcataagcaaccggtccaccggaggttgcctcaccctgccttatcccctttcttccttcgcatccaccacaccactaccacctctagctagatccagatcaaggtacatggcaggagcgctgagatggaggctgatgatcaaggcagtgggagaaaggggccaatgctgagctcgataacggcaagctttgctgcagccttgacctatgttcacttcgcttttatttcgctatgagataaatgtgaatttgttatggaattgcgttatatatgtgttgagcattgttatggtgatgtggaagtttactctcgactttggatttgcggtgtgtctgatattgatttgcagtggtgtggatccgtagaaatgggacgagcaggaaatggcactgcatctggatatttttgagctatattatttgttttcaccgaaaatcacctcccaagttgctcggcttaacctaaccacctgcaaaaattgatttttacatgtggttatggcaatttggtagaggcgcaggtggctcatccgcatgtacacatatttttccgcctataagtccatcgaaattttgactaattattaatcttttagaaaaattattttgaaataaaccgtgtaaaaatcttcagcaaaaataacatgagctcaggggccgtatggcattgaggtccaatagctcagcatcgtccctgatcgatgccgctaaccccgtcaggcgttattcagcttagagggcgattggagaggattaagggggaataattccagactataataggtgtgaaataaatcccctccaattcctctctcataaggattaaccgaataaggcctcacggtgatgcgcgagaagatgcaatggattgaccaccataacgcttggcgctgacctcgtatactccaaaaagaagagtgggtacgtcatgtacatccacaagttgacaagttgtgtggtggttacattgttttgctatatatcttatgcacacatatcacctaagtttgaatctcacgtacgatggttaggtggttaggttcttaatttgaatggttagttattactagcgcgcgcgcacaaacactgaaaaatataattttttaaattgtgagtgtatatttagtcataagaatttgattcataccaaagcaataaatcaacttaaattaaactttattttacaatccattattacatacctaagtaattatatataagtttagatcctatatacctacaatcaaaatttaacaaaaagatattcaaatttagttcaaacttgtttgaactagctagtaaataagttaatgttcataactaaacatttttttaaaaaaatcagactcattagcattaggtacatactcaatttttaatcatgttggccgggccccatgaagccccagttaattttaatatatatatatatatatatatatatatataaagttaaatttgagttgttttgttgctaggtataggtatgaatcgaatacttataactagatatatagaaaattttgaaaaatttagacgaatttgtgtatttcatattatggtgcccgggtgcccatatatgtcctatgtgtgtgtatgtaaaccggagttgctcaaagtatatatactataaaaagagtgtgctaaatatattcaattaaaaaagaaacacttatcatagaaatgataatttcataggatcaactccgacacaataattttctcatcaatttaagattccatggttcaatataattatgctttagattttatatatgttctgtgaggataattagaagaaaatcgcgaagtgagtatagctcaacttgttaggtttttttggtagaaccaacccacccggttttatgtcctagactttgatacgcgggtgtttgtgattacggctaactattgttgtagtagtagccaacgtacctgtctacatcgaggcacttgtggtcaatttgtaaatcccaacatatgtcgtctcagtctttcaaaggtgctcgtagaggtagggtagtgtgcgtgtgtgctcgtaggggtcattgtgcgcatattatgagcgtgtgcatttgtactgtttttcttaaaaaaatcataactcgttaataagatagcaggttcataatatatagaatgaaataatatgttttttttccaaaaaaggtcatccacgcacaaaaatgcatatgttaggctagcaaaattttaagaaactttaaataagatgtccacgtttgtgtgcgcatgcttccttcctgtttagttagattacaaatatatttagttcaagaattacaccaatatattcgtatatatattaaagtactggtttttgcagctgaaaagaatatatcttatgagatcgaattgaaacttttgttcaaacttcaatgaatcttaattaaacacgttttcagaaaaaaaaatagtatcgtcacacaaattcaacggagatatattattgttaggaaaattggaaaagggtacaacgttctggcagacaaacgtgcagctcacccctataaataacttagctgcgaccatttgttcgaatcagccgggctgagaggcagcagctagctagcgcacatgcattttcgttgtggcgaacaagctagctgctagtaccctcagttataccaagatatacactacattcctagctaggtacgattagccgccggtgagtggggagatggtgacatcaacagtgaagttggaggaggttaggaggatgcaaagagcggaggggatggcggcggtgctagcgatcgggacggcaacgccggctaactgcgtgtaccagaccgactacccggactactacttcagggtcaccaacagcgagcacctaaccaacctgaaggagaggttccagaggatgtgtaagcactaatgagtaatcagttaatttgcatctatattatactagtacacatactgtatctagtctaaataagtgaaaggtgaatccctttatagaaattaaagtactgcgccatcacttctattataaaaactgatcatgtttttgtcggtattttggtatgtcatttttatttgagtcggtttgtaatttcgttcgcttttggaaatatagattcgtgtttgagtcaattttattgtttgttcattttttgaaatacaaaaggagtcgtataagaaatatttcttaaaaaaactcgcacattaacttgagacgatagtcggactcctaattgcagctcgtgattttctaaaaaaatttaagcgaatttccagagtaaatttcaccctatctaaaccgtataacaataataattaataataattaagattaaaatagcgcaggtgcaaattaatatcgcgcatccatgatatatgcaggtgaaagctcgcagatacggaagaggtacacgcatcttactgaggagatcctacaggagaaccctagcatgtgcgtgttcacggcgccgtcgctggacgcgaggcaggacatggtggtggcggaggtgcccaagctggggaaggcggcagccgaggaggcgatcaaagagtgggggcagccgatgtcgcggatcacccacctcgtgttctgcacgaccaacggagtggacatgcccggagccgactaccaggtggccaagatgctgggcctacccacgtcggtgaagcggctgatgatgtaccagcaggggtgcttcgccggtggcacggtgctgcgcgtggccaaggacctggccgagaacaaccgcggcgcgcgggtgctggtggtgtgctcggagatcatggcgatggccttccgggggccgtccgagtcgcacctcgactccctcgtcgggcacgcgctcttcggcgacggcgcagcggcggtgatcgtcggctctgaccccgacgaggcagccgatgagcggccgctgttccagattgtgtcggcgagccagaccatcctgccgggcacggaggacgccatcgtggggcacctccgcgaggtgggtctcaccttccacctgcccaaggacgtcccggagttcatatccgacagtgtcgagggcgcgctcaccgacgccttcatgccgctcggcgtccacgactggaactccatcttctgggtggtgcacccgggcggtccggccatcctcgaccaggttgaggagaaggtcgccctccacaaggcccgcatgcgcgcctcccgcaacgtcctctccgagtaccgcaacatggccagcgccaccgtcctcttcgtcctcgacgagatgcgcaagctctctgccgacgacggcacgccaccaccggcgagggcatggactggggcgtcctcttcggcttcggtcctggcctcaccgtcgagactatcgttctccacagcgtccccatcaccgccgccgcccctcttattatgcagtaatactacttaatggtacaacttctggcgtaaactttactacactactttgtttaattattttaattgtttcgtgtcatcgttcctgttcacgtcgatcaggcttcaatttctacatcagtgtgtgtttcagtgtttgtaactgttgtgacctagcggccgtacgcgtgatcgatcctgggatggcacgatttcttgtgaactctcgggcggctttaaagtacacgttatgtcatatatatgcatgtaattggccccttgtttgcccattaataagtggagaatgataaacaccagaaaacggcgcagcaagcaagatcgcagccaaaaaaatgtctcagccttatttgtcttgtgttcgttcttccatgccgtggagttcataccaaaccattaatggtgtacgtattttcttcttcacaaatactaattaacggtcgtctatttttggtcttggtttcaaaagaaactacaatcaattattacacagcgattataggtcgaatatggttacaaaattataaaatcacaactcgaatagaaacaacaaaactaccacttacactaccagtactcaaccagcctaaagacaacaataagaaccctcatccatagagctggtttagttcccaaaacaaaaatttttacagtgtcatatcgattgtttggacatatgcatggagtattaaatataggcaaaaatcccaattacacagattgcgtgtaaattacgaggcgaatcttttaagcataattgcgccatgatttgacaatgtggtgctacaataaacatttactaatgacggattaattaggcttaataaatttatctcgtagttttctgacggaatctgtaatttattttgttattagattacgtttaatacttcaaatgtgcactggtggagaaagcgtttgtagtcccggttcgtaacccccctttagtcccggttttcaaaccgggactaccaatccgggactaaagtcgagctgaccttttttttttcatggccctgttgctgcatggtttatatatatatatatatatatatatatataaaaaccatgcatatatatgttttaatacatatatatatgcatataatatatatatatatattatatttatatatgtttcagtacatatacatgcataatatatatgtatttatacatatatatgttatgcaaatgcataggtatatatatatatatatatatatatatatatatatatatatatatatatatatatatatgaaagcacttaacattttatgtgcatatatatatgactaaaatatatatttacattaaagaaaatgtgtacatgcatatagaaaaatagacatgtattaattacaatctattatgatgtcctagctagctacgatttcgacgtagtagtagtcgttatctcagaagctaaggacctatgaattgtatttctgtcgtagtagaattcacccttgggatcaaggatttgttcattgataaatcccatgagttgttcttgaaccaccgcgataaattccttgtgtgtgatcaggttatccctcatgcgaataaactatattaatgtatgaaattaattagtaattaaacaacaaatcgatacgtacgcaatgaaatttagaatttatttgtacgtacatcgagctctcttgcggtgatgatttggtctacaaggcagtggcaatactcgcacacgtagcagctgcacaagttagttccctgcttttgctttgtgcactataaataaatgataaacggtgagagatctaattaatatacacttgtatgtatttgaattggagattcaatataaatgtaaagcatgtgtactcacaggaaaattgaacttccgcctaagtctttctctccatttactgcggaccaaatgacggaatcgataccaagccctacatggagtttaaagctatgattcgtagtagcaattaattataacaagattcttaattaacataggaacttatgacagtacctgtctataagttcgaaaaccttgtcaaacatagactcttttttatccattgagtcatatacgttgacggtgcaggcctccaggttgaagagtaaaaagacccagtggaatctgcaatgtgcgtgggatgcattacatatgaaacacttagcatgttcgtacggaatgaaatttggtataggaagacagtaaaattaaactaactctgtgttgtacggtaatagtatgaacgtcttgtaatgctgcgccttcaagagatggacgagattgtcctctgtggcttgcggatactggtcgagcattgcgacgtttactttccgagggtcgatgaatccagtatcgaaaaccccccgccgccgggccctttgaatctccattctacaacaataaaaggaagtatatattatatgtagtctacttatatacaaggacctaactaattaaaggaaacataataagaaatctaactgaacgatacttacaaaatccagcaactcataatagagacgtcgagggcatccagctggtatagttcgtagatacccttgaaattgatccagagaatgtcatctccttgcaagaagtccgtgtccctgatcctcgctccgatcatttctgtaccggtggcgctcatctccatgtacagttgatggaacttgtacatttgtgtgggtagggactgcagctgctcaggcttgacaagcggtttaccgagttcgtacatgtatttcacttccgcctttttgattggtgcacctcgtagcaattgatccgtagttagcccggtgtcattaataaattcttgtattccaaaatcttcatgttcgttcacgttcgttcgttcgttcacgttctcgttcatgttcgttcattcgttctcgttcacgatcgttcgttcgttcacgtggcggcagcggagcggcggcgtggcggcgcggctgcggcttggcgcggcggcagcgtggcggcgcggcatcgacgtggcgcagcggcggcgttgcgcggtggcggcgtggcggcgcggcgagggcgtgccgcggcggcgtcgtggtgtctcggcgtcgtgccgccgcggaggcgtggcgcagcccggcgttgtggtgcgcgcagcttcgtcggcactgccggcgcgacgtcgtcgccggtggtggcagcatcgaggtcagggttggtgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcgtaatttttaatcatacaaagagcatttaagtaattacccacatattaaattaatcattaaatggtctaattgtaattttttatgtactttgagtgtccaagtattttcaggatttttcttgaaattatttgagcattggaagtatttttaacaattcaaagatcatttaagtgattattttaattggaaaagtaataaaatcctcctcctcagcttgggccattttcggcccattccttcctttccttcctctctcttccaccggcccaacccgagcctgcatcctctcttttcttctcttagccaaagtctggtattgctccctcttctaaacaggctgagaaaagaaaagcccggcaagaagtctacttttcctccctgcgctactgttcatcttccagctctggacagagccagagcagagccgtgccgtgcctgttgccgccgatccccttccaaaatctcgcctctcgttgctcctttttctaaaattagttgaggggaaatattcctcttatcctcctctatctttacccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtgtgccccctctcccgtggtctcccgtgcctcgtagcgccgccgccacgtgctccaccccgccgtcgtcgccggccgagctccatccgcgtcgtgccgccgcctccgtcgtcgccgccggccgccgtcaccgccgtaaggtacgccgaggtgtggagaagcccggccgctctctccccgctgttgccgatcaccggagccccgtcgccgccgtcgaccgaagccgcgccgccgctagacctcgtcgtcggccgtcgtcgttcgtcgtttggttcgagggtgagtaccgttgggttcgtctcgtcgtcctctacgtgtacatgtcctccaaagtcgcagccgaccatccaatctccggcgaggtcgccatcttggtccggctattgatgaggtcatcatgacgtcatcatcgtttttctttttcctgtttttctaatagattaaatcttcggaaattcataactaaatcatcgtaactcggttttgagtggttcaagttgctaaattcatctaaaatcatgatctacatgtttgtttactttatatgtactgtttatttggtttttattagcctttttcttcgttttgcgtgttagcttgtcgtttccgtcgttgcggaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgattactttattccttgataccttgggttattataacttgactagttgggctttatatattggttcagctagatattagttatgattgcttagccatgcttagaaacattagcacactattgggataacttatgactcactattatttaatgatggcttaatgatagttcacgatggtcaatcgtgattggttaattaattacttgccaactaaatcttgataatggtgggttgtgagcacatggttttgagagtcgtgctcatggcaattaaggaccggttcgcgagctactgttgtgaaacattaaccgtgccaaccacaagccagcgtgggcaacggctttacctttcgtatagcatggttcattgcagagcaccagactgagaagtggcggagataagcccacgggggtcgctggggagtccatgcctctggtttttgagggggtgattatgatccaggaacggtgcactgtggtgggttgtgttatgcaaggggtaatgtcacagctcctttccgaggtaccgtggtggtactgaggcacattgtgacatgtcgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagcatgggtatgttgttcagtgttgattaaaatttctgattaattactccactgttttacttctcttaaatgttttgctaaatgctgtttttgcaaatgagcctatattatgccatcctttggtatccttgtgcacttgcatatttgctgtgtggcttgttgagtatgtcatatgctaattctttcaataatcaatcaacctcagttgaagaaaatgatccagaaggagaagacgtttggcttataccccagttgagctgcctgtgggagtggagccggagcttcgctagattttattttccgctgcagttttcttcatggtgaggactaagtgcctcttaagtaagtatttatcgttttagctaatttgatgaatctgtatattaaattgtcagtttgtgtacctcggctgattcctggacgaggattttatgcacaaataagttcggaattactagtgaatttccgggcgtgacaagttagtcatcatcggcgcggcggagtcgtgttcggccgcgacgacgtcggcggcggcgtcggcaacgaggcggccggcggctgtttggggagagagagagatcgaggtcggagagagagagggaggtggcggcggctctcaccccagagatgcgacggcggcggaggcggcaacgacaacgcgcgcgagacgaccgcgagatacgacggcggcgtcggcgcggggatgctctaggtagtggcggcgaaggagaagccgagagagaaattgattggggaaaaaacttctaagtgttggtggagaagacgaaggcgcgcatcgggaatatatatacctctagatctttagtcctggttgatgagaataaccgggagtaaagatattttcccgctatttccaatttctttttaaacccagttagagttaagaaccgggactactgataagcgcactgaatattaatttccattacatatgtgtttctaaaatagaaaataatgtgttcaaattaatgacaattacttcgaaaaattattgttgtctgtagtacattaagtggataaaacgtagtaagcaaatactcctatatgatttaaaattaataaaaattctaataatcatatatacttagcatatgaatgatattaaattaattgttaaaaactctaattaacatatgtatatacgtacgacatgcatgatttaaaattaataaaaattctaataatcatataaaatgagcatatgaatgatattaaattaattgttaaaaactgtaattaatatatgtaaatacatacgacatgcatgatttaaaattaataaaaattcaaataatcatatataattagcatatgaatgatattaaattaattgttaaaaactctaattaacatatgtaaatgccacatgcatgatttaaaacttttaaaaatcctaattatcgcatataactagcatatgcatgatttaaaattgttaaaaactctaagtaacatatgtaaatgccacatgcatgacttaaaacttttaaaagttctaattatcgcatataactagcatatgcatgatttaaaattgttaaaaactctaagtatcatatgtaaatgtcacatgcatgatttaaaacttttaaaaattccaattatcgcatataactagcatatgcatgatttaaaattgttaaaaactctcagtaacatatgtaaatgccacatgcatgatttaaaacttttaaaaattctaattatcgcatataactagcaattacatgatttaatattgttcaaacctctaatcatcgtacgtaattaacatatgccatacaacaattgatttatatggataatcaatacatccaaaatagattacatcgtgtacacaataattacggcaatacatcgaaggtgacggttgaccgcacgtactttctcctcattattgttccctccttgtgatcgctacgtgagtaaggggtgtcttcatttgatagaaggatgctagggtcaatcgtcaccgtgaaagggggttgcccatccaactgatcgtaatcctcgtcagttttgtcctcaactccgacaatttttcttttgcctgggagaaccacgtgacgcttcggctcgtcaggtcctctgcccttctttcctttgctagacatgtccttcacgtaaaagacttgcgttacatcattggcaaggacaaaatgtttgtccgagtatccaaccttgttaaggtcaaccgttgtcatcccactgtcatcaatcattacacctccaccagtcaacctaatccatccttggaatgtcgtgatcgacccagatggtccccccgccaggaaggccagttgtgtgacgccccacactctccgagaccgggccccgccaggaaggccagttgtgtgacgccccacactctccgagaccgggccctctctacatctagcagcttccctaggacatagactaccctcacagaccaacgctagtgttttctgcacactttgtcctcactcgtgcacactactagtgagtgttttctgcacactttgtcccgaaattgctccaggccaagcacgcttaacctaagagttctttcgagaccggcttccggaaaagaagttgcaacttgttgatatgagtattctattaatcctattaagccctaggccgggatgtcacaagttgttggttgatcgtctcgttacccatgagatgttgtcgtagccacgcggggaaagtatcaatgtgatgccgtgtaatccatgcatcggacttaccgatgtttatgacgcgaactagagccaagtgctcctcgatgtaaggagctaccaatgaagattgttgcagaaccgtgaaatgggctttacggaataaattgttgtctaccgccattattgctttccttctgagagatccctctccccatagtctcccttcatgtcgtgattcaggtacctcgattgggcaaaggtcttcaataaattttatgcaaaattcgatgacctcctctgttccataccccttggcgatgctttcatctggacgagcacggttacgaacatacttctttagaatgcccatgtacctctcgaaaggaaacatgttgtgtaggtacacaggcccgagaatactgatctctttgacaaggtgacaaagcagatgcgtcattatattgaaaaatgaaggtggaaatatcgactcaaaactgacaagacaatgcaccacatcattctgaagggcttctaatctatccggattgatgaccttctgcgaaattgtgttcatgaatgcacatagtctggaaggataccccttattacaactggtagcagttgtgtcatcaacaggtgacagtcatgagactttaggtttgtgaacttcttctccttcgtgcttattattcgcttgatattcgtggagtatccagacggtacctttatgtgctccaagcattcaaacatactttccttctctgcctgctaatagtgtagctggctggactcaagtaatggcttcctttctcctttggttctgggtgaaggtcgccgcgttgttccatatggtttagatcattacgtgcttctagtgtatctttcgactttccatatacacctaggaagccaagaaggtttacgcaaaggttcttagtgaggtgcatcacgtcgattgcgtggcggacgtccaagaattcccaatagggtaactcccaaaatatagagttcttttttcacatcgccgcgtgaccatcttcgctctctataggctggcttctatgcccctttccgaacactactttaagttctttaaccatagcaaacattgttttactgtgcgatgtttaggcttcgcacggtggtccgccttatgttcaaagtgattgcctttcttccgtaccgggtggtttgcagcaaggaatcgacgattacccatgtacacaaccttcctacagtgcttaagatacgtactttctgtttcatccatacagtgagtgcaagccttgtaccccttgttggactgaccggaaaggttgctaagtgcagaccaatcgttgatggttacgaacagcagcgctcgtaggttaaactcctcctgtttgtcctcgtcccacacgggacaccttcctttttccacaacagtttaagatcttcgaccattggtcttaggtatacatcaatgtcgttaccaggttgcttggggccttgaataataatcagcatcattatgtacttcctcttcatgcatagccaggggggaggttgtagatacacatcgtaacgggccaagtgctatggccgctgctcatctctccaaaagaattcatgccatccgtacttaaaccaaaccgtatgtttcgtgcgtcctttccaaagtctttaaaatttatttcgatgttccgccattgcgaaacatcggcggggtgtctcagcatcccgtcctgttgacgctcttcagcgtgccatcgcatcattctagtattccccttgttcctgaacaaacgccttagccgttatattatagggaaataccacattaccttagcaggaattctcttctttgttagctgcccgtcaacttctcctggatcgtctcgtctaatcttgtatcgtagtgctttgtaaacagggcatgcttctaagttctcgtactcctcaccgcgatataggatacaatcattcggacatgcgtgaatcttctgaacttccagtcatagagggcagactatcttcttagcctcgtacgttgtctcgggcaatttgtttccctccggaataatgtccttgatgagtttcaataaatcgccaaatgccttgtcactaaaaccatttttggccttccattgcaagaacttcagagtggtatcctaactttttgtgcccctgctcgcaacctgggtacaacaacgttctgtggtcctctaacatcttgtccaatttatgggcccccttttcacttttgcagtcctccttggcgtcttgcaacatctaaccaagatcgggctgcagg

SEQ ID NO: 63079 - DNA, 883 bp, Oryza sativa
aatagtcctggatgcagaatactccttctgattcttacacttattgcatggacaacaaataaaacccttatgcctgttagcttcggccattctcaaaaaataacgcacgccgtcaataacctctttggaccaccggtcagcgtacatccattgccgatccatctacatgagatgaacaaaaattgtacacaaataattattcttacaatatgacagtcatacaataattataaaataattacaaactctttcaacagtcatacaataatgacatatcattattcatacaaaaattataaaatattacaccaaataattcttatttactatttctaaagttttaaactaatattaatgtgttgtacttcttttaattttcattttagtttgttttctattatttaagattaactttcactatattttccttctcaactattttataaaaccttctttagcaaataaactaaatttctatatattctttcttccccacacaaattttctctctcatcaacttacaactaaattttggagacaaaaaagtgtgcaaaacatagctccaaatataatatgacaaagaaaacattggagaatgaagttgctaaccttttaggcacctccgatttgtatataatcaccaaaataaattcactagaaattttggcatgacctcccctcttttttgaagaaattttgaagcttgctcgggcagctagaggaggaagaagacgaatatctaagggtgagactttagtcccggttagtgttatgaactggggctaaagatccccgtgatctttagtcccggttggtaacaccaaccgggactaaagatacttgttacgaaccgggactaaagatcccgggggggggggggggg

SEQ ID NO: 63080 - DNA, 3112 bp, Oryza sativa
cacttaattacttgctgtacatgacacactattcatgtttctttactgttaatctcttccatgtagtttaagaaggttttgcatgcaactagtcgcacgttcgcgcgactataaccttcctatctattagctgctattacaattaacaataaattttccaccattcagctaaatcaataattaatgtatagactcagggtttatattcatcttattcgtgttgtttcctgctttacttgatttaatattcgaaaaaagtatttggtcggaagtgcatgttcaatacaaatactatgttgttttgatatgtaataaatacatattgtaatgaaaataaacaatttactataattacgctaaacttgtgatattattgtaagaatcaaaattaaatttcactactacctcggattccaaatatcctgggtctacatttaagtaaaattgcacatcataattgtaactatgttataagatttgtttgagatgttaactttttttttctatatctttgttttgattgttgctgactgatttaaagtgttatatgtagaataatttttccctcttatgaaattatttaattggttatctagtctaaggaccgtttgggttgattggccaggctaagccagccctaggcctatttgggaggccaacatgagataaccaataagaggtaatgagtggctcaaactcttccttctctctatattttactacttctagaagattcctcatttcaatggctaggattcttccttgctattttgtcattttgtgaatccaactgctattttttgacaaatcatgtggctaattctggttgctttttgagttttacttttcaattaggtagatgtctatgcattgcaatgcaatggaatttagagtagggataagtctatttaacacccttcaactttttgctttgttaaaaacacaccctcgaactataaaattggtttctaacacactcaaactatcaaaaccagacatttacatcctttagaggttttaggatggttttggtatagctggacatcactttggatgccacattttaaaaagatccacatcagcaaagggaagtgtcccattagtcagttccattccacccctcttcttcttccttcccctctaactcgctctcccctctcttcgtggagcagttaaagttgacagcgagctccatccgtggagagacccccaccctctcggcttggagctccacgctatttcgccgccgttggcagtaacactgctcaacaagctcgagttggaggtgaagatggcgcgggcgacgacaaactcttggtggtggaggccctgcggcatcgactcctccgtcgagttcatcttgggatcaaggccgtgctgccggcacccgtctctttaacctcggcaaggagggggagggggtgggggtgctgggtctagggtggtagtggcgcttggataggaagccatctacgagctccctgagcttgacgaggagagtgccgacggcggtagtggtggagcttgggtaggaggggacggcaaaggcttcatggaggagagaattgaagaaccacaccttggtctcgtactctcgtcgacatcggggaggagagatacctccaaatttcaactagccgtagccagatcaagatacagttgggtcgatccgcatccatcaaccctcaccagagcttgccaataaccccgtcttctatgtgcttggcgaaccctcttcttcgagcttgctaacagccccttcaccaatcacggccaagggagcaggctccgcgtcaagcttgtcaccaacctccctcttcccttgagcatggccaagggggtgggcaccgcatcaatctcactgtcaacctcgtcatggccaccgccaacctccctcttctctcgagcatggcgagatctctatggccgactcaagctcggtgagggagggagtcaaaagagtgagccatggcggcctcaagctcggtgaggggtgagcgagtcgaaagagagagggaggaggaagaaaccactctaactagtagggccagctgatatggcaataccaaaaatgccacataaaatcacaactttcacggagaaaggagaacaactgtattttaaagtagtagagaagtgcatatctcaaagaccaaatatgccacataataatacagctttcgcaatacacatttgctttattaaccactaatgcatgaaagccaacttgagcatgaatcgtttagcttagtttgctggagcctggagacgcaaaatatgatcatgcaaacgttcagaattttatatactgtttgaaggtatgcagttcgtctccacccttgccttctccccttgataatcaaaattccccatttcccctatgaagcacatcttgaccttctccccttgaatcatcaaaatgagatgcagtttccgggctacttttcagagtttacttaattatatgctcaattacattgtgttcatatgtgatgaattagtcgttctgtagagacaaatgggaaggcggggtgagctgcaaaagagcggatgagaaacgctttgcatttttctttcatattccatttgtcatccacactgtctatgtaccctcaaagagaatatatatgcactgtattagctacctacaagctatatcatccacaagtgtcaacctcattcttgaagcaccaaaacaacgcttcagtagatcttaacaaagtacaaactcattatctacctggaggctggagggaatctcccttgtgccactgggaatatgcccttgaattttgtttctcccatttatggtactatttccaaatcttatgccaaaacatgctgtggacattggccatgctgtactgaggaacgcaatgatgatttatgcccccatcctgtattagacaaacttaacgacatactctgttcttcactcatgatggtggtagctcatctgaaatcattagagacaagaagtcaagaacataaaaagaacaatttatgctatgggccaaacggagacatgagacacaagtactgtgtatttagaaaaagggtaattaccatattataaaaagggtaatttcctcgaaaatacgataaccaagga

SEQ ID NO: 63081 - DNA, 2204 bp, Oryza sativa
gtcgagggctacaagtttgatataaagtttgtcttcattagaattcacatgaaaaatttatgaattatttttaaatataaagtctttagaccgtcctatttgatccagatgatattcaaatccaagtttagggaccggggtgacacaactgaacaagttggagaacctaaatgagtgatctgcaagtttaggaaccgagatgacacagtcgaacaagtttgaggatttgaacggtcgatttgcgagtttaaggaccgggatgacacagcggtacaagtttagggaccggtgatggattttactctttttttttaccatttccatttttgtgtctgtcagtaaccatttccatttctatcagtaacaaatcatgaacgattaccgttcggtcggtaacaaatcatgaactatagccagtcggtcaggaattaccaggggcactgtttttcacaacttcacccgtaactgaccacggagtggaaacagcgccaggacaccttgtgcatgctcactcctgttatgcactcgtgacagcaatgaggaggcaccaagcccatagtataggcttgtggaccagaactgcaacagccacactgggatgtacgcagtggaggtgaggctgcacaggcattacccaacctacatggaggtggcaagaaatgcaaagttttcccagaatgatgcatatcaattatcaaagcagtggctcgaccaccccagatgagcatatcagaggtgcggttacgcactcgttgcccatcctatgttgaggtggcaagaaatgcaaacttttgccagattgatggatatcaaaccttaaccagcgacacgatcacccagatgagcattagaggtggagagatgcaatcctcatactgccctgttctaggtgcttccctttggatgtgtgaatgccaccttgccatcctttataagaaatgggatgtgtcaattacggatgtagagtttccttctttctttgggtttatgtgtaatcagatggagagtagaggtgccacttggaataaaaatgacaagtagtacgtttgggccaaactgtgttaccgcccgatgcatattccggcataggttcacaaaggagtgccatatatgggagaagcaaaaatctggtggcatccttttcctttgggttctagttcgggaaccgccagttttctcaaaacatggatttggtttcaggatctggaaatttctagtgacacgtaaggaattttccaacaatttcagttatgggcctaatggacttcaaaccagggattcccagtttcattttggaaatagattctgggcgataaccagaaatttcagaaaaaataacacctagaattgtttgaactttgatttaagaatagaaaagcgaaaaagaaagaaaaagaagaaggcaaagagagaaaaacagaacagttctcataccataaatttctttttgtcagcacatatgtgttaccactgaaggaggcaggcgtttctgtgttggaagacctgtgtttaaagccgaggtatttcctgcttaacatcagagagatgtaaacatcgagagctcacgtttgcttgtctctcaatgaacctggtgtgattaagctcaaatgagtcatccataacaatgattcatgtaggtcccatcggttgcccatattccctaataagccaaaacggcttattagagaataaaactaacttataggtaaaacttttatatatgtgttcttaacaacttaaaagccaatactaaaaaagaactacgttgaaaatattttaaaatcaacttcaaaattaagtttgaaaattcaaattttggctttggcttattagggcaaccgatggggctcgtaatatatgcaagctcatcaaaacagaaacaaaataagagataccaaaatattccctccatttcatattataagtcgtttgactttttttcttaatcaaagttccttaagtttgatcaagtttatagaaaaatatcctaacattttcaatacaaaacaaacatattatcaaaatatattcaatgttaatttaatgaaactaatttggtgttataaatgttgctaatcttttctataaacttggtcaaacttaagaaactttgactaaggaaaaagtcaaacgacttataatatgaaacggagggattatattattgcatgataaattcatagtcttcttgaaatgataattag

SEQ ID NO: 63082 - DNA, 45671 bp, Oryza sativa
  unsure (1)..(45671): unsure at all n locations
aaatgcagatcattatttctcttacaagtgtagtggcatgtttgtgattccatggcttcctcaagtatcaatgtgtattgatgtgagaaggtgatgaactgatgatttaaaactagtcaagataaaattgttcttattgctaaatccatttttattttggacaaggagcagcaggaaaatataggtggtacatggaagtatggaattactggtagtacattgatacttgaaccttcagacattcaagaaaaacaattcactgccaaataagtaagagtagatgaaatcataaaatatttgtcaactcctctgaaaaggagaatcctataaatctatttgattatgctgaggacaaacatattaaatgattatatgtttgggagaaatatattgtattgtgtcagtgtggcaaggccgttagttccatatctaaccaaatatggacttcacttttatagaaatgaacagatcgatagtttttttcccccctgaacatgtaggagaactgcatccctttgcattaaaaagaaagatatccactaaaactaaaaaccataccacaccaaaaacagagtaatgaagcatgtatatccattgcactgcagaagttggatatctttctttgggtcttagaaagatatccactaaaattactggaatgacaactatgttcttagaaagatatccactaaaactataaactaccacaccaaaaacagagtaatgaagcatgttctgaaatgacaactatgttctgaaggccaactataccttcatcatgttctctgtcttcccacattttccaagaaaatttaaaacatggtttagtgttccaacagaaatggatgagagcgaagaatccaaatattcaatcatctcacttgctgttttccagtcacgtatcctgttatgaggaagcagaacaaaatagaatattgagttattcaatgcatcaaaagcttgtaaacaacataacaccagatgtgtgcggtaaaaaggaatttgtttctgctcaacacttgaaaccaccaatatatcacaagtccaatacaagttacatgatgaaagcatggcagcatgccatgatagcctgattatctaaacctacaaacagtgataatgaaaggagcagaggctcactggcaagttgctgtagcccatcaaggaaaatgaaattatcaatgagctacaatccgaattgtgtaagcgaacaaatgtagattgccaatacagtaaccccaacattcaattgattcaagttgtcaattactggaatcgaattaacactacacagaacattccaccctgctatcttaataaacttgaaacttcatactgtttttacctattaaaaacttatcttttatatcgcatggttgcttaagaagaacaagcagatgtttgtaagtgactcaaatggtcacctgattaaaataatcctaaagcaaagctgcacatgacaggtaagatgactgagtcatgtacacctaaaagccataaacacgatgataccaaagcaagtgtgaatgcatattataggttactagatcagcagatgttgcacactgctcagataataataatagacctaagttaccaatttagaattgcctgttcgacttaagacatcagtaaacgtacatggtgcatgaagctattatctcaaaataagatttttggttcaacgggatggattttttcttcatgaattccatcaattgaaggactctttcaggttcgccacccttattgaatgcttccatgagagatgagcatataatggcatctggtggaataccatttacttccatctctttgaacaggtcccaagctctcttccaaccaccttatggtccataagaactaaaagatcagtttaaattcttgagaagctaaatcaattaatcataataacaaaagaatattaccaccagcattataggcttggatcaatgtagtatatgtcaaaacatcaggaaaacagcctgattttttcatagaactgaaagtagattctgcttcagatagtttgccctgaatacaaatcatgttaggatagcaaactttttagagtaaacaacagagaaaataagagcaacacttgcctgtttgatatacgaataaatcaatgaagagtaaacctccttggttgaagaaaccttggagtccaccatgtcctcaaaaaatctcaaagattccgtatactttcctaatttactagatccactgatgagtatattgtaggttacagcatctggtttcacattgctctccctcattgatgtatacaactccaaagctttctcataatctccaaaacttaaataacttttaatgccggagttgtaagcaactgtatttagatcaatacctcgggacctagctgcttcaagaattgtctcaattcttgttatctgcctgcagcgaccgcaggcagccaacagagtacttatggaaacaacatctggctgaatgccatctttctccatttcatgcagcaagccaacagcttccttcaacattcccgcagacccataggcatcaataagtgcattgtaactgactttatttggtttgcatgagttcttcttcatcttgttaaagacctccctagccttctcaggctgtgcagatctaccatatgcattcagtaaggaggtatacgaaactatatcaggtcgtaacccatttttctttattaaattaaaaattgccaaggcctctctatgcatacctcgtgaggcatatgcacccaaaagcgaattatatgctacaatattaggcttcactccttcagcaaccatcaaatcaaagattgctttgcaattttcaacttgcccataaatacaataagaatgcatgatgctagtatatgtaacaacatctggaggacatttggttcttctctccctcattgagttaaacaattcaatagcttccccacactgtccaatctttacaaggcaatggatgataatatttaacgtgaaagtatcagaggtgacatttgctcctttcattatttcaaaataagatattgcttttgagtactgagctccattcttgagagcagacaagacaatgttgtgtgtaaccaaatctggtcccacaccattttctgtcattttcttacacagttctaaagcttttttccagttgccagcagccccacatgcatttatcacattattatacgtagtccgggtaggaggtatctgcagcaaaagtccggaacacaaccttctttaataaacaattatggcaactaaactaaaaaaatgaaatatataaactttgctggttttctaatagtctctttgcatttcaataacgtaaggactgatgaggcaatcaacagtgatgtgtccttgcacaaagtgagtgcatggagccaaaaactttatatggttccaagattctcttcaaattcaacccatattttagagagaaaaacttcaacccttaatcaagcaattttaccttactcaacaaactcccttaaaacaggattgcatttctcgctctgaacctctggtagttgcaaaacatgtttttcctgttattttttaactcttcattattttctttggtgcactaaatctaccatagccattactatgtatagtagaaaacagaaggaccctattgggtttatagatgaaaaattagctcaatatcaagaatggttatagcgaaatgaggaaagcaataaacgcattgtactcattgtaaagaagaagcatttccaaaattatttatctaaaatgaataaggttaaaagcacaaaagttaatgttttgtattacttcgaaaaataaaacacacaaacacatcaacttaggcatttgcaagatgagaaagcaagaatatagggtttatgtttcaaggaatgatactgacagcagcacgaagcatatcttccataatgttgatggcccaacgccattgaccagctcgagaatgagcatggatgagggaattgtatatatcagcatcaggtttacacctaaggttataaatgtcagtattttgtccaaaaaaaaaaagagaaggaaatgacagataatgaaaaatgatatatttcttatcacagtagtggaaaacaaaatatagaaatagcaaccacatggaaattgcacttagtattacacatattacagtttattatgataaagtataaatttcctacatgcgagatcagcaaccatcacttgcgctgttccctagatgatctgggaagattttggatttgcaaactcaaacaaattgaaccataacacaaacatgttatttgtatatagacaagttaccgacgagacaattactcaattatgaggtgataaatttttttagtaatatcaggcaaaactctttttgatggttgaaggaacgcagaagccaaattaaaaccttatgtcagaaatatatgttataacattcataccgccattcctgcatctcaaagaacaggccacgtgcctgatcaacctggttatgcctcgcatatagtcgtatcatcatgccataaatgtcgttacgagcacagtagttatcctgatttttcatccagcagaacacatggacagcatgctgtaaattcccagaaattgtgatctcctacaagtgatacaacatgtgtaagcgcgttattacctgaaaaggctagttttatgttagcaaatcgagagatttgagcctcgtctacaaaatttgcatgtgcagctggtactaccataacaacacagctagatcgattgaattgttcatgatttttgtaatttcaagcaatcgataacattttggccccaaaaccagtttgtcattagtgcctccacgcaaggcaaccatggcagccacattgatgtatatcatcagcaattttcaattcatgaaatgctacagagcgtggggatgatggccttacgcggatgaggagagggaagttgcggcgggcgaagcggccggcccagcagttgagcacggcgtcgacggcgcgggcctcggcgcgcgggagcgcgagcacgcgcgcggcggcctccgacaccttccagtcccgctgccaccggctcccctccacgcgcaggcggtggcgcgcggggagcgaagcggcgcccacgccctccacctcggcgcgggcctcgcgccggccccggtcgtagtccacggacacgggggggcggcgctccgcccaccccggcggcgcggcgcccgggtgcgccagccgcggccgcggcggccgtgggggcgcgcggaccacgcgcgtccgggccggtgacgctggcgccgccgcgtcgggcgtcgcagccggcgaccgcggcggcggcggagcggaagacatcgcggcgggtggtggagggggggagagaagctttaccgttggggcggtgtgagagcgggttttccggataaggggcgatcttttcctcaacagaaaaaccaggaaatgaactccatccgtcctaaaatatcctcgcgaaattagaatcagattcgtaaaacgagaaagcattctgttatatcctagatttttatattttaaaaataagatagtaatttacaagcaccccaatctaaaaatatcaccgtagaaatgcttttattttagaaactaggtgaaaccctacgtgttattgtaggagtttagtattataataatataagtaaaaaataatgcgtaacatagctagacaacataaactaaagtaagttgatgtgatttatgataatttaaatttaaatagtatataaaatgatgattcaagatatcattttttcaatacgattttgtatccgccaaaaagaaatacctggattcggctccgatacctatgtaaacatatgggtagattattttaccctgaaattattacagattaatatggacagacgggaaatacatgtcccgttttcaccccttgattcgatcttacccgtcctattttcaccccttgattcgatcttatccattcccgttctctctctgagtcgtcgtcttcctccttcgcctctcctatttcacccctccctcccccctcctctccaatacagcaaagaactcctttatgcaaacatagcggccgtgataatagggcttttatctaagggtaaatgggcaaacgggcacgattaccatgggcagcctccctccaaccgaagtaccgaacctgcgccgagggagacagtgcttctatgggccggattttgtcgccgtgggccaggtgagcccgctcgtttttgctaacctcgctggttgccgtccgatgcagatcgtgcgctccatctccccgctatttccctccctctgactccgaatccgaatccgtagtcgagtctctccccccttcggcgtaaaaaggagaagagaaatcccccgtctcctccgctccttgcgacaagaacagggggagggagaggcgccgatccccatctgctcgagcaaagcagcggaggggaggggatcctgcaggtgagcagcatccatccacatcctccttctgattcatggattcatctctctctctctcccacccctacttttgtctggaattcgctttgtgtgcgttcgttaaccctagctttctcttgtagatctggaagaagctcatctcttaatttcagagagagcctcaaccttttgatacaagagtaacagtattgggggttcatctgaacccccaaatgtcccaagttggatccgcccctgagacgatggatctggagacggagaatcgtcttgcttctttacttctcgaggaggcgaggaggttgcaggcggaggctgacagggaaggtgttcacgcatatctgcgaaagcccaatgtaaggcaccgtccgaattcgcgcttccttacggccacagttcgtggagttcagcaaggttagcatcgtagtttcgatttatcgttattccatacttgatacctcctcctgttgattgattagctatccaaggcaactataataatttcttagtttcttgactcattgttaatcgtttggtagactttatctggaattgaattattttttatagaacatattaattttattgtttgcccaaaaaaatgtctgttccatgtcttaaaggagaattataggtgtggttaaacacaaaatataaaccaatcgtgtaaaacttacttcctttgtctaggaatgattcgctggatagcaagtaatgacaatctcataagtatagctgatctcatgttgctaattttcttgtccaaagatatcagcggtgttctggttgtctacttactgaattggcatgatatgtgctgttcacctacagcgaaccgtgttgtggaggtcaatgaaatgnnnnnnnnnnnnnnnnnnnnnnnnnnnnnnnnnnnnnnnatgaaaggagtagaggtcttggtgacgccagaggtgaaaaacgcaaaagtgacttgagaaaccagagttccagtccaagggttgaagaagaaggcatagcttataacagttcatattcggatcaggaggatggtctaggggacgatgacattgagaagtttcttcattcgaggtctgtattttctatcttttggttgttctactaccaacattttacacaagtagctatctgcaatgttgctgacagagatgtaactttggtctgctatagggtaaagcgaggtcgaggggccgttggttctaggatggatgagcctggtccataccttaatgttgcatctcgtagtcaagagaacgaacctaatgctgatactcaggtggaagaaaaatgggaacgaagagtacaaggcccggagaaaccagtgtctttgagatcaagatcacctgatgactattggcgtagggaagcactagatggagaaccttccagccctgaactccacaagaaaaaagagaagaagaaggaaaagagttcagagaaaaaggacaggaaagagagaaggaagaaaaaagacaagaagaaatctaagcatcgccaccaccaccatcacaaaagtcggcaaagggagtgattgttctgcttgctgagcataaaaaatgtacacaagaaacatgttagcttctaattgctactgttacttctcacttgaaacatgttgtaccaaaaacttgatatcgtgtggaatggagaactgttcttctcacacggagtgttgatacaaagccatatgttagattttagtgctctcgttggtcttgtgtatttattatcatgatgactaaatcacaccctcgttaattaggaataacgtggttttggtagctaaatgttacagcttccaatcttatctgcaactattgtatgttgtacaaatcgtacaaatcgatcaaatttgtatgctgtctgtctgtcaggcaaggattcctcaattggagcactttggagtccctgtttactggcattctagtttcactttcacatcagtagcccagatcagatattctgactcagaactttaaaacgctgctgatttgcactttgcagtatgacctcatgataatcctccaagcaacatgtaccttcgagagttcttccctagaactttcatttcgaaaaaaaaacaaattcacaaaaataaagagagatttttctctcctttaagaattagtttacatttcctgttcatagcctgataatgcagcataatctgtggaacttcatttgagtatcgatcaaaacagttcagtacccttgctgagagggtgaaaaagaacatagggatgacatgattgttcatatgtagttgcacaaatgtttacaggattacatgacataaaaaaaatgtaagaatgaaaagataatgacctagagtctaccacttctgtttacgcctgaaggcaatcagtggaacgctaatcgagatttatgggctctgtacagtataatgcaatgtgtattgaaggactggattcgacaaaatctatctgcaaaaaacaatgaaattgttactaatcagatcaaatgatcagaagcataataagggacgaagtgaagataagtagtagtaaataggcatgtggaatatggttaaactgatcatgtaaacatcattcacaaacaagcatgatgagcagtgatatttgatagcttaagaatagttgtgccaagcgaaagagacttaattctggaaggttagtaagaatcaaccacatgttcgataaataaaatggtttcaagtttcaacatacacaaagaagttaatgaccattgtactattctagctgctgtcattgagatggtttggagatttcaagtagtcaaggtaatttgtatattttgagaatttttgttgggacctgtaatgactacaaaaaattaacatactcaacaacatgtttaaatttaaaagtgtatagcgaaattgtatcagttactcccactcattcattgtgcaggtcagtcaaagctactctatgaagaaatggcactttagcttagtaagtggctattgccttagaaccatgaggcatatgtctgaacgatcatgattaacctgcctctttcttaataaaagagaatagccaaacctatatctcattgcaaactacaaatagctgaaattttagattgaacaatcgaaaatttgaaatgttgtcagcgaaatactccctccgtcccaataagtagcaacctaggataggattagacccatcctaagactagggtatgtccaaattcgtagtcctaggatgggattagacccatcttgctacatattgggacagagtgagtactcacattgcttagcagtgaaaagtacaaaacataaaaggtgagaaagatagcactgaatctattttctttaagggaaagcattgtgctgtgcaagttcctcaacatccatggctattgagcaacaagaaacaaccaagagaaggacctgaggcaatcacctgcatcaatgaatgaaggaagaatggcccaggaggattcagccaacaacaaaggggctgatctccccgttccgcatgccgcgggctatctcaccggcgatcaccaggcacgttgaaacccagccggcgagcaccatccacaccatgtccacaatgtgagccgcaagcccccacgacatcgtcatcctcgcactcttttccctcaatttcctctcctttccagcctttccctacagctgcttccagggaggcaattccacaaacacctagcctgcaagcccacaaggaacccccaacagtttgcccccccccccccccccccaatcatgagtgagccgacaagatgccatggaggtgaacaagggttagatctatctagttctccaataattgattccatcttctaatcgatgggattgacaaggcacagaacaattacctctgtataatcctgagatggcaaattcacctcaccatgcaacaacagaatcgactccagtttgcaagaacccttcacccatggcagtgattgaatcaggatcttgtgtttcaccaccccagcacgtacaattcttctcctgcttcaataagattggaaaccaaatagaccttggggaatcttcagactcttcagagtgggactgtttccccctttgcttccgccctcagattctaccaaaccatggacggatagatccttaaatttagacggaatcaagaagagataagacaggaaaaataattttttttagaaaatacaccatcaagtttcttgcttgctttccccaaactcttgcctttcacctgtcgctgtcaaactgacccaactgagcaaattcaagaaacacctaggaccaacctgcacaagaaccaactggagactgccacataggagtctctgaccaggaattttggaggagatcctcatccaaattggtttatccaatcgtctttatctgtttggttagaggattagataggggatttggacaagtatacaagtattcttcagttttgtctcatcgtcaattcgtcgaaaaacacctgccctccaggtcagcacagtacattgaacagaaaaggttctactgctgagtaaatgcagattaatcattttttttaaagaaatacagtacagacacacgctcataacatgcacactcacgttataaacgcacacacggacatctcattatcgattggtatgtcatctaccactaaaaaaataatcgatctttgactccatcaacagttgtcacaatataagccattggcttgttgagcttttcaaacccaatcttaaattgttgcaagcatttttttttcatcgttttttttttctagcccaagtcctactcgaaaaataatatcttgttgacttatttatttttgtacagcatgtgagtctttttttttcatttctcatacatattgtgtttgcttccctgagccagttccggcttataagatttgagttgattccatcatctcctctctatgctacagtagctattcttaattaattgaatattgataagtactaataagttctctagatcttttttagaaaaaaagaaaagttctctggattgttgggtcagagactcatccaaatttgggccaggctctgggtcggcctgctgtcactaggccaaaagtcatgatccagtggcccagatcttattaggtccctcactgtcattaggaaaataatttggggaccaggtgaccctgcttaaaaagttgggttatgttcaaagcagggtctcctaatctcctatgattattttccggatttcaagcattgcgatagataatatatagcgggttggtcgtgaattaatctcttgatagcagattgtgtatagagagtgctatagcggctagtatgttccaacatacttcctccgtttgtaaatatttgacgccattgattttttaaaacatgtttgaccattcatcttattaaaaaaattaattaattattaattcctttcctatcatttgatttattgttaaatatacttttatgtacatatagttttacatatttcaaaaaaattttaaataagacgaacggttaaacatgtgctaaaaagtcaacggtgtcaaacatttagaaacgaatggagtattatcttgggtccgctaactttgtagtgctagcagtagaggactaccaacattatagcggtcgccattacggccactgcaaacactatattaattaccttgcttccaagtaactgagctacatgtgtagaagtctaagaagtggatctgaagtgtttgggttaaagtcactatattatttatatttactagcgtataatatccatgcgttagatcagaattaaggaaacattgtcattaatacattctcggcacaacaggcgggtcctttggcccccacgcacaaactccattttttcccttcacaacagtgtgcagggagttgatggtgtgagtgatggatgcggattgaccattcatcacacctagttgtttcatttaaattagtatatgtatacctagaaggtaatatcatggtttaagcatgaccaatgagtttatttttcttctagaaaggtataattaacaagttattactttgttacaataccaaagcgaatcgattttcttttgattcatcactgtatgtacgtagtatgtgctgacttatcatcaaatttacacttgaaaagaaaattgtgctgatctttcaaaaataaagaaaagaaaattgtgcgcggttcgttgtttcaatttgttcaaacaaggtaaaaatatgaaatactactcatcacctgctctttattgcccatcacatgataattacacaccgttgcaagaacaagcatagcacgcgaccataatcattttattcgtttgataaataaataatctagaatataacaatggcgattattatttatcattaaacagcatcagatatcaattaatcaccaagtggcaacggcgcgatccgccgtcgtcggcgcgcgtgtcgaggtcgcactcgtcgcgcccggggagcccctcggcgatggcggccatggcccccttcttgcacgccagcggcgcctcctcctcctcgacgagcacctccaccatggcgcgcagcgcgtcgcagcggcagcgcgccgccacctccctcagctggtggcagcaccgcgcccgcacccccggcgggtcgccgccgccgcaccgccgcagcaggtacgcccggcaccccggcagcgggtccttgggcaccacgccctgccccggctcgcacccatccgccgcgcgcgcgacgccgccgtagtactcctcgccgcccgcagccgccgcgacgacggcgccgaccaccaccaccatcagcgccaccagcgccaccgccaccgacgacaccgagagcttgctgttcttcgacgccattgtcgccgtcaggaagagaaatcgatgagcagtgcaaggtttgggttgttggggggggggggggtggtgagattttagatggttggaaaaagggagagaaatggaagcgtggggaggaagacgaacagttgctttttttgtttttttgaatttgccgggaagcgaagctacgtggagagggcgtcgtgcatggcgcgcgcgggaattgtcagtgggcgtaagggattagcgtccaaattaaacaaaacgaattcatcagtgcatttccagggccgggctgcctacttgcttaatgggccgtgaaagattgggcccaaaagggacctgcacgaatctcaactcgatcggacaaagggtctcatcttttcgcttatacttattcttatcagacaaaatttgaatttttaaacttaaatttggatttgattttaagattttttcatcgaagtttatttttcaatctttgcttttaaatcgctaagaacacgtatataaaagtttaattcacaaattacttttcgtttgcaaatatgtcgtttcgcttattcagcgaaacgatggctccggaagggtttacttactactgggcccgcatactacctctccctttgtgtttccactcaccccgcctataaaaataccgccatttcatcagtatactatttactatagcatttattcatttgtattaaaatatacttatcattgagaccatgtaaagcaatttatgtgacttctaatgtccaagttgtcaacctctattctctcgttttctgcacgcacacttaccgaaccactaaatgatgtgtttttttaataaaagtttctataaaaaggttattgtaaaaatagttaactttggcgtgaaggactaatacttcggtttcaatttgcctcacgaagaaaagggtggatggaggaagaagattgatctgaccggtgggttccatgagtagatgaggaagaagatggagaaggaaggagatggatggaaaatgtgatggcagtggtggtaccaattttgtaaattttcaatggcatggttacaaatagatgaattgtagtagcatttatctgaatcaacatatttataatggcatggatccaattaacctaaaaatcaatacgtactagccctcttggaatcgtctttttcgtactgtaactaccttttactctagttcgtccatttttattggtttgcattgtaaattaaccatccatccttgctgtaaaagtgcgaatctgttaatcctgatgggtgtttaccccaatttgtctaaatttaatatgctagccgattttgatctcaattatcatcttggtcaggagtttttctagatcacggttattagcgattatattcatatcctaaggctctcggtggtacatcgtggtgattggtccctgaaaaaagggtcaacaatggcaaatatgcaatttatttcaaggcccctgaaccatattatctgaaagtttacttggtacgtattatctaaaagtttcctctatatatggttggctgttttttcttttacctttttctgattgcatgttgtccctagggactagtaattatattatatatttcagtgtccctcttgcacaaaggaattaaagaacaattcgagcgggctagtgaatcaacataagaacatcgaagttcatcatttattcaccacatacatacgtttccatgcaaatggaaacagtaattacagtaactacaccacaccacacaaagtagctatagcctagtggccagtcgccgggttcctaagataacccagccattagcaaacaccaccgatgccgatatggatatccacaccgcataatgccaggaggctcgccaccaccatgcatttcatgttgtctctccggcagccagggaatacctcgtccatgggttgcccgtgagccgccgtgccgagctccttgtacatgcctaccaacttgtggctgagcaccggacacctacataagttgttgttgatggtggcgagctgcctacagcagtctcgccagacttgctcatccacgttaccggctgcgccaccgccaatgcactggcccttcaccattgttcggcagcgtgggagtgggtacacatcgagtagtctattcttggctggcaaagctggctgggggtatacaccacctagcagtggtggtctgccattgttgtcgttgccacaagcatggagacaactatcgagagcaacactaagaaccatagtataatttgaaatttcattctccactggcaagcataaatctccctgaattttttggtttttttggtcaaaatttatttaaattcagtcaaaatatgttaaaaattcaaataatttcggtcagaaaaacccggaaatcacaccatattcgttaacccctgaaattacactaccttgtttggtgccattttgtttttctttgtgttgcagaaaattttagttagtctcaaattgtatgagagggtgtacaggtaagcgctacatcaatggtggttttatatgtagctacaaatactaaagtgattccagaacggacacaatttttatcatgagtgagtagcttatggttttgcatgtaatatttattgtggttcaaagctaatctaggcatcatttcgaaaaaaaaaaacccttcgttttatatggaccacactcttttcattttcattcttccatgcaagaaaacaaatgcacaaactgccaacagatatatagttttggaaggtaacaaaatcttttgatctttatttgcatggctttttctatatatagttgatccaatttggtaaacaagaaaaaagataatacttcagaacaaatattgttaagaggaatgctctggaagctaaaaagcatgcagtaaagaaagctgcaacactagattcagaaaattaagaaacgtgtgtttagtgaagaaacgtgtgattatgtcggagtattctgaaacacaagacgcgcacgttcacttaatttccttttattgtgtactctaatcttgagaggactgggcagttggatctaagtaacagagttattttaacaagccacggaattatatagggaagcacgtacgcataatcactttgtcaaaaaaaaaacattacaaattaaaggctagagatattgtgtgttattaccttgtcgtattgcaatttgcatagaaatgttttaagtaaagagtaaggagagcacaagaaataggtctgaagtgtggtaggtttgtcaatttgcgaaggaataaaaagagcgttgttagcttggggagtgagtttaatatctatcggaaatgtattaatttatttttaaatcttggttttaccatatcaattatcttaatcattgtaaaataaactactccctccgttttaaattatttgttgttttagttttgttacaaatcatatgtcactacaataaaaacctcatatgggacttttctagaggagtttacaacaaaaaccttatataggacttttctagaggagtttgtaaattacctctaaaatcatgagttctataacgtagaggcactttgtactttaaaaactgcccagaaaaccttttactctagagacactttttatatattttcaacatattttgttaattcttatctcgtagaggcattttttcggcactttaaaatatgcctgatatgtataagaaattttcttcaggcattttaaactctgtataaacactgtttagggccactaaagggtaagaccctgagcaaacaagccaggcctaaggtcaaacctgtaacttgcctagcatatgtttggttgctacccttaggattctagcatgatgaatcttgcctgagcaagccatgctatctcgctccacctgcctgagtaaaatcaccgcattagtgaaaatgagaccacttcttcctcctcctcctcactgctagcctagggtttttgcagaggccatttcccatcgattcttccatcgctcccgcagcggtgaccaaggaacttgcagatccggtggccagttgtttctttttccagtaaaaatcctgcatttggtgatctgttagagcgtacgctactggagaagtgatctttgctgagtcatacaaaaatcacatagtcccggttcgagtaggaaccgagactaaagatattctttagtcccggttcaaaaacctaggggtactttttgatctttactcctagttgaatagctgttagaccctcaacaaactttagtcccggttggtgataccaaccgaggctaattgtctctctcctacagcatctgttctctctctcttccttatctcctcctcctcctcctgcaaaataagctgccatcaaaccgtcttgggacttattttgtatcggttttaatagttgagggatatgttgtatttggttttccggttgaaagacgaaaatcggattcgttgacaagttaagggacctcagatgaacttattccaaattaactgtaatatatatttggttggttgcttattttttagcctagtaattataaatttcagtattccctcttgcaccatggagttaaagaaaaatccgagccggctagcgaatcatcataagactatcagagttcatcatttattcaccacatatatatgtttccaagcaaaaggaaacactaattatataggtaccacacaagacacacaaggtagctatttcttagtggccagtcgcggggttcataggataactcagccagtagcaaacaccaccaatgccaatgggaatgtctacattgcaaaacgccgggaggctcgccgccacgcgtttcatgtcgcctctccggcagccagggaacacctcgtccatgggttgccctttagcgggtgcaccgagctccttgtacattccaaccaacatgtggctcagcgcggggcacctacagaagctgtcgtcgatggcggcgagctgccggcagcagtcttgccggacttgctcgtccacggcaccgccggcgcactggcgcttcgccagcgcccggcagcggggcagcgggtacatcgggtagccccgtccggcagcgcatagctgcccgggggtataaaccacctggccacggtgatccgccattgtcgtcgttgccacgagcatggagacaactaccgggagcaacaccgagaacactaccttgatgaaagccattttctttctattgttgttgcagaaaattttaattattctcaatcctcaatgagtggttttatatatgtagctactaagactaaagtgatagtgattcaagaatggacacaaaacttttagcatgagtgattagcttgtggttttgaatgaaatatttattgtgattcacagctaatctaggcatcatctggggaaaaaaaagttggctaaagtggattcatatggaccacactctttaattgtttaaacccattttcattcttccgtgcaagaaaataaatgcataaactactaacagacacatagttatggaaggcaacaaaaatattttgatctttatttccatggctttttgtatagtggtccaatttgataaacaaaaaaatgatacttcagaacaaatattgttaaaaagaatgctctgcaagctacaaagtatgcagtaaagaaagcggcaacactagattcagaaaattaaataacgtgtgcgttctctgtatatacgtgcctgatcaagcatatattggagttttctgaaaaacaaaattcatatataagatagctttgatgtgcacgttcagtctttcacctactttttttttttgttgtactgcaatcttgagaggcctaggcagttggataacagagatatattaacaaggcacggaattatatttatatggacataagaagcacgtacgcataatcactttgttgaaaaatgttgcaaattaaaggctagaaatattgtctgctataacttttcccgttgcaatttgcactactaggaaaagcattatcgcaagcggccgaaaagggtcttcgcaggcggggcggccgtccgcctgtaagccaacgactatgaagatcgccgatcttcgcaggcggggaggccgtccgcctgcgaagataattttcgcagacggacgttggctagtccggtccgcctgcgaaaataggaatcgtccgcttgcaaaaaagaaaacttccgcctgcgaagataggtagaaaatattgaaatttaaatataatttggccgtaaattacttttaaattatttattagaaattcttgcaggtacatatattggaatattatcaagcatttggtactgagaaatctacttatattgcataaatcaaaagtgttgccaaaatatatatattacaatattgttttacattgtcacttcaaataacgtcatctagttacattatggcatagcagtgttccactcccgaagatccttgaattcgtcacttgccgctagggcaccctctgggtcgaagaaatctcctttgacatgacagcactcatggtggatgaagtggcacagatcacgctgcacatttgtgatacctgtatcgtcaaagcttgttcgacattctaatcttggcaactgcatgcattgaaattaatcaatatattagtatcataaatatcaagagctgtctagtaaatagtatagagacttacatcctccgcgttagtcctgtaccgtccattaaccctaaggaattcgcacgcataatacccgcaaaggaccgttcctcgcggttgcttgtgacactgaaggacatatcatagaaaaaagtagttataatttgcaattagtgaaactattggaatacataaagtgagtggagtattaccggccaataggtacgtactagcagcttctcccgtgttcgtgtctgttctccacccttgaacttgtagtattggtatgcactgtatgaatgtcataccatttcagagtaaggaggatatttatttgtaatacatccatatacaaatgcaagagtcataataacttactactgtaagattgttagaaattctttgtattgcttgtgtttgtaatcgagaggatccaagactaccacggttccgtctttagggtggatgagtaaacagatataatgatcgctacatattaataacattataattagttagtaacagctaaaataagacatatgtgtacaagataaatgtaccgaacttacttaaaattataagcggccatgacgactctcttattttgaaagtgcaagaaggctcgtccaatgtactgtgcgacagtaatcaatttctccttgtgcaagcccttcttgtattctgctatctctttcggattcttgcccttcagctggtctgaccctggatctagcgtaacggtatgctgtgtttggcagatctgagttggatccaagaagccgatgggttcttttttcttcttagcatccatgtattgcatcctacataagaagtttgttagtagcaatcacatggagttgtattgtacatattttttatctaattaattaaaattcgtactcacatgcaccaaacaccgacatagttgacgtccatcttatccgacgatatatggcgtggagatctgagaaatctagccatacgtaaccttcttcgccgaaacaatctgccggtgatcgagctattatattgcccaagcctttcttgctggcctccatgtagaagttatgtaaccttctcatctcccatggtgcttctttcagtgcccattccggcaagagtgctttcccatgttcgtacttttccgggcaatcatcggttgcgaagtatgttggcccggctagcacagaagccttctgggggtcgtcatctctgagcttggcacgttccttaccccctctgaagacggttagcatgaacttctccttgttcgcatctttggacttggattcgtggctcctaatcactcgtggcacctcgggttctttcgcaggagaagggtcttcaaatatctctggctctgtaccatcccattccaatcctggtacttcatctttgactgacccgactgatgccacaaattccacctctggttctgccactgtaatctctatgggcacatccggcacttgaatctccatggctgtctccggcggtgcaatctccatggctgtctccggcggtgcagtctccatggctgtctccggcaatgcaatctccggtggcacttccggcactggattttccttaccaagttcaggatcatccgccttatcagtcaccttcctcttaggaggcctcggaggttttcccaaacccggtttaggcaacacaggtttttccccggcgtcggtgcccaatccaaagaatatgtcattcttatgccagagaattacaagatcgaccgcatccccaagtacggatataccatctgcagtcgggtagtcaatgtcgtaggactcaaacccttcgtggaccacttgtggctgcaccttggcatacgcatcgggtaagaactgttcattgtatgttctaccagggatagcaatggctgtagcggcctcaagagttttaccggagcgtccaatgggaacgtccaatctgcagggtgtattctccttgaggtcatcgaaggggtaatctggctcagtttctttggtttcggggcgaagcaaaatcatgtgcttcgaccgtagaaatcatggacgaacggtcgacgacgagcttcggtcgtggacaacgaaggaagggccggcgacgaggttcggccatggacgacgaacggcctacgacgaggttcggccgtggacgacgaccggccgaagacgtcgttcgcggccgaggacgtattcgctcgtggacgacgatcggccgatgaagccgttcagccgcgagcggaggggtgggcaacggtggtggaggggccaacggcggcggtggccgtgcgcgcggtggaggggccggcggcggtggaggagccgatggcggaggagagcgagctcgacggtggcggtggatgagccggcagcggtggatgagctcgacggtggcggtggcggtggatgagccggcgacggggctgcctcggtggagcgtggtggacgacgacggtcggctgcggcggaggacgacggtcggagagcgaaggtcgcaggcggggcggcggcggaggacggcggaggcgtgcggcggtgaaaaatttcggcagcctgacggcgccaaattttttagggttcccgcctggacttagaaattttggcgccgcgggcttgcccttatatagggcaaagatcttcgcaagcgggcggtccgcctgcgaagatcttttcaacaaactagtaattgcacataaaaatatttacacttttcaaatattactaactttaaatttttttaactaaattttcacaattcaaatggtaattgcacataaaaattagtacttagaaattaatatgcaaaatgttgagtacaattgttcgtcaatttgcgatacgatcacacatacgaccattacataactactaacttcttagatgtttatatgccactcaacaatcattaccctttaacatttttgcccacaccgtccgtgcgcatgtaaggcttcacggtcttctgagtagatgtctcgacattcttaatcttctgtacaaactgactataaagtggcatactatcatattggttgtaatcttcgacatcttcaaccccatccactcccaatatcttttgtttccctggtagcactatatctttcttcaaatttgaagggtctttcacataaaacacttgtgccacgcgattggcgagtacccaaggatcatccttgtgacccactctcgcaaggtcaacaacagtaagaccgaacttatcaacatttaccctgttcgggtattttacccactggcacttaaatatggggaattgcattgtgtgcccatagtcaatttcccatatttcttcaataaacccgaagtatgattgtttttcaccggcttcatcaattgcctccacacggacaccgctgttttgtgtacaggtcttattatctcgggctcttgtgctaaacgaatatccattaatgtcatatccctgccaagaatttactgtagttgatggaccacaagccaaccgcttcatagttatttcatcggtagtttctccctcaggtaagtctaggtctcgcaaccaatctatgaagagacgcttgtgttctttcattatccactcggtggagcgacccttattgttagctcgtattagttcgatatgttgatcgatgtacggctcgacgatagcaaactgatgaagcacgctgaagtgagcttcttggaatgatttgtgatcatgggtgacgaatctcttctttcctatcgttcccctgccactcaatctgccctcgtgttggggcacaggtactccaattgcatatccatccttgagataatcgatacagcactcgacaacctcttcagtactataatcctcaaccattgatccctctagatgtgcacgatttcggacgtaacccttcagaaccgccatgtaacgctcgtatgaccacatttgatggaggtacaatgggccaagcgcaaccatctgcggcacaatgtgaacaatgaggtgctccatcatatcaaaaaatgacggagggaaacacatctcaagttggcactgggtctcatgtgcgaatgtacggagatttcctaactcttcgagactaatgaccttctgtgacactgcgttgaaaaagtagcacaaccttgtgatagcaacctttaaatgctccggttttatggctcttattgcaattgcaagaaacacggtgagcaagacatggcagtcgtgtgaattataaccagataccgacaaatctttcattgaaactagtcgactgatgtttgatgagaaacctatgggcagtctgacattacggagtgagttgcaaaatgacttcttctccttaggtgtcagtgtgaaacaggctggtggaagatatactttgccattcttttctccttcttgagggtgtaactcttccctgattcccatctcgactaggtccatcgttgattgcagaccatctttagtcttcttcggcatgtccaacaatgttccaactatgttgtcaaacacattcttctctagatgcatgacgtctatggcatgctgaacctccagatctttccagtacgggaggtacttaaaaaatatggaatgcttcttgaatgggggagggagtttatcatctggcttcgaactgtcatcttgcttcttactatcccctcccttcgtattcttctcgggtttcttgcgctttgtcccctttgatggtttcttagtcatttttccaaactcgcaaacaattttctctatcattgcacacacattttctcccgatgtaggttttggtgcaggatcagtctcttcagtaccatcgaactccgccttcatcttacggtacttgtgatttgtgcgtaggaaccgccggtgccgcatgtacacaagcttgttggaacccgggagatacctataggacgtccattcaagcagatcacacatcctgttttacctttaatttgacctgaaactaaaaacattgctggataatcgttaatggtcacgaagatgattgccttcactgtgaagtattcccttaagtactcgtcccacactttcaatccctctttccataaatcggccatatcttccaacaatggtccaagaaatacgtctatatcaataccaggctaacggggtccctgtatgaggatacagagtagtacgtattttcgcttttgacaaagccaggtaggaagattatacatggtgagaagcactggccaagtactatgtgaactgctcatgtctccaaaaggattaactccatcagtactcagggcaaatctaatgttccgtgggtctttagcaaactctctatactgcgcatcaaaggttctccattgacgagcatctgccgggtgtcgaatcatcccatccttcttgcgcccttcttcatgccagtgcattagttccgcatctcgcgggtttgagtatattcgtgtaatgcggtctttcacaggaaggtaccacatcacaagctgcgggatttttctctgtcgtccctcagttgcttcagagggttctaggctagtattgctattcgacttgtaccagcttgcaccgcatgttggacattcatccaaagaagcgtactctttcctatacagtatgcagtgatttacgcacgcatgaatcttttccacaccaagtgaaagggggcatatgagtttctttgcttgatatgtgctggatggtagtgagttaggcctcggtagcattttctgcaggagttctaaaagactgtcgaaactggtatcagaccatccatgtctcgcctttaacctcataagttcaagaactgaccggagtgttgtgaaatcactgtcacagcccttcgactcatcgtacaaaacttcctttgctgccttctgtaaagcttcaaagttatttagccctctggccgaccccatcagcacctcgggttctgcattacgtaacattttctctaggtcgattttgtcctcaacagaaccatcgtcatgcaccatgtcttcaacttgtgtcggaactacattttcaggctcgtccacttgttcttcgccatgacgtgtccatatttcgtacttgtccataaatccgtgagttaccaagtgctccttcactttaaaagcatcgtcaaagtcccaggctatttcattcttacagtcagcacacggacaaattatcttcctcatattgttcttctcagcgtgaaccttggcaataccaataaatttagccacttcgtttctatatggagacaaaaacctcggccaatgatacatccattcccgactttctatatctctaaaaaatacacgtaaaatatttgcacaattaataccaaatttgtagggtttattgaaaaaacttatagctattcaaaactaattaactaaaggttaagttgtaaagtaataaaaaatcatagtttatttcaattttttttacacagacatgccaaattagcacattaggaaaatctaacaaaatcaattcatcggcatattacaaaatactataactattttttgattgcactgaataaatagacatttaaaatttttttctctctctatacatgacaagagctagatctagatctagaactaggtggtggatatgatagcaaaaaattaaaaaacaagaatttatgttaccacattaaaccactacaacaagaggcatcaagtattacacatacatctaacataaacaaatgacaagaaataaaattaaaaaacatggagctcttccttcaaaattttggatgcataaatccatcacaaattaaggtctaaaagcttaaaaaaaatgcatacctagtgtggaaatgagtagatctaagtaccgtagaaaaatcccccgaagatttgaagttcaaaacctcccccctatatttaagtcactttaggagagagaaacgtcggggagaatgaacagggctcggggaggaagaagactatataggggcatctttgcaggcgggccatataagcgtcgcctgcgaagattgatgccggcggggttctggctccgaattacgtgcacgcctgcgaaaatttatcccttacgacgccgaaaatgagattgctagtagtgttgcaccagcccttcccttattttataagtaaagagtaaaggagattaaaaaagtgtcttaagcggggtaggtttgttcattcctgaaggaaaaacgaggccggatttgttagcttggagagcgagttaatttaatgtctttcagaaatgcatttactttgaaatgttggttttaccatatatatccatttacgatcttaactattgcaaaataaactataaactatttgtgatttttttaacttgtcagacaaagtctccaatccatataggtttgttgccattcatgtttataataatatattcataaaaaatatttaaataaaacaacacaagtatatttattgtaaatctatgaatgcaattattcgcatagattatattatatcgcatagattgtatagacctgtgactaccatatgttttttgacacgtcatgaaaccaatcctactgtttgtcagttgcttatcgggtgacacatttgatgaaaacaagcgtaggaataataacaaaactaaaagaagagaggaacatcgtttctactcctttcaattcagattataagtcgttttgacttgggtcaaagttaaattgcttcaagtttgacaagtttatagaaaaaaagtagttacactttcatcacaagacaaatatattatggaaatatatttaatatatatatatatatatatatatatatatatatatatatatatatatattaattgaaactaaattactgttgtaaatattactatatttgtatacaaacttagtcaaatttaaactagtttgattttgaccaaaactaaaacgacttataatcagaaacaaagggagtactcttatttcttactagtaaaatggccgtgctttgctatggataaaagaaaatatattataatatgtaatagatattaaaaattatcgaatatattaatgccacttgcttacttgtttgaatatacagtatttacttgtttgaaccatatatttggactattccataatataaaaaaacaggagcctatttggaaaacagtgggggtggcagattcactaccaccacatctagggacttttatgtacaaccttcgttttgaatataaggatgtgtctatgttgtttatcaggtgtttgtcgaatacttatatcaaaagattcatttttagtcacttcagttgtcaatttttgaattttgaattatttagatatcatttacaagaatctgattacctatgcaatcactgaaatgatgggaatcaaagtaatcagtgcatgaatacttatagtgtggtaccaaagaatggagggagtgaataagaaatgcaacattcaaatattatagatgttactattaattgtcagatcacaaaaaaatacggcagcttattatagagggcacctttaggctgcgattcggccgacatgggcgctctcctcaacaagaaattccctttttccatcatgaaattaaagaacaacgaaggctagctagcaaaccagcaagatatattcagaagaacattgaagttcatcatttattcaccacatatatataaatagatgcttcctgacaaaagaaagcactaattatttagcaaccccacatagtcacacacacacagctaactatagtagcctagtgaccggttcttggggtcctaggatacccaagccagtagcagacaccaccaggcccattggggatgtccacgttgcagaacgccgggaggctcgccgccgcgcgctccaagtcccctctccggcagccggggaacacctcggccatggggtgcccggcctcggtggcgccgagctccctgtagatgcctgacagcatgtgatcgagcgccccgcacctgcaccagccgtcgtcgacggcggcgagctgccggcagcagtcttgccagacttgctcgtccgcggcgctggccgcgccacggccaacgcattggcgcctcaccaatgttcgacattgcgggagtgagtatgtcggatagcttattcctggccgacattgctcaccggggctgtagacttggtggtggtccgccatggtcgccatcgccgccgcgagcacggagagaacgacgaggagcaataccgagaacactaccttgttggaagccatattttgcttagtttgtgaaaaatcttaattaactgtgatagctaggctcttcgtctctgggtggttttatatatagctataaagaccaaagtgattcaagaacagatagaaattttttggctgttcatgagctatttatggatttgcttgtggttctgtatgaaacatctattgtgattcacacgcctaatctggggcatcatatggacaacagatggttaaagtggattgatatgtactacactctttaattatttgaatttgtttgatccttacgtggaagaaaataaatgctatatgtggctatagaaagactaattaaagtgattcaactttgaagaacggccacaaaattgttttagctgttcatgcgtggttagtatgctcttggggttttgcatgactggcatgagcaatttgcttgtggttttgcatgaaatattttttgttattcacggctaatctgagcattatatattttgacaaaaagttggtttaaagtggattgatatggaccacactctttaattatttgaactcattttcattcttccgtgtaagaaaagaaatgcacacaccgtcaacagacatatagtactatgggtaacaaaatcttttgatatttatatttatccaatttgtttaatgacgaaaaggatagttcaaagcaaattatgtttatagctacccgtggcatgattttgttgttatgtcatatcggaagtggtcttgaagtaataacaccttgatgtaatttgtaagatcaacaaagtttcctttgtcttcaaagaatgtttgctaatttgcaaaaggaaaaaagagtattgttagcttggggattgagcttaatgtttttccataaatgtatttattcttaatgtcggtttatcatatcgatgatgttagttatttcaaagtaaacaatactcattgggaaagactctgagggaaaaaattatgcgggatctttgatgaggacatcccagctacacttgacgtgaacaaggctgatggttacgttatacatcacatggagaaatttgaagatgacgtaaaccaagttgatggcttacgtcttagtaagaacgatcaaacatatcatggtccaattatgcacagccatgctaagaaaatacaactagaggtgaactcactctttgctcaacttaacccaaattttaatgagaattttatactacctaaatattctacctttgtcttgctaaggtttacatcggaagacatcattactacgccaagaaggatgggttatgttgaggatgacaagagttacaccgagcaggaattagcccatgcactaccagcagctgtctacgccaacaaaaagttggtttacgctacaaaggctcaacatccaaggcttgtacgacccagccagtcaagttacgggttgcatggcatacatggttggaaagaggggcatgtctagcttccaatgcttcaaaccccatctcaatatcactttccaataaaaagttagagcatttttactgaggactgcgcaggagctgaagggctgtgcgtgaacccgagaaaactttttgcattctcatttatgttagccttgatcaccagaacgtggcttcttatgttcacacctacgctaggaggaatgttcctagtataaatacacttctaattcatccattagacaacttttgttcaattgaaaacctcatgtatgagagattattgaagtctgcataagtcttaccctttttgttctcgtgagttcttttgggcttgtgagaaggatcctcttgtgtcccctagttcgtgattttggccctcgggcctcttgtgtggattagttctggattgtggttctgtaattgctcgttttgacgggtcagagtccaggaaacttcggatcattctcacactcaccacttggtcgcatccaaccttggcaggtataaagctagttatcctctagctacgagtagctagttaccctcttgtgtacaatttatgccggtgctcttttgcttcaaacctactaccgtgaagatcgggtcacctctcgcgattgcgttcgcaacaaccttggttattcgctcttctagaaatacttctatttactgtcggcacgaatcttcacgaaagcaatagcttacatagacatctttaatactatagaggcattgcaaaaatatcgcacaagtgccttttgaataatctctataaatggggaaacattttatagaatgtctccattcacaatgtgatttttctagaagcatttttatgtgtataagagagtggtaaattttaaagtgccaaaaagattgattctcaaacaaagtaaatttgtctctaaaataaaaaaagttccaagcaattattaaagtgcttctaaaatgtgtctctaggctatagaactcctaagtttagagatgatttcaaaatcagctatagaaaagtgcccacgtacttaaagtttttcatgtgcttggagcagtcatcacctcctacctcagctcatgtccccaaattctcaccttctctcttgtctcaactccccacctcccttccttctccttggccggaggcccaatctccgtccagagtgcaatccatgtgcaggggcagcgagctaccccaacttttcctactctctcccactacctaactctccttccatctaagctgaagtcccaatgtttggccagatgcgtagtgacggtgccaacgtcaactcatccaaccatggggacggccgtcaaatttgttaaggtttattttggttacaatctgaaaaaccgtgaagtattttgggattggtgaaaaaccgaggtcatgcataatttcttccacatactttaggaaaatatatcgtaataagaatttctaaaagcattacataaaaaaaaacttccaagaacaaaactaaagaagagaggaacatccattccacttttttatttcttattagtactatcacatacataagaggagaaaattatagatgctacaattaattgttggcgatctcaccaccaaattaaaatagtgcagattattaaagagggcacttttaggctgcgttcgagcgcaggagaaagagagaaatattgtttcgtttttcgcgcgcacgcttcccgaactactaaacggtatgtttttttcaaaaaatttctataggaaagttgctttaaaaaattatattaatccatttttgaagtttaaaatagttaatactttattaattatgtgctaatggctcacctcgttttgcgtatcttcccaatctcctcaatcccctccttctcaaacacacccttagtttgcaaaatccgcactccgtcagcatggatgccatgcctgccatcctctggccgacgcagcccagcagcggtgctattcggtcgacatgagcaccatgaaattcttttttttcacaaaatgaaattaaataacaacgaaatattgctacccaattggcaagatgtattcagaagaacattgaagttcatcatttattcaccatatgtatatatgcttcctgacaaatgaaagcactagttatttagcaaccccacagagtcatacacacagctagctttagtagcctagtgaccagttctcggggtcctaggataacctagccagtagcagacaccacctgtcccattggggatgtccacgttgcagaacgccgggaggctcgccgccgcgcgctccaagtcccctctccggcagccggggaacacctcggccatggggtgcccaacatcggtggcgccgagctccctgtagatgcctccaaccatgtggttgagcgccgagcacctgcaccagctgtcgtcgaccgcggcgagctgccggcagcagtcctgccggagttgctcgtccacggcgccgccgggtgcgccgtggcccacgcactggcgcttcaccaccgcccggcagcgtggcagcgagtacatcgggtagcccattcctggctgacaacgctcgccgaggctgtacaccacctggtctttgtggtggtccgccatggtcgccgtcgcggcgagcacggagacgatgatgaggagcaacgccgagaacactaccttgttggaagccatggctttttgtttgcagaaaatctttagtctgaatttgtatgagagggataggtttaaggtcttcatctattggtggttttatatatagctataaagactaaagtgatttaagaagggacataaaagttttagctgttcatgagctaatagattaacttgtggttttgtatacatataaaatattaattgtgatccacgcctaatgtgggcatcatatggactaaagttggtaaaagtggattgatatgcaccacactctttattaatttgaaccttccgtggaagaaaattaaagaaatgcacataatgtcaacagacatatatagttttgcatgcaaggtaacaaaatcagttcatctttatttccatggcttgtatagtgatccaaattgtggaacaataaaaagaatagttctgaacaaatactttaaaaagaatgctctggaagctgcagtaacgaaagctgcatcactagatttcagaaaattaagaaattaacgtgcctgatgaagcatataagtattggagttttctgaaacacaaatatcatatatatagatagctttacgcgcacgttggataacagggttatattaacaaggcacggcattatatatggccaggagaagtacgcacgcataatcactttgtttaaaaattaatgatacaaattaaatgttaggaatattttgtgctataactttgtcgacttgtaataaagtaaaaaatacgtgaggttaaaatataggtattatgtgaggtggaaggaagaggttttttatttcgtgacaaaggaaaaagaaacaagctagagggttgttagcatggggtgtgagtttaatgtccttcaaaatctatatttatttggaattgttggtttgaccatatgaatgaccttagtttttgcaaaatatactatactccttgtgttcctttttatttgtacaatcacgacatagtctctctcgccaattcattaatttttatcattcctattgataatcatatattcataataaacagttcaatataactacagttatagtcttttttttatgataaatcaatgagtgccatctttgaatattaaatcatattatatttttgcatctataagtgattaaaaaaataatcaagatttcattgcctcctatacatccaaaacagcatctatttgtgaacggaagcaacactttaatggcttaacaagtgatcttatttgtgcagtcagcgatatactctatctgtactctatctcaacaaaggagtatatgagaacccttttgttgtgtatgacatgtaggggtgaaaacagtacggaatttttccggattccggtcatgttttcggaaacggaatcggccggtcggaattttttcggaatttctcggaatcggaatcgaaaacggaaatattttctcggaaacggaatcgaatatgataatagcagtttccgtcggaacccggaaacgatcggaaacattccggaaaaattgtcggaatttccgaagttaaaaataccatagattcaatagtccataattcatccctagcttcccagcccaacccaaatcgcggcggcatctaccctaaccggctaaccctataggagagagaccgtcagactcagaactcagacgcgactcgcgagttggaggcggagcggcggctgcggcatccagatcgcggcatcgcggcgccggcgtgccctcacgcccaccgcccgtggcgccggcgccccaccgcccactgctggtcgcctggccggctggcccccgccgtcctcgctcccaccatctcgcgccgcccttgctcttcgtcgtttcgccgccggccgccgccaccatctcgcacctccgccggcctgctcggtccccgccatctcaaggcgccgtcccaccgcgtctcgccgtttcaccgtcgccaccaccgccgccgacgacggaacaaccaccacaccgacgaggcgacgacgacaccaccactgcagtctcttcctcaccgccaccaacgccgacggctcctcgcctcgcagcagccagcagcccagcggcagcatctgagcaaccagcagcagcaggtgtatatagtgattgactttgcacttttactaatgctctatcattttttttgaaggctaatggaacggaacaagagacagagacagtagaagcggaatgttctaatgaggatggcattgcgccaatggatgtttgaagaaaatgttggtcaatttaattttcaagttacatctaatttcaagtttccatttcaaattagtgtactcctgctgcacaagtggatgagatatgtttgaaccatgtactgatgtgttttgtgattgaactatgttttgtgatgaactatgtatttatagggtgatgtgttttgtgattgaactaagtactgaaacactgatggactgatgtgcgttgctgttctgtgatgattgatgaactattgctgttctgtgatgattgatgttgtgaccttaggtcacgaacaagatcggggataggccggaaagaagtgttttcccgcctatccttagaaacgagctcgaacagcaaacacaacttttgaggattacttttgtattcaagatgttttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcccgggaattcgaattcccctttgccttctctttcatccttggaaaacacctgtgaaattgtaacttgtccaaaatatgtgtagttgtattagcgattatggaatgtccctaaaaaggtgttcttcacccgaagaggtattttctattcgaatgagtgttcttcctctgggaaggtattttccctttgggaaggtgttcttcctcttggaaaggtagtttccactcaaaatgagtgttttcccttctggatacttaggtcttgcaaaacctcgtagtgttttgaccgaattggaggaaaaggtgtttgcaccctgctacaacaagcccctcacgggtaagggcgatgtgtgttttcggccgaaaccgtgcctgagtttatggaaaaagggggaaaaccgccgtcctcctattcggtcgaaacacactattcaaatatgcatatacgccacgtttactattcatttatttttattcttattatttttcatttttatttatttatttattgtgtttttttttgaatgccacgtgccggtatttcattggtgcgctcaaggggtcgcgtcgcttcgggtttcgtgtccgctcgtaaacccgcgacccttaccaccctgcgctatataaggccaggaggggtcgctatcacgtgacccacgccaccactcgtttgctctgccatcaactcgaaatcacaaaatactcgaactaaatctctttcttccttcttccattcgagttttggtgctttgcttgatttcttcctttctcactacacaacatggggaaaaacaagaaaactgcggaaaagtcgaagtccaagaaatcaaaaagccacgaagatacttcttgtggtattggtgcctcttcgattaaggaaaaaaacttaaacgatcttgttgatgttggttggatatctggtcgaaacgttgtaattcgaccagtgggagaatcaaggccttctcccaagctgggatacactcttgtgtttgaggatttcttctacgccgggtttaaattcccatgcagcacttttttggttgaggtcctgaaattgttcagacttgagtttcctcaattgactccaaatgctttagttcgaattgggcttttcgaatggatgattcgaagctgcggtgggacccctcgagctgaagactttgcatacttccattgtactcggcactacaccaaacagaactcgaagtttgggtgtgtaaactttgctcctcatcccaagcgcggaagtccatggccagctgtgtctgctattcgagcaaaatgggggaacaagtggcaatcgaagtggttttatcatcaaatccctctcagcctgctgaatgataaggattgtcctttttcgttctctgggaagaaaccgaaaactgtctccgagccatcagtctctttgtcgccggagttcactgccatacaacctcgaatcgaagaacttgtttcgaaatttagctgccgagacctggtggaagagtttgttcttctcaaaattagacctctttcgagcggctgggatatcactctcggagaaatccccgaaaattgcccttccagtcttcctccatttgtggtttcgtctgatcgtaagtttccttttcgaactgcaaaccttgtttgtcttgaaaaagtgatttagttaagaagatttattttctccctttgttatcttcttccttgtagttgtgattccagaggatatggtccgcccagttcgaaaatttcttggcccttataccaaggatgagcatttgaaatttttgacacttcaaaatgagaaaaggcaaaatcgggtcttcgcctctctaggctccgatatccctgtccgcgttcatcctgaaattgtccccaaactaaagaaaaagaaatctgtgaagccctcttcctctgatgatgatgatgatgttgaagtggaagatattgacgaagaaattggggaagaaaatgctgaagaagaagaaggcgaggaaggagctgatgaagaagagaacgactcgggtgatgatagcgactcgagtagcagttcgagcgacaactcgagcgacttgtctgaatctggtgatagcaaaacagttcctcctcctactgttttagctgatttgaaaaggaagaaaactgccagcagtcctcctcctgaaccgagttctaaacgagtgcaacttgttattgacagtgatgaagagttggatgaagatgatatccgtattgatctttctgctatccatgtcaccccaattcgagctgatgctagttttgccctttcggcaaaagaagtagcttcactgtatgttgttgccccaaccaccacggttgtcgagaaagattgctcgacccaagtgggtgatactgttgagacaacaaaccctcttcgagctgatcgagacttggttgcaaaaaaggcaaaaacgcccgtcagtgcagccgaaaagtccgaagcagggaagagtgctgctgatggaggtgttcgaactacaggtagttcgaacccaactccacctccgtcaccgccgttcatcgcaaccccttccccagagctgatacaaaacgttcttggtggttttagcgaacgatgcgcaaaagatggacattggcttatgggtcttcctaatttcaacgaactcggggaaagtagccatcatggcccaaacctgtgtttgaatgacctaaagtatcgccaccccctgagttcgattggtgatgaactcgagaaagttctgattactcctgatcttgaaaaggagtttttggaagaaaatgatcttatgtcctcttggacagcacttgatgtatctgctgcacaggtatttttatttatctatttatttatttatttatttatttattattattttctttttaacttaaaacctattttctgatgcgcagactgcgagccttgctcgtcttcaacgtggtgttgctcggaaagctcttcgagctctttgcacgcaacggaagaaatcacttgatcgcatcgctaaactcgaaaaggatcgggattatcttcgctgcaaacttgatcgaatggccgacgagaagaaaatcaccaccgatctcgtgcgcaagttaagcggcgaaaagaaagagctttccgaagaaaagaagttgcttactgaggaaaagaagaaattactcgctcatgtaaaagcattcgagcgaaaaatcatcgagtatcaagacgtcgcacgacaacgcgctgaatcagaagacaagatgaaggagcaagttgaggtcttggagaagaagaataaagaactcgaactcgcctgcaaaaatcaaagcgagaagatatctgctttagagctcgagagcgaaagttgccgccaacttcttctgaaaagttgcgagaccgttcgaatcacgttgcgaagtctaggggctgacatcagcttgctatcggaagaaaataccttagcagctgtgggaaaatggttcgaggaattttccattgggctaaaagatagcgttactccctttgcatctcgctgctcgaagactgctgtggagagcctttcggcctgtctgctttcaaatgggtgtgaacactttaccacccttaaaactgatatacaaggtatacttaatgatgaggccaaatttgcacagcttcgagatgcagctcaacccgtcgtaaaggctttccaagtgctttactggaagaagaaaggatatgaagataccctgaggtctctccgagcatctcttgcctcgagatcaaagtcacaaccggccagttcgagccaacaagataaagacagtagtactccgagctcgagcgcacaggtgtgacgttcgtgaaaagaatagttaaggatgcttcgtatgttcgaaaacaatgctattttgctgcttcaaaaccgttatggttgagagcctttattgtaaaaattcatctcttattgcatgcttttcacggaaattccctttctttgggggggctgcatgttaactcgaatcgaaaacttgtgattcgacgcaacaacactttgcctactcgaaatgtgaagcacttagcatttcgagaccctgcaaagctttcttctaccaggaccgccgtctccgatgacgaactcgaagcctgttatgataatacttgtatatttgcttttaagtttttccgatggcaacgaagccatcgacatgacagtttacgtgactttgtacttgagtttagggaacggcgttcgaacaatactcttgctagtaaagccttttggcaaaacttccaaccatccgaacgccaacgtagaatatggaaaaggcgttattcaatagttccatatacagtaatgccttctcctctcaacattgtttatcccgactcttttctttcttctttgtagagtttgtatgtaacttgttataccttcttaacatcaaataaacccttcctttcttcttttctttataaatgctctttatttcaattgttcaagcacccttaggtaaactacgtcctccttatctttggaagaagttacgaaatcgaaacgtactttatctcgtcacgtgcattttccgccttttgagctcgagcgaggggaaaatagagttcgagcattctttagttggttttttggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaacgtattttacctcgtcacgcggattttctgctttttgagctcgaacgagaatagagttcgagcattcctgagctggtttttaggactaaggcaaaatagttcgaaaaccgccgtcctcctcacctttcgaaggagtgacgaggtcgaaacgtattttatctcgtcacgcggattttccgctttttgagctcgaacgagaatagagttcgagcattcctgagctggtttttaggactaaggcaaaatagttcgaaaaccgccgtcctcctcacctttcgaaggagtgacgaggtcgaaatttgctagtcgaaagtattcgactcctagcgtgaggagttatattttgtcgactttgctagtcgagagtatttgactccgagcgtgcggagttctattttgtcgactttgttagtcgaatgtatttgactccgagcgtgcggagttctattagactttgttagtcgagagtatttgactccgagcgtgcggagttctattttgtcgactttgttagtcgagagtatttgactccgagcgtgcggagttctattttgtcgactttgttagtcgagagtatttgactccgagcgtgaggagttctattttgtcgactttgttagtcgaatgtatttgactccgagcgtgcggagttctattttgtcgactttgttagtcgagagtatttgactccgagcgtgcggagttctattttgtcgactttgttagtcgagagtatttgactccgagcgtgcggagttctattttgtcgactttgttagtcgaatgtatttgactccgagcgtgcggagttctattttgtcgactttggtagtcgaatgtatttgactccgagcgtgcggagttctattttgtcgactttgttagtcgagagtatttgactccgagcgtgcggagttctattgcaatcatacacagaggcatgttttttatacaggttcgggcctccattatggataaaaaccctacgtcctgtttatatacattaacttggatatcattcgtatttacatctgagtgagtatactacaaactcgagctcccgtgttctcctttttctctttctctctctctctcctttttttttaggcataaaatttctttaaagaaatagcattccaagtatgctttaactcatcaccatcaagatatgctaacttgaatgctcccgtttctgtcttctttttgactatgaatggtccttcccactttgactcgagttttccaacagctacctcattgagcactttcttcaagactaaatctccttcttcaatcggccttgtctttactttttggttgtaatagctctttgttccttctgtgtatgatgccatcttctccaaagcttcaacccttatttcatctagcatttcaagagttatgtctcttccttcttcatctttttggtcaaatatcattcttggagaatgtgcccctacttcgcttggagtcattgcttcatcgccataaaccaatctgaaaggggtcatgccagtcgaccttactaccgtagttcttagtgcccaaagcactgatagcaaatcctccggccattttccttttgctgatccttctaacctcttcttgatagcttccatgattttaccatttgccctttccacagctccatttgtctgaggatggcctacagaggcaaagttgatttgcaaattaaggcctttacacatgtcttgaaattttccagattcgaattgctttccattgtcacatactatttcccttgggattccaaatcgacatattatgttcttccaaacaaacttttgtagtgctgcagaagttattcttgccactgcttctgcctcaatccatcttgaaaagtattcaattgcaacaatgataaagcgcaaatctcccttcgctcttggaagaggacctactatatctattccccatctgtaaaaaggccagactggcggaattggttgcagttctttgggtggtgcttttgtcattgggccgaacttctgacatgctttgcacgtcttgatgtatttctctgtatctttcataattgttggccaatagattccttgtcttatgacttttgaagccactgaccgtggtgcttgatgagctccacacaagccttcatgtatttctaccaccatcttcatgccttcttcccttgttacacactttaacaaaggagcagtaactccacttttatacaactgtccctctaccaccttgtattttttggatgttagttgtattctctttgcttcttcttccttttctggaagttgtgcactggcaaggtatttcaagatcggttctctccaatctccttctctctgtatgcatgctacttctttcttttcgtaacttggctgggtgattatatcgaaaaatgaattttccaatggttgacctgttgcggctgccttagctagctcatcagcttctccattttcttcccttgttatggcttttaccgttattcccaagaaatgtttctcattcagccttgcttcttccagatatttagccatagtttcctcctttgcttcaaaggatttggaaaagtgacctgctaccaactttgagtcagttttgactattaaccgccgagcccctagcgctcttgcctttctcatagccaataaaacgccttcatactctgctgtgttgtttgttgaaggaaaagctaattgaacagaatacttcaacgtttgcttcattggtgttttcacaactgcagcggctcctgctccggcggcattgcatgctccatcagagaatactatccatggtttttcgacttcttcctgttgttctacctcattgggagtccattctgccacaaaatctgctagtacttgtgactttatggctgttcttgatatgtatttcaggtcaaaaggtaagagttccattgcccattttgctattctccccgcgacttccttgtttgttaacacttctcctatcgggtatgccgatggtattgttatgtcatgcgacagaaaataatgcctcaactttcttgaagccatcacaattgcataaatcaacttttctacttctgagtatcgtgttgttggtccttgtaatgcttctgagacaaagtataccggcacttgcctattttcttcttcttgtaccaaaactgcgctaactgtcgctggagttgctgccacatacattaacagaggttgaccttttggcggacttgctaatgttggcatttcatgcaagtatttcttcaagtcctcgaaagcttgttggcattcagcagtccactcgaaggtgtttgcccccctcaaagtcttgaagaagggtaatcccttttctgctgatttagataaaaatctactcaaagatgccattcggcctgtcaatctctgcacttctcttgtgttttttggcggctcatttgatggattgctgcgattttgtcaggatttgcctctattcctcttttggacaccaagaaaccaagtaactttcctgctctaacgccaaaaacacacttttctggattaagcttaactgagcattttctcaggttttcaaatgtttcttgcaaatctttgccatgggtaaatgcttgtttactctataccacaatgtcatctacgtatgcctcgacattccgtcctaactgcttagccaagacttttcctatcagcctggcaaaagtcgctcctgcattcttcaaaccaaatggcattctgataaaacaataagttccaaatggtgttataaatgatgtcttttcctcatcctccttcaccataaaaacttggtgatagccagagtatgcgtctaagaaactcattagttcgcatccagctgtggcatctaccaactgatctatccgtggcaaaggaaaatcatcttttgggcatgccttgttgaggtctgtaaagtcaatgcacattctccacttgccatttgccttctttactaacactggatttgccagccattctgggtgcatcacttctcttatgactttcgccttcaacaacttttcaagttcaatttttgcagcttgttgtctgtctatagacattcttctcaatttttgttttttgggcttgtatcctgacttaatcgctaggttgtgctcaattagacttctatcaactccctgcaactcatctggtgaccatgcaaatacagccatgttttcttttactacctttaagatttcttcctcaacatgtttttccaagttttctcctatcagaatgaactttccagggtcatgttcatccaactgtactttctttgttttcccttcaggaattggcttttgtatttttatgtattctccctgtttttggtcaaccacatgtactcctttcacacttggtgttccttaaagctcatactttcttcctgcaagctgttctcctcggaccgttattactccccttggtcctgggagcttcatacatatgtagttgtggtgtattatggcctcaaaaatattgattgttgaccttccaagaattgcattgtactgatatggcatatcgaccacatcaaatactatctcttcttttctcacattagtgccttttccaaagaccacttgtaaagatatttttccaattgcatgtacttgttgtccaccaaaaccttgtaaaggtactcatgcatttgttaacctatcttctggtatttgcattttcttgaaagcatcataaaacaacacatccgctgaacttcctccatcgattaacactctttgcacttcgcattgtgctatttccactg

SEQ ID NO: 63083 - DNA, 1622 bp, Oryza sativa
tttcaaacaagtcttttgctgtctttggtctatttctagcaagatcgaaacgaagaggaccgggtagcaatgccctttttgctgccgctatgagcatttcgtcatctacatgcctgatctgacatcttacccttgaaaacttcacgatgaaacttctcaatgtttcccctggaagctgcttcatggcatacaagtcatctgcctcttttggttcttcatacgccccaatgaatcctgctcgaaaggtgtctctcatatgttcccatgaatagattgtcattggtggaatggtagtgtaccatgataatgtactccttctagcattgttgggagtatcttagctttcgtggtatcatctccacctgctgcttcaactgctgtctcatatactctgaggtattcattgggatctgtgtctcctttgtactttgtgatgttggacaacttgaagtttattggccaaggtgccatttgcaggttttgacttaagggattctttgtatctattgctctggtcggttgaaaatagggttgtgtgggctggaattgaaaggcctggttcggtatttgacctgcatattgtatatggttggccatttgtgggatgtacccttgttcaagcatcatctctggttgttgcatatggaaaggggaaaaaccttgggggacttggtgatggttttgagctgcttgagtgtttgttgattgcgtatgtgtgaagttgggcaaagatgtttgaatctgtggtatttgggtttgtggaacttgtatttgtggtatatcattttgtgggagttgtgttcgtgggatattactttgtaggatatgaggttgggggatttggatttgattgggaagaactgggtgggtttgatgtaattgtgtttgaggatattgtacttggttaggaatttgagtttgaattggaatatgcggctggaaagaaatgtgcgtttgaatgggaatttggttttggctagggatcaaggttcgagctaggttctgagtaggaatggtaatttgagcttgaggtgtattctgggtaagaatgggaatttgagcctgagatgggttttgtacttgactgggagcttgggttcgtggtagatcttgagcttgggtggctttggtactttctccttctttgttctccccctgggcatctccttttgcctgatctgattgcttttccctagcccctggtattgcacactgatcacttgatcctcctgctcctactgtctgattgtgtagggtttgcaatctttgtaactctttttgcaattcctcatattgtcctttactcaccatgacagccccttgcgcttggaccaattcagccagctctacatcactcatgggtgttttccctgtttcttccaccaccgcaccagcaattctttcttcttgagttgtttcattacctcctgctgctgtggatgtcttggccatctctgcccactgcttatcaagtgtttccgttgctcttgccaagtcactttcttccactgccttttcccactctctctcgagtgcagctgtcgcgcttgcaaaagctcctgtatagcgtactggcacagtcttctgtccgttgagaacgtcgcatttactgtttgagccca

SEQ ID NO: 63084 - DNA, 3732 bp, Oryza sativa
tttgtattcaagatgtcttgtcctgctacaggtttttgactggcttttataaccagtggtcgtacacgtgagattacatttttacccctgtgggtctttgtaagtttactctaatgcccctgccacatcagcgtctgtgggggcattctagtacatctccaggggtcttttagtcttttaggtgctagctggcgagagtggttgaaggtggtccccacggaatcttcccttggcatcttctcttgttcgagtagtgctcttcctcgaactcttgggaaaaatgccttttccgtcctggaccgtcttcttcctcctgggaatttgaattcccctttgccttctctttcatccttggaaaacacctgtgaaattgtaacttgtccaaaatatgtgtagttgtattagcgattatggaatgtccctaaaaaggtgttcttcacccgaagaggtattttctattcgaatgagtgttcttcctctgggaaggtattttccctttgggaaggtgttcttcctcttggaaaggtagtttccactcaaaatgagtgttttcccttctggatacttaggtcttgcaaaacctcgtagtgttttgaccgaattggaggaaaaggtgtttgcaccctgctacaacaattgatgaactaagtgttgatggactgatgttctgttgttgttctcaaacccatttcctggagtgataggctgatagcagtatagcacctgaattgtgtataccttataggcttataccattctgttttgctgtattcttttagaatatttgttatgcaaattatatgaagttatagaagaatatattttgctgtgagactcagtttgaggggtttatgtattccgataaattttcgttaccgtatccgcgccggttcgttttcgctccgttttcggttttgataatattcgtttccgttttcgttttcggggtttccgatttcgattccgattccgaaaaaaaatatgaaaacgaaaacgataaaggttgtttccgtccgtttccgtaccgttttcacccctaatgacatgcacgcattatcatacatccatgtctactaaatttttttttcaagtttagtttgcacctataaaaattaaaatctggaaattcatttgcacgggcgagtacttaagagaacgcaatgttgaaattgatctccacggctgtcggtatatatttacaaatctcgcgaatttcaacgttacaggccatatagtcagcctcgaaaatgcccatgtaaacgaactagctatcggcggtctacacaaacatttttttatagtgtcatggtgacactcattttttctcaccttgaaaattataaaacaatgaagcgtagcaaggaaatcttcatagagatataaacagaagaacatctgagttcatcatttattcatcatacatgcttccagataaaaggaaacacaaattatttagtaaccaaatcacacacatgaacagccaataactagctacatacagaaggctagtagccagttcccggtagccagtagcagacaccgcctacgccattggggatgtccacgttgcagaacgccgggaggctcgccgccgcgcgctcgatgtcccctctccggcagccgcggaacacctcggccatggggtgcccagcgtcggcggcgccgctctccctgtagatgatcctcagcatgtggttgagcgcatcgcacctgcaccagctgctgtcgatggcggcgagctgccggcagcagcctcgccggacctgctcgtccaccgtgccgggggcgacgcactggcgcttcacgaacgcccggcatcgcggcagcgggtacgtcgggtagccgattcctggctgacatagctggccgggagtgtagaccacctgttcttggtggtggtccgccattgtcgtcgttgctgcgagcacggagacgacgacgacgagcaacgccgagatcactaccttgttggaagccatttttttttgtttgcagaaattcttgattgttaatttgtatgagagggatagaagctctcccatctatgggtggttttatatatagctataaagactaaagtggttcaggaaatggagacaattttttttggctgttcatgagggattagcttgtggttttgaatgaaaattttgttgttattcgtacgcctaatctggcatcacacggataaaagttggttaaaggggattgatatgcaccacactctttaattatttcaacttattttgattcttccgtgcaagaaattgaattaatgcacacattgtcaacagacgcgacgcatagttatgcatggtaacaaaatctgttgatctttagttccatggcttatatggtgatccaaattgttgaacaagaaaaacaatagttccaaacaaatattttaaaagtaatgcctctggaagctgcaacagtagacgtgcctgatcaagcatatatatattggagttatctgaaacacaaatttcatatatagatagctttaatgcgcacattggataacaggttatattaacaaggcacggcattatatatggctagaagaagcacgtacgcaaaatcactttgtgaaaaaatgatacaaattaaaggctacaaataatttgtgctataatcctgtcgagttgcagtttgtgccagccctttttttaaagaaagtataagggatatcaaaatataggtcttaagtgaggggcaagaaagagtttgttattttgtgagaaaggaaacaaaataaaacaagagggttgttagcttgggtgtgagtttaatgtccttcaaagtgtatttgttttatctgatcgatgatcttaattattgcaaaataaacaactcattgtattccttttttactcgtcatacgtaccatctcgacacattaattctcaccagttcataggtttttgtcattcgtattgataattatattaataaaagacagttaaatataacaataataaatattcatattttatttttgtgtatattagtgagttaaaaagaaatcaagattttgttgcctcctatccaaaacagcatttttccatgaacgggaagtaacatatatatcaatagctttacttatattttgttcacgctttcacaattgacatatttgtgtagtcatcgcagccattttttctatatgtatacttcgttgtaatttatttttttgctggcatgcagtatatgacaaagttattgtgtatggcttttacagacgtcatgaaaaagaacagaatgtccaagaagcagttggaccagagaggccaaggcgaacttgataagatctgaaatggactgtgctgctacaagggtggcaaaggggatgctttttgacaggtcatgaaactagtccccgctttcacaattaacaagccacgtaatagaaattactaagaacattacaaaaaaaggggaatttcaagaacaaaataatagaagagaggaacatcgtccattccactttttattacttattattgtcatcagatatatggagacgcagcaatcgtggatgtgaaaattaattagtcggctggctagtgctagctagtaacaagctactcccttcgttacaaaataagattatagaggggaccttcaggttttgcaatacactaatacacaaacgatttttctatactagacttcatgaatttttgcaaacagaccataagtgatggcgtatgcaaaaatcgaccttcattt

SEQ ID NO: 63085 - DNA, 1395 bp, Oryza sativa
ggcgtcttaagaagccgtatgtgaaaataaaatttgaaaattaaaaatttgaaactagtttatctcactcgtatgaactctaaattggatgattctttttcctaaatgtttctaaaatcatactctatcatgttattgtgttctttgctattattttggccatttttccttgtgacttcgttttataaattaaaaatttgaatttcaaaacttcaaataatattttgaagcagtaaataactttagtcgaaaagtcatcaacaacaaagttgtataactcatcaagatctataacttttattttggtcatttcttcatttgatgaagtgatagtaatattttcacaaaatttacatatctctcttatagtttataaaaccatatgagagatatgtaaattttatgaacaatgttactgttaatttgtcggacgaagaaatgaccaaaataaaagttatagatcttgacgagttatacaactttgttgttgatgatttttttcaactgaaatcatttagttttacaaaatgttgtttgaagttgtcataatttgaatttcaaattcaaattgttgaatcaaagtcatatagaaaaatgaccaaaacaaaagttgtatattttaataagttatacaaccttgttagtgatgtatttttcatttgaaatcatttactacctgaaaaattatttaaatttattatattttaaagttcaaattttagatagttcaatcaaactcggatagagaaatgaccaaaagaaaaatggtagatctcaatgatttctacaactttgtttttgacaactttttcacatgagttgatttagaaccataaaattcgattcgaatttctcatatttttacatgcagccccttaagaggttcgcatgcaaaaatctacttagattttttcatgcttaccttttaagtggtccgcatgcaaaaatgccaccccaatttttttcatctccctccactctcttttcccttccaccacttcaattttttttcaacacatctcctctctctctccccctctattatttaaggcaaattttgctacaggacacttgttatgtgtggttttagccccaggacactgcccaaactcacttttgggtgaaaacactccgtaaacgtggtaatttaccagtggacaccacgccgattaaaataatgctttctctcagagcgcgcttgcacggggtggcgtcggtcacggcaaagatggcgaggatggcggctggcggagtggagcggggtggcagcggcggtggacgagcgcgtggccggtggagcggcagtgtcggccaagcggagtggcagcggcagcgaccaagtgcgcgataggagtcgcggcggcgggcggctggcgagagtggcgcacaccccat

SEQ ID NO: 63086 - DNA, 2232 bp, Oryza sativa
  unsure (1)..(2232): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttttactctccccctctctctctctatctccacggatctgtcctctccctctctccccctccctctctgagagcgggtgccggtgaccgtgagcagggacggagatggcatcggtgggcggcggatccagcggcgccgccctagggagcggctacggctacgacgacggcgggcgcacagcgggggcggcggatagatccggcgagtgggcggcgacgcgggcggcggcgccgtcccgcgcagatccggcgccaagggctcttctcacccgcgcgaacagtggggccggcggtcggcgtcgacggcgggtggtggggtagtcgatccggtgatggcgtgcagcggggatacggcgctccggcgcggggctagggttcgggtttgttggtttttttttccgtgattttattttcgcatgcggctggtataagcgaccacatgcgaaaatcccatttcgcatgcggttgcgccggccacatgcgaagagcgtcattttggcagatcttcttgcccatgcggttggcaaccgctccttctcgcccgtatgcaaaaaggggttttcgtagtaacgatagccatactccgtcaacatatacaccgtgctggcgatcctctggccatcgcagccctgcaggtagtgccaccatgcggccgacacatggacaccctccttagcatgacattccatatttctcgtcatatcaaagtttaaagaagtaaagaacgacggcagatagctagcgaatcatcaagacatatacagaagaacatgggagttgttcatcatttattcaccacacatgcttcctaacaaaaggaaacactaattattttaggagtaaattgcattcacggtatatcaacttggcaagtggatacaatttagtgtaagataatatctacgggagcaatatattctaagataatataagacttgtgcaagaggttcttattgccatctatggatgagggttatgcatattcttgccaactatggccttgtttagttggggaaaatttttgagattggttgttatatcgaatatacagacacaccactggtggagaaaccatctttcgtcggtcggccgaattccacaatagtcccggttgcaataaaaaccaggactgttgacgaaaaaatcgaacacaccagcctgggagatcttcttagctcctgtgcaggtccaaaaattgatgagatgcgggcgtgccagtcagtttgatcctgcaactgacaagatatgcaaatagtagatcaaaacagccgaacggctgacaagccgatggagtagttccagccgatgccgataatagccgatgccgataccagccgatagcgataggatttaagcaatcggctatataaaggcaatcggctactgataataaaatataacaataatatagtccagtataaaccaatcggctagcattgatatgatagaataagcattgatatgaaggttagagcatacatcagctggaggtccgatgtcatgacatccacaagattagattaaacagtgaagcctttgttgtcatcggctaaatccaacttatatgtatatgcaattcttatgagccgatgcaacatccagataactcaccggctgaaaccccgatgaaacccttattggcaatcaagaagcaggctagatattatggttctaagcacgacatagtagatcaaacttaactgatacagcactaagtatgaaaagaaacataatatctagacaatcaagccgttgactgagttttcagggtggtagatgtctaagctaatctaatctagcaacgggatttagccgataccggcagaaaccctaaaacgagaagtagtcgatagagctaaattgatatgctaagactagattaacagagacatatgataaataggtaggcaagtatatcatccaaaccagagcaatccaagaggtcgaatgtactgatgcagccttgaacgacg

SEQ ID NO: 63087 - DNA, 8325 bp, Oryza sativa
  unsure (1)..(8325): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaccttaacataggctagcttttttgtgcacttacttgagactagttgatttaggttttgaattgtgcaaaaccattttgatttacgcttccgcatacaaaattcggttttagccaaaagttttaaaaccgcctattcaccccccccccctctagtcggcctccttgatcctacagccaccccttttagttttgccgaaatattgtttcaacaagaactacgaggaagccgagataatgtttcgacaagaactacgaggaagttaagtttccaacaggtccacatctgataataaagagactctcaaggtttgctacctcaacttcttatctcttgaaggttattgatactgaagtgctagctgatagaatgttctatatccaaacacttgctaataccattgtggcttcggttcttttggaggctatcctagctaagctcagctcatttgcaatggacatgaccctatatttttcttgcatgttcatctaccaaagtagttggcagcatggtctcttcatctcttcaaacaagtgcaaatcaggtgaacaagaaatctattttgcttcccttcaatatcccaattattttcttctatcatggataatttgtattcttccacctctagggtaccagccaaaaccagctaaataaaactagtgtatatatataatatgtattcatccttcttgaaagaaaatcacataaatatcatgcatgtactattgtgatgtgttttttccatgccactacggcgcagcagaggctatgtgtgttcagatgatgagtagagctgtcacttggaataaaactgacaaatcaattactacatttcaacaaaaaatctggaggcatattgaggtttggtaaatttctagtgacatatatataaggaattttcctatagcatactatagttctcctgttcagttatgggcctgatgcacttcacatcagggattccaattttgttttggaaaaaaaataatcagaactgaaaaaaattaatgaccatatataattgtttgaactcgatttatgaacgtaaaattgtgataaaaaaattcgaagcctaggtaccttggtttacacagataataatatctttcgagtttcacaccaaagagatgttgaaaccacaatagcttacattttcttctctctctctccatgaacttggcgtgcttaggctcgaatgagtcatttataacaatgattcatgtcatactccatccgttcacaaacataagagattctatattgtttagcaaagttaagattgaggttcaaattactttgatgtctgtcacgcccagaaatttagcccaaaatttcatactattttgtgtattaaatccttgttcaggaattagccagggtacacaaaacgacaaattaatatacaagtacaaacgtaaataaagcgtaaaatacttacagaagaggcacttagttctcacaccaaaaccgaagcagcagcaacggaaaaaggcgatcatagcgaggcttcagctccactccacaggcaaaactcaactggggtctgagccttggtcctctaacttcgtcttcagctcagaagcactacacttctgaaaagggggaataatagcaaggttgagtacaaccaccgtactcaccaagccacaccaatgatgcactcatgcaacgggagacaaagagaggtttgtggctatttgcataaaggtagttgcaaaacattttattgagcaaaatagtaaaactgttgattaattaaggtagtactaaatcttcactgatcaacgctacaccacgttgatcaggcctaaccatcccacctgaactaaaccagttcattaagccaatttattaagggtgagactaatcacggtgaatctggtcgatcgcccattaccacgggcacggttatttgaatagttttactctggccagaggtgcacaactgtacccacaagacacaatccaccggcatgtcaccgtgcccggctggacacgtcaccatgtcgagtgattgtggcaagacccttcatataactccctctgaccaatcgatgccacacctcaggtttcacccctcccccagcaggcagcaggcagtcccccctcgtgccacggtgaatccggaagcagcataggccgtcgcagggcccatccatactcgatcacacccaccctagcctgggtacgtcagccaaaggaaagctatactacaagtcaagcaattacccattcctgcttgtggtacgcgcggtaagtcttccagtgcatccagcgaaccagtccttaatttgctatgggcgcaactagaaaaaccatgcacccacaaaccaccattaagtcatgttttagttggataattacaaccaatgaaacatggctagatgtctcgagcacgcagctcgtcaagatatatactaggtgtctaatgatgtaattatcccattatgtgaactagtggtaattaagtatggataagcatataattctagctaggtcaacataagtaacacaaaatagtcgaattatcacctaagtttgacaaaggacgaacatcaagtaatatggcacaagcgaagaagtagataaaaccctgatcccatgtaattagcatgacatgcaattttatttgcaaacgataaaacatttataaattaggatcaacatgctcaaggggaatgtgtgacttgccctgcttcttcaaaagaatcctctgaactctttcctcgtaatcgcgagcttccgaaacagcggaatctacgcgctggcacgcaaaacaaggaaaaactctaataaaaaccaagtaaacagtatatgaaaagtaaacaaacatgtagagctcaagtttagatgaattttgcaagttgaatggcccaatttggagttcttatgaattagctatgaattttagaagttttgagccatttaaatgaatttctataattattactcgaaatattgcgcaattaaagctatttatggtgtcaaccgaggggattaggtggagccgacaagcaggccccacctgtcggtgactcaaggagccttggcctaccgtggaccgagtccacggaggcacgggctagtgcaccacgtggcgcactcgtggcgccgatggggcaccgacgtgctggccacctatgcggacacacgggcggctcagatggaggccggggccgatccgacggcccagatcggccgcgcgacaggggtggcggcaactggctgcccggcgaggacgcggcgcgcggcggcagcgacccgaccggacggccactagcggcagcggcgcgtcgcgagctggcccaggatgcgaccgacgaagcggagaaagagggagagggaggggagcgctcatcggggaacgacactgtagggaggcggccggcgaagctcgaggcggagggaggcggcggagctccagtgacgagcgacgctcaggaaggggtgtacgagctcggtcgcgacctggggatggggtttaaaggggttagggaagcgcggggtggccggaacagcgaggaaggatggccgaaggcgatgagggtggcggagctcaccggcgagcgagggagatggagctccggcgaggttttcgacggtgtggggcggtgcccgtggtacggcacagtgcaacgacgctggggtgaccatcgtggctcgggatggcgggtaacagtgggaaaacggcgaccggaggcggtgaatgtggcggctgcctcgggtgtgtggtgggaaggtcgttccggcggcgttttggggaaagggaggggacgccaagatgtagcttggcacggtggtggcggtgcagtgcggcggtgacccaagcggtggtggtgggcggctgaacgacactggtgagcggctgaggttggtggcgcggtggggcggcttttcgatggtggtgggggaaaacggagtggcggcctggcttgcccttgcggcggcgaagctggcgatgacggcggagtagagcggtgaagactagagtggtggtggcgcgcggccaaagctcaccggagggtggcggaaatggcggacggcgtgggcagcacgggaggggttgaagggagctcgggcaaatggggaaaaagggagagggaggtgcgggcatcctttttgtgggctcgggtcaatgggatcgtggccgattaggggcggcaacctgcgaggaagtggcatggcgacatggggaggatggtggctggatttggtgggaaggagtggggaaaatgggcgcaggacggacgcgaggtggaggagaggggtggcatctgggcccacgcgagagagaagcgcggggaggcatgaaaaaggtggcagcgtgggactgtttcggcagccatggagccggcccgaggagaaagaggaagatgacacgtggggcctcgggtcccacctgtcggggagagagaggggaaattggcaaggggaggttaaatagacttcatgggcaagcggaccgagggagagaggccggcccaagagaaaggagggaaggagggaggggaaaatgggccaaggagagagagggagagctttggaatagaaggggtcgaaagtgaaggagggggaaataatttgttttccatttaatttaaatgggtttaatgaactttatgctatttaaattatttcttgagctcggaaaattcgcaggaaaagttcagagagtattttagggcacagagaatattacaaaattatttgtagccatgatttttaaaggaaattttaattccctccttatttcacttgattaaattgctttaatttttaatataatttctagaaatgatttatttaatgatttttaatctcgaacgaaaattggggcgctacaatgtctgtgtgtgtttgaattaggaaagatcacgcctatcaatgagaataaatgtagaggttggatggattgggaaagtagtgctgtaaaatctcctatattcgtgaataaatttaaaccccaaatcccttatttttgtagagagagaaataagtatacgctgttaacgaccaaatttggtaaattctatcactattggcatcggaggtgaagatcagattgaagtgggatccaaaatgaagatcattgcggaaatagagtaagagtcggctgcagtccaaatcggctaaggtcaggtcggcagagttcgagtcggatggggctagccgatacagccgattctgataatatgactcggtgtacgtcatcgggttcaagttgatgtgcttcaagatggttgccatgcatggatagagtcctgggaaggcaattgtatctattaattaggatattctatgtaatttcccttgatatatgtttgggcaaaagtctgccgtaaagacttatgttatcttagagtttgttagagataatagtcatgtctgttgtggacgtatcttgtaattctcgggtataaatagacccgagccctatgtaaaaaagggacgacatccaatacaatctcggcgcatcgccaccctttttgctttacttttatttcgatgagttcgtactctcgggttgagctgcatcggtttcgatcttcaataagaggtaaaacttgtcatgacgacttatgttctcaggattagtgcttccatctttatgatactctaatcttgtctatataattcgtcgagttatcatatatctcacataatcttcgataatatctttatctaacctataatcggctaacatctgttaatggaaggcagccgattaggttagacaatgacgttaacttagattatgtgatatatctaccactctatgaaacttccagcggcttgattgtctagatattatttttcttttcatacttaatgctgcatcagttgagtttgatctattaagtcatgcttagaattgcaatctctagcctgctttctggtcgccgattagggtagtatcggagtttcaaccgatcttatctgatttaactacttttattccatatgcttaatctatatgttaaatctgccctttatgttaagatcttgtcgcatctaagtacattaggcttctgtttggtatattctacttactttaatatcttaatatagagtggtatcggagtattagccaatacatgctagatccatttgatcggctatgctataaatgtatataatcccactattaatatatatttcgatctaagtgatttatactgtctcggcaaggcgaccgatctatcccaaccacttgatttaagtatatatcgatataaggattatatatcattaatatctacagccgattgagtagatttagttctgatttgcttattgatatttgccgatcgatgtacgcatgacatcggcttgaaataaatgatatgtcatcggcacctagcgatcggctatcattaaaggattaatgcggtttcttgttctatttcttgtggatngcaggatcaaattanctggacgctcatacatcgaaagcgagtttggacctgcactggagttagcagatctcncaggcttcgtgtttctgtcaacataggcatactcagtanacataatcggttccaacgctgtctatgactgtccacagatgtanntggtatgtntttaagattcnagccatcgtcatcattcttcaagaatgatagctagatcacaaaagagtaggatatgatatggcacattaaccacaaattgaatactaccttgaggggatcgatcgtttgctctaatttgtatagtatatggagttaaataactggttcgaaatacaaggtaaaatggtctaatttttttttccttatgaatcatatttttagaatcgctaccttgagggaatcgatcgtttgctataatttgtatagtatatggagttaaataactggttttgaaatacaaggtaaaatggtcttaattttttccttatgaatcatatttttagaatcgtagagcatataatacgtgaaataattcagtaaataagcagaaaagaacggggctaataatcaaattaagaatcactccagcgcaatcatattttccaaacctatgccccttccattgattagtttcatcaactgaaagtttgatgcagtacttgtggggcagaacatgcagaccaatcaacatatatcaacaggtaaaattatacagttgaatattatgaggttataatttctcagccaaagcttcattctcaaatgaatatatcaaatctggttactcacactataaggaatttgattttttatgactgcaaaacatatttatgagtagacagtcatacatcattaaagagtggctaatctactgcgttcatcaaccaaattaaatcttgtatcaaattgatatgtaatttgtgttcatcaaccaaattaaatcttgtgtcaaattgatatataatttagcacatgttttacatgttattatttctcaatcgaatcattctttgtcttcctatctttaaccatcatctctagttttccttctcaaatcaacaggctcaaataaaaaatttgtgcctcattcaatatatatagtatacattcatctataacattgatttctctgtcttcctatctttaaccatcatctctagttttccttctcaaataaacaggctcaaataaaaatttgtgcctcattcaatatatagtatacattcatctataacattgatttgtaagccacatgactattgataagaaacagatttaacagtttagtaagcaaccctcttgtttttctccaatattttatcacatttaataatgatcttttgcggtataactaacccatattatttcaatcatgcctaaaactagcactcctatatatcactggtacgacataaacacatcatgtgtgcaaagttagctgtatgatgccactatatactatcactgtcatttaattgctatggcatcatgtttatgttccttgcccacttatttgcttcataaatcacatacgcatgaacgctagctactcccgcatgaatcattagctagcttactttattgaaatgcagaacgatcatgcatgtaacatgtatcaatttttatgttttttttagcgcgccaattgatctttacccttctctgccctttttgttttttttaaaggtatcccaccctcggactatctttggttgattggatggaccgacgagatgaatggaaaactatcc

SEQ ID NO: 63088 - DNA, 18993 bp, Oryza sativa
  unsure (1)..(18993): unsure at all n locations
tgtattgcaatttgcatatatcttatgaattatgtcgatcgtcggttgagaatgtgagacggagaaagaaaaacacaactgatgcaaccgtgagagaaacattggtcaggcctagctagaggaagagatcccatcttttcatttatgattatacttattagccaaaatttaaattttcaaccttaaacttagagttgattttggggggttttttttcatcgcagtttattttccagagtttgcttttcgtttgcaatgttgtttggcttattccctaaataagccaaacgatagccccgcaaatctgctgtaattcacaaaagatttgcgcatcactgcgcccccgagcttcaaattgagtaatttttgtgaatggaattcaaatcgagcaattgccaagtctaggccattgagatgccaaaacctttgtttggtgacacaaagtgcctgcctgaccgctagcaaagctaacgcaaatgccaatggcattgaaatggtgagcgagatcattccatctggttatctacagcattttaaaagtttaaattgcaggaatccacttcaaaaccgaagaacccttcaacttgcacgttttataaatacaggaatggatcgatggtaagcctataccaaacagaaagcaacgtgtatgacgcacggatgtgtccaaaagaaaatgtgcttgtgtcctatcacctttaggcaacatatgttgacactcgactgaacatttggaccagaagctttggatgtgcaaaattccgtagccgattgattagcataacacaaaacattgttttcaacattggtccatctggcagcctaactgcaatgccaaactttgatgagggacagtacatgttcaaatgtttaaacctaactagcagccaccaagatgacaaaatttgcattgtttcctaaggtcaaatcaaaagaacaaaatcgtacttcatgctagagtttattgaaacctcataaaacagttttccacaattccaaggtctcgctgcactttgattcttattgattccactacgtgtaatgatacaacagcagcgaccaattctggtatgtacacttctcttatgagtgggaaagaatatattgaaaagatgatttttcaaggactgcaaatttcaaggtggtgttccatcttgcttattcttttggtacacattctctaggcattcctttgctcggtggaccttcgactgaagataaaagctcccagattttgcatttctttcaaataaattatcatagcgctgcaatttttaaaatatatttgttaggatagtcgaatcataatcaaatgatttttttaggagcgctgcgaccacccccccccccccccaaaaaaaaaaagaagaagaagccaagtagcagacctgtgcaatctcttcccaagttgactgctcagatacaccgagtatctgcctagcttcttgctcagtcattgttttgctggctctacgaatgttattaattgtttcatgggccacaccagttttatttgcatctggcagaatataggaggaaaactaacataagtcatccttctttcaaaaaagaataataacaattctcctacagtcaaagatttggcaggaaaatattaagaaaggtcatatttgtcttgtggtggctattaataagtactaacgtatttccattttctgatattcagaagttagttgtgaacatgtttttagagttgtaaaactttagatacaagctaatcagatatatagttggcctgatctcataattatgcaaatcagagttcttagataacacagaggtgagttctgtatcattgtattgcagaggacatttatgttcaaattaggtaaataaaatccaggcaaacaagtaccattanaactagtaaaatagagtttgtgcctttatggtacttctttaaaatctaccataagttaggcaaaaaaacaaagatatccatttcttcataaaatcataaaaccgaagaactgacttaactgcaggtaccaaattgttaaaacataagtggacccaacttgtaagtagctagcacagaatgatattagtaaacaatgaaagttcaaacttgttatgacagttttaagcccctagatgctagacatccatgtatcataaatatgtctcgcatgtgagaagaaatcaaacaacaaatctcatgagcaacaggcaacataaaaccaaattgatattgagggagatagcgttatatgtgtaagtaataccaaaaaagttatagtccaaatgcaagcatctataaaacagggtcatatcttacttggacaatgacaatatgaggaattttaattaataattatttgacaagacaatgtcaatataaggaattttaattactaagtatttgataacatcgtttatggttcattttatagaacttggtgcagtatataacaaaatgcaaaattaccgtccattttagtttttgagcgattgttgctccacgtaagcggtcttttcacaaaagtttgctgatatcaatccacatctcatgtttctatctactcagtcaaggaacaaagaggtagcctctatatacagactgcaatggatgaaaaaacttactatcaagtgctttccggtatgcttggagcatagctcttcctataatcccagagcccatgacaatcaagtttgcaataagcttccctgcctgtaaatcaaaaagcaaaactatgtaaataagtggcacaactcaaaatagcagtagttcatgcatttggattttttttggatatgtatgctttcaacactggtccttggaagggggaggacatttcgcaacatatccaatgccaaatcaaccatgaagcaaagccaatccattccaatcaaacctacgggcacgataccacgccacagcggtcgcagaaactagttaccacaaaataattgaagagcgaagtctctaattatcacaacgcgatgccgtaattcggcagcttgcacagaccaaatcatttgctgatgcggtttgacttcgtttgtactgccaaatctaacaaacgaaagcaaggtgcgatccaagtataaaaacaggcaaatccctgtgccggtttatattcgaaaattatttttcccctggagaaatctggcaaactgagcccccgggatcgcatgctgttcttccactcccctaccccgcgaaaccgcgatccattccctcatgcgtatcgaatcgagcgattacaccaaccacacgaggaaatttaacccgtgatcttacacaggcggcgtgtcgcccatcgaggagccccgaatcaagccaatcgaatccggcctcagcatccacccatccacgggtctctacttctcccaaaacaacacaaaaaaaaaacaaaaaaacaaaaaacaaaatcagagcagcatcgcgcgcgcgccgagcgggatgggggcgaggaggaaggggtgagggatgcgaggggaactcaccatggcggacaggcggcggcggcggcggcggccgtgggattgcgcagctgagggggaggggagcaatggagggagggagacgtggaggaggaggaggggtggacacgcgtggtgatgctttcgcttccccgggctgagcctcgcgtcgcgcttggatcgtccagttgggttgggccggctagcttgttctgggaggttctagagatgaaaggagcggaggctcggaccgggcagggctcaatagcctgtctctgggctcttcgttcggcctagtccattttttccttgctagtatgggcctacaagcccgtggttcagctgaggatggaaaaacaccattttgactctctcaagtactatatataaaatataaaaaatctgaaggcctcatttctttttcgcttatgcttatatttattagccaaaatttaatttttcaatcttaaatttagattgattttgaggattttttatcgtagttttatttttcagcctttgtttttagatcgttaaaaaacgtatataaaaattttattcacaaattatttttcatttgtaaatatgccgttttgttttttttctccaaatagccaaacaatggggctgtgattcgctcaaccacagaaaccatgtatgacatctttctcaacgatcaataccatttaatttgtctccctagacggtttggatgggaaaatatgcgatggaaactacatatgtagtggaaacctgtaaattaccgttagatcgaaaaatagatatctgagattcgtccacgttattatgagtaaaaattttactcgttgtccatttttcgatccaaagacagtttccactgcatttatggtttgcactacatattttctcggtttggacatcattttatgttatgtagcagctacatggcacgctaacatagtcttttaatcaatgtgacgtctacgtggtattatatccactaattcattgttaggttaaattatttcaactcctggttgactgccaataaaaattaaaattctaacggtaattctaagcatgttcaaataagttcccaatcaactaacatagttaagttttttttaaaataaataaataaagttattcctataatcaaattgataatccatggtgataatctgctcaacaatttaccatggtgataatattatatgaatattgactctaatcaaacacatacaaagctactatcaaattaccaaacgatcgattttggaaccaatccaattcagacctcagtcagatcaatgagtcagcctctcaacgcttagttacacacattgcattacgagggtgatacaaaaacaactttgctgtggtcaatcgaatctggatatcttgaaaattactgacatacatacgctactggaatactactactactactactactactactactactactactactactactactactactactactagttcttatctcggtagctaggtagaagatcaagaggacatcaagcatccaagttactacagtattcaagctgcccctgatcgaagcaaacatatacaaaatggacgcacgcacgccacactctcgttcttggctttctagctgcatcaaccaaatctttcccagcttcttgatgatgagtcgatcgacttgattcttcttcttcttcttcctcctcctcctacgtcttctgatcgatcgatcgccattgctgtctggcaatttgctgcagctgtaagtgagtacgtcagtaacctaggtggcccatctcccagttcagcttcgatgccaccctgtcgtggtaaggcacgtactcctgcagcagaaatgttcatcagagtctgcaatgttcagaggtctgcaatgcaagaacctgaaagtctgaaacccaagctcgatatatcgagtgactgtcttgtcagtcatcgtgtacctctagcttgtccatcagctcctccgccgtcggcgccatgacgatgatccgccgcgcgctggtgttgatgaacccttcctccaccgccttgtcgatgaacgtcagcagcgagttgtagtacccgtcgacgttgagcagcccaacctgaagaacaagacattcagacatttttttcagttattttgcggttctgaactttctgaagaactctgagcatgcagtatgtaatgtaccggcttatgatggatgccaagctgtgcccatgtaatcacctcgagcagctcctccagagtcccgtaccctcctgcatcatcaacacattcccatgatgaactctgaatgaatattcggtgcgcacacacagcaagatgctggacagataattttttcagtgttcatacatccatctactactactcatcagtcaaagaatcacttgcagtggtagcttagctagctccaattattggttacactagatagaaagataggtagccccagctttctttttttttttcttttcaggcatgtatggtgcatgcactgttcagtggcagaagttaatttcttgctcccatcttgctgtaactctctctgtcagggacttgaatgttctttttcacctgatccagatgagataaacttgcagactatactactgtactatactacaccatgttagtagcacagtaacattttctgactgacagtttgtaaagtaaatctcaccaggtagggctatgaaggcatcagactgccttgccatctctgccttcctttggtgcatatcagcaactggcctcacctcccccactgtctcaccacttatctgccagaaacaatgaaccatgatttggtttttgcaatcagcaatcatcctgagcaatgcatgcatgataaaatgcaaagctgaacagtaaaaagagtttcttggcatgccatgatactatcatactgtgtgttgtagtggtgatggtggtggtgtatgtgcagtgcaggcaaacactagtaggagtagcttatacattcccaagagggcatgattgtgctccaaggggagcaagaaatggcacttgatgatttaactactactctttgcctccatgaagaatggtaaaagggccaggtaggaagaggaccacaagaaattgaagacaggtgagtatggatggccagctttaatttctttgtggcatgattatggatggtataggtatagtgacatggtatacaggataagcacaaaaggtacagagtcattactactcccatactctatcacacattatgggtcaattatatacttattttttcttaagaggtttcaaatcttgcataccccaaaactcttgaaattatatactggctgatacagcctttgtcccaaatagtaactacttttagactatgtacttgaacaaacactattgttattctagtgtatgacaaccgacttagccctcatttacagcaagaccagtaggctttatccttctttttgaacaaaataattgtactagtaatatactagtactgtgaacttttttctcccaaagtaatattttttaacccaaaaagaaccttttttttttatcaaacttcacacacacaacaagaacattcctctgggcaagacaccataggcagtcaaagacagtgccctctacttctacacctctgcctataaacaacaccctgcttctgctctagcatcaagaatgcaaaaaagaaaaaggaaaaaaaaaaggtcctctttctctgtagaacaggatgatgccacagcaagactttttggggttaaggaaattaacatctgtaaagctgcatctcggtgagttgtttaatctcacgccaagatctggatttgtgcccctgaaactgaaagagcatgtagcccttgatcacaactgctcaggatttattctttttttgcccaagtgccaatgtcccctgggactccaacaacggctggttcatggggtccaaactcccaaaccccccatttgattatattttctactagtatcacttaaccaaaaaccttaaaaacttccaaaagatgagctcactgccatgattgggttcgtgacaacgcaagtactgctacgggtacaagctgaagtggatcaactcaaggttattaaaatctcgattctattaactgtcatacgattttacgactttgtaatcctagttaagatgtctgattttacgattctatacaagtagaatcttcaattttatgtttttttaatacatacgattctattattcgatcttagaacttttgattctattcagaatcacaaatttaacaataatgttgtgattataactgaaggtggaaaatagatagggcccaatcgtcagtgactcgttcggggcagtttgtgtgtatgtttctttgtgtgcatagtgacttacatgccgatgagaaccaacaatacattattcctacataatatactccctccgtcctaaaatataaaaagttttcctagtacaatgtatgtccagatttattgtactaggatgtgtcacatctatccaaaatcactcttatattatatactccctccgtcccataatatagcaacttagacatgatgtgacacttcatattataacgaatctggatagtaagcatgtccggattcattgtactatgaagtgtcacgtccgctactaggttgttatattatgggacggagggagtagcatataggagtacggtaactttgttgcaggtagacacaaaaatgagacgtacctctggcgtcatgagagtcttgggaatgaccctgcgcgtggacaacaagatgacaaaaagaagcgatcagcacaagaactcggaaacacaagctactagctagaagtactagcatgcagtaattaaaaactgctaaaactatcaaacaaggagagacacattctcctggggattcatgcagtaattagtactagtagtaacagtgtgcagctagcatggaggagtggagtacccgatgacgtggcggccgccgtcgaagaccgcctgagagacgagccccatgaggccgatgctgccgccgccgtacaccaggtctatgctcctcgccacctgcatgcataacacacacagattaaccaactaaccgcacggttaaatttcagttccagttataactcacgtacaactacgggagacatgcagccatagattaatcaaaagaaaacatgcttttaatgtattttagagccgtttacaaacgtcgattaaattcagtcgtacgtgagtcgaacaggtgggtcgtgtgcactcaaaaggggactagtatgaattaatgattgatcaactggggtagtaactaataagccggcaagatgcggtccaagttactatttttcttggattaattacccaacctgctgcagcagcagcatgtagcagctcatggcgaaatggtgattgatcgtctttaatgcgaggcgacatggatgacgcaacagcagcgatgctgagctgagctgatatgagctatggccgcgaattatggcgccgtgaatgcagtaggacccggctcggctatggaccatggaaaatttcggtcggccgccgcgcatgaacagatgggacggcgacggggaggcaggaggaggaataagaagacgatccatcagcttggtggaagaagtcggcgtgtgcagaaagttcagaaacgaaattcgctatagcttgcttgctcaatgagcagtggtagtagcagaggggattgtttggcaaaaaaagtctgcaacttttgcattatatttgcagaccgatgaactgatacggttatagtgacagactgacagtgaccatggacagaggagaagaagaagaagaagaagaagaagcatgtgtaggagtagcatgcatggacagagttagagtttaattaccagctcgttgccgagctcaatggcggcgtcatggtagctcctcttcttcccctggctgctgccgcagaagacgcaaatcctcttgaacctcgactgcctcatctctctctcctctactattctcttctcttcttgctactctctacgatctatctaatccttgcagtgaaacagctagctagtaattgcctgtatttatcaccctcctctcctctgcccttagctagcgtcgtcgtcactgtgctgctgctagtgcaagcaagcgcactacgctgctgctgctgcaacgacgggttccttgtgatcagctagcaatctccctctgagctagtagtgcgccaccatggctatatactacataaaagtgggagaggagagaggaggagattgtagtgatgagttttcactttccggcgaaatggacgggtgggtgtgtagtacgttgattactggggttgatgtgtgagtccgagtcaccttatcgggattgccggtgcaaattggcttcaaaacaggccgagccggcgaaggttgctgctagctactgtatatccatcgtggggttcatctccatttgcagggtcgttttaggagaaagctaagctagcgcctgcttatacaattatactagtgcatgcgacggggaaaacgcctattacaattatactataattagatttaaaagtttttcctaaaaaaacttacggcatttttaagatagtccatattttttttcttctctttactttttgttattacctttttatttgttacttcctctgtctgaaaacatagcaagtttgttttagcctttaatatgagttttaagaagaggtttaaaaatacttgggttacctcttcgaggtgggtgcggtacaggctcatactacttagaagttaggactataataaagccaagtgatagtagagatagtataggtagtttagtgacaaaatttgttatgtttgaaacaaaaattgaaatagaagttgttatattttaatacggaggaagtactgtatttttaattatatggtaaacgcactcgccactagatacatgataccacacacactgggaatatgttcctaacacacgctaaaaaagacggggaccaacaacacatttttgacatcactgaaatcctattgaaaacccatcttattcgtgcataatatttgtggaaattaggacttaaatattaatagttggagtaatgcacccacgacttcattattcgccggtgcatcgcttactatttttgttcttttcttactaatgcaactactttctattaaataaaccatataacatagtggaatgtttcatattgatacaacagaaaaaattataagactagccttcgaaaggtataatcaagaaaaagacagtcatgccacgcgtctatgatagaaaagcccactactgagagacaacagtaagacatcccaactgcactcaagacacttttgggaacaagagggggtgggcgagagaagaatggatccactctcctatgtacagaccgctaacatggccatcttgtggtgaacggaagcgcctccaaaacaggataaaccgtctgaagcagagattggtgagaaaggacctgtctaaagcgaggacgtagttttcacctgaagaaattaattccctagggagggaaggaagacgccaagacaacaaccccaagaaagttacggctccaaaatggcatcaccgttgtcggccctgaaacaggatgggctttagcctggagatcttccagctctcccatgccactatctccccattgctaccatcttccatcagtcaaagaccgtcgtgccatgctttcaccatcgctcctccacgcccatctcctgagaccactgcgccataccgtcatcaccaagagccaatttgttggagagacattgggtctagctagtctagagaataacatcggatcctgccttggagctaccagatccgacagctccttccaccctctccactgccacctgccactccaccaccccgccatccgctggccctctcactagatacggctatgaatggtctagatctgtacgaccacctccaacctcttggtcacctcaatgcccgaactgaatatgctttctcggggagaaaattcatgtcgccgctgtccttatagccacgtggcttgtaggtgtgcctctcaaacagtggctaggcattatagaggaacagagggttggtggctatggtcgtcgcttcgtcgtctcccgtgtcatctctaggattggatgtgagatagaggacgggtgaatgctactactaatttaatccttagaataggactttgtttcaagataaaagataagagatgctgatttgcttgacatagctagaactcaattaaggctttagttattcatagatagctccacacaaagcagcatggacgcaaaatagatgttctttctgtctgcttactaataaatacttagtacatcaacttgcgtagctgcaaacagttgcacaggccaaaaacacggctaacagtggacggcaatatggattattacatgatcaaaaccccacacaattacgtgcatgtggtgtgcgcatatagtggtttgcgtgtgtgtcttctgtgtaatcgataaaaaaaataaaaaataaataaaaatccagcacaagcatgacagaaagtgatatgaatatatatatatatatatatatatatatatatatatatgatctatcatttgtccaagcttaatgccatatctgatctgcaccaatcgtatctctactgcattttttttctcatttttggttgtgcagagcagaggagttaattgactccacagtttggttgctggcgaggctggtgcgaacatgccaaccagcagcagcagcagccacacgccacgccatccgccaagacagctgttgatgggcgcgggccggggcatgtacgcaatgtagccgtgtgcaggggaggcgcgcgacaccggcatctgcatgggcatgcatcgtcgcggcgcgcgcgcacacgaggtgttcggcccgcgtggggcgccgcgcgcccgcgcgcgcgaggcgcgctgcccgctacggccgccgcgagaggggcgcgcgcggcgcggagaggcacgggcaccgaccggcacggggtgatgggggtggcgcgcgtggcgttgcgctgcgtgtggggctccgtgccggcgggcgcgcgagagttcgtgcccgaccgaccgcacggcgcgcgctttgcattggctggtgttttcggtctcgacgcgcgcgtggtccggcagcggcatggcgcgcgggcctgcacgttgtcttgggaattaaaacaaaaaaaaccaacacatgtagtataaaacccagggtgtaccaccgtacattggtcctgaactaggttgttctatgtctctttgttattatagatcgttttgattatttttactagttaaattttttctaggttcgattaaatttgtagaaaaatatagcaattttgttttaattttcatattcatttttttatattttatcaaaatatataggttccaatgttatatttaataaaacgaatttggtattgtaaatattatttttttatataaataaagtaaaaaaagacttataatataaaatggagagagtgctaacttatttataatctactctacaaaattcagagatgtggtacatagggttagaattcggagaagtatgtttcctgacagttggttagttcgatgctcaattagtttagctctacatgttgcatgcttgcagtactgtacttactgtagtgtagtattgcgcgttgtcgttggccgtgtcggtttcatgatcgatcgatgcttgtttgctaagtcactagttggacaacttactaaccgaaagaggttaaaaaatacgattaacttgcatgcgtgttagcgttcggtgccggccacccaagcacgcaccgcacgcgcgcgtgcccgttaaccggcggcgcatgtacgtcgccgagcctgcgacgccggccctgccgtacgtgctcgtcgtcacccggtgaaaagcggtctccccctgcctctatcaatatcaatagaatttcgcaccgtctcgtgcgagtcgttcaaaaaagaaaacggtctcccccacgagcaattttacagttcttgaaaatgtatcattttttccattataaatttgatacctcttgatatgtaggtactttttctgtttcacaatgtaagtcattctaggtatttacattgtgcttacattgtgaaacggagagagtagtaggtactataaggtactaaattttatactaaaattttggtatctctttaaggactgtaaaattactcctcccccacatttagagaaagtttgtagcaaccatagcttattataaaatctttggttcagtttagagaagcttaagattataagaatccgttggttggtaatcaatttgaatatgaagaagttgggttatataactagtttcttttctgaattatataactagagattcttggaatcttaataagaatccggactgtttgggggaattggagcatttgaaagaagtagcagtagctagaagctctttcaatcagggcctctagtttctccgcgcattaatttctcagttgcattgaaaaaaattgtagtagtagaattcacaaaataatctagatgtcagaaactgacaaatccagattttcgctgactactcgtaaaatactcataaattaaactgctttgaattctctaagctcccaaacagaggacacctctttgttttttggggggacaaatgttgatccttaattatggttgcagcaacgcaatattttcaaagtaattctctacacgctgcatgcaagatctaatagcaaatcaaaacaactaaaaagaaatgaagacgatcgatcggagatcggattacaccagatagccggaaggagagaaaggcagggagcttttaacatgcacgcagcagcaaagcaagccgcagcaggtgatcgatatcatatcatcactaattaatcctgaatttctgatacccctaatccgatcctttacatgagcttaattaacagtggaatccacaaactctcatccaccacttacaaagttacaaaatttttatattccacgcaactgtggggaaaagctactagcatcgctttctccccacggtttccattgctagctaatgacgcatcagaatgaagtataggttagactattaattaaataattagcactccatattataatttgggacactgctgatgtgccttctgacagccggccggtcggatttgactgtcatttgaccagcctctagctcctaataacatatgctggccctgatgcatgcctggatgcatgcctacatggctacagagagcatgcaaaacaattgatgctttggttggttagtgatcggtatgtccatccgtaaacaagaagttacactctgacactgacactgtctgctcatttggccatggagctatagcacgccacaagttgccaaactcacccagcagttgagagaaccaaaaaaaaacctactttaggggtgatcaggggcgtaaagttttaacatatcacatcggatattatatagggtgtcgtataggtggtcggatattaataaaaaaattacagaacccatcagtaaactgtaggacgaatttattaagcctaattaatctatcattagcaaatgtttactgtagtacaacattgtcaaatcatggaacaatttaggctcaaaagattcgtctcgcaaattagttgtaatatgtacaattagttattttttagcctatatttaatacttcatgcaggtgttgaaacgttcgatgtggcagggtgtaaaatttttatgtgggatataaactgggccttagtcttttccaatcgatcagactaattaaggctaagactgtttcagggaagaggaaaagaaaagattaagagagtatgtaaaataagatagttattaacgcatgattaattgagtattaattattttaaatttaaaaatgaattagtatagttttctcaaacaatttttctatagacatcttttttaagtaagcgtgcacacaaaaaattaagatggtagaaaaaaaagtagccggaaatctctaaaatgaatccgaaaatcgaattccgaaaaaaaaatactcagaaatccatagaatgaagccggtgcatgtaactcaatataataccatgaatcgacacgccatatatggcccgaaaagaaacatggagatgatgggagaaacatggacctccaatgatcaaggagtagggtgaggatcaaaggggatgggtacccatccatggcccatgcacacccccactcgacacctagcttggcaaccactcctaaaggaggaggaagaagatggtgcatgatgatgcatgagctagtcttattctatgcatgcgttcgatgcctgaagatggatgatgcagcctcctcctgcgttgcccccctcgtgccctagggatgggagacatatgcgccttttcggtaatgctgcgagtccaacacccactcggccaccctcccctgatacctgtatgaagttagcttattacgatccctttccatcttaaaataaatcaatcactggctaagaacggtcgtagttgatcaccatttcatcaccatcagtgaaatgataaattaaacaagcatactattttcattaaaaaaatcgatttctaggaacgaatctaaacttagactacgtttaaagatttataactagaagttattttttaaaagaactgagggagtatgtatgcaccttgcgcctctatacgggcatactctctctgtaaaaactaaaaaaagaacaaacctgagtttgaatctggacatacgctatatatgtctgatttaaacttaggctcagtttttttttcgaagggaatatgcatgatgcatacacctgctatgagttagatcaatccatgcatggccgtccaattgtactgtggtgccatcatcatgcacccatatgcactgtatccgagctggtccaaaacactaagctccctgatcactggtcccaaacactaagcccctgtttgggacgcggtgccttagtcttttccattagtactttttaaagggattaggctttttcacgtaaaactattaggggtttctttggaaaacaaaaattttacagaactttaacatgaatcggttcgattttcatgaaaagcgttcagaattccttaattcatttcaagcgaggccttatgttttgaatgaggcataaaacgaggggcgggtatacatccccttaggcattaagtgacgaaataattttccatatatttttttagataataagaaaacatatggaaaattttccatgtatatatatgggcgtggttaagaagttcttgtattatctccatgtgaattgtgaaggctaattatattggggctttaggatttactacttctcaccagcatctctttttctttaaccttggacagacagtaaggaactcccctacggtatattaagtttccttaatataacaaagtttatttacaaagtaaacaccagcatctcttgagtgacgaaatcctaaaataacactgcaaaaatgagatattttgtggtacattaaaaaaaacaaagagctagctagctagccagatgatcaccagtacattgtactgcaatctttttgtttgaaccgtgcacattgtgcaatctacagttacaacactaagccgaaatcaagttggaacaaataataagtggacaccggaaatacttggcacatcaactttgtggagcatcatatcaaggccccctgattaattaagtgaccaattaagcatttggtgtaacctagcttgagtcacccaacacaaaacacactgggaccaaccattagctctcatgggtaggcatattggatccaattctcgattccgattgtttaattagtttgatccctttcatgtgcttttattattcattgccacgaagattgaagcttttaacacatctttgccatatatagtaaggttgtttatatatgcctgctagcttaattaattatttgccataagccatagtcagaatttaatttttagaacttgaagttgatttttttattttccagcttagacttttaaattgctaagaatagaaatataaacatattaattcttaggaaaatgattctatactcctaggattacgtactcctgttcttattctaaatttatactaggttgctttgcgtttatttttctcggattacaagccatagctaactcagtcaatgacagctcttgtacaacatgttgctagctgctcgttttcgatggtcgatttccaatggcatgaacatatataattaaggtcttctttaggcacaatgagtttaatttaacggattaagatcgcacttccaccgaccaattgagttgaattccttagaattccaacatcggcacctgcttggaatgatttggcccctagtgtgctgggcactataatatttgaaaatcataagccccaggaatctcccaacatacatgcatcacccttatctttctctccctgccaagccttttttttctctctctttttgtcttgctttcttccaaatgattattatttctccttgtgatgatgatgagccgacagtgctcaattgagctgttccgttacatgcccggaaaaagagctgttggttatatggactgagttcctcttacgtaagttatgtcattttagagtcagaaccatgttgtgtccatagtaaagaaacatggacatgttagtgattcaaagtcaggatgtaaatccgttgttcatgtgtattggatatgccttcaagtaaaaggtagaacaaggaacgggatatgtatgtttcagtttctaaaagaatacgagtgatgaggaataacaggttattaaaatagttgcacaattaattaatattattgtctactacctcctttcttaaacagatatcattctaaattgctgtagtcaaagctataaaccttaaatgattaattaataaaaaatatgaagatttgacatgagaaaatgatatggtatatttgatcatcaaaagcaatttcatataattatatttttaatagcttttagaaacatgtagttaaaaagtagtgataaaatatatatgtgtgttggtactgggttgatttttaaaatgacaagtaaaaaagaatgcaagaagtaatagataaacatagagttagttagcaaaggatggaccatctatagacatggcgcacataagggtacgggcgccaaaaagttaaatgatacatctctaacgagatgtctaaacagtaaccatggtctctcatgcctctttgtcttataaattttggaataattaggtgccttgtcccagtaaggattagagtttctttttctggatatgcctataaaggccatttagattccattgcaatcaaatccatcttttgctatcacaattcttccattgcatgaatgaattcagctgataatctccctttatttaaagtagtgagttttccaggcatcgacaacgagatcaagcaccaagccactagctagagacccttttgtccaactgtaaaacccaaccgatgat

SEQ ID NO: 63089 - DNA, 7511 bp, Oryza sativa
aggttatgagcgaaaatgacattgctcctttctaacaccacttgtcagcaacagttcattaacagtggaaacaactgtgcctaaacacaaagttgaccgagaattcaaatgactatttaaccctctaacatgagagatgcacttgatagtgtaatgtatggtttcaatcttgaggtctcgtgttcaatccccaacattctcataatatttttcttaaaatatgttaaaatatattttcttattattccgatacatgtagtagctcttcctaccattttttgtagtatgatgatcacgatctctcgctttcacttaaaatcatcttctctcctataaaaacggttcaacttaaaaaaccgatttcttaaaaaaacaaacgttataaaaaccaaacagattaatcggtccaaatcctttcaccaaagtaaataaaaaaccgttataacgcacgggcctaacagtcttgagtaaaagttcatctactgcctaactagcacgcagcactgcaaccaaccaaacgaactaattcaccgaagggctctgctccggtgtttggcgagtttagccgaggcgcccgcgcgaaaaaaaattgtgcatatacttttttttaaataatttacgttcatgtatctgtatgagaagaaatgtcacaaatatatatgtcccacaaatcgaatacgcgggagcgctcacaaatcacgttgcggattgtgggagcactgtttgggccgttcccgttgaatgggcgagcggaaccgccatggtcccgcggctacaaaaatgtggcagcgtggtggccagcgggaccacacggcaccgagacggtcccacggttccgttgcgtggaactggctctgtgaatagtagtaaacaatgtccaaacagcgtaaacaatgtctcaacggtgctaaacagcaccgaacagtattatatatgtctcaccctatatatgcgcagccggtctcgcatgcccagcccgcgggaccgtcaatcccgtgtttttaggtcacgcaaaacactcggtcctgcgttttcaccatgtaggatgtgcatatttatgcaaattcttcgtatgccgtaaattattaaaagaaatatgtatattcacaattttttttttttgctggcccgcgcgagcgagcgagcgaaatcacgcgccgtatcgaggttttcggtgggccgctagcgcgcgacaagtctgtggccggtgagtggtggtctgattttgtgctgcgtcgtcgccggcggcggtacgtccacggcagaatgggggcctcggatgagttgtcgcgctcccaaaattcccaataacagtggttcatattagagttgacatctatgataacaacaatatatatacaatgttcatcgagagtttgacatctatgacaacttggtggccctgtttagcacgttggtttttttgtcttcttcacaagacccacatcatacatatccataagcgattttatcatctttttacaacccgcacaagatagtgcgatatttctattgatatagtagaaaaaatgtcatgtatattgtcgaggaaaagaaaaacaaattaagcacacaacacctctaaggaatgatcatcgcctactcgttggttggcttattagcggtaaccaaaatttaaattttattgcattattgtggagttgattttaacttttttctaagcacattttccagccttgcttttgaaccattaaaataaagatatatgtaaacgttttacctataaattattttttcttcatttattttctcacggcttttcatccatagcttaaccaatcaaaactatattaatacattaaccatctatcaacgagaaaagaaaataaattacactcttgagtagtacatgtattattcataatcaaattttatttttgcctcaacttgaataggtcgacctttagcttgcatgttagttccagaatcataaccatgtgcctaacatgcaagggatgaatgtgcatccgcttaaaggagtaaaatgaccttttcaaattaatcaacacaaacctcaactaagttccagctatataaacaccctcatctgaggatgcaattaaacgataaatttgaccaaaatttctgcttcatcgatccagattggtctcgacgtgcatagtatgtttcaacaaacatgacatgccacatgtacggggtatctactctttttttttaaaaaaaaaaaacttgggtatacttcctccatcataaaaataaatctatgatgggatatgacacatcctattatttattatttatgtagcactctctttgcttaaagttatagggtatttttttaggataagattgatcaataattactgtattaaaatatcatttgtgatataaaagttttataatcataagcaagttctttttaatattctactattataaaaattgaaaatattttgccggtattttgatactctctccgttttttaatagatgatgccgttgactttttcttcaatgtttgaccattcctcttatttaaaaattttatgcagatgtataagctataaatcacacttaaaatactatgagtgataaaacaactcataaaaaataaattataattacgtaaatttttttaataagacgaatggtcaaacatgtgagaaaaagtcaacggtgtcatctatttaaaaacggaggtagtatgtcatatgtatctaagtaggttttttaagtttgttcgcttttggaaatacatatccgtgtttgagtcggattttaagtttattttgagaaacacaaaaggagtcgtataagaaatatctttaaaaaaactcacatgctaacttgagatgaaagttggactcttaattgcagctcatgattttctaaaaaaaatatccaagcgaattcctaaattgaatttcattctagctaaatcgtataacaataataagatcaaaatagcattcacccgtagcaacgcacgggcacttttctagtaaatataaaaactttattttgtgtcacaaaaagtgtatcctagtagagcaatcgttgatcaaattcttatagtaagaaaacaaaatgtgtcatatattttaaaacggggagatatataatattagcagcccaagcccccttgtccagtcatctcattatgatcatgctgacaattactccctctgaaaaaagaaatctagtacagaatacgatatcttttgtctagatttataatattaaaatatatcatatttcatattaggattattttttattaaacggggagagtacaagttactacagcggtacagcccatccttcctttcatgatggtataacgtacggaaaggagtcgccgctcccgagtagtaactagtaaggctccattcgaaaaaacagcttggcttagtttttttaaaaaaaaacattaaacgacaaataatattatcctatactctgttcattaagtacttcgtcctgtactctgttcattaacaacttcctacttttaaaatttgtgtcaaaatatgataacttctccacttacacttttctcaactaatcacaagctcataaccttctactatttaaattccttacatatattcttttacccaataaatcataatattcatctatttaatttcaccaacctttttttaatacccatgttaattctggaattacgtatattttgggaccgaggtggtattaacttattataaacttaaaaaatgtgtttgtttgatttctctttaaaataacctctgtaaaaaaattctaaaaaataaaacacgccgtttaatgatttaagagaacatggcccaataagtcggttggactcggtttttctctggtactatatccgttccaaaataagtgtagtcatgggtatccatgtttaacatttaaccgtcctttcttatttgaaaaaattaagaatttttttttaaaaaaagtacactcataaagtattattcatgttttatcatcaaataatattacaaatactaaccataaaaaagaattgtaataagacgaatagttgggacctgaactaaggtaagttagatttaggagctgaggtctcccaaacgggctcgtagtgaagtactgatccatcgcaatgctggccatgcacccagcagcagctcatccagagagcgtggcatccagcgatctcagacaggagtagtctttccccccacgaaacacaccacgacgccaccccgctcggtgtacgtgaggccccagatcagccgagacgacgaccttgctgatcgaggcagcgatcaaccaatcataatgctccctccggttttattttaattgacgttttaaacaatgacatggtctataaaatatatctttgatcttatttttctactataatatgcctcatctgtttcaaaacgtttgacaccgttaactttttagtacgtgtttgatcattcgtcttatttaaaaaatttaagtaattatttattcttttcatatcatttgatttattgttaaatatactctcatgtaaacatatagttttacatatttcacaattttttttaaataagacgaacggtcaaacatatgctaaaaagtcaacggtgtcaaacattttgaaacggatggagtatataataaataaatgcatgtttacttttattatggtgcttatttatactaaatatttttaaagtacatatgtagaagacaaaactacatatgttgttctagtttatttatactaaatatttttaaagttatggatggtcaaatataaaagtttgaccttaaccttctttaaaacatcaattattatagaatcggagggagtactatacgggatcaaaccgcggttttgcaaaacaatgcacaaagttgccgcactcccgcatcgcaaatgaccaggaacactaatgactgctacaaattactgtaaaatcgtttgttactccgtactaagcatgtataagagcacaccgtatactaccagtagagattgatcgagatcacagtaaaataactccaactcaaatctactttcccggcacagtttacggccatactcagtgtcctgtgtccgtatacaagtatacaacagataggtgcagtgacaaattctgaggctctctttagttcccacgcaaaaatttttcaccctgtcacatcgaatatttaaacacatgtatggagtattaaatatagataaaaaaatctaattacacatattgcgtgtaaattgtgagacgaatcttttaagcctaattacgccaccatttgacaatatggtactacagtgaacatttgataatgatagattaattagacttaataaattcgtctcgcagtttacagtcggaatatgtaatttgttttgttattagactacgcttaatacttcaaacgtgtgtccgtatatccaatgtgacacgtcaaaacttttcacccttgaactaaacagggcctgagtagtactatgaaacggaggtagtatatgctaatgtactgcacgagcagtagacagcattgcagtacctcacctttcttcctctgccatcctctcttgccgcggctttcgccaacaacgacagcctgctatgctcacatcggtgcctccaggtctccactggtggaagccaaagcaagcagtgtgtgtgcctgtgagcctgtgcagcacctggcccatgattctgcttccacccttgccttctgaaacgggcaaattttcatcttcccttttcccctccctgctgccagctgctgatgatgcgttttcagaaggtaacagagatgaatgccatccatccagatgtctgatctgcacgtactagtacagcatggatccattcctggccattgacaaaattcgggacattttacttgccatatgagttcaggggacagatgcagagtgcttggctggtagactggcttaccgttcttcattttttttttaccatggtcaagtgtcactatccctcttgccgcagatcatcaacagtggaggctttatccgattgtcctctagcacgtcgtccttgagcttgttgggcatcagcttcacattttggcgccatgccatgaatgcacacactttatactccatctagcttccaaatcctgggtcttccctgttcctgaaagaaaaaaataagttggggtgcagactgtaagtgacatcaattcactcagctaaagaatcacaaaagtggtgaccaggtttacaatgttctcaagtaaagacacagtgtcatctctcttaaggattgacggcaaacctgatctgttgtctattcacctggatatatacatgcagttggctacatcatgaatgctgtacatcttaatacaaagtgctattgtttctgactaaatattcatgatctgattacaaacgtgtaactgtgaaatgcatgttagacaaactacataaagagggaaacgctggaatcccaggatggacaatgactaaagcacatgaaggacaaaaaacaacagaacaagggtggtcatctaccattccaccaagccctgaagttgtggctttcggtcatacaacagatactaacagagatctcaggagatgctagcttggtagaagagatctttggggcttagactagagatcctgggggccacctgacaagatgctcttcagtaggagagtgggatggctagcctcatccttgtcctcttccatccgacaagtaggaggttttcatgcttcatggatcccctctgatcaacttggttttcagtgatgcccacacagtgacccttcaatgaccaaaaattcgtcgttacatggatgaagttcaattggggtggcatctctgttgatacgttggaatttcacattccatgacctgtaccatgggcaagtcattttctcaatgttataccagcacacgatagattgaaacagttaacgaatccgtacctccagtcagcaccgagtgacacttaattttggttacatggcctctctgcaactactaatgacattcatgttactttcttgattgctttgttgctccatccaccgacgagccacggatggctgatggtgatggctcaccttaatgccatctgcctatctgcctcattgatggatctaagaatgagagaacaaagcattcttcagaaagcatgacaggactcctaaactctgcttactgacagtgccatagtggacatatattcgactctgagtgagaataaaatgacaagacacaaagtgacacacctagcattatttcatcattcttttgattgcaagaacacataaatgaaattttgttgtctgtacacattataatagccaaacaagaatatggagcttatttatgacaagatatgacaggatcttagatattgagttgtgagtttagatatagacaatgaaccaactgagcttttgtatagtaatgttgatggtatttataaaacaagtcttcatcaccaagaaattgtagcaatcctaccaagcaacaatcatgaaactcagatgaaacaagaacaaatct

SEQ ID NO: 63090 - DNA, 1629 bp, Oryza sativa
aatatattgatataagcatgcaaacagggatgaaaaacgcaacaaccaagttccaatagtggagaaaccaacaaaacttagcaaaattcaaaagatataacaactacatggttatcttttaaacaaaacactacaatgactgaatggtcagactccagttacctaagaaatattcaccattgcagattcagctaaaaagatcaccaaatgacatgcgctcagtccgggcactgccaaaagaggagaaacagaattttaaatatagtcttgagctcttaaaattcttgattcagatattcttataaagtgatttaatataaaagagttgatttaatcttactctttggcacaacatatggatcctgtgattccctgggccaatattgtcctcaattgtcgattatcgagacacaaggagtcaagggcatagtgcctataaaacctgtacaacaccaaacatcaaccaaaaggtaaagtatgaattagttattcaatgtaatgtacactataagtaaaagtgataacacagtcgcactcacatgctcaaggtattaaataccagttttaacagcaagtgcatttaatatgggtagatagacaagctcactatttttctgcagagctctgcctagcacacaatatatttgagtatctgggtaaataccaacagatagcataatcgggacaaacataaaggcttttttggcaaattgtcttttgcaaagtcgattgattgctgcactgaaatcttcaatagaagcttcaaatcctgcatctagaagcttaccaactaacaaaacagcattgataggcattccttttgcgcactgagctttgataagtgttgtgtacgcaaattttctcaacttaatgccattttctctgagggactccaaaagtatttctgcttgaataacttttcccttcaaacacagcacattaataagcaagttataagtaacaggtgtcggcacaaggccacggcataacatgatgtcatgtatgtggaaagccatctgaacgttttctgattcacagaaaccttgtataagggtattgtaagttatcgggtcagcattaatacctttgctatccatatctttgagaacattgatagcctcatcaaatctgagctgcttacaaagccctttaacaatgacactgtaagttactgcatttgccttgatcctctttgcaaccatttcatcaaaaagacttagcatggtattaacttctccagcttcagagagtgcatccatcaaggtagtgtatgtcactgctgttggtagaagtccacttagctgaatagccctaaaatagctctcggcaagttgcagatccccaattttacaatacccatatagaagagaattgcatgtgacaatggttgggtgcataccagctacagtgatctgatcatacaaacgaacagcatttacaatatcaccaagttttgcataaccatcaataacgacattatagaacactacatcagttggctgatattttctagctacattttccaaataccaccttgcttcaactaacaatcctttcttgcaaagtcctagaagaatagaaaaatggttcagtgatgttggcattaccctctgagaactgcacattgca

SEQ ID NO: 63091 - DNA, 833 bp, Oryza sativa
atgtatgcattgctttcgacccttttcttactgttttttatatggtaatgatcaattgataatgcctctggaaaaacaatatatcctgtgtcacacattcatatcgatcagaagttcaaaactaccgatgccattcctacgcctcctcacaccaatcaccatagttattcagataccacatgagtagagttgataatcagaatggggaaaattcatagcatgctcaccttgctcagtcaccagctgcgccaaggctgcccgcatcgcgcgccacctcctctcccgcagaagctcatggcagagcttgatccgcgcgacagcgcgggccttcctctcgacctcctcgtcatcggcagcccccccgccattgcagccaaccctaggcgctccccgtgcaatcccgccgatggagggaggggctcgggtgtccctgccaacagccgccgcgtcctcctcggactccgtcacctccgccgccgcggccgccgccgagggataatacgagagcggtctccacgcgggcacgggcgggcggggggaggagcggcggcgccggaggtgaggcaggaggaggaggaggagggggagcgggaggcgcggtcggaagggcatccgaggaaggggcagggtctcatggcgcggggagggtgtgcagagctccggctccttctcgagctagggccaccggcgctgcacggccgcggcggcgaagagcatctccggcggcggcggcggcggcggaggcggggtttgtgtgggcggcgcttcaagggaaggggattttaggagaggtgtgacggggaagtgggccaaatgtttggggctgcaggaat

SEQ ID NO: 63092 - DNA, 12199 bp, Oryza sativa
gttagcagcacagaagtctatacgaagtctcccagtaggactcaaattttcctctctcactgcaacatcagaagctgcatttgcttgaattttgaaaatcaggtgaattttacttccttggctggtttgcacagtgattttctttttatggggggtctacgtggtaagccccacttatcagttagaaacgatagacccacatgtgagttacaactttagtcttcaaccccacctcccctctttctctctcgttctccttagtggcactgtctgccacacgatctccttgaagacgcttgaatctagcggtggagcgatggtgtctacttagactcatgcgatgaacctgtggacaactccgatcgcctctactgcacctcgatctcatccttaagtttgatagggaggaagatgagagccatattgtcgtgtgcctgaggaggaggagtccttgccggacacgctcacgactagatctagtctctcccactctactccctttctccggtctccttcgcgttcgctacctccgccatacaccctaagctctgttgccaccacgactctttctcaagttcggttaggatagctgtaagctaaacttgaggaaaacacaggagagatgaaggtggtgtatccgtgtatgatctcagcgccacctggaggttagctaggatgacaacagcgtgatgctattgggggagttcaatagaggcagtgagatctagaagctcaacgaagccgaagaagcgactccaacgggctaattgcatcaagagccaggcatggacatggtgcagctttggttggagcatcaagaccattgtcttgtcgctgaaggccacggttagcagaaagagagtagtagagggagaatagcgtgataaattaaggttcactagcatgtgggcactacaatttttcttagtgactttagcataggagaccatgtcagcataccacgtcagacaaaattaatgtacaatctagtcatagaggtaagttgactttagttttcaaagctaagggaggtgcagatcttggtactgtggtttgaggaagcgaattcagattgagcccctagggaaggcggtgatatagacattttctgggaggaaattagttgagtacgtactccgtactaattattataaaattaaaaattggatttatctgatatttgaaaacaacttctatatgaaaaattttccgtacaaaataaactatttaacagtgtaaaccgtttaatgatttaaaaagcatgcgattcttctggacattaacaaatgtgtctattgcccccgcgtcacccccacgctggcgaccggagaagggtgaactgaaaccctagcgccgccactccctctttccctcccctgcctcgcctccaccggagctagccgccagacaccgcgcggctaactaggatggtgacgggggggctcagtttcatcatcctcatgtgcggagaggaggggcagcggcatggagcagggccgcatcaacacgttggggacaagtggcagcgatggccacatcggcgcatcagggacaagcggcggtgacgacgcgacgaagtcaagcgacggatggcatgatggaagcacgtggagacgacggcgcccctaggggacgccaagctgctcagatctggggccatctcggcttgccctcgctagttgctacaagcagctagggcaacaggtcggcatggcgatgaaggccctcccacgcaatggcaacgcaatggggcgagggttgtgcagcgctggtggcacggttggtggcgtggcggcggcggcggcgggtgtggggttccatacccaccttggttcaaaagtgctaatgggcaactggagcgactggacacgtgtcgcgtgcagaaagggggcacagacggcgtgcgtgtggagactggagacgattttttcggttttttttctatttctatttgatttttttctggttttcttttggtttctctttctttttttttaaagatgtacgtttgcaaagtttgtattcgtatgtataccaaattttgtatttgcacgtatacaaagtttgtattcgtgattttaatatgtacatatacaaagtttgtatacacatacgtgaagtttgtatacgcatatacaaactttgcatacgtgtatacaaagtttatatatgtgtacgtacgggatgtaaggtttgtatacgcgtatacaaagtttgtatttgtacatacgtataaaaacataaaaaaatacttgtatataaattttgtaaatgtgtatataaactttatatacgtgtataaaaaattagtatacgtaggtataaaaacctaaaaaaatacacatatacaaactttatatatgtgtatacaaactttgtatacatatatacaaaattggtatacgtacgtataaaaacctaaaaatacacgtatacaaaatttgtatttgtacgtatataaagtttgcatacataagtattaaaaacagaaaaagatatggaaagaaaaaaaacagaaaaaaaacaaaacggaaggtacggaagaaaaacagaaaaaaccaaaaaaaaaagagaaaccgaaaaaaaaaacaaaaaagaaacggaaaacgcgggcgctcaagagaaaccgaaaaaaaaaacagaaaacgcgggcgctccaagcgagtgctgtccgccgcactagtagtagagaggagagactagatgggttagaactgatcgcgcggggcgcagggagcacgattgatcgcccattagggctccccaccttggttggtttcggcctgctctgtcgacgacggtcagtcgaggcgcgaggaggagtgcccgctgcggtgcttgatcgaggagaagtagcagcaaccagtggcatgcaaccttcaacagctggcgacgtgagcgagtaagcggctggtggcggtgacgctttcttctcggttgccggccgaccaatatcctttcggtggagctcctcccatcctatggctagattccgttctggctgtggggagcttttgggggagggtggaggcgcaagctttgtatagcagaggatgacgcgcagcatggtgggtcggtggcctcatgggcctgcctgagttgtggggtggtgggctaggcatggtggctagagagacggtccgatggtccgacgatgtacattgtatgggttggttgtgtggttttggatgaaaatcattggcgaaagcctcgattggcctttggttggctcgactacggcggcgcccttaggcatcgtttccctccttggaggcgtcattatggcgtcttttctccctcaccgtcaatcttcctgcccgtatcatggtcgttggtagacttctgtgtcgaaactctataggcctatctgttcggtgaggccttcacattctaggctccattattggatatggcgagcgtccaacattctttgtttctgctaggtgaagccagagctgcttcgttgtgatgcgatgaagcttggttgcgataacatgttgtagtcttccaggggtgggtgttagctgttgtgcaagaagtggtgtttggcagcttgggctgaggtccaaagcgggcgtcggtattgctttatttgttttggcgatgcctttggtaataacggtgtgttagctatggagttggagctgttgtgtcgctaggcgacaagctcgccaatgataacacttgtctcaccaagtcatgatctctgcgtcgctttacaacaaactctttatcgatggatgctttgggctccaccattatttttttttcgattattggtagcgtaggtttttttcgcgcatactatgcggtagacgtaaatggaacgaaagctagccggcaagttaatttaacttagcgtgtgaagaaccgaagcgcataaagcgtagtaattgactcgaccgcgagcgacgtcgatcgatctgtctccctcgatccataaccgaccgaccaattacgcgccgtacgtacgtggaacacggtcgaacgatccctcgatcgcaccacacgatgacaccacaacccccacccccccccccccccggcaaaaaaaaaaaaaaaagctcagccacctgcgtctgcgtctgcgtgccaggcggcgatcggtacgagtagttttcgctgccagatcagaatcaggttctcctcgctcgtcgatcgtcttccgctacttaacccccgcacacacaccgcccccatttccatcctgcacacagccatttcacttgctttgctccacgcctccacctacctaaatcgctctcattagtactcaattaagtcgatcggcgagcgattcagcgcggctcctcgaccgatctctccgtttcgtcagatcgatcgatcgatcgatcaggtacgtgcaacacatggtgtacgtttcacatatatgtcattcaacaaattaggtagcatcattttagtagtgccaagattgattcaaacaagccctatatcaatttttgtgtttattgcaagtagccttctctcactcagcccatgtgctctgtagtctgtacaaatatagtcctactactactcgagttgagagattcagtttagcacatactgaattaagcccaagtttagatttgaagtttttcttcaaactttcaacttttccatcacatcaaaacttttctacacacaaacttctaacttttccatcacatcgtttcaattttaacaaaacttccaattttgatgtgaactaaatacaccctaagggcatctacaaaggtagagtctaatacgagctatctatattaattaatattattagagactatcctcctacagtagtaaagacaataagatttctaaaccattaatacactaaataattttttattatacttctttccttttctctatcctcattgcaataaattttccgttaataaataataagagtcgactctaatccgttgtcatgcgtaacagcgatatttctcttttcttccctctttttcttccacgtcatcaaatttatttgcatgacaacgaaaagagctcgttattaaccaccattgtacatgccctaagctggaactgacatatatgtatatgcatgtatcgctggttgctgatttggttgagatgggtttaatttaattctattcaatttaattgttgtttgcagggctgtgtattgcgccgtgtagtacgtgagaggatcggagtcggagcagcgagcgagatttgttgaagcaaattaagtagatcgatctcatatcgatcatccttaattaatttatcatggagctggtgctggtgatatcgctgccgctgctggcgctcatcataatcgtcgccatcgtcctctgcgtcatctgccgctagcttagctgattccttcctgcctccgcgatcattttgcatacatgtagtatgtcagtatgtggtgcatcaaatgtgatcattttgccgcccgttgttgttgggcacggtgattgacgacagaaagaattactcccttcatattttaatgtatgacaccattgactttttaaccaacgtttgaccattcgtcttattcaaattttttatacaaatacaagaatatttatgtcatgtttaaagaacatttgatgataaatcaagtcacaataaaataaatgataattacataagttttttaaataagacaaaatgttaaacgtttattaaaaaattaatggtgtcatacattaaaattaaaatacagagggagtactagagaacacatggcttcttgttccttctttggcctggtatggtgtgagtcgttgtgactagtgtgctcccaatccaggctgcctatacatttgtccatttcttcttcttcttcttctttttcttcttcttcttcttcgtttttctgttggttactgatgagttcttttgctaaggtttccaactctactctcttatttttcacgtgtatatgctttccaaactactgatcaatatctttttttttcaaaatttctatgcgaaagttactttagaaaatcgtattaacctattttttattaaaaaaactaatacttaattaatcatatattgatgagtcaatctatccttatatgtatgaaagattagttcacaccactaccaaccgaacgcagctctaacacgaaaggcatcgattccaagcgtgcggtagtctgtccatggtgagtgcgtgagaagatgatcccaacggaagaagagcacataccgtgcacagtacagctcctgtgctgtgtgtacgcctagctgcaggcagcaccggccggcacgtggcacgcggtttttctgggcttttggcctcttccccctaggctcgcacccccaccaccacccgattcccggaacccgccccatttccgcctcctccttcgccttcgcggcttcgcctctctcccacacatgcatcgccatcgccgtcatcgtcaggactaagctctgctctgcatctgcaccaccacccagctgcagcccgaacaagaagacgagcatctcatctcatctcatctgccgatcgatcgattcgctgcaggtacctactattaccactactagtacggtccttacgccctctagtgtcagagctaagcgtcaatcgatccagccttttggattcacgccgccatatagctcgcgctagctccccccaaatcgttcccggtaatacttttgctgctggtttcaggcgggcgagctgctctgcagctgctaactcgccatggcaccatcaacgctgtagagctctctgtcgttgctgcatctgtcctagctaattaaatcaagattagctgcggctgtactgatgtagtagtgctagtactgcaccttttcatttcatcgggtggatgagttttttccagatctattgattgatcatctgtttaactgttcaagatagcttttactactatatagtcaattaattagctctagtagatttgacatttgagagtttgaggctactcatgcttgcttgctctgcgatttttttttctctaagaaaaagagagagagagaggcattaatggctactggatttatgtaggaaatggagtggttgagaaaccatcaactgtagcttccaataaaattgtttgtagtagagcaaggttcaagattcatctgttgacttgtggagtcatctaatagtaacagtcaagagtgagatgtgggttagtagtgttatctaattggaatcggatccaactgttgccaactagtactagtacttgtaacatgggcagacactccagcagcacaagcagctactgtagtgtttagctgtacatttagctgatgaaaagatgacgatgctactactctgatcttagctgaatccgagaggcaacgatttctgtcggaaattgatctcttttttatgaaataaccggaattccgaatgcttcaaacaacagcaaaagaaattcagttttacgcgttagaagttaagcaatccttgagaaattcggtgaggtttatctcctcactcgcattgattccaaagaacaaatgttgatttgatagattatgatgtgcgagtgcgactttcttgtaatcgcgtagcgatatctcctcctcctcctcccctgtttcgtgcggtttcgctgccacgagtgtgaggtgtgtgaggaagctttccatcccctctcttgctctgtaccctaacttgttttcgtccctttaattcatgaggtagagctcctgcctttttcgctcaatcacatcatatttacagttacttcacccattgatatgttttctcaagaaaaattatatgcgactaaattcatcgtgctatacaattttgcaaatcgcaagcctatggttggagcacccatataccgcatgtttcagaacacataagtacagaaaaaaaaatcatgacagcattttgctgcttttctttttctagagaagtattttggtactgcctagaagtgacgaagaaggaatttatcaattttggtttgaattgcagggagagctgaacaatggagttcgtgttgatcatctcgctgccgctcctcatcctgatcataatcgtcgcggtggttctctgcatcatctgccgctagctgaatggtgacacctcattgttcttcctgcccatatcttgatgtgaacatatcatgtatcaattgattagtatctcatgactcacaacagagcagtctcgtactctctttggggggccagtgtggttgtgattagtttggccctagctttgatgagcaaaaagacattgattctgaatgtcatacatacatatgtgctgtgagaatcccctctctgctttggttcgtttttgatattattcatacgggagatcggacagctgaaagcatgatattctcattctctttgtcattcttctgaagatcagaagcatcatctgctttgtgttgttctgtaccattttgttcatgccgccccatgagaaaaaaaagccacatagtgaccatacttttgagcaggaaacgcaaagagaagcctgatgagaaaggaacatgtggactgtttggtacgccttgttctcacgccttttgtgtgagatctttgcttttgcaaaaatatatatacatgcatatagtgcatatgcttttgtctgtgctctttcggatgtccttaaatcttaaattctttagtctttttttttcttctcttttttgagttggatatgtgctggggctgaaaaagtctagcaagtgtaatgccgacactttggttcagataagaaacacttccaatcccattagaaacatctggtaaatgtgtgctgatctgggctgcaaaatagccatggcgagcaggttgcaatggcatggctcatgtggaatcttcagttacttattggtattgcgttcttcagacagatagaaagaagcatggtggagcctgaagcttcgcctgtatctgagtcgagcaaagaaaaagttgctcaagatgtacacgcacaatcagatagacatgacaacacctgtctacctgctactggtctttacatgaaagatcaactaatgacaaaccttttcaacaactaagtacctatttatgatcacaaggtcttcttttcacacgggggtattcagctaacgtcacttttgaaaccaacatctgaacaaaaatcactggaagactggttccgtttctagtcctttcatgggttctccacgctatcacttcgcattggaaaccttggagatcaacaagcagaggacgccagatccaaatggaaaacattaccaggaaacctgcaacaaaatggatgaattcagttgattacaagtatcaaacaacctgttcatgacatttgaacattactatgggggactttgaggccactcaaaatttcagtttgtggttttgctttgataaatgctattctgtgcaacagacgaaatgaagtgaaagagatgatacttccgccataaggtgagcataatattaaccagaaaaggggaaaagagtaagccatagcacaggcaccttatctaagagttttttttttttttttactttctattttcgagacattggtatggtatccaatacacacctttgactattgatttttctagttatatcttagtaagatcactaaacatataatgacatgagagaattctttgtgacatatctactgcaactgcaaaggtgagaaaatctaaaaatcaacaggtggcaattaaactgttatctctctgttgcactggagcaatgggagaatcgaagcagtactaagaagaaatgcatttgtgatatagatcgattaacaaactacacagagataacgtaatatattaaaaagtcaatagctatggttgctgtcgactgcgtctgtaccaagtatgggcctgaacattggctcggtgttgggcactgccattgcgcagggcgcctgcctgggttagacaatatcataatagtgtggccaaaaacactatatgcctttgataaaggacataaactagttgaaattaaagtcctacttatatataaaaacagtcagtactcattgccctcaacgaaagaagggaacataataaatcgtggtagaatggtatttgcagcaaatgtttccccccttcgctgctgccttagaaaaaagatatattatatggacagaataaacaaacctttatcatcagttttcagttcattagaattcagaaacagtcatcttcttgataaatgtccagtgaataaatatggcaagatatcccttcaggttattcttgctcatcataaataaaatatagctcacaagctgccaatgctttagacacctcatcttgtttttttagaaagctttgttgaggacaaaatctatgttattgccatcatttaaacctaactatttaaatattatacaggctaatgaatggtattgtccttccttttcttttgtcaatgtcagcttaagaaacaaaagatggtcagttttggagttgtggtggcatgataaatagatacgtgttggaagccttaactctagttacacctcacggttaagtttggaaaaatatgtgagattcagatctgctacagagcttataaattagattttgttgagtcaaaaattttctttgtcaaatattaagcttcagcaaatggttattaaaggcatgaagtatgaacagcacaagaaggcttgaaacttatgttcagtggtaaaagtaccgaaagcacatgatggagcagagaataacaacatgaacagggtgtaaaatgaatgtaatacaactacaaacagaaacacattcaaaatttgctgttagttgctaccaccccatagttcaataaatgtgagccaataaagctttactgaaaccttgatagcataagcatcaaactagtgcttagttttaaaacttccaaccaccattcagggtacaagaggcacaagtagcacccacaagaataacgaataggtgggtaggagagaagctctgaaagagctaattcatctaattcagaaaatgagtctacacagatatgtttaattactctttacaaaattttgtggttcattgacatcaacattaagaattatgagtacaccaggttcgaatgtaccatggttcatgcagagttcagcggcagcatagaatccatagatcaaagaaatcaggttttcatgaagtaaagttgttaacaatcataaagcataaagtgttcgatgataatacgtggtggatactcagaattaataaggaccagagactaaatattagaagtattattggagaaatcaatcctaatccaccaaacatatccagccaaaacacatcattatccaatatgcaatacctaatctaaaaggatccccatatattgtcaggtaagaaatttctattcataagctgccctacaggtcagtacactaaaagagaaaatcgaagcagcgcttagaccaacaagagaaaccagaccaaaatgtgcaaattgtgattgattcaccggaaaaaaaggagtaacaatttagcatttcatgaaccttccaagaagctaaaattatgcagatttcgtgcgaatcacccgcgtaacaggacattcagacaatcggtcctcgcacatcaaggaccaggctagcaacctgttctctcgaggattgtctatcagtctatctcctcacagagtcacagcgccacagtgcacgggtaaattattagtagcagttgtacatttttttgcaattcgtgcaccttcatgatattgatagcccacaaattcagcgagatttcaactagacatattcagactgtcctcgcacatccagactactcctagttagtaacagttcttgcaactggctatcattcgcaacgtgaccgtacaagggtaaatttggatgagagaattggggaaaaaaggggaagaggaggaattggaggagcttacatcctggggcgggggcggctagtgcttcttgctccgcgcgggctgccttgagccgtcggtggcgagcctgtagatccagtagccctgcgggggagaaggagagagggatttttaggccgaatccacggcaggaggggtagggagaggcgcgtgcgtacgagggcgaggacgtgggcggcgatgaggaggacgatgaggaaggggaggaggtcgaggagccacggcgggcggaggacggcggcggcggcggcgtaatcccgcgccatggcgacgcggcgggagatcagcgcggcggccgggtgcgggt

SEQ ID NO: 63093 - DNA, 20350 bp, Oryza sativa
aaccaacccgacccgaccgatggggtcgcccctttttctggtgcacctaaagctgggccgcacgcacgtcgcaccgtacgagatgggcgcaccggccggcgccaccgcgcgcggtaaatgccaacgtgcggccgccggagacgggcggcgagacggttgggccggccgaacagatgccgcgtgcatgataggtgggaataagtccactttgactcccttaaaagcaacccgaatctaatccgtggccttaaactacaaaccagatatcctgacctcctcaatgttaaaaccggtgtaatttgattccctcaagcggttttagagagcggttttgttgatgtggcgcttgacctagtcaaactagctgactcagcatgtgggacccacacgtcagcgtaacattttttctatctcctctctttttcccatgctgtctaacagcaaccgatgcagatgcggatttgtaacgatggcgccgccgcggccacacctcacggcaccgggtacggtggccacctcgccgacaccgccgcaggcggcgcttttttctcccgctccgcatcgtcggcctcgacctccgcgacagccacctcgccgacacagccatttgctcggcgaccggacgactcgccgccacggtggtcgccgagctccgccgggccgccctcatcgcagccgtcggagaacaccgcgacgtgcaccaacgacgaaccgcgtcacggcgacggtgcaccggacgccgccatgaccacgaagacgagcggtggcggcggcggcgctggtgggaggggaggccgacatagcgtcgcctcgaggccgcgagcgccgacggctccctcgagctctggctcccctcccccggcaccgtaggctccttcgccctcgcggagtccgtggcgcaccggccgtcgccatcgaggagggtgctcacgatggagtgtgtgtgtgtgtgtgagggggggggggggttgggtgctcgaccagagtatgcggcggtggagcgacgcgcgtcagagccgtggtcaagaccctcctcgccggcgagcgtcacctttgcgacgagctgttagcctccgacgaggagctcggccacgagtggttcgccgatgtcgccaggagatgcctcctgcagctcatcggcttcgcggacgccgtcgccatgtccacaccggcgacggagaagctctaccgcatgctcggcatgtacgaggcactcaccgccgtcgagccggacatcgaatccctcttcaccggagacgtccgcgacttattctcctccgaggtcaccggcgtcgtggcgcagctgggcaacaccatccgccacacgatgacgatcgaccagttcgtcaacgtcatccacggcgagtcgtcgcggcgaccagtccatggaggcaagatccaccccatgacacgctacgtgctcaactactgtggtctcctcgctgagtgccgcaccacgctcgacatggtcctcgccgacaacaacaacaccaacgatgaccaccacgacggtggcggcgcctcatcgtcagggcggtgcatgcgggagctcctcactcacctcctccgcaagccggatgagaaatccaggctctacgaccacaccgggctgcagaacatcttcctcatgaataacctctactgcatcgtgcagaagatgatggaggaggaagaagagatagacccacagtgggccccacttttttttttgcgcgaatgacgaatgggtcccacatatatgtttttagttctgatgccacctaagcgccacgtcaacagtatacaggcaacactgccacgtagacgccacgtcagcaaaaccgctcttcaaaatcgctgaaggagtcaagttgcactggttttaacagttgaggaagtcaagatatctggttttgtggttcagggtcatgaattagattcgagtcacttttaagggagtcaaagtggacttattccatgataggtgcagtagcccgtagggaataaggatgggcctttgggcgaaggacgtcgtacgtggggaataacttaataagtttactttgactcccttaactagtgaccgaatctgatttgcatccctgaaccacagcacatgatatctcgaccccctaaactattaaaaacggtgcaatttggcttcctcggtggttttggagggcggtttcgctgacgtggcgcctacgtggttgtattgacctagtcttcgttccacttggcgttgacgtggcgcttaggtggcattagaattaaaaaatgtgtgtgggaccccatttgtcgttcacaaaaaatatatgtgggatctactgacatgtggggccttctctctcccttatctctctcctctcctcgcttctcccttctccccccaacaacaccccacacacacacacaaatatatgcggaatttgagtttttttttctatgatagtcctagagatggcagtggtgccccattcaccgtttctccacggtgaattcacccattaggggacggggataattagaattggttcaccatgggaattaaatgggaggagacatgtcgccatcggttttcgtggggtggggatgatccttcattccccgtccctactcccaatgcattccaaaccggcctattggttggttattctttgaagtgtagcagggtagaatcatgaaacaaactcaaagtggtctatgagtattttacccgggaatatgaataatgatctagtctcagaattaatggtctttaatactccttgtaatctctttcttttggtgtgtgttggtttttgcatcttagctatgtagagaccggaagtgttctcagggcaatagaatcaccttgatataatgtgtttctcaaactggctactatgatacataccatttatctatttatctatctatatatattatattatatttattatttattttactctaccctatatttcaacaaatactttcactcatcacttatcactcattctttcattcctcactcatcactcaacggtccagattgcctctctgaaatctcaacgattgagattgctcccacctcccacctccctcgattgcgcgctcctctccgccccctctctatcgctctcacgcgctgccgcccctcgccaaccacgacctacgccctcatctctcctctcacgcggcaccaccgtcgtcgccgccgccttcgactgccgccgctccgccgtcgtcgcatccgtcgtctcgccgccaccgatccccgcgccaccgccgtcgccgccgccctcgactaccgccactctgccgtcgtcgcatccgtcgtctcgccgccaccgattcacgtcgccgccgatgccttcctcgcgtggtcgctgccgagaccttccgtgcagatctgctcctcgtcgccaccgatccccgccgccggcttgcctcaaccgatccccatcgccgccgtcgctccaccggctcgccctcgccagcgtctccccgtaggtcagtctcgcgccgccgccactcgcatctcctcacccccgcgattcccaaccctaaccgtcgtcactgccaccgccagcccccgtcgaccgtcgcaccgcgctgcgccgcactgtctcgcccttccaccacgcccccggactccaacgtcgccgctccagccccgatccacgccgccgcagccgcatcaccgtctatttccgccatgggggcgtgattccgcgcgacggctggaggaggcgaggtcgggcctgccctccatcgatggcggactccgcgtgacggctggaggaggtgaggtcgggcctgccctccagccccgatccacgccgccgcagccgcatcaccgtctgtttccgccataggggcgtgattccgcgcgacggctggaggaggcgatgttgggcctgccctccatcgatggcagattccgcgtgacggctggaggaggcgaggtcgggcctgcccttcacgacgctccacgtcgccgcagcccgcagccccggtggggccggtggttgggtggttccatcccggtccggccctggaaggcgaaccggcttgggtccctcgcgccgccactgatccagggctcctcaaccctgcaagccgtcatcctgcctgcgaacaaggtaagagtgcttctcgatcccgttcctgtacatgaggaggcatacggggcagggtatcgtttattcatagagatgcataatggctttagaaatcccctttgttgactaaatccccattgttcattattaaacattgttcactgtgcatggatatctgtgatgcaaaactctaatccaaagcctgttttgcatttcaactaaatttcacatgttaatctcattcgtgtggtacgatttttttttttttgggtttcattgctgtcattggatgagatacttcacatcttgttaacatttatcgtcaatctttcactgtaaaattgtggggaagaaatggcccgcctcagataattcttttgtgtcaatttttctatgtgattgcttctatctagcaaactgacttaacctttcatttcaaatgatttaatctataggacaaaaattcaggttgtcgaagaaaaattcaggctgacaggacaccatgtcaactgctattgtttgctgcacaatcaaggaaatttttggctgattctactaaatttctgtttggtataggtaatttctttcataatgattaccccttacaaatagtgcaaatatatactccgtgggtcaatcttcgcactgttgtagaatctgatgtttaaaattgcctgcatccggtttgcaaatcaagaaaaaaaaatgccctgattactgtgccaaccatattttcttcgagggattgaccaaatctttttcttgtaaaagcttaaccctgttccaaatgtaatactgcaattttgctcaatttcacatgcacaccacagtgtagtcatgcattaatgattttgatttcacagtgtgacatgcacatcacattgtgaacaagtatattgacagatcaacattttgatttcacatatatgcttccctgttaaagcccggttatcctaatcgatctgggatctaagaagttgatggtatatgcagtaccatttgtttttcttgcaattgactctaaattcttatgtcgttcagttcatataaatggctatattctacagaagatagatgaacctatttttctttctctagggcaaataactgaagagtgttggtatttgagttaaccactttttacgagcctaacctgctgcacttccacaaccatggatttaaatagattgttcatgtagttcctattttttctgaacaaagtgaaaaatacgtcgcctatgataaaatggcaacttactgtgtgcaatgcagtacactaatttattttttatagatcttttttttgttggtgattgatagcgtggctgctctccatagacggcttcttattttcttttcatgccatatcaataaaagtaatatatttttccatccgggtgaaatttgatctcttaaccattcggcacttatcttctttcacagatcatttattaaattttccctgtatcctacgtttacagtgttgcatgaatcagaaaaaatctgattgaaggatctaatatttgaggactcctgctctgctggtgactacttcactccagttattcaaggtatcaaagttactctaaaacgatgttgttaaaagggactgctttactaaattgtgatcatgtattatctctttagtttgtggatcttgggtctgtgatcatgtattatctttacgatcaaataacgcgcgcgcgcgcacacacacacacacacactcctactatctctacgtagaccccacatggaaggccactataagattgtgtatccgctatgtcatgtactggtgaaaaaatgataaatagtctgaaccatatttattttttcatatagagcagaaaaattactgaagcatcaatacaaaactttggttgttttccggccttgttgcagataatcatgatttcaacttggtgttactggtaccgacttacaggagtagagattaaaatttcagaaacctggcaatcgaaaaaatgaactctatagattttggtttttaggagtttggaatttcaagttgatggttgtgagcggcagtcgtagcagcaagcttgggatattattggcaaatcatatccaaatctctgtcaattacgctatcctgcagcagatgagagtaaaggttagcaaatcatatccaaatctctgtcagctgctattatggcaatatttccatgtattacatgcccatacatgtcaactcacaagacatacaaggcaatattgttatgtctttccataaaccataaatatcatgataacaacaatggtaacattatcctccttagcctatatatatatgtgggtgaaggagtgtgatccaaaaaaaattactgatcctccttagccggctgcatacgactgctcaacttcaactcatcatcttggtatcgttctccaatctatctcttttgtgttggaaattattatatactttagtttgcacctattgatctcctacttcttctgtattgtagtaaggcatggcatccatgtatgatgtggatttttcaccacatcaagccacacctaaggagtcaatgaacttcaaggatgatgcgaaggtgcagccttcgtcagggcaaacaccaaacaaggggaattattacatgggccacgcgaatgccatcatgatgatgtttcagtacatacgtgatggctgccggcatgttgagagttccatggaagacttcaagtccaagaaggtagaagaaggacgcgatgagaaaaggaaggtgggagaagggtatgatcctcgctggtcttctcccatcgagataacaatgaagatctgcaatgacgacgtctccgatgaagcaaccgagaaggaaccatgatttagtattgtcgctactgtgttttggccttacaataaaataacatttcttgtgaattacacaagaaaattcagtacacaatgtcgttcaggtccattaagtactgcttgtgaaatgcaaccaaatttgatgaaactttgttatgatgcctattcaatattgcttgtgattcagttgatttctgggacctatacaaatgtgctctacctcctgttgaactactttgtatttgtttggcacggttggatgaatagtaatgtccctttatatttgttttccatgtctttttatataaggagacacatcacacaccaatttcctgacgttggatatttagtcatgtgttggatatttagtcatgtgtagcactattgatttctgtaattcttttgctttagatcaaacatattttatttgcttcaaggctccattaatttaaagagctgaccaatcacatgaatattgatttgtgaacatgaaagcgtataaaaaaaagcaaatataattaacataagaaaccagtattgctaatttgctattatgttgcctattcagtcacgataaaggagtaaaggactgctagatgtcaaacttatgtgtatggcccaaatcctgtaatggcccattaacaactaaaatacccatgataaatacttatatgcaatactcaacctaagtgcctttgatctgtcacgtttatcatatatcttaaggcacatatatatgcattatcatatatctttaatatcatattattatgcattatgacatggggtataaatatattggtatatcctattattatattttacttgcaatatatttgatgcatgacataaattgaattaaaactcaaatgcacagttcatataataatattttttttacgaaacatgaaaattttaaaaattattatagacaaatagagttgcaccgtagcgtttagcacgggcatattactagtacccacaggagaaaaatgtgagagctgactggtaaatctcctcaagtaattacttgaaagttggtttgttgatgtactccagcatagcattagctgaaattagcacaagagtaaacatatcacagcatttataactaacaaccgatatgagccagaagagtctccatgagcaaatgtagatgcatgcatgttgtatttccaaataaagaatacaaagttgatcagtgaaataaatgaattttaacttcgaattaacatcttgacaacaaccttatcacaaaaacatgagttgcccatggctcggattcttcgtcttccccggttcctttgccatttcaagtaagattgatcatcagacatcagtcaatcataacatgatgtagattgaagaacacaaaaggatcttcaaattttagttgaaaaatcttcatagaacaattataaccgaacatcaacaaacacactgaattctgaataccaagaagtctaaaaatacatttcaccctcaatttctgcaactactaagagataatttctcgccaagaaagacaagaacaacaactaacgatcagcacatgctgcttaaaagtttaaaagaaaaccctgaacttttctacaaatatgaagaaccagaactgtgggatgccttttcagcggcggatgttagattggaggttgagcaaaaaagacctagccaagagcaattttaccatctaacatttggtacctaaaattgctccctagccaaaggcgggttttttttttatggaggttcaagtcctgacgaattggataagtgtataaaatatttcttcccttttacaacgtattttaactattttcaaccttgtagtaaaagggaagaaaatgttttacaaagttgaaaattttcgtggggctataaatttttttcgccgggctgaaaaaaaaagttgaaaattggtatgtgtttattgtactatttcaatcctgaaattaaccagattttttttaaaaaaaagagcaactgcaaagtgcaaaccacccgcttaactctgaagaacaatcacttccttcttcaccaacacaaatccggaaatggcatggctttttccattttctctcgtcacaaaaatttctgatttctcactagaaaggataatcattttaaccacctctttgcatccattcttcattggtgtaaaatctgcatgtgaaggagcaattcgagcacgcgtgatcgaatccaccctgttttcacattgtttggacagtcatggtttccttctttttcttctgaagtttctgaatcaatgctaaacacctgcatcattaaataaagtgaagcttaattatttccttcctgttcgacaacgatgacgatctttagcagattgatcggcggcacaattaatgcgtgaattcagtcagtgatgagagaaaaacagaagccaaatcagactgacgagaaaaggttcgctcacatgctgagtttataccgaaaagagaaggctcaactactgtgagcttttgtgttttgcctataaatgtactgattcagtgtgaaaatttgcctggaattgctgcgaaatttcgtgggaacttcgtatgttcatctgcaccagaagcgattccattttcgttgaggaggaaggtagctagcacctcaaacattaccggttttggtctgatgttctgaacatgcacgcaaagcaatgccatttctgaagaacaggctagaattgtgatgacattgcttatagaaatttgaagcggttggccttgtttgtgatcaaaggctgtgtttagttcctttcaaagttagaagtttgggttgaaattggtacaatatgactgaaaagttatgtgtatggcaggttgatgtgatggaaaaagttggaagttttgatctaaacacagccaaagatgtagaatttttcttttctatcacaattttcttttcagtggactaagagttggattttcacctgaaaaatattaccactgcaactcttgtctgaagttctgaacatgcacacaaagcaatgccattacagatattctgcaaagttgattttttttttttgctgggtcagccgaagataagtccaatcaaatttcattaagataaagagagtacaggttacaaaattattacatcgaccaacgttgccgaaggcgggacgagaattgccaaaatgcaatccgcccacagaaaggaacacctgaaactattgctgaaaatgttgatcaaatatgtgaaattttaatagtgggtcttcggttttcacttcaaaaaatactactgctgctgcaactctgcaagagataggtggagaaggtaacatgtgagccaaaccacgcttgattggttggtagtcgatcatatttattatttaaattactcaatatcgatagcaatacgatgtaacaagaaatcagaaaaaataaaatcaacatatcgtaaaaaagaaaagataacaatcggatatgacggtacccttagagcaggtacaatagcagattataaataatctataaacatattttaaagagataaaagaggagagagaagagcatcgagctacagatctatagccagctatagcacggactccaagacgtaatgtgtatatgacaggtggaaccaaatattaacagtatagtaagcaactattgtatgtattggtcatagatgatttatagttaatactgagtagatccgaaatttctgtgactatttctatccctttttcctcggtgccgttgggacacctgtccagcaaagtacgatcggaaatgacggttctacccctcctcctcgtctgcttcacctccataaaacccccacttgtgcccagggcttcacctcccacgtctgcgaggaagaggcgctgctgtgattgcgagtgcgaggtatgtgcattccccccacaaatctcggcccccctctcctcccttcgcttctcccgatccgtagaaaagcttcgtgcctttgagggatggagtatgcgtgctctgtttgatggtcagaggctgagaaaggagcgaatttttccaatcgttttgtgagcccagcggttacggtgtttcggggttgtttcaacagtggaggggatttcgattcatgcaggttcttggctttctggatgggattttccttttctcgtttagttgattttttcaataaaagttcctggctttctttgagtatatttgtttcatctgcctgctcgagtggaagtggggtttctaccgcttgatatttcttctctcttttttttccagtgtatttcttgtactccccggttattacttgcttataagataaaattctaaaaaaaaataacttggttataagatttgcagttttgatttggtctgccgttgaggattcttgtgttctatggctcgtctctgttttttatagtgtgcaagattcttcgatcaattattagctcttgatttctattggaggttattggcttgtggtttgtgtgtgcaatgtgcaatgcaagttcttggctttgttgacgttccagagtgtagtgtggttctttgatctgactgcttaagaataaagcacctgccttttgtaacatgaggatcctcaatttttcgtgtttgtgtattcttgtttcttgtggtggttacttggtcaagattattaagaatcctatagaattaggattcttaataaagatatgcactgttgttgaggatcctcatgttacaaacattttttttctttctgaaatgtgcaatattgttcaagttcctagctctgcgttattggctgaagatggatttcatttacaggttattcccaagaagacgaagtggtaaaaagctatgggcaactcctgccttagtgctcgtaaggattcccttcgagattcttaatctcttttgcttgctactaacctactagctactgaaattattgtggtagaagcacagaacacggttcaccagtggtgtcagtcgattctgtttcagatttctgatatttccatgtagaaataaaatgtcaagaaaaaattgtaattttagttcctggaaactagttacctttgtcatcgtgttgagcggtttggtctcatttatcagaaggtatagcaaatggcatagatagatatgagtttgaggcttgaactactagttttcataatcactgcctattgactctggctaggtgtaatcttggctacaatatgttggcagtggttaattacttgtgccatgggccatggcccatgaggttatggcatgtagttttgtataggaaacactttgataccatggtaatgcttgtttgctggatgatttggaaagaacaaaattcacacgtgttcaatcagtgttcccatactattggccggatcttttttagataatgaaagctttatttagacttagttaactacatcaagatgattggcatgtagttttgtataggaaacactttgataccatggtaatgcttgtttgctggatgatttggaaagaacaaaattcacacgtgttcaatcagtgttcccatactattggccggatcttttttagataatgaaagctttatttagacttagttaactacatcaagatgatacaatcaaactgagtcactcttggcctctgcataaaatgcacacagccaaaaaagaagaaagaaacaactagaacatctcccaagccccaaagtttgacagaaacatatatcttagtggctatcaatccgtaggctagaccgccacccatgctcctaggtaaaaaaactcctgtgccacctggtccaactgtcgagataccaccgtatatcttagtggctatcaatccgtagactagaccgccacccatgctcctgggtaaaaaactcctgtgccacctggtccaaacgtcaagataccaccataatagtatcccgcagtcccggttggtggaggatagcccaggtacgtagccaccgggtaattaaggtgataacctgcaaaggagaagacacatcttgttatcaaaaattactccattcctgcttagccaaatggaccaacatagagctgttgcacccatcaaaagtagattcctcatttatttggggacacatgatagccaactcccaaacatatgaccaacattgcgaggaggtttcagattagaagccaactgaattacagaccacaccaagcgagataagcggcaccgaaagaataaatgttggatagtttcatccttgtgacagaaacaacatgtcttgttgcctttccaatttctcttagcaaggttgtccttggtgagaattactccccgacgtaaataccaaaggaagattttaacttttaggggtactttcaccttccaaatccgtctattgatattcggaaccccgctatgtgttagagctagataatgagatttgaccgagaagaccccattcggggtgaggttccagtgaaactcatcttgctcctgtaccaaaatcaaatcagctatgcgaggcaataagttatgccaagcagctagttttgcaccaattaaatcccgtcgccatgaaaagcacggaggattggtttggaaaatctgtgcgatagtcgattgtttatgcctaactatgttatagagacaaggatattgttctcttaaccaggcattacccaaccatttgtcttcccagaacctaacttgggagccgtccctaatcttgaaggatccaaaacggaaaaagtcttgtttgaccttcataagactagcccaaaaatgtgaatcccccgctttccaataggcttgagataaaggttgtgatcccaaatatttattgcgtagcaattattgccatattccatcggtggtaagtagtttgtataaccacttactaatcaacgctttattctttatctcgaggtcatgaattcctagccccccttgttctttgggacgacaaataatgtcccacttagcaagccgatatttcttcttatgtccatccccttgccaataaaacctagatcgaaggtaatcaagttttttaagtaccccactaggaattgcaaggaatgacatcatatacattgggagactgctaagtactgagttaatcaaagtaagtcgtcctcccaacgaaagaagttttcttttccagctactcaatttcttctcaaatctctcgaccacttctttccattccgcatttctcaacttcctataatggatcggaatgcccagataacggaatgggaagttaccgacctggcagccaaagagctggttgtattgatcactataatcaagtgcttcaccaaaacaatacagttcacttttatgaaaattgatcttaagacccgacaactgctcgaaagctagaagcactgacttcatgttctgagctttttcaaggtcatgattcataaacagcaccgtgtcatcggcatattgtagaatgaagagtcccccatcaatcaaatgtggtatgactccatcaatttgcccttgtgttttggctctgtttatcaatgtggctagcatatcagcgataaagttgaataggattggggagagagggtctccttgccgaaggccctttttagtctgaaaaaaaggctcgacgtcatcattgactttgactaccacgcttcccccggaaatgaaagactcaatccaagatatccacttgggtgaaaaacctttcatacgcagagtttgtagcagaaaaggccatttaaccttgtcatacgccttttcgaagtcaattttgaatatcaccccactcaacttcttcctatgtagctcatgaactgtttcatgtatgatgacgactccatctaaaatgtttcgtccacgcatgaaagcagtttgggtcgggttcactaaatggtcagcaaccgagctaattcggtttgtagccaccttagtgaatattttatagctgacatttaacaagcatatgagtctgtattgttggatttgatttgcttctttaacttttggaactagagtaagtaccccaaaatttagtccgaaaattgggaggctaccagtatggaattcattaaaaaggttcatcaggtcatgcttaataatgtcccaaaatttttggtaaaattcagctgggaaaccatctggtccaggagctttattatgctccatcgcaaaaatggcttctttcacttcttccgaaaaaggagcagtaagcaaatcattttcagcttgtgaaacttgagccatatcaccaattatggactcatcaagcgaaaacgagttctcctctggtggtccaaaaagtttttcattgtcttatctttggtgacattaaggacgagatcacagtgtggaagaaagcagagtttttcattgtctctgatgactaagtgtttgtagtgtgaaggtttttgtcttcatgcctttgaggtgggattactatcaatctcacactggtttcgacaacttgtcgatgtaatattactataacctatacctccctaatcttaatgaaatttggtcggcctttttcatcagctgacttgacaaaaaatagtattatgtactaattctgactttactgcaaagaacggatagtttttcggagttgtctttgttctcatacgattagatatgctcttatatgtggaccaaacaatgatgtgacatacacaacagcagatttcctgccttacacgggagtaactcctcttcctttctcccttgtgtagtttgagttaatacacttgacatcttgatttcagccgatgcactgctggtaaagatccataatccagtgttcttatggaaggtttatggcttctcagcgctacttcagaggggagctttagcagccaagtctgctgcatttcattgctctggatacaactggtacgtatagctgtgaagacactacagcggtaatatgcattagatttaaaactgcatgtgactaggcagataccatgcgtcattcatcagttcatttgatatgttcaagagataaaatagttgcctataaacaataagaattgcgaaatagtcttacatgttcacgtcccttaaaaaaatcaatgtagctaagtaattagtctcagcgccctataaaatggaaattgcaaggggatgtttgataggatgaatgaagaaattaggatttgttattacttcagccttgatttttaatctgagttggtattatgctcattgattctcattatacaggtacttgaaagtgtctccaatgcataaaacccttggtgatggaactccacatgttgctctttctcttgtgctgtcccgactaagctttaagccagattacaccatgaatgcagtgttcgtgctgtcaatgtacaaccattcgaagggaaattttcttgtagtcaaaggtaatttcctgaatttggagcagtattgaacatattatctcaattccaccgctttaattcaatgtgtaaatatatatgatcaaatagtttccacattgtttaattcactttgtgttgtcttatgctaccaactttggtttcatcaacctatcgatatttgcagttaacatatggtagtgttgtatagtgcatacatgattccccccccctcttaagaacaaatgttcaattgttgtgaggtctatttatgttgcagcctagactacatttctctaatattgccacattttaaccatgagcagctagctacaacttcgacgtcaagaacacacactcaaggaatatatgcttgatttcccttgaagaccaactgaaatcatctgagtatctgcttgatgatacttgtgtccttggtgtggagatattacaaatagatgtgtgccgttctcttaaaaagaagaatgttaaagttcagaggttctcttcctccagaagaagaagtttgtctctgttcagaatctcttcctccagaagaaggatttcactaaaggggattacacctggaccatgaacaacttccctgagttggatttgaagccatcggtcctttcacctgcatttgaaattggcagacgcaaatggtatgcatctgttctggttacaattttgttgatgtttatatgttaccggtcctttctgtgtgcaatttgttcattatcacaaattagatttctaatttcatgctggccagaaacattgagttgttcttggcagttgacatcagtagtggattcaattagaaaaaggtagttgtcttccatgtcctgtatatcgtactgcaaatataccatgttccagttaaattatctaggatttatctctaagcaatagacctgaataactccaacggtagtatattttcagttagggaacaatatttctagtctgttaacataaacgacatatcttatttctgatagttaaatcctatttaacagccacttgacatatgtatcaacaacattatcttccgatgaacctagagtcatatggtatattttcccctggcatgagcactgaactcgtttggtcccaggttcatcagaatgtatccgcgtggtgatgagtacagcactaattccctttccatgtacttgttcccgcaatcctgggacaagctccttccagagcctgggatgatgatcgaactgacactatccatcctgaaccaaaacaatgcgcaacttcacaaagtttcaggttcagcttttccatgacagatcctgtggaatgaatttatatgcagggactgcttcatttttttgcagcatctcattcttagtttgtctcaatcgcaggtcgctttgtctttgctagtaagaatggctggggatggtccaacttcatcgcgtcaacaaactcaaggatcttgtcggatcaagctgcattgtcaaggcagacatcaccatcatcgggtcatccagtgagagtcagattgtggtctgaggaagaaacaatgcccttgcatccttctggcaagaacacctgccaaactatctatgataaaattatggtagcatcacaaagaacttgtctgatcaatggtattcttatggtagttaagatacctgagcaatggacgctgagaaaaatgtaagatatgccatgctatctatctatgtagaactggagagtaatgttatgttctgaaccacttttatgcatggatggtataagcatttgccattatatattgtcatctcggtgtctttaaattcagcatatgttaatctgctgatcagcctgtgttgttctgcttgatgatgcctctctgaattacattatcgtttcgagtttttgacaacttgtgtttgttgcatatgctgccatatatggtttaattggtcaagccctgtacgtgctaaacgggcccatcaatcttggccccaaaaaaatcaatctactgggcctcgtttttttttcctgttccctataaatctcaggattatgtgtgtgccggtggaggcgttgatcagttgagataaacgcgacgagttcgtgtgtgtttgtttgggcggcgactgcgagggcgatctggctgtttgctaggtatgtacattgtctttctcgcagatgacaaaaaatggtgctttcttaatttggttatctgatgccattatgatctcttggtaaaagaaaatccttttcattgagtggattaaggtacactgatcctacatctgtgatcttgtcgtttcactagcaaaacctagctgctcatcaatccattgttttctagagttcttggttatgagatatgcgattgttacatcagtctggctggactgaagctttgagatatatattttatcgtgaaagctgagacttaatctcttgttattgattatcacctagtatatgctgaggttaatttactggagacgggatctaaaaagggagctcgaagagagaaccatgggcaacgttgctggacgtgctgcaggtgcttgtaagtattcttttctgaaaaattgctctctcaacctggatctcatttgaagttttctttgttcagattagattagacactagtaacacattagtcattctaacctgtacatcggtatgtatgggtatttcaagttagtgcaaaagatatttgagcaaatgggcagtaacattagttttacttgtgtgtactgcaattgtcaatgggcagacttgtattttggagtataaaacatagcattcaaaccctaatgaagttttaattcattctgccaaaaaagataaagtttgaattcttagcagtaaatttctcttcagtgctatatgattttgaaaatggttactgctctcaaaatggagaaagaaatatttcgaaaatgattaattcctaaattcaggtacagtgttgtctatgctaattgaattcaccaaaaaattacaaagtgtcctaatctcatgagtagattcaaatggtttgcatggagacttatgtacactgaaatgattaaggaatgtatatatcgatcctttaggactaaagaatcagtatgaggatgcttaattatatggtgccaatttgttgaaggataaataatttgcataccactgaaattttacatattctctatctacccacgctctgattgagaaattagtgccaaataagagattgaatacttcagtgcaaaatttgagatatcggattggaataggggcgctgctagagaaagggtattgtccaaactaggtgttaacagcccaaaacccactccttagtattaattaaaaaccagatatgcccacaaaagacacaagacacaagaatgtgctggatagaaaaatataaatgatagtacaacgcattaacctagcaagggatttgcatgcgcatatatatttgttacagtgcgctcaatgttatttttcttaaagaaaattattcatggcagcattatcatggtactccctctgtttcataatgtaagtcattctagtatttcccacattcatagtgatgttaataaatctagatatatatattaacatcactatgaatgtgaaaaatgctagaatgacttacattatgaaacggaggaagtaaatcgtatcaatgatgtcctaagagtttattaattgatattgcaaaatcaaatttcagattccaaggagccccaaaatgctccttttgtaaaagaacgtgaaccagctttccaatggaagatttacaattcggatcctctgcattagaggtactaatgcagaggatgaacagtaccacgcgttagaatcactgtggaccgtcggatcaagagtgaaaggaccagattgtgtgatacagtaaattcggaacagtaccaaatagtgcgctacagtgttttgaatcctgtagctacagtaatcgacactgttcatggcattagctaactgttcccctcacatgaacagtgctcttctgcattacggcagacgatccggatccaagatttatggcttctctgcgttatttcagcgaggagccacatcagtcacctctgatttgttccactacggtgggcacacctggtatgtaatatctagtttggtggaaggagaatt

SEQ ID NO: 63094 - DNA, 975 bp, Oryza sativa
gtgttactattcagcatgtctttctccagacaaaggggttcatgcaagggaactatacatggaacattgaggactccaaattggacttaaagtccataatctgttctccaaagtttgatattggtgaacataaatggtatgcacacatggtaccagtaagttttatgtttgtttttatatgatttgaatgagtgtgttattagaacactaacagtacttgtctttaaaaagagaaaggtgtttctctttcttttttttaacattgtgtagttaaaccatcatatatatttgtctttgtgctgtgtgttatgagctagtgatcgcatgtatttatttgtgaaacttaggaaatgaaattctttttaccatgttagcaagctggattgatgccaatatatatttttaccatatatatgtttttatgatcattgtattgcaagtctcctactatttagcttatccctaagatgtactttatttctcatagcacatcttagactttcagattttcagttatgcgaccataataaatggattggatttattcttatgtcaggtaccttcgtgttgatccatatggtgattatcgcaaccgtgactatgtctccatctacttatgccttgatgataactccaacatgcctccaattgagtccgcgatcatggcagaattcatcatatccatcctgaaccaaaagaacggaaaacactcgcaacagaaaggttcatcatatcaactcctccagttttcaattgcattagaatttgacgcatttcgaaacagggtttacatttacaacccatttgttttttgtggcgaattaccttcatgtatatcaattttactttctccatctcttatttgtttttgtttttagtttttttttggcgaaccacagcccggaccgtgttttcttgcaaaggaattgcttggggatggcacaaattcattcggagagatcagatgaagaacac

SEQ ID NO: 63095 - DNA, 10842 bp, Oryza sativa
aaattcatgtagcctaaaagtaatctacatatattatagaagtaacttatatcaaaaagaaagtaactgtaatgaatgtcttttttaattggatatgactacacagctagtggtagctagcttggactccatctagtatctcctttcaacttgaaaaatacaatagtatcttttttctcattctacatgaaaaacaaaaatgaaaggaaagaaacaatcgatgattaaacagatttatagagagttacttttgaaccatgcaaaagttacttccaattaacattgaagttacttttaaaaattgttaaacttatgtgtgttgatctgtgctgattaaatttaatttctagataaagtcatatttttatccctacaacgaatttacttctattgtcgcaacaaaagtacttccgttttgttttaagttacttttataatatatgtaaattacttttagactctattaaatttacttttatatgtctaagttttatatgtctaagaagtaatttagtcaacttaaaagtaatatatatatatatatatatatatatatatatatatatatatatatatatatatatatatatatatatatatatatatatatatagaaaaactattctacacccgggtatagaatagctattctatacccctcctccctcccaagggtcacacccacctccccctccttaccaaggcccaaaaccgacctcccaccggtcaaacccacctcttctcacctctcgtcccaggatggtgcagtaacacaacgaccactatgcagtaacactgtgtcttacgtgcagtaacagtgttaaaatataattgaaacatagtcatgatggatctacttttgataagcttttttttctagcatcatggtgcaaacggttttaaaagcccttacatcacttgggagatattgttattcaaaacttgacatttttgcaatttgtctctccacaagtagtaatactatacaattacttgttactacttgtctgttgtacgttactacaatcgcatcacgatgttactacactgcgttttactgtattttttgggtagtgttactgcataaacacgtggtaacgtgtacctttcgtgcagtaacacttttatttttgtgtagtaacaagtatatggttagcttctgagacttttaacctatatatttttgtttcagttcttgatttactgtaattcaccacaatattactgtcacatcttacacatgcagtaacactatattggtgggaggagaccggttttcttgagaagagggaggaagaacggttcttgaagaggggagtacgtagatgcattttgaagtttaaccctctacatgcagtaacactatagcatcatggtgggaacgattttaaaaaaaataatatatatcttgtgagacattgcttttcaaagattggcactttgaactttaaccctccacatgcagtaacagaatgtgtaacttgcagtaacaagggcatatacatgcagtaacatggttttaccaaatgtataaaattgttcaaaacactcctacatcaatcagacctcgctcaaagtgacgtacagacattacctatagcccacctatttaatcttcatctcgtaaaaatgacatattaaaactacaattattgtgcagtaacatagttactttgaagtggtaacatacacctaccatgtagtaacacttctacttttatgcagtaacaagtatatggttagcatgtgaagctttaaccagtaatactagtcacttgaatgtaataacaacctatatatttttgtagtaaccggacgtgttactatatttcatgatggcgttactacgaaaagggtgggagtacatagatggaggaaggagaccggttttcttgaaaagagagaggaaggccaagtttttgggtagagagagatagggagaggagaaagcggagggatcatgagagggagagagagaccgggattatatctattttgttactacacactagttacattattactatatttatttcacactgttactgcggggttgcagtaacatatagtacaaagcagtaacgagcgggagtaaatactaaagtttagaaatcgttagttatacaaacaataatcaatagcgtggtggtgaccactactcatgaaaattcaatgatggcatatcatgttacaatagtaatctataattcataattctgatggtaatattgctatagctgtgtagtaaaagatttgggatagtgcagtaagatggtttgaagtgtatactaacaaccatcctagtaccattactacatgttttgtgccaaatactacaggatttagcacgtatgagaagataaaaatttactaagaaaactctatcacaattgagaaatagcctattagttagtgccctgtggtaatttgagttgaaggtcttgagttctattcccattgaatgcaaaatttttctttatttttttctctctaaaaaaaagagaggtggaaggggatggggagaaaaaaaaggagaggggaggcgcgcgagaaggtgggcgagggaaccccaggtgtagaatagtcttaccctatatatatatatatatatatgaaaatgtttatgtactcccgggagtacgtactcctggtccgcatccaccgtccatccgcgtaccgcatagatcgatcgcacacatgttcctgcttatcggatcccaccagacccaatttgaattttctaaaaagaaatactggaatatttgattatcccttgatgatcggatctggcatcggtgtatatatatatatatatatatatatatatatatatatatatatatatatatatatatatatatatatatatatatatatatatatatctcctacatatataataaaagtaatttacgaatataaatattttttcatcttaatataatcatgtaagatcttgttgtgaagatttaattgtaacgaacacaatggtgtaatcggataagtaatttgagagaaaacttgtttgaagaggaaaaggacgtacatgtatattaaaaaaatgcatgcatgtagtaccatgtattagatggacttctccacgtttctctgtgtttaggcgtcgctagttaagacaaaatcgagagccctctccaattagatgttacgtcctaatctcgtagtaatttcatcgaacgtgcgattctgactaagaatcctactccatgtcgaagaacttcacaaatagggccaagaataaattcggaagaaggcccagattgtcctctaaaccaagcccaatacataattcaagctcattccacatctccacaagcccaaatccaagcccagcccagaccaaggcccaggcccgcctctgcggtctccttcgtcacccgcgcgtcaaccaacctccggcgtctcctccccccgattccccattcgccctcgccaccgccaccgccaccgccacccctcgccgccgccgccgatccgcgccgccaccgccatgccggccgccgcggaccccgcgcctccgacgccaccgccgcctcctcccccgagcctggacctgcggacgggcgggcggatcctgcggcgggcggcggcgcactccctccgcccgcgctccctcccgccgctcctcctcgcggcgctcctcctcgtcctcttccgcctggcgctcgtcgccggcacgctccgcctcgcctccttcgccgaccacgacccggcgctccggtccctcctctcccgcctctccccgcccgcgccgcacgccccgccgcacccgcccccgcgccacctcccgcgccgccgctccccgttcacctcctcctcctcgtcccccccttccctctctgacgacgacttcctcgtcgggaccctcgatcccgcctcctccgccccctcccgacgccgcaacgcctcctattacgagtttctcttcactccctcctcctcctcctcatcgcccaaaccctaccccttgtcgctcccccaccgcctcccttccaccgcgatcccgttcaccttcgttgtccgtaacgagacctcgccgccgaagcccgccgcggggcgagacggcggcagtgagctccggttgctcgacctgaccaggcgtgacgccgtggccatcatcaacctcctcgcgatgctttcgtccgtgcacgtgctcgcgatcctcggctacatcaccgttcactccgtagctctgggcaccgtgttcgcgtctgtcgccgggcagcacttgcaggggcggccgcggcggtggttccatttctctggtatggctttcagggtgagacggctcactgggtttgcgttcctgcggtgggcgacgcgggacgcgatcgtgcagatgctctgcctctggttcttctccgaggtgcacgaccaggcgcagctgttcaggctctttgtcgtcgccaagctcatgcccttttcagcatctgtcaacccgtggctcgctgcgaccgttggagggccagagcttgatgggttcttcattgcgtgggctctccttgatgcggtcgtctcggtgcttttcaccgtggtgccatgggtgattgttatggaccgtgatccacgaccgcctggtcgcaatgctgtgaaggaaggatgctaccttgtgtcattgatggcaactgatgccactttgatcaaatgctggcaaacagtggtatgcggcagcatgggacagcttgccatggttacacttggtgggaaggttcttggcggatttctccactcaatcggagaggtgtacttcatggtggtgtggctgatgttctacttttcagcaaggtgtaaggaggttcggttggggggccgccattttggattggaggatgtggcagctgctcttgatgggttcaggcaatagcatgttgacagttgcagcattactttttcagtgggaagaggtatatttcatgcctcataatgctcattcatgccgcattgctggtcttggtggagtcgcaatttcgtagttctcttaatcttccaaattgtgctatgatgttctgattcggatgagggagagagaacttggcaatgcttgtatatacagtttttgtcctatgggggtaatcatgtatagtgacaccatttggcacacaagaaaggttgtcttgttcctttttccatcggaggtgagatgccttgtgatagaggatgtagatccaagatgatgatagcgagatttatacagtcctatggtgtagtagcagaattatcttgagtgatttttgggatggaaactcttggtgcttcaagttcacacgctgttgacactatgttgatatcctttgtttttcttcttttgttgtgtgagcaactttgtctataacttcatttcaataaccctttaactttcttttcaacgaagttgctaggccattgctgagttttcttttaatggcccagttcttttttgggtcctggttctactagtctgccattatttgtctcttcaattgatacgatataaatttatcacacatgatctggaattctctccaacacatttggtgcacctctataagcaactttgcatgtgaggttctatttattggataataccccttttggaccagtgtctatcatatttcattccacaatgacctttacttttagatatgatctgcggttcatgttcccttacatgtcacttgttcagttgttccaactatttattcaatccataattcattaaaaagtttaaagcctgttgcatgtgggatactggaaaatactgaattggtggtgttgattgatattggtccaaaatcagtagtgaacccgaggaagtagaagggtgggtgcaaagtttggactgattataagagacagcgtattgtcattttaattctgtttaccagtttgtatcatgattgcaacccttacttaattcatgttcagaacataaaacgtacttctcatgagtatttaccatttagatattcacttgtatgtattaatacatagggcaggcattcaagctgaatatactcaactgcagtcttcaaaagacaattgatctttgccttgttcatccctttttccccttatttgtcatgctactaaattaaaggaccagttgctgttaggcttttataaatggcatttagagattggttaagatatgaacaaacatatggtttcagtaatttggtataagaaaaaaaaatataggacacgtatcttgctacgctaggctcaattccaggtttgcccagtattctgtgacccatcgataaacaagaagactaaaccatactctattttgacttatgctgttatgcatcctggtattgattttgcacacttaggacttgaaaggtatagcttagaagttaaaacatcaattttatgaggcagggggccgtgccaactagaaactagataaattggtactagtactatgaagtatggtgccatctctgaagcttgtgccatctactctcatgagtcatgtactgtgaccgcagcaggtattgtttaatttgtaaaagaagttagcatttgcttcgatggcattgtgtttgtaatttttttaaagtttgccagtacatatatgaccagaggatgccgatcatatgtagccatgcattgttatgattcttctcagtttctcagttcttatgtatcatgttatgtttcatggaaagatgaaaaggtatattgcatactgtgggaactatggagtcataaactgctgatgcttatgtaaatttttgtggaaaatgttttgctttgggataatacttgtatcaagtatgttgagaatatgtttgctggctgctcatggaaatgtatttgttcatcggttgcttcactgcatatctcatattaccttctgcacttgaacctgcagtcttccagttatctgaaggccgcatctgtacatgtctgaatagctggtcgcttttacctatggaactttggcttgtttatctcatgcgactatgcgattatctacctgtgttagaggttgctgaatgatgcatttgctattctttgtgtcgagactaattcgttctatgttactgaccctaaattatgctgtgctgtggtctggaaaatggtttgaaatgcttcattaccatttgtttctcctgtcacttgttagtcaaatcctactatcagagagatgaggtacagagcaattgagtaaactgattcatgaaacctttgggcatgtcatgtcgtgttcttccctgttatgatctgatgagctgcgaacaggatgatatgcatctgctttcttttgctgtcctttttattttggagatggatgcttgtgttttcagatgaacaggatttctctcgttgacatgttggcctggcccaacctctcgtagaaggaacggctaaaatgtagcccgcaggcaggtcacgcttcgttatggttgctgaaaattactgagaatatctgacagccaacaggagctctatggtcgtgtactctccctggttataatgtttttcacctgtactctttgtctgttttttaagtacttgccaccggacattattcatgtataaacctcgatcgcttgtatttctttaaaaaaatatataaatactttagagccccttagaaaaaaggtgtttcatcaaagtgtttttcttaaaaaaaatactaagcattaaactttcattcgaagtagtttaaccatttaaaaatttaggggcatgttagtttttagtcacctaaaagtacccacatatttacttttggacaacctagatcgcatcaagatttatgcaagaacaataaactttgtctaattcttccctcttccttcctgtgatgcgtgtcttctctcaattgcggctgaattactagcgatgtaagtgggtagtcctgttacccgcataaaaacccgcttgttagttcatttctcacatgatagtataaaatttagaaaaaaaatgaattaaaagtgagataagcgggctaaaaaaaacccgcttgcccaccccgcttgaatccctatgaattacatgagctcgatccctaacccaagccgccgcctccctccctcccccaccccctctccctgggctttgcttgtgccagtgagccccatcacataggtgtactccctcacgctcttgtctcttctcttatacctatacctagtgagatgactccgtcctgcctatatatttttttttatttctggtgacttacactatcgagacaccaccgttgcaaccacattctaatcactacaaatccaacgtcagttcccgccactgactttgtccatcgtcctcttctagcccctcaactctggtggcaatgtcgttgtatgtcacagtcttgctgcatgctcatgttcaccacctccttagccatccctataaagttgcccacaccgccccctaccacttcaccaccacccaaccttaaaacataatccatatgtcatttgtcgagttttgatgtcatcgccactataggttgtcgtcaacgccatcgttaagaagttgttgccgccgttgtcatcattggtgagtcttttgtcatgaatcccgcttcttcctctccccatgctataggttggaatataactttataaccattggatttagatcaagtgactgagatttgaccatgagaaaatctttgtcacctaaaacctagcaatcggtcaaatggttaatagtaacaagtaatcttggaagagtttggtctctcctggtaagatgtatagtactcaatccatctcaatttaatcatcatctaatatttttgaggtcttcctcttcccacaataatcacactttaaaaagtgtattttcgtttaaactcagtattaattacttcttatgtttcaaaatataagatatgatctatccagatttataatcctgatacacttacattttgagatgatgaaagtagtttttactacccacatggccacatgatgttaatctttaagagaaatgagatgcaaataataagatggctggccggctagatcgatcttcatgagcgaataaaaagatgcacggcggctaacgagataggcccaaggacgtacggccggctgtcgtatcaacgttagtaatagcaagtttaatagtataacccactactagatctaatttatttatagccgatctaatagtcaattcatataatagttgcttactatactattaacatatggtcccacctgttatacacacattacgtctttgagtccgtactgtagctagctataaatctgtagtccgctgctgttctctcttatcttttatctcattaaaatatgtttatagctggttaatagtaagctattgtacctgcctaaccgcacgacgattagtagccaacttggaacgaattgaaacggcgactgcgtctcatcagcagcccatcactggagtagtagtgtaaagtggccgcgccatgtacgttaattacgagctcacacacatgcccatgtgagataattaacccatgcatgttgccctaattaaacaatggaacatatgagatcgagttgttgattaatccttgagccacaacaatacattatattatactacaattcatggactgaaagatatactagctagccatgagcatactgacatatatgatgatggctatagctaatcatggctcaacttttaggtaaacaacgtgccaatatttgatagatagagggactatactagctagtgtgttgaaaggatttctgggtggaaatggcctttttttctttcaggagatctgataggagattacgtgcaagtattttaaaggttatataggttgataggtgtacatctgtagtcaagctcaaatgtagctcatgcattctattgctattatcattatatcctattcaaggcatatatatagtgcaacaaccgtcaaaccgacaaatttttttttatgattactaaaagaagtaatatgtacattacgagtaaatttcataaaattatagaaccatgactttcacaaagcgatattgctctatcgtttgcttttcagcttatcagcaacaaccaaaatttactttttaaattttaaagttaattttgatgttttcttaatcgtattttattattgatggtaaaatcttatcttattcatatatataaagctacagatttaacgtaaaatttatcatagaattctactccctccgtcccataatataagggattttgagtttttgtttatagtgtttgaccactcgtcttattaaaaaaatttatgcaaatataaaaaacgaaaagttatgtatagagtactttggataataaagtaagtcaaaaaaaaagtaaataataattcaaaatttttttaataagacaagtggtcaaaccgtgtaagcaaaaactcaaaattccttatattatgagacggatggagtatattatttaacctacactatgacaattcacaatgcactatcacaatcttaattcatcgcaatttctgcatgatctgttgacaaaatggcgacatgatgtgccggcacgtgcatataccattgttatgtccaggatgtacatgtagtactggagtcgtagcatctgtggaggccatatgctaccactgttacagattctcaggcaactcaacatccatcacatccatccgtttgtgactcggggcctatttggtttccagagacttattctaagtctatgtcatatcgaatgtttggatattaatttaaagtattaaacatacactaattacaaaacctatttcataaccttggactaattcgcgagacgaatcttttgagtctaattacgctatgattttaacaatatgatgctacagtaaacttttaatgg

SEQ ID NO: 63096 - DNA, 1672 bp, Oryza sativa
aggtcctaattttctttttgtccttcctggtgacaagaaaaggagaattaagcagccgtagccctgtagatccttttgcttgtactttttctttatcaactataaaaaagaaagaagctggacaatgaaaagacaaaaacaactctaaagttaatctaaaatcaaatcctaaaatttaaaatcagcttcatgttaagcgcacacttaattatagacccactggctataatttatctcttaatttcagtgaacttttggctccaaggagctcaattatttagtgattacctgctaaataaagtaagagttccacatgattccccaaaattagttaatactacagtacatggttgggtgtgcttcaattcgtacggtcgaacaatagtatacagtggcatctcttctgtctctcatcatcctataattatgctctgagcctattgatgctgatgcaccaatggattattacctgcattgtctccctatctctccattgatcgatgcatgccatgttacacgggcaattttttttttgaaaaaaaaaaagccggcagagttgcacatatatttattgtattttctgttcaattggataggcaattgggcgtatgatctcgatgcggttttatctagcacacaagccctccactctaacacaccagcatatattatccgtaagtttgtaatgatttttttaagagaacattatcatcaatccggttttatcatcacattttatatacattgttagctattaattctgcatatacttgttaaactggccaatagacattttggtctcgtgctcttatttatgctatccttagaaaaaaaagtaaggaattattggtggagatgggatgctacctaggaggaatggtatcgactcaaagcgtcatattgacggtatcctgtggttataatagcaactctgttttgggtaacctccactggacaatattttcttgaactccatttctaaaagaatttaaaatatatttgattcccttatatttttatttttaaaatatctgttgtgtcagccctccatcagatgggtggaggctggagggccattggagctcaatccaaacgcacgccagacagttgagatgtgagaatatatttcacttatatatagctaaatcataaaactgttaataaaaaatcttaattagtagactaatgtacagaaaaatcgtaataaaatctctcacggctatatatcctctcgcaccctaaaattcctccctctcaccaaggagattcgaattgagggacacaagccattttattggaggaatatttctaattattcctaagatgaaataattggtcatacctacatgctaattgctaaacgtatgaattgatgaatcatgcatgatttatgataattattcgagactacaaacgaactaattgacttattataagagttgaaaaattggcacgctgccctgttaatccataccgtacaatcctttgaaagaaaaaaggacatgacccagtggcacatatatatatgtcctccagtcaaagatagcacagtgtgaaccctcgtctactcctcccccaatctttgaaccctagcttgcaatatgcaggagatcgagcagctaactctacatgagcttaattagcttggaaaaagttttcccggtctctatct

SEQ ID NO: 63097 - DNA, 3898 bp, Oryza sativa
  unsure (1)..(3898): unsure at all n locations
cctcatcgtccgcctccacaactccctcggcaacaggtccgtctaaaccactctcctttattttcagttttttttttacttcattcaggtctaaaccactcttcttcttcttcttcttcttcttcttctcttttcagtttttttttacttcattttgcactttgtttgtgcgtttgtgtggtaataaacagataattcacattaattttgtcttcacaagatttttgtgtctaaccattgtgtttaactgtcccatcaccttatggcctattctttttctctttttttattcttttcttccttttagaaaataaatttatggtcttgtttcttatggtagaagtcagagatgtaaaacattttttttattaaaaaacattgtggttagagtgttataagcagtttcgctgcatatttgtaagtaatactgtaaaataaaagtagtgatttgattgagatgtcgtggatgaatagtagtggaaaagatatgcaccagcttttcaaactttcaggtaggagtacagtttatcattgattggcggcgatagcctcctcctcgaggaaataaactttataccccaaagaagacaaaagcttgtgccattagtttaatcccccatttgcgaataaccaaatccagggctccagattccatctcgtttggcctttcatggctgccaatggtggctgcctgcctcctgctcatcctcatgctcatgctgatgcatatgcaaatcctgcaattgatatggctgctctgctgctggctgctttgctgctggagcatcaccacttgctcgagctggaccacactaaactgttcggctcagtgcttagctaagcttaagctattcatgatgataattgtgtactgcactagtgtccactgcccaaagccatatatgcatccatgatccttaatttcgtagtatactatagtttatttgcacatgagtggcctgccccagttgctgaattcaatgccaaagcatgattactttaattaatttgattggttatgtaattacaaagaggaggagaagttgtgttccaatgatgcactggatgctcaatctacctgtaactgttgcatttggaatcaaatcttttgctgcagcatcaaaatcttgcagattatacagacttgtttaacagtttgtttattacaaaagcttctctgcttcttttgtttttagctgtttcatgtgacatgatctgggttgcaattgcattgcatcgatcaatgctttagctagctcttcttgttcttggtgctcatggtgcttttgtcatttgttgccaacaggtggtcagccatcgccgcccagatgccgggtcgcactgacaacgagatcaagaacgtgtggcacactcacctcaagaagaggctggacgacgaacggaagctcgccgccgccggcggtggcggtggccgccggccgcatacgcgcaagcagcccaaggcggcaaagagcgccgccgccgtcaagcgcgaggcgacgccgtccgtcagcgtcgacaccagtagcggcgtgacgtgctccacggtgaccgagtcgtcgccgtcgtcggccgacggcgaccaccggcggcagcagcagcaaacgcagcatgccgctgtcaaggaggagagcttcagctcgggcggcgagctgccggcggcggcggcggcgcccacggcagcggccgacatggacgagagcttctggtcgtcgacggaggtgaccgggatgatggccggcctcggcgacatggacgaggagctggccatcgccggcacgtcgtcggcggcggcggcgaggagcgacgacatggagttctggctcaagatgctcctcgagtccggcgacatgagggatttggccgtcttgtaatctatttaatttaatcatggcagaattaagcttgattaaattaattaactaccgggaagaattgatagtatctcttctctgttgtttttttttaccttcttttttcatcttttttttcccagtttccagtgagaaaacgatgggaaattcaggtgatattttcacctttgttagaaaaaggaatactgtagtagtagcaaaaatttctttggttcgttatcagctggcttcagaattagatgcagtgcttctgtgctttgtacttaattaattaccctcgaaatgagatggttaatgttattagtagctttgcttagttaaatactgctccaaattgactgtaatggctgattatgtctcactgtgtatcagttcatggctggctgttgtattaggcttatgttttaaggtgttatacagatgtttacagttagtttttttttttacaaaataaactggggtagaaaaatatgttaccaattgccatgtctctccgaaggtcgaagattgatattcttggaggaaaataatactatcattttgcaaatccaataaaaaggacctttacacacctcaatgctgaaccaaaccatccaaaaaacagttaaacgaaactatcacaatggccacctcaatgctcacgtagcatcaagaagaaatctcaaaagattttagaaacggttaaattctttctgtgagtaacacatgacaaacattttcgcagcacatgacaagaaaaaggttgtggtaattaattaagggtttgatatcctgtcatgtacagtactccaagatgtttacagagagacggagattttttttttatgaaacgcagtacaaagtacaaacacaagcgtggaggaaatatttatgacttagcaggggataatttgctttaatcctacgtaactataaattttgtgcagtaaaatcatgttatttatatgtgatttcattagaggtttcagtatattttttctgaattttgtatggcatggttacctcaaaaaaattatatataagaaacaacattaataaagggtgccgagtactgaggatcggacttttggtatcaaattattgtaaaatgaaacaaatcctcaagttaaacccaagattcagactacgtccacacctactgaactggcttattgaacatgtacttgctgctaattttcagaaactaattaatctcaaagctcaatcaccatcggaacgtacagtgaggtattacttatgtaggtgtctacgtacagtgtacttgctacaaagaagaggtgtatatatatatatatatatattccatcaaaagtaactgaatatttcaaatgctagacttgaacataagattctatcaaatcatgatcagctggcttaccttattaattacaaaatgtcaatgactaacaaagcatttttcacaaaatcaactatgattaactaattagaccggattcttggttgacagtttcaataaaaaggcatcactagatcacaatgtacgggttcacaataaggtgaataaaatgtgaaggtgacatcagataaaataaatgttctcgttgcttttatgctcataattattgctaagtcagagaagaattagtcatgttgctctctagataattgatcctagctgcaagtaaatctgtccttagatcactagcagcagctaattcacaactttcacacatcttttgggttaaagcaactatacactaattaaccttagatcagctgacgctctctctcctctctctntctctctctctctctgacgacccttggctaatttctttggacgaacacattacacacgtacagctagcatgcataaactgacagctgaaaaaaaaatacgtgaaaacacaacgtctccgtgtcatcgaagagattacaaaaactaatgtgaagctggccatgatcgatgcctgttcatcaacgtttcattctttcaaagatttccaagcattcttgaccgaccaagctaatggtcagctgcaagaacaaatgtctcgctgata

SEQ ID NO: 63098 - DNA, 1504 bp, Oryza sativa
ccatttctatgagactatcataaaagtctggatgaagggcctaaaagacaagcaggtagcaagcttgattttgccagttttggcaaataaatggccggttgtggtgaagggcttgaaagaaagaaaactggaagaatggtccaaggtacactcctccagctgttgaacaaggcagactcagcatctgtccattcatcattcatcaatgccatgcaatgcatgcagacgcttgggagttgcaggaacattgcggttttttattttattattattattattatttttgcagctctgaacaatcagcagcaattcagcagctctctgccaaattagtgtggtggctactgtgcactgtagtgctggaggcggcaaaagccggatcggactgctcattggcatggtcgaattggtaataaatagtagtccgaacaatcacttctttttaagtttatactccctccatctacttttgataaccatatttcatcttgacacactgatcaagaataaataattctacttattatctatttaaacatgctactagttattcctcgtaaacaagcgattcattgatatttacatttgtcgatgtctatgtagccaatcttgtgtggaagaatggagtgtaacgcattaaatccgagaaaattattaagagaataggtggttggattgagatatgtctatcaaaagtaaatttttcagatttagaaatatgcctatctaaaatagatggagagagtagttagaaataaagtctttttaaacggttcttttcactacgtagtactactcccgtttacgaataactatctatcgacaatggatatactttttacatatatttttttaaaagatagcatcaaaatgatatgtttaaaagtgcaatattaataaagtacagtcaattacaaatctaataatagaactctgaagccacatagtttgattatctgaaagttataggtcgaagatacgcctcaatgtcaaaactgaagggggcagcaggaagcaagaagctagaagacgcgaaattgcagcggcgattctttgcatggagtctgaggcaacgtagggtgggacagatggctgctagggagctgaatagaacaaaattaaggtaggaaccaacgaacagttcatcgttataaagagatttcatgtccaaattttctagttattcttacccccagttaagtcaaagtttcttgcccctttttttaagtcaaagctataatacttttccgtgtaattttgagtgaagctattgggatttggtatataattctttgcctttttgttttcataagtacattaatattgcaagaaactttgggaagaaaatcaaatttggtgtaaaacccttgctttttttattataatacaatactatttttctactccctccgtcccataatataaaggattttgagtttttgcttgcaacgtttgaccactcgtcttattcaattttttttgaaattattatttattttattta

SEQ ID NO: 63099 - DNA, 11800 bp, Oryza sativa
  unsure (1)..(11800): unsure at all n locations
tgaataagacgagtggtcaaacgttgcaatcaaaaactcaaaatcccttatattgtgggacagagggagtacacaactacaatgatcgaacaacacgatcatattggattcaccgatccaaccgaatctaatggtgttttttctctttttgctaatatggtactaatttgtaataaatctcggcggtgacttgttttctatctttttataataataaaagtatattacatcctttgacttttataaacaataacaatagatatataatttgggtagaaattgatctataggagtaccttctaactccctttattccacaatatagctactttagtggtcaaattttgtcttgaaatataattaatgaagtattgttctcctaccaaccatctctattggtggtattcttttctcctgaagatgaatattaagttttttacgtaaaatgaggtggtattaacatatgatttattgatttttaattattactccatctgtattttaatgtatgacgtcgttgactttataatcaacgtttgaccactcgtcttattcgaaatttttatgcaaatataaaaatacttatgtcatgcttaaagaacttttgatgataaatcaagtcacaataaaataaattataattacataaattttttgaataagacgaaaggtcaaacgtttgtcaaaatgtcaacggcgtcatacattaaaatatggagggagtacaaacttgaaaaatagattaatatgatattttagagcaactttcatatagaaagttttcacacgaaacgcaccatttagtagtttaaaaagcgtaccacgaaaatcttaatgtttatccaactcatgttggagaagagtttctacccctatatatatatatatatatatatatatatatatatatatatatatatatatatatatatatatatatatatatatatatatatatatatatatctttggctgaaaaaaatggacactcgcacaacactcgtttctaaatttttctcctctatctcgtcatttcctctcttctctctcctaatcttttttagtaacggtgaaatctaaattttttttctagtaacggcaaaatctgaaaaatctcttctaagactcaaaatcagatgtatgttaggacgaatggaataggagaattcatgaataaattgtcttcttagagaaacatcaccgcgcgatccactgcaactttaacatagcacattataaccattggatcgatacagccactattgcatactattcgtgaacaatattttctaatgatctgagctgttggtttttgatccatcagctaccttgcaactgctaaagttgcagtcatagcaacaatctcaaatccccgtgcaccgtatcagccacatccagccgacggctccttggctccatgcaggctcgtcgccaggcagcccctcaaaatcgagtactagtaatagtagtcgactagtcgtagtctgtacgtagactgtaataggttgcggcaggtcatacaattcggtcacgtcaattcgcttagtggtgcacaacacacattcaggttcagacaaatgatcccttccacgaacaaaacgcaacacgtaatcagcacattttttttcatttttaatttttttttaacatttacaaaaatattatatcatctaaaatataaatttacagcacatttttttgcagcaaggtgtgcacattttacacttaggtcccttgccgccctctacaagggcttcaaaggggtaaatgtaattttcgccctaccaaaaatgtatttttctagttttttttcaacttgtccgtccctcacatcacgtcaccctaccgccctctaccggagagggcggtagggtctacttctgtaaatatttttaccggtacaatatttctgtaaatattaaaaaataaaaattttaaaatgaaaaaaattcagtaacagcgcgactcacgtttccatgggccatgtggcagaaagttcaaccaccagcccaagcccgatgcagattatgctttcgcaaaatgtacttgctactggtccatgattccatcagatgtcaaatgggttcaatgttttcagcaaatgtcctgcgaatcaccaggcaaaaaaaagggagctagtacaaagcctcaatacacactggagtaaaaccagcaacggcatctgcgctccacatctcgcgatgtgcagcggtctgagataaacagtttctatgtgatggaacttaaaagtctcttttattcaaaaacacgggagcgggcaatcgctcactatctgtccctctgggtattgcttagttttagttgaggcatgagtaagcgagcgtcttctcctccgacagctcctgggcagtcgcgtccatcttcttccttgagaactcgtcgatcgggagacctgtaagaaacgatagatcatcaggcatttgtaaactgttgcgacataatcagcgcaatactctatacattggcacattttaacagacagcccatgaacatgtagaaagaaggtaagcaagcataccctgaacaatcgtccattcgccaccactgcatgttactgggaacgagtagatcagaccagcaggcacaccatacgaaccatcagagtacacacccatggagacaaatgttccctgtggtgaaaagttgaacgtgttgatgaataattaggaccgaattgagggaaatgtctaaagtaaaattaggaggaaaagacatggaatgtcaaaaggccaaacagacctcaggagtgccaagaacccagtcacgaatgtgatcgcatgcagagctggcagcagatagggcactggattgcttcctcgccttgatgatggcggcaccacgctgctggacggtagagatgaattccgtatttaacctgtttgagagaccaccattaaatccatatgcaatggaaatatgaacaaaaacaaaaactacttttttttaatatatgcagcatttctgatttaccactcatcatcagcaacgagttccctgacaggcttctctccactgggagtcttcacagtggcgtggttaacatcagggtactgggtggatgagtggttgccccagatgatcgcattcttcacatcagtaacttggacattaagtttttcagagatctggccaagtgccctgttgtggtcaagacgggtgaggcaagtaatgttcttctcagggatggatggagcgaattcttttaagatgagagcgttggtgtttgctggattggcaactaccagaacctgaaaaataaaaggtacagccgaacattataaatctctaattagaaagttgagaaagaattaacttcacatggatttacaggcaacttcaaaataattgaatttgataagtgctttttcaagtttaaaataattgaatttggtaatgcataatcaaataggaaaataatggagtgatcaatctcataaactataaatgatgataagactgaattattatgcattatagcattacatgtgattgctactcaaggtgagagcaatgctggcaacttgacaatcattgcagtaaattgcaaactacatttgaaatatttccataccttgcagttaggggctgcatgagcctcaagagcagaagcttgggatttgtagatggagacattttttgacataacatccttcctttccattccctccttcctggggaacccaccaaccataaccgcaacattcacaccagtgcaggcctccacaacatcagttgttgcgacaattcctacaacaccaaaacagaaaagtttaaacatcagcaaggatgctgacagtttaaaaacaaattgagttcaatgaaccagcttacccttcaaaagaggaaatgcagcatcaaccagctccatcttaaggccattaagagattcagtagctggtggaatgtcaagcatgtgtagaataacaggctggtcagcacccaacatcacacccctagcaatcatggggacaagagcatatccaatttgtcctgcggaataaaagaatgaattagctcacaaaagaaagcccctgggtgcaaatttcttaagacacacaagcaacaatggtattgcattccatatgaagtgcaaaccatcagctttcaaatactgctacatttccagatgagcataaaaaaatacatttgttttcatgctgattaccatatcacctattatcatcattcgtgaaagcacccaaaagaaagctagtggcccctcctcagggcttcacctgatccaacctggctaagagtgggattcagagtgtactaaccaacaatcagttacatttccaatgcccgagctcctaagtggagaacaaagcacccctttccacgtacaagaggacctcagaccacattacaaaagtgtttgtgaagtgcacaccacatcagattgaactaactaattcaattaattgccagctaggttcccatctggcataagcatacatcagaaaaatgaagctttcataacaatgaaggcaaactagtttaagttaacaagacagtgatagttttcagctgttgaaagaaaatatttatagcaatttagcaattctaactatggatcacactagacaagagattagaatgagatggataaacaaaaaccatttatatcttggtttaagaaccccaacttgtgtagatcaatttttagcacgagcactgctacacatactaaatttttcttactaaacttttactaacaatcatctcaaccatttgattttagtagatggaagttataaaaaatttagacgcactcatagcatgacatatcagtgttagtaataagaatttagtaagaaaaagttagtatgcatagccttttccttattagtaccctacaatttggtgctaatcccacttattaagcatgtgcaatgcaatttaattatttagatttaaatgtttaaatgccaagatatcctgccaaatcccagatggagaatctacgacggaattttggatcaaagtcactatcactatatggatgcatgataatttttgcagttgaatcctgagctgggataagacatgccagaacttgacggaatacaaacccgatcccaaacagttttgtggggccaaattgaagggacacaccctccagagctaaactaaattaaatgcatgtttcaagacaaacatctcaagttatcagtgtatgtctttgagaaccaagctcacaactgtgactagctcccatcggatcatttgattaacagattaataggtaaaccctcctaaacccttttaacctataagactaacctcccacctctaactatggaatcccacactcccactcatcaaatcgacaccatgatccatttcaaaccactcaaacccctacagatcaaaagaaatacacatggatctccactaaacccccactaaaacctcatgcacagacttaacacaaactcgagtcaactatcacaaactaagcaaaatcagtcccccgaaaaccagatcaagcgaccataataaccagatctaatacaacccaccatcagatgagctcatccaatccacgaaccacaaaacttagtaccgaaatcaaatcacgccagtgaccttctcccactaaataatccgcaccccccccccaaccagatcaaccgccacacaacgagatctagctatctacaaccaccacactcgaaaccctccactggatcggcgcggatctgcagccagatccgagccaccgccccccgcacgagatcgcgtcggcaaaccaagagaacgagggggaagtgaggcgagcgcgacgccgtccgtacctgcggcgccggtgacgagcacgcgcatcggttccttcgccattggagcggaaggggggggggagcgggagcttcgagaaggttctggaagcgtaggggttagggaggaggaggagaggcgacgctgctcttttgggtgagttttgcgagagagggggaaacgggtggccgttatttaacctcgcggcgacggggagcccggagaacccccgttgctcccacgtgggggctcccctacccatctcccactgacggtgggccccacctaggtgggtccacgctgtcggcgacggagcgcgtggggtgggtgggttggagccaggtgtgcgcgggcgtgacaccgtgggcgctggcccacagatcggcgatgggatctgggaaacctgcaacggagacgctaacatcctgacaggtggggacacgactgcgcgttgtggggacaggctgtcagtgatgcaggtggggcccacctggcgtttcgggagaagatgtggccgaaattctttttttgtttttggactaattattaaagtttgcaccagaaagtgtgacgtcgatgccgtgtgggggaagaaaagatgctccgttgggaannnnnnnnnnnnnnnnnnnnnactcttttcttcttccttgggtaacgacgatcatgacatcgtgacaaccgccgtatggagtatttcagaacttatctacgaaaatgtgtgtttgtggatcgtgaggacctcaagtgttcactgaaaataacatgtcattaaaaatatctatcttccacttgatcttcgtattagtgatgtccgtagaacgagtggaattttggagtatacgaagttatatggactaaaggattgtttggatggagactagctttactataactgtagtaaaccacacaaaggctgtgttcgggagtgagggttgggtacccgacacgtaaaacgaagcagcgtctagcgtgagattaattaagttttagctactttttttaaaaaaaatagattaatataattttttaagcaactttcgtaaaaaaatattttgcaaaaaacacaccgtttaacagtttgaaaaagcgtacgcgcgaaaaacgagaaggagaagttgggaacatgtcctatcgaacgtagccaaaatgtggccaacaatttgttagccacaattatggcaaactttggctagaaaatgacaatataacgcacgggccaatgtgctaataaagtgtagcttaattcaactgtgtctaagattttggtatagcaaattgcggtcaccaaccaaacaacccctaaattaagctacagaaatatttttacactacaatgggtggcttcgttgaaaccaaggtttgaccatcggtcaccatagtttaccaccaaggctaaataacgaaaaatgtttgttacgaatttaaaaaagtttttaattaaccttttctagcattttagcttttatctgttttgctcggtaactaacctattaccgaggaggggtacaacgatgataagggaaccactagttgaagatgtcctatatatatggctacacaacaaatcattatcatgtcaatttgtttcaacttgacttttattaatactaaccaagtatgtgaaggaggtcaggaattgactatagtgatgaaatacactctataaatatttaatgtttattagtataagatttggctaacatttaaacccttgtccatcgataattttttaaatgctcttttttaaaaaaaggacaactggtatgcatgaatttttcttgaaaaagtactatcataataccgtatgcttatttcattttacaaacttatgctgatgtaaaattgatggtcaacatttcaaagcctagtcagatcctattctaaatgtcaaatatttataatcggatgaagtaataactactggccaagtgtctccaagacaagactgtaggggttcaaaatttgagacattcaatacccaaaaatatcatagttattgtattataggaaaatgaatggagagaaatatgattgatgaatagtagaggggatgaccaccaatccaccatggggaaacatttttttatgctgagagaaagaaatactagatattaagattaagaaattaggaggttcacttgttgtaaatgtacatcaattcaatactgctgtcccgtctgcaacaaactcattgtgaaggaattacaaaggattgataaaggcaagcatttcctttgtatccatacaacttaaatagggcaaacaatacacaatcttctctctctgtctttcaagaatcacaatcattttaaggttgtgttcttttcccctctttcccaaattacttccctcgtttttccacgcacacgctattcaaactactaaacggtggatttttttttgcaaaagttttctatatgaaagttgctttaaaaaattatattaatatatttttttaagtttttttgctaatatttaattaatctcactataatcgtgtgtttcgttttccgtgtcaggaggcaaggttcccaaccttgcctcccgaacacatcctaaggcactatggagattcaactcatataatagaattgatactacttcatttatcattctcaaaggtaaaaaaacaaaagattatactctcaccatttttaatatatgacaacaataactttttaagatacatttagggagtatcttaaaaactaccgcaaattttttagtcaaaaactttcatatataactataatataattgaaatataattaatacattgtaactatattgtaattatattgtaaccacgatataacttactagtaaaacgtacattcagctatggtttcattagctagcacgtgaatcttatacgtcacatgtgtgaaaatttctttctagcaaaattttccctttatgcacaaatctgaaagttttgagtgcaaaaaaaaacttgcggaagtaatttgagtgagaaaatcaagtgagagataagaaaaaaaatctttcaagtgagatatatagagatatagcaaaatcgtttaactattcacctccatcacaacaaaagcacaatctgaaagcccatgaaaaccgaacacaaacggcctaaaagtccagctaaggctcaatcaggcccatccatcccgctcggcccactaactcctccacactctcttccttcttccgatcgccgcagatagcgcacgccacctcccctcccctcccctcccatggcaacgccaccaccgccaccgccttcgcctcgtcgcctccgccgctagccgttacccccccaccaccggcgccccctcaccttctccccaatgtcgacggcggcgcccgcatccgctacggcggctgcgagcctcttcctccgccggagtctctcctcctcctcccctcgccacgtcttcctgcctcattgggttgcccccattgtcgtcgcgcgccccgctaggtaaattacgcccgcgttgttgggataattggttccgtgcctcgtgaaatcgtagcccaacgttggtagagttcgtcggtttcgcacactttattagttgtcggtgggggtttgcttttttttttttttacaagcagttgttaattcacggtaaatcacgatgaggaaaaaaaaacaggttatctgcggtgccggcgaagcgcggtggaggtggtgttgttgcggctgcatcggcggcggcggggagcgcgcagtttggcgccggggacagtgagaatccatacgaggtagaatgattgggttattgggagtggctatgttcatgtttaggatcagccttcgttggtgatcaggtgattcagtgattggatgtggctcctggtcttgttgtgatggttggtccctgtttgttagattttggggatcagtccacttgatgggttcgaccaggtgaagatggcctataagcggaggcgaaaggatgccgagagcaacaaagatgccgagcacctgttcaaggtggttttgggtcatgggggttcagaatttggttactgttgtgttgttaatgtattgatgagtgatggagttttgtcgaatttcagttagagagggcatacgatatggtcatgatggagcagcttcagaaccggaagaatggggtggcatatggatcaatccaggttactctctactattatttccttgtcacattgatgatgcatggtctacagcaacaaagtttgcacttgcgcgttactgccctttttttgtatgtgctccaccgtttacggtagcactgttcaatcccatgcagtcggcaatttggcatatgtatccaattagagttagatatgaggattcatattcacaaaattgatttgtaattgcaaaactgatttgttctgtatatggtaacagactgttaccattcgtttggtactccttggttaaattccttcatgctaaaataaacacatactgatatttactgttgagcgacgtagtttgagatgcagagatatctaaccaagcaacgcattgcctgctattaagcttgatggttactttagcatggtgaatttgacggagatcttagatgacttatcttgcatcgactcttctagtctccttactggagtgaacttcatgagacctctgtcggttgccatgtttaagaggatccttccaacatatggctaataatgaaatgagtctcatgataattctctattctgatgttttctttcactgattattcagttctctttctgaacattaggtgtcaaaggacattaaatatgctgataatcaaccagtggttccttgggggcctaggtaccttacagttcacattttgtaaccaatctcttcatgtgcttcttcaatatatactgtgtacattttgttttccaatgcatctatacactatgaatcttaggagacttaacagacttaattcttgactgcaatcctgcatccatgaattgggcatccttgttacttaatgcagttctctagcaaaacttgatgatccaatgcccatgcccttattgtttttaaattttaacttttctctagcataactgttgattattcacatgttagttccaaatattaaaactctgggccactggaaatatcatcacacattaacacctatccacttctttgttagctttagtgctatgctattgccatttcatgatcatcatcatgatcatcttgcagatactcaagatccactgggaaggacctgcgcattaatatggcaatatcagcaacatttgtaagaaaattattttctgtatcatcccaagtaccacattgaaatattaataattactgtttttaatcaaacacaatgttttatgaatcccagtggattgttcctctgtactcaactttgttatatgcattggtgttaaacttgaaattacacaatagaaaataatttgaatttcagcattatttcacataggatttttttaatcatcagcttgccaaacttcctatcttgggcaagtcattttgtgtatggagaaaaggtactttattaatggacatttttttatccttttttttttgcagatcatgtatatatctaccatgggccatgcagactggaagcccatgcagtttttgtgttttgcctatttctatcgaatacttgacaaactgaaggctaccgagtcagctagcactcctatatacaatgtgaggcggtttactaaataattttatttgctgttcccttttcattttctatggaatccctgcacttacaggaatgacatatcaaataatcaaattggttcagtttgctttactctattgtagttcagatatgataagagcaaaaggtacactagggaaatggagctattagatgggatggaattcttacttttcatgagttgggaatgcatatatttgatatatgtggctccttttttagttacaaagttacataagtgcatgcttgtcttgtattaaggatcttagattacttggtcactagtttttagctttgcagtt

SEQ ID NO: 63100 - DNA, 3072 bp, Oryza sativa
tgttaaatataatattgaaataaaatgtttgtggcaggagtatggtgaggttgaaggtcgtggcatacacatggcaaaacgagtactccgtagtttgggtttggtacttggatcaatacttgctgtatccctggttagtgggttgttcggatacagtgctatctagatgctaaactattggtttatctgccagttttctctactgtttctcagtattcgtatcctcaccctaatgttttatccttttcagggctacactgggctagccaatttttctcagtttcttgggcagtatattccatctgttgtttataacttccaggtatgttatgcttgagcatatctgatgttgtttgggattattttattggatcagagtgccacatttttatattcattcttgttaccaagatcacatttacagccccattgtttcgcttattcggggaataagcgaaacggcatatttgcaaacgaaaaataatgtgtgaatagaacttttatatacgtgttcttagcgatctaaaagcaaaggctgaaaaataaacttcgttaaaaaaaccccaaaatcaaatccaaatttaagtttgaaaattcaaattttgactgataagcataagcataagcgaaaagatgaggccattaagctgataagttccacacttaaattttctcccatttgctaagttacacacttaaaaaatttcacttctgtcataaagtagaaactggaaagttgttagtgtttttaaaaagacagacaagcctcctgaaaataatattttttcgctggaggctaaaagttaaaaactctaataagaatactggagtaagcaataagtgcaatctctttttctggtggagaacatgtaatggaagaatgctagtgaatattgttgctgttgttttcaggtgaagtaaaactaattggtggctatcttatgccaggaattgattgtgactacagcttcatctgttttgctttgcatattggcgtcgtactatcgatagcaacttgtgtaattgtgttggatcaccccttggcattgcaatcttgataaacctgtcttcatgagggccatggtcgataacttgagcctattctgctatggaatatgagagcccatcaactatataagtgcactgttcttgcatgttttacatcgttcttacatctggaaaattttgcagctactgataagatgttctatccaatgttttgaaactgaaatttagcatgcaagagacagacagctaacaaagcaatgtgtcacatgaaacctgacgatgctgaaaatctagttctagtgagttgttccagcaaaaagttaactgcaattttcctagaagtttccttgagtttgcaatctgcttgcaagttccttgtatatttactgaacaattactctgtgttggtgagttatgaattacaacgtccttatggaatctgcctacttgatcatggaacctcttttgctttagttaatcaaaactaaggtacaatgcctcctctctcactctccacatccaagggaggatgccattttttaatggccaaataaatctggaattggcatgagaaatcggcatctaatccagtcctgaaaatgaacaggatatttaggaaggttaaacagtctacctaccaatctgatctcatacatatacgtagtgatgtagcagatactagtcagcacacatatttgttttgctctgtatgcttccactatacctccttttttcttatgttgactttttagacacattgacaattgatttagtgctgacacacgtttgagttttttccctgtacgagcaaagtaacaatatggaagtatggaagtcaatcactaatatcctatcatttgcataatgctttatagatatatatatatatgtttttccaacagagcattcaaagttttagaaatttgaccactgttttccagcgtctgtcgaataactggcaatgttccatacattcagtactttttagataagacaagtgtggcctcttggcttttaagatgtacagcttgcctcccaaattttagttcgtactattagtgtcatctaataatgcatgggacctattaacatttacagctttcatgtcaggctgtagaacggccacaacttcatctgagaatatcacccagcatacacatgttctccccagtggtgtttttcaatccagctgcttcgtacatgcgccacacaccatctacgattgttctgttccatgccaatttttgaaaccccaaattcaagattcttgaccggtgcatgtccgtcccgttatgtttgttggcttcagcatctcacacgattcacaggtactcatctcagcatttaacaacaccctgattagtccttttctcttaagctgcaataaccgaggagcttacactaaaaccgagcaaattccatgctcacacagcacacacacgcacgtacgttaacatgcttaatcaaacgctttttcatcttgtctcatgcgttttgaagctaccgttgtagtggtatccttgtcctcttcgaacgatcagaacatgggcgtagtgctgggacacacgagagcacaagcacatggaacaaagaactaattgcgatgttaattaatttaagaaatgctgttgtgttgtcattgtcctgatgatatgggtcttggttggtgctattttcatattttatggagtacctgttgagcccttattttgcagaaataaacaggatgaacacgtgtccaaccatctcgaaagaaacaaaatgaaatcaaagtaaattgttttgtaccggaatagaagttgtggattcctgctgcggcatcgtaaattggaaggaaatgcttgtaaatgtctttgtcagaatctatgagagcaaaggtctgctatactatttgttgccccagatccggtgcagttcctacttccaacaaatactccaagttaaacaaagagaagctaggtatgtaagcaaactataccacctgcacaaatacagttttgcatgaattaatttatcctatttcacagtatcgtacaagcacatgcattttttaacgaactaaca

SEQ ID NO: 63101 - DNA, 1471 bp, Oryza sativa
tttccttcttccttcatttttgcatatatctaccaagtactcccaatcaaggatcgtaatagagttgccccgtttgtttgagcttaaaagccattgctaattttgaactttagaattaattatggtttcctttgtcgaatttgaaactcagccttgattttttaaccgccacgagtacaagtgtaaaaaagtcttatcctaaaattacttttcactatatcggtggtgtatcttccttgtcttgtcttatgcagccaaaaaagaaaaaagaaaagccctccaagcagaattgccataaaatctgctgagtttaatttcttttcagtcttccacacgacaaattgagaagcttaacatgcatccacgcacatgtctgatgaatgcgtgagaatgagacatctatatactagattgacgattttgcatggcaccgtggtcaccattttctggcaacgcaaatagtacgcttcaccgacaaaatggcacgcgggtggcactctgaagcctctccatcaacctaagcgcctagcctttggtccttctcaacccctatatgcacttggcttaagtacttcggtcctcccttgtctagtggaggttgtacactcgtactcctattctggttcccattaaaatgaaaaatacgtacaatattttctttaaaaaaaaacacaatgcaagcacacatgcatactctatcctatcctatgagcacatctgaaagagattttttttgaaaatttttttatagatggtttaaaaaaatatttccaaaaactgaaccttttagccacgccagtgtcatactttttggaaaggactattaataaaattaaaaaaaataaaaagtctaaaaaataaaaaaaatactccaaaagactagttcggtatatcttaaaactgactagttcggtacatcgatgggtctatcactaaaagaataattaatcataaacgcgaacacccatatcaaatctaaaatcttaaaattgggtgagctggttacaccataaggaatctaactgaatacactcgctttgcaaaatatgcacaatttatatgaatttgtttctttaaatataattcatcttacaactcgtaccaacttaaccctctttatttttattcttaattttcttggcctgattataagttgtctgtctttcccagacatagtaacggagatgatgaaatcactaagttaaagctgtggatttagaggttgtacataaagtgcctgattatacttctttttaatccttcctcacaagttaaagatgtggatttagaggttgtacataaagctccgaaccctataattaatgtgtttatgccttgtgggattagtacccatatgtcatagataccatagatacgtggaaccaagaatcatgaaacgccaccatacgagaaattttttaatcttttttttatcatttttcattttaaaactatattctaaaaacttatt

SEQ ID NO: 63102 - DNA, 5419 bp, Oryza sativa
gaagatcaccggagcaccgtcgccgccgtcaagccgaagaccgccgccgcttcaacctcgtcgccgttgtcgtccgttgttcttccgccgccgttttggtcaccggtgagttcgccgcgtcgtcctctacgtgctggtgcccttcgtttgcgtcctcgcactgtcgttcgccggcgagcgtgcgccgtccgagccgccgagccgccgccgccggtggtgacgtcatcgctgacgtcatcgtccccgtccgtcgtgagccggtcgtggaccgatcgatctcggccgtacgttttggatcaagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatttaagtgttttaatccgattaaatcttcaaaaattcataactaattcatcttagctccgatttagttggttcaagtctctaaatttttctaaaattgagatatacatgttaaaaatatccacatatactgttcatgcttgtttatgtgctgttttggtgtttttgcttctttttgcttagattccgtcgtttccggagagtccgttttcgccggagaagaatttgaagagttccaaggccagcaaggcaagtcacacagatcccaaacaaccctttgagcatgttgatcctatttaaagctactgtttttattcaactattgcatttattttcgaatgtcattgggtggaaataacctattgtttgttacaacccttttgttcttgattactttattccttgataccttgggttattataacttgactagttgagctttatatattggttcaactagatattagatataattgcttagccctgcttagaaacattagctcactattgggttaacttatgactcactgttatttaatgatggctgaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtgtagcatggttcattgcggggcaccagactgagaagtggcggagataagcccacgggggtcgctggggagtccataccttgtttataagggggtgattatgatccaggaaaggtgcgccgtagtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtctcacccttctcaccatagtaaatgatgcttcaattggtaataatttgattagctcctggtttggaatggtatattcctggtttggagatagaactgtgcagccgggatggttgttcagaatggttgggcctatgcaacagggtatgttgtatagcgttggattaatattgtttaattacttaactgttttatcaaattctcaaatgtttgctaaatgctgcttttgcaaatgaaccctactatgccatcctttgttatcctgtgcacttgcatatttgctgcgtggcttgctgagtatgtcatatactcaccttgcaatcattcatcagaggaagagttctacagtgaagctgatggtgtggaggattaggtgtagccctggtcaagctgcctgtggagtggagccgtctgcgccgtttatcttattttccgctgcttagatctttattgattgagaggaactatctacctctgtaatgacattttatacgcttaatcattagagtaataattgtactctattatcaatttgttcttgtgtgcctcggctgattcctggacgagggttcacacacatgtaagcgtttggaattttggatagaaattccgggcgtgacagagatgcttagccatgcttagttcaactagtgcacaaaagggggtcacattaaagtataggctttgattattagcaatagctttggattagtgccactgcaatggtgttggttaattaaaatacactacatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagctgacgtacccaggcgagggtgggcatgatggagttgggtcggccggggtgtccggttgatcggcttccggattcaccgtggcacgaaaggggggttgcccgttgcctgctggggacgggggcgaaccctaaggtgtggtgcgatcggttagagagggttatgcgaacggtcctgtcacggcctctttccggtatgtcgtggtggcatgtcggcgcacgggaacgtgtcgtggggctgtgtcttgtgggtacagttgtacacctctgataagagttaaactattcgaatagccgtgcccgcggttatgggcggtcgaccagattcaccgtgattagtctcacccctagtttagcttaatgaactggtgtagtccaggtggttggttgggcctgttgcaacgtggcgtagcgttggatagtgactggttaacattgcttaattactacaactgtttttactgttttcaactactggttttaaatgcctgctttatgcaaatgaaccccgtagcctcctttggttatatcttgcatcatacctcctcttccggtatgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagccttcaggcttagctcgcttttatctttttccgctgcatttgtaatcttttgtatttttgtaagacgtggatctgtatgtcaacaattgtcgtttgtgtaccctggctggttctggacaggggtttaatgcacattcagcttagaaattctggttcgtgaatttttgggcgtgacaacgtccccttcggtcggtcgttcctctccgtcggctcgtcatcccgttgtgccgcctccgtcgtcggcatcgcagcggcatgctccatgccgtacttgcctccgtgcagctgctgccggctgccatcttcgcctcctcgccggccccggtcgtcgtcgtcgtcctctcgtcgttaccggtcgtcgtgctgttcgttcctccatcaagccgtgctcgttcgttgcccgcgtttcgtcagagtgtgctgcagccccgtcgtcgtcttcgtcctcggctccgcgtcgtcaagccctgcactggccgcgtctcgccttcgtccaaagaccgccgccgaagtcgtcctctcgtcgttcgcctccgtcgtccctgagccgtctccgccgcgcccgttcgtcatcgtcgttccacgccccgtctcgttgtggtgaggaccactctactggctgccccgtcctcgccctttcggtgtcgccccgtgcctgttgtgcggttgtcgaccccggtactcgtgtaccagtgtcggtagtcgttcgtgtgtgcgtgtggtgaccgtgttagtgtgcccgctcggtagccgcgtggtttccacgtgtgtagcccgcgtggtatctagtggagtccatttgtcggccactggcctcggttgacacacagggtccgcttccgtcaacccgtggaccgtctctgtgtacccggtccaccgtggtcccttaggttgacatgtggggtccgcatgtcaacagcgcagccttcttgtcttttccaggctagcgcttacacatgttttatagttgtaaagcttaattataataatccacaaatctccgtataacagcattaaacttcggatgaccacgtcctggtcatacgaactccgaatcgacctgttcaagtctcttaatgtttattataacctaaagaaccatgtgcctttctttttatgtattgttattgcttctttgtaggcttgtagcttagcttgtgtgtttcgcgtagcttccgttgttccagaggttcccgaagtgtggttcgtggttgtcgccgaaggttcgaaaggccgttctctctaagcaaggcaagtcgcataatccttgagcatattgaatcccagtttataaaattattttgatttaaattattgcattaacgctttatttaagtttttgcgttattattgttttatttagcactccctattaatccttgttatagccttatcattgctattgtttattatcaccttgttcaccctaggaaaataaaaccccaactagtgggtaatctatgcatggttcctctagtatgaacttaggtagatgcttcgctgattaattaggcaacattaggtggttttataactttagactttgggagttctcatatcatttggacacacacctccccctctattcaaaacccccaaaatggttttaggttgggctcgaggtgcatggttttgatagtagcacctcggccatcataaggaccggtcttcgggcctctattgcaaagcactaccgtactaaccacttgtctaatgagtaaggcttaactcggtgtttagtctagtcctgaacaaaacgacacggatagagatggatgaagtcgttatgatgaatatctctgaggcaaatgtaggctacacgggctgcggttcggcagtcgagatatgtaggcaaatgaaggctacacgggccggtgtccgttagccgagatgccatggcactggactagcacgcgggtggtctcacctctatgtgtgtggtgcacccggtctaggtcctattgctaggggctcaatcctggcctgcctgtcccgggataccggtcgtaggcagggttgggtcggtgcttttgttcacggctaggatgggtgaagggttatgtcacgttttttatgatgggttccacttgcaagggaatgcagagtaaaggcgtgtcttgttgttaacagtgaaatttggtaagcccggagtagtcatcggcttagagttagcatcggcttggaagtcctgagattagccgatgagagttgtcaagtcgtcagttgtcggattcttgctatattcggttaagaaaattgatctactaaaggaagcttatccagaagagaccgagttcaaagagaatgcggcatggcaagttatctatta

SEQ ID NO: 63103 - DNA, 1938 bp, Oryza sativa
cttttatgtttaggaaagtttctttcttgtccgacaaggacttgtatcaacccatgggtataaatatctacacccgaggtctatgtgatctatctctacgatcaatacaattcagcgcatcgccaccctttttacttctacttttgttttttacgttccggcggaacttggcacccgacgcggggctgcatcgtcttcgatcttcggcgaagggataagtccaatgttccgtaggcctaggcaattctatcgtttacgtcggcgtcgttcaaggctgcatcagtacattcgacctcttggattgctctggtttggatgatatttttgtctacctatttatcatatgtctatgttaatctagtcttagcaaatcaatttatctctatcggctgcttctcgttttagggtttctgccggtataggctaaatcgtgttgttagattagattagcttagacatctaccaccctaaaaatcagtcaacgacttgattgtctagatattatgtttcttttcatacttagtgctgcatcagttaagtttgatctactaagccgtgcttaaaaccataatctctagcatgcttcttgattgccaataagggtttcatcggggtttcagccggtgaattatctggacgttgcatcggctcataaggattgcacatacatataagttggatttcgccgatgacaacaaaggtttcactgtttaatctaatcttgtggatttcttgacatcggacctccagccgatgtgtgctttaaccttcggatcgatgcttatttatcatatcattgctagccgattggtttatactggattatattgcaatattatattatcatcagccgattgcctttatatcatcatctacattggacatatagccgatttatcgaaatcctatcgctattggctggtattggcatcggctattatcgatatcggctgagattgctccatcggcttatcagccgatcgactactttgatctactatctgcatatcttgtaagttgcaggatcaaactgacttgcacgcccacatctcatcaacctttggacctgcacaggagctaagcagatctcccaggccagtgtgttcgatttttttgtcaacacttgtgggtaaagatgtacacctctgatcagagtataatctattcgaatagccgctccctcggttatgggcaagcctagcaatgtacccaagttagtggtttacttcttaaaacttgcttaacaactaaaacgtggaatggttggcctgggttggcttgggacgaactgggacccaggtagggttgccagttcggtcggaatcatcataggccttgggttatggcaggttcgtatgggttcacggccttgagtaataatattgtgtagctctaggattatatttacaaaataactttgggcaactaagtgacttttaaatgctatttactgcaaaacctaaccctatattattaccccttgtacccccttgcattaatcatgcatctccctgtgtgacttgctgaatactgtggttgtactcattcttgctctatctctctctctttcagtaggagaagctttggagaagaagtctgttgacggtcgttatcgatcagtttcgaccgttcatactaccaaaataaaggagaactagtgatgcttgcaatggcataaatctgttagaacaataatattccactagtattaggtttactaacttttttacagagaatgatcataaagtggaggagaatcgacattaactcagacgataaatcaatcggacgatgtcgggaaccagacatatgaatagatgggccaagaactcagaactgacacgatgaattgggccaaaattcagaagtctgcgaagtggagcaatagaggaggccaccagccgaaattaggctggattggaccagccctaggttcgg

SEQ ID NO: 63104 - DNA, 7812 bp, Oryza sativa
ggccgaaccaatcctggcgccgttggatccaggttttggcgtcaacgtccaggattgcatcccaataacggttggagggcacttcggacaattccccttctacaaccgtcataactacctctatataaggagctcactctcttcacttcacacacatctcaagcaatagctctctcatttctctcaagtttaatttagtagtatctagctggtggaatagaaatagaataggaatcaggagtccggaagccttcggaagagttcaggtatggctctagtagctttcctttcctcttttctaagctttgtacttttattagaatatttttctatatacatttatggtattgaaaggctttccaagtatatgagtacctactttataatatgttcatgttatgctgaatatacggctagcttatctgggagatggtttggtgcgggtataatgtttgcatatgcaattgctctataccatgacgatgatattatagtagtatctggtaatttaggtgtggtgtctagattacgagatatcattatttggggttatatattgcggatgagaggtgggccgctgatggtgacaactcaatacgggtattccttcgcgcctatatataatcctaagttaattccctggggagggtattcctccgtatttagccccgattgtatggtcatgacgggctgtcgtaaggaactcggcaatcaggggtggcttctcaaaataccaggagggcatcatatagagggtattagctagtatatcagttaactataatgtatgtatactatgtatattataagtatatgaatagattctctttctcttttctttcctcctagcttagattatttattatgagaatgaattgttaatgcttgtgtgtcactttacccttgaattatcttaactcttgcttagaatatgattatcacaagtaatatataaactattagtcaatctctctctacatgatctttccacgggataaaataaatacgatacccttggaatactctcgggtgaaatgctacaatggtatatccgtgcgcttgcggataaactctgcaaccataatataccagaagtatttctgcgccattgctggaaattatatttctagtaatatcgttaagaaataccaacaaagtcctaggtagagtcctgtcttataccccagttgagcgccagtgaagatggagccgtaggcccgctagtccgctactgtttatttgtgtttgtcaggccttaagtgcctttgtaataatgtaaatattatcgatataataaagatgtgtcttttgtatcatgtttgtgtggtgtaccttggcttttcaaggatggggataaatacactaccgttcaggaaaatgtatttttccaggcgcgacaacatgccctttgtctccactcttgatgaaccctgagttcctctcgacactcaaggctgttgttggcccgatctttcggtgagttgtgataactacgatttgggagaaacgttgacgatccgactacaaccgtacgagacgtgtgttgcgccttagcgatcgatacacctctccgtgggttgttgatcttgccggtgcagatcaaccctattcctgcaagcaaatcgaagaaacaagcaagaacaagataaaaagcaatctgatattgcaaataggaatttaatacaaatgataagttggggttccgaagaacaagcagacggacggtctagccgacacgcgcgctgcaaacaagtagcaatggctaaactttaatctaacaaaccccccagaaaccctgaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttctttagttgctgccgactgagatggaatttggcaatgaggcttgatgcattggaaagaggactccgagagctttccatcaagtactcacgggccgaaaacggaggtcgtatggagcttcggcggccgtttgaagtcagcagtgagcaggtggccgaattggattttggcacttggaggactcgaacttgatttcttgttgttcatccatgatgtgagcaacggatgtatccgtagtagccatggtcacatcatgctccccttcttcacagaaaaccgtcctcggtttttccatatggtgtcttcatatagtccattcaaaataacctgtttcatccaatcaaaactggagaaactcgaagtagtgtgattagcaataacatgtttctctaaatccgaacaaatgaaaactatatgcaccaaatatattcctctatcattatatttgccaaagatatgaaaaatagcattagttggacatagcaaatcagacttagcaaataatttctccttcaaattatcgagctcacaaaaatcatcaaactgaatatagcccaaagtatttaaagaagatagcaatttacgttcctcaacttcattagcaatgtgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaatgaattccagaatttggttccactaacggttgctctacttttgcatgaaaagtggacaaatttacttcgttaacaatgcactcaccttgattagtttcagtaccatttactttaccttggatgtcctctttagatgatggaggtgtctcgaacttgagtgtgaacaatggaattggtggctctttcatgtctctctcctccttttcgtgattacgcacttccagcaaatagttagtaattggaggcaaagacatagcgtgtttctttttcatatcctcctctattttactttcagcattgcaagcaagttgtaacaaatgagaaagagatctatacttttcacaagcaagcgtgtcctgaatttctttgttaagtccacgtaaaaacctcaattctgtagcttcttcacattcatctaagccacaacgtaataaacaagcatgcatatcataatagtatgaagtaacacttttggtatcttgttttaaacattgcagtttgttgagcagaatatcagcataatacatgggaacataaacatctctaaaatatcgtttcaggtctttccaagattgtggtattttgttatgcctacaaagatgtttccaatcattagaagcatgtttaactaaaacactagaggcacacataaccttttgtttctcagacaagacatgcctttgaaattcactatcaaccgctagctcccaattaatgtaagcataaggatcatagtttccctcgaaataaggcagtgcagatttgatcttacctagaacatcgtcacttacctcataaaggtcatgttgatcactcctcatgtctcgacgaagatgtcgatggtgagcatagctatccccaattatcgtgcgtatccctgccattgttagtagaaaacaagaaacatatacaaaaatatgcgcgttcctattaactactaggtagtggcagctcaaaaatcacacacactcaagcttttaaccaagctcttacaagatcttaccaatgcaagcggaatggtgacatacaccgactcaaccaagcaccccaatggaggttggatgtatcgatgccttggctaacacttgttgtacggctgcaatcaaatctgtggagctctgggtaggcttaaatatgtagcaaaggaatagcaaatgctcaaatcagagaatgcaaagttgaataattgttcaaagtcaagcaccgtgctggtcctaggctagaacgtactagagacgcgagcctagacacaaacgataccacaagatagcactaggaacaactcatgcacaactctgatatatgagttcagctcaaacataacaatattttctcttttctttctttcttctttcttttttttcctttccttttcttttcttttttttttgggtgcggcttttcttttcttctttttttatgcaccattctgccttttttttctttcttttttttttgattttattttacaaaaacagattaaaggacctcaatgtaagattacagggactcaaacgtaaatacaaaatttacagggactcaaatgtaaaagttaaaacccaaaattagaactatacaaaaatggaatcctctcgtcctgtaggttccgtttttgcaaacggattttcaatccgatactcgaaaaattttcaccaagcagtatgcaagatcacggtatagattgaaaccgtgaccgagaggagacactcggactcggcctggtcgcggacccggggcggtggtgggtgaggaaaggaaggatgcggcactacctaggagtccggttatggtgagagaaaaagggaaactgatttcaatcaatctgatctactatttctttccagattaaactctcgcacttccaaaaacagatttggaaattcttcttcctcctctctacaccggcaacaagcacaggccgatctattcacgggcaaaccagaaactcaagcaaatcctaaatgcaactccaaaactgaccgataaaaaattctgaaaactacaaaaacagaaccgtggcagcgagccgattccgttttcgtaggtcccgacaacaacagagacacggtggcagcgacgactgtggtacaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaagtaatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggataaacgttgacgatccgattacaaccgtacgagacgttgtgttgcgccttagcgatcgatacacctctccgtgggttgttgatcttgccggtgcagatcaaccctattcctgcaagcaaatcgaagaaacaagcaagaacaagataaaaagcaatctgatattgcaaataggaatttaatacaaatgataagttggggttccgaagaacaagcagacggacggtctagccgacacgcgcgctgcaaacaagtagcaatggctaaactttaatctaacaaaaccccccagaaaccctgaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttctttagttgctgccgactgagatggaatttggcaatgaggcttgatgcattggaaagaggactccgagagctttccatcaagtactcacgggccgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtgacatcaactcttcaccaccaccaactcatttctccatcaaactctccactcgatctcctctccgtctctaccgcttctcttttttctcctctgcaccattgtcatcttgtctcctggtgctcgacgaggcgtcgtctaatagctggaaaaacaaaaatgctttggttacttacccaacggtgtcctgtcgaggggtgatcgggatgacgccggcccggctggtgagacccaccgtcggcttaatcccgaccaccgaattccacgacgccgggcagattatcgacccatctgtctccgtccccagcgtcaccgccgccatgttcgccgccgcggccaccgccgaaccgctgctcgaccagcacggggtagccgtgaccacgtacgggttcttcctcatggacaattcgacaaacactttgtttacgcgatgaaatgctggggagatgacatgcacagagttttggggttgccactaccaccacttaccagcgtctcgccgccgcgtgcgctccagccgttcgtcaagggacggaagctggaccactcggcggggttggacttgccgaggatgacggcgccggcggcgcggaggcgggccgccacgccggcgtcgcagcggacgacggagccgagcagcgccagcgacccggccgtcgtgttgagccggtcgcgcgtcgcgatgttgtccttgaggaggacggggacgccgtgcagcggcccgaagccacggcggccggaggctcgctcggcgtcggcgcgcgccgcctgggcgagcgcgtcggggttgacctcgatgacggcgtgcagcagcgggttgaggcgggcgacgcggtcgaggtagaagcggacgagcgctgtggaggtgaggctgccgttgctgaagccgagctggatggcgtcgaaggtggcttcctcgatctggaacgctcggcaggcggtggcggcggcggcgagcgccatgatagcggcggcgagttgcagcggcaggtgagacataatgcacgtgcttttagtgtcagtatgtttttatttgcgtttgttaatcgagacacgaacggcatgagtaagagtaagcaccgaacagggaatttataggtatagcagtggaggagtatatgatacgacacatatgccatgacgccactattactaattttcgcacaaatgtgctctttagttaaccaaatcccacgaatgttcgtaggcaaaatttgctacggaacgctaaaaaatacaattaactaagagataccgtaaagacataaattaactatggaacactgtaaaatagtggtaattagctaatagacaccgaacacactattttattatttttataaaaacagagagagaaagagctgcgttttgcttttgctgaagtcgcaccgatgccgctgggatctgccccatggcagtgagctgccacgccatgaccggactaaacaaatgggtgagagaaagagataagaaagagaagaagaagaaaagagaaaaaaaatagaaaccatgaaaaaggaggaagaaatggaaaaaaatgaaaaaggcgatgatggagtgatggatgtcgcgcacgccgccaccgcatggtcaaacggcgtcgtcgcccggccccaacagccacacatgggcaaagccatcgccctgtcgcgcctgcgcgaacccatcgcatccacccgcgccacagttctcggctgcacctgcgcccgccgcgttgccatgcctggcgccccggccgcgctcaccctccagccgcttgcagcgttggccattcgcgacgtcggccgcccaccatggccatctacccgctccaccactcgcagcgtgggcatccatagcgcccactgtgccgcctcacccctggtgccggctggaccatgcctaagtattaattacttctctaatacttgcgcatgaacttccttctctatctggagttctaatactatagcacttagtacgagtactaaacaatgaacctgtaaagatgtaaatctatctttcttagatgaaa

SEQ ID NO: 63105 - DNA, 50992 bp, Oryza sativa
cctgactctctacctatctctaatatacaaaagatacaatagatcctcttgtaattcagcttaaagttgtgtgttctaaaaatgagatgagctactccttttatttgctccatatgatggttataggtatgcgaaatttccaaaatgccgtccaaccatctttgtaaagttatcagtagcatacacgtggaagaccaggatcaaaggcgccagtggtggttcggccgaaccctgggccccacctcctagcctctcctttagctaggagattgagtggtgggtcctgatggcagttacgacagttatgacccattccatgatggtttcacttgacttgtgggtccttcaatccgtgtacttgtgtctaattggccggatgtatgttttcttatatgactggtgtgttttctccttaaaatacctgcatactcatatttcaccaacactagtggaaataattagtaataatccctactactaagttggatatcatattttatattattatatgtagacattgacggtcagatattatgatttaaggatcgttaacagtaccttttttaattaaccggtacctataatatattgtaggtgttattttttaaaaaaagttaccaataatatcagtgatgatttttctttataatcgacacctataattgctcaaaagtgccatttgtatattttttaacctgcataggtggaaaaaggtttatgagtgtcgattttatcatttcctgcatctatggtaccatcctttttgtgtgtttatatggtagtgccttaggcccattggatagaggtccaatacaagcggtagaggagaccttgccttcatctctcccgtctatcttggctgtcgcgcagattaaacgcgtcgtcgtccatgccgggttggtagcacagcggaaggataagttgtacttaagaaatagttcgagcaagtaaaatatatcttttttttctttctagctactttggaatggtcaaaacatccttttctggcaggacaattggcttaatggagccaatccgagtctccgagagttaagagtaggagaacggtaacagtttaatttagacgaggtgttttataatgatctcttgcagtgataaaatctatccaaactgtttatatttggcaaaatttactggaaggcattgtgattttgtgattttagctgctgaacatgataaaagttaatctatctatttttagtagaataggagaaagaagttgtgcgaaatatcaaaactgcccttagccccttcctccatgtttccattctctgatcggccccgaggcgagctgtcggtggctggaatttttacaatttggtctttttaaaaaacttatttcacaaatagatcccaaaagaacttacctaaaaatgatcctttttgggtgccagagtcgctggcgccgttgtcgtcctccagccaccgtagctggtcggtgccgaggtggcagggggagcgcactaatgtggctggcgccgcccatccccccagcccgcccaccatttttcctctcctctcctctctagtgtagatgtgcaacattttttattttgtattattttttttggtattttcttcacaagaaccaaccatgtgacttgtagatttcgaacattcttgggcctttttttacatcttttatatcctataaacacaaaaagttggggtttgtattttttttgttacatttgggtgccatttcttaaaacaggcgtaactttctcatacggactcggaatcaggcaaataatatatccacggtcatttacaaattagaacctccaaatttcgcttgcaagattgtgttttcgaggctagaagcttttcggtagagctttagaaaattctataagtcacatattttgtccatttgagtttatttttttatggttggttcttgtgctcttaagtgtgaaaaaatataaaaaaactaaaataaaagtaaaaaagttgcatctatgtagagagaacaagattgtagaattagagggggggggggggcgccagcatgcaaaacccttgggagacaaggttgctgtaaggtgacaaggatttgatgtatcaatgttccacttttatcatggtaatttagtaacgttgactagttaatttattgactgctggaaaatattgttcaagtaaattatggctatcatttcatgtagttatattttgaattagattaaatatttagtaacgttgactagttaatctattgagcgcattatgttaatctaatgtgttcacataaaaattctattggccacatattttattcgttcgagtttaaaataaaaaaaaaggtcgcaactccacggagagaaacaggattggaggggggcgctagccatgctggctccctcctcctaccacgtcggttcacgtgtgccacagtggcgggggactgtaccaatcatcctggcgctgtcccgttcgaccacggcgacagccactctggcgccatcaaaagaaccattttttagataaatttttttaagggtctatttgtgaaataagttttttagtaggatcagattgtaaaaaattcagctgtccgaagcgcaccaattcaagctctccaacctgcacttcgtcaacgagcacgtggcacgaaagggaaaagggagtcctgttgttagtgtgcggcagtgtggcctccatcctcgggatgtcagatgagggcttgcgtgtggcatggcgccacctgacgtacgcgctcgattttctttagaagtaatactccctccatctacttttgatatagttatatttcatcttggcacacagaataatgataagtaattctacttatcatccatttaaatatgatactagtcatttctcgtaaacaagcgatttattaatatttataattcttaagatccatatagccaatcaggtgtgtaagaatggagagtcattaattaaatccgagaaagtcattaagatgataggttgttgaaagtagatggagggagtatgatttaatgaaaaatcataaaattatatgtcggtcaagtgaaatcgtaagtttagcaccctatcgaacaaccatggttcatcgacagggacctctcgaacaacggctgtttggtaggggctttgtattaagacctatcgaacatgggatgttcgacatgccccttgcatgcatgcactttttattactccctctgtctatttttgatagtcatatttcatattgacacacagatcaaggataagtaattctacttattatccatttaaacatgctactagtcatttcttgtaaagaagtgattcattaatatttacatttctcaatgcccatgtagccaatcatgtgtggaagaatggagagtcacacattaaattcgagaaaatcattaagatgataggttgttggattgaaatatacctatcaaaaataaaactttcagatttaaaaatataactatcaaaagtagacggagggagtattattttcctgagcccatgatcctgtcgaacaacggtggatcgacaggtcctattgaaccaccattatttgacaagcgttaaacttacgatttcatctgaacgacctatatttttgtgattttcattcaaatcgtattatttctaagaaaagttcctctctgcaccgtccacctctcaacagactagcaagatcgatgaacagcttgtcgaactcctcacctccacagcgccggcagcgcccacaccggcatcctgcaaactcttcttatgaataatgggttaatatatttttttttctaaaaaatattatttaacaatttaaaaagtgtacgagcggaaagccagggagatgaacacaaccctcacataaatcgcctgttcgggcacaagcacaatgtccacatccacctcgcctacatgcctccactgaccactgaccactgcttccttcaacctcaacggccagcagtgagattgtctctccggtgaccactcaacatccatcaaagtccaagaggactccgcgaagacaccgatctgccacaacaattactgacattgaccaaggttgagaggatgattttgctgtgcgtgaagctggcgggtgatggtgcatgatctgaagacaaggaaatgtagagatttggggaatcagggaggaaagaaaaggaaggatctgaccagtgggactagctagctaggggcgttcttggccttttatattttctctctctcatattcaaacaaaaataatattttaatgggtgcggtgtttagtaacaaataaccatattttgatccaaagattgacttttgtcatgtgcaagaactaaaaccacgaagttacgatgattacggaaaattttgcctttatattttctactccttccgtttcacaatgtaaatcattctagcgttttccacattcatattaatattaatgaatctagacatatatatatatatatatatatatatctagattcattaacattaatataaatgtgagaaaatgctaaaataacttacattgtgaaacggaggaagtactcaatatttcgcttacgcatgtgcttgtaagacaaattttaaattttaaactttaatttgtaagacaaattttggtgttgatgttgtagtttttcaccattaatgttggtgttgatgctatttaaggacatatttaaggacatcaaacttcgaattactaaggacatatatataaaagttttacttataaattattttttacttgctacttcctccgtttcacaatgtaagtcattctagcactttccacattctagaatgacttatattatgagacggaggtagtaataatcagttgggatatgcatatgcataagtgaacagaagtgaccggtagtacttaaatcataccaatttatactaccaattcaacttgtttggtttgaatatttcttctagttagttgcagtcttgcagatcttatagatcaatgactgggccgactggcggccctttaatgttgttgttggacttctgatcagctacgacagtgcaatctgttaactccggtccaatgtgccttttggcgaccaaaacttggaaacaatcgcctccctgccgctttcattagcgggaaaaatggaggatcttggacaccctgatagctttggataatacggaaaggaaagaacaatcgggttttcaaccgggagcttccaacttggcctgaagttgtatctcaaagctacggaaaaagccaagctatagtgaccaggtaaactataagtcgcttttctggtcgtctcgtaggttgtacttgtttgagtcctctattttgataacgtgagatgtaagattgttgttttattatttgttgtccgctctatgtaactgacagggtgtcactttgtctgtttacttccacaattctctatatgtctaaattcattagtatctaaatgaatgtgggcaatgctaaaaagtcttacattgtgaaacggagaaagtataatatagacaaaggatacaatgggttgagaacaatggaaggaccaaataagtatcatgtataggttatttgcacttataacatgcctcaatgccccctcacatgtgcacacgacattctaattagcttataacagagtatgattagttataatgtgttattttggccttgattcacatgcaccggacaaatttgtgcactgaatcaagcgttttataagttcgtgtactaaattgtatcaacctattccctgcaaaaaaaaaaatcaaagtatcaagttcgtgtatcaccaatacaatttactcatataaaaatgttattgggatgtctgaaaaaatggttttaaatactacctcagttttcatttacttgtcactttgaccacgttttaggtttgcaaatacttgacacaacaagcttaccaaggtagtgattcctattttgtccttgctgagcctaagataatactcccacttaactaggggcattttggtcattttaaacttgattgcattagtatgtggcgtggccaaaagtgattcataaataaaagtggaggaagtagtgtataacatctaagttaagaggctgtgtgcatgctgtaggtgagatccacccatacacttcgccctttttcctcatgataagaggcactagggctgccggtagcacaggtgaatggtgaaacgaaagttttatagtggatatgtagatggggacatagatatgtagatggatgccggtctttgtttgtgggttagatcacttatatgcaccacactagtatgctacagaaagcagcgtcccaaccaaaccttgacgctatcagcgttagcgtccatcctttttcaaaataggatatcctatttaccagatatttaatttttgaattataaattattataatacattgaacatataatactctggactaccaaatttttggcatccctgaattggacaacaaaactagatggctatttagttccatcaatttatttgggcaaggatcaaaaagctccgtgaattatataacacaaattttatatacactacatcttgaagccaggcatcattcgaactttggtagcttgctcataagcataggccatttcaatcagccttggctcatagcccttcaatccaccgaagcaagtaccaaatggcactccttgactgtcgtacccagccggcacggtgatcgctggcatgccactgacggcgaagaagactctcccgttgtcattgggcgtgacaatcgcatccaactggtgcatcctcatcaacttctccagcccatcagcagacagcttattgagatgttggattgaagctttctccaccggtccaatgccgttggtcttttcggcttcaataaaatagggttgtccaaaatctttaagcctctcctgtaacaaagcgtcatacaacactaagttcttgcgtaccttttttttttggcaattaaatcgtaattaaacaagagtgtgctcaaatttaattttctgcattgggttgcaaaatttgcactttcaagaacaaattcatatctaatcttataatttttcaagccaagagaatttgtgatgcaagattaattaattaattcaagtagctcccatacatacctccaccggatgtgccttgttgaatgctatgacatctgcaagggaacgaactggggaatacaacaagtcggacaaataagcattcaagcttaacttgaactctgctatcattgcgatatgctcgttggaaaaaagaacattctgtacttcagtcagattttttgcgatgtcgatgttctcaatcaccatggctccatgtttcctttcattaagaagaaatgacgttttttagaacattaagaagatatgacttaataaacgatgaatgctagtataattcattttgagctattttagccaacattttaatggttctgcgctacacaatatggcacactttttattattgtataccactcaatttgcaagactatatccagataaataaacaaaataatttgttctatgttttccacatgcatattttcctactatatccagataaataaacaaaagaatttgttgtatatgcgatagtttttatcatattattgaatcgatcatttgctgattacagtgcttaatatgattgactgagtcttactttcttttctcatttttatgccagattgccagaaacaaacaatattgactataacattttattatactttcaaacatcatagaaagaatattattttactgcaacaatttctttcttcataaatgatgcttctaatacgaatatcaccaaaatcttttatagactgaatgcacatatgctagcatatgtattatcttttagaagtgctttgtgtttgtgtacctcattaattgaatatgtttttggtatgccctcagctgtttcttctcaaatatttcttgagtgaagaagccgttgggaataccaatcctcttgcctttgaatccatccatccttaagaattgtccatatccaccattaggaatgtacttggatgctgctccagtggcttcagcgtcaagtgcatcatacccaacaatggcatccaacacatggacagcatccgacactgtccgacatattggcctatattttgtcagattaaaaatgttaatagtatataattactgcaaaatgtccactcattcatacatagtcttccatatataacacctatagtatgtcacagtcctagttgtttttctgtgtagttaccatgaagtaaattttaatgcagtaacttttgttaccaaataataaaaagttaccaatagttaaaactaaattagcccgaaaatgtttaagtatctctattttaaatatatctggacaaatactgatatacagatgccgtaacgactcaatgcacacgtttttttccttgcttagaatgtcatatccattgaacgtgcgtgcgtatataaaatcagtaaaaaatgatgacaaatctagaattaaaatgtaatggactagatacacaaccgtatcactaagctacatagtttatggaaaacaaacatgtgttagttatttctcttttgaactgaaatagaacccccacttttcatgagctctacgagatttgtaaccagcaaaacatcatagttagtgaggttatgaggctaggtgacgagattttaacctttagtcgatcatttggtactccagaagctaaggtcctgggaacatttgaaaactgtgattgaatctgtttggtttagtaagagtgaagtcaaaattgagtttgttgatgcttttgggcacttgaatctgtgttaatgcttaaattgtactccctccgttttcttaatatgtgatgccattaatttttagcataacatttgatcattcgtcttattaaaaaaatacataaatatttttaatacatgacaccgttaattttttacataatgtttgatcattcattttattaaaaaaattatatcaatgttatttattttgttttgcatgttttaacattaaaaacattaactatgacctatactttagcatatttatattaattttttgaataaaacgacaatatatactttgtgctgttagtggagtagagttgtttggaaaatatctttagctaaaccgggagattgtttcatacaaaagcaacgcctttggcacttggcatcaaaagaataaaaagctaacaaataaccttgtgttagcacttttttaaccagaaaaattgtgttcatttttaaactgaaaatgaaacttgtgattacccaacactgtcctgtcgaggggagatggggacgacgccggcgcggctggtgagcccaaccgtcggcttaatcccgaccaccgaattcagcgacgctgggcacagtatagacccgtcggtctccgtccccagcgtcaccgccgccatgttcgccgccgccgccaccgccgaaccgctgctcgatccgcacggggtgaacgagcgcacgtacggattcttcatggacaatttcacaaacaccttgtgagcttatacgatcaaatagagaagagaaagaagcagaaattgttggtgcggtggttggtgttaccagtgtctggccgccgcgggcgctccagccgttcggggcggggcggtaagcggaccactcggtgaggctggccttaccgaggataacggcgccggcggcgcggaggcgagccgccacgccggcgtcgcgggggacgacggagccgagcagcgcgaacgacccggccgtcgtgttgagccggtcgcgtgtcgcgatgttgtccttgagcaggacggggacgccgtggagcggcccgcagcggcgaccggtggcgcgctcgtcgtcggcgcgcgccgcctgggcgagcgcgtcggggttgacctcgatgacggcgtggaggagcgggttgaggcgggtgatctggtcgaggtagaagcggacgagcgccgtggaggtgaggctgccgttgctgaagccgagctggatggcgtcgacggtggcctcgtggaactcgaagccggtggcggcggcgacggcggcgagagccatgatggcgagtagcagccgccgctgagccatgagtaaagtaagcagtgagcagtgtctcagcagactcgtgtttattttgcgttggttaattcagacacgaacgccatgagcccatgagtaagcacactaagtagtggaaaacagtgggtttcttatagcagcggagcagtgggacgcctgacgagtgacgacgcccccatttctccattattaattgtcgcataaatgttctcttctctttgctcgaagaaaaccaagtagcttttcgatattcggtattttttatagatgaaaaattttaaaatgcaagtgcagtataatcactactacagaaatggtcaaaaacatattttcgcaaatggccagtggcttgcctccccaagatgtttttaaaaagccaatactttttcaagcgggcagcgcaatcacgcgtgtagaggccgccgcagtcgtatgtgccgtgcgcaagcggttaagttgtgccacccgcctacaataaaaaaaatcatcaaaaagagaaaaaaaaaatccaaaaattgaaaccctacctccggtttacttccactgagggccattgtcgtcgctgctctcatgctcgaccgccatcgtcacctctgccaagctcagcgactacggttccgttgctacagaagccgatagcggcagatccacgctcccaggatgttgaggtcgttgtcgccgctcccattcctggcggtggtggatccatgctcctgaggccgcggctgttgccgtcgtcgctccttcccgagcgatgagggattcacgctccagaggtcaccgtggtcgtctgtactgctcccgtgcccaacagcggcgggtccgcgctctagtggccaccaccggatgatctacgcactaggaatgggaagtgattgttgacggtcattatcgaccagtttcgaccgtcaatattaccaaaatagaggagaactagtgatgtttgcaatgcatatatatgttagaataataatattccactagtattaggttcactaaccttttgcagagaataaccataaagtggaggagaatcgacatcaactcaaacgataaatcaatcggacgatgtcgagaaccagacttatgtataaatgggccaagaactcagaattgacatgacaaactgggctaaaaatcacaagtctgcggagaagaacaacagaggagtccgccagccaaaccatgggctggttgggccggccccaggttcagccgaacctccctcgtcgccgttggatgcagggcttcttctggatggtgtggattagctcccaatgacggttggagggtatttccgaccattccaaccgtcataaccgtcattgggaggctatataaacccctcaccttctcacttcactcacacaccttaagcaaagctctctcatattctctcaagtttagtttagttctctcatattctctctcataggaatagagtataaatcaggagtccggaagtcttcggaagagttcgggtatggctctagtagctttcctttcctcttttgtaagctttgtacttttattagaatactcttctttatacatttatgatattgaaatactttccgagtatataaatgcctactttatattatgttcatattatactgactatactgctagcttatctgggagatgctttggtgcgggtataatgtttgcatatgcaattactctatgtcatgacgatgatattagagtagtatctggtagtttagacgtagtgtctagattacgggatatcattatttggggttatatgctgcggatgagaggtgggccgctgatggtgacagctcactacgggtattcctccgcgcgtgtatataatcctaagttaattccatagggagggtattcctctgtatttagccctggttgtatggtcatgacgggctgttataaggaactcggcagtcaggggtggcttctcgaagtaccaggagggcatcggatatatggtattagctagtatatcagttaactagaatgtatgtatatatactatgtatattagaagtataggaatagattatctttctcttttctttctacttagcttagataatatattatgagaatgagtagctgatgcttgtgtgtcactctacccttggattatcttaacccctgcttagaatatgattatcacaagtaatatataaattattagtcaagttctctctacatgatcttcccacgggataaaataaatacgatacccttggaatactctagggtgaaatgctacaatggtatatccatgcgcttgcgtatgaactctgtaaccataatataccaggagtatttctgcgccattgctaggaattatatttctattaatgtcgttaagaaataccaacagtgatggaaggaagaggtcgttggttgatcaacccctcccattgtcaccgccgatgccggatccttcctagctagggccacggccaacggatctgttgcctttcgtcaccgccaccagatttgcctcagccgacgaactccaacctccgccggtgccaccgccgcatcacagacctgcatcgactatgccgagggtagagtgagaatgagagaatggagatgctgagggtagaggaggagaggttgaaaataagaagctgaggaagatagagataaaatagtgagatagaggagagaggttgggtgatatatagagagaagaagagaaggttgtgttgatcaggtcggtccgtgcgcctgtacgcagtaggttaagatgtctacctgtgagaataggtttgtttttttagactgacctcttaatacgcctgcctgtgagaattgattttcgcaagtgggttaatacgggagacccgaaaatttttacatatgggttttcttttggcccatttgtaaaattaaaaggggttgtctgcatacatcatttttaagaccgtcagctcatccgcctccgcctccgcttccgccgacgatgcggacgccgatctcgcggcgccgaaggaggaacacggcagtggtggacacggcgacgacggagcggaagaggaacacggtggcgctggagcggaagagaaacacagcagtggcgcggaagaggaacacggtggcggcggatcgggatttctagggctacagtctgttctcactgcacgcgaagttacgttttagcccttccacctcagttcttcacgtggcactgcaccagggatagaattggtactgcccggtaccaaactctaccagccgttggattggccagatccaacggctaggattttggtaccgagcaatactggtaccgaccgctgtaccgtaacaacgctccatttttaaagtagtgaattatagtatagttacataactagtttataattaacatgaaaataccttgcacgaccagttggttagctccataggcttcctcacaatctgcacgaaacttgatgtgaccgaatccgaaagtttgtggaaaagaaccacacaaaataataaagcaaatccgatctgcacacttttttctctctcgatctgcacgaatctattggtagatttgtcttgaaaagcacttttatatatactttaatagcttttagaaatagttgtgataaaacatttgcattgaagaccttgtcattgtacaacacaagtaaaaaagaatggaggtagaattacaatagattatatacctataagattggtattttaaataactaactttaacctaatctctttttctctcacttatgtattaatttgtgtctctataggagcacgtgcaagggtgattgttgcatgatagtcaatgttttccttttcaccaatttcgtatttataattactgatagaccttaagcttcggcaggacttgagctccctggttctcagaccaccaaattaagcttcgtagaatcgtagcggcttccttgtcatccaccccgggtaatggtcaaacctcctatccttttctaggaggacagttggcttgatggagccaatccaagaattaggaaaaggagaacagtagcctacagcaaaaacacaatggaccaatgacattcctggtgcacttggactggtatgctgggtggctatatactctaatacttatcaatttggagatggctacaatcaatcggtctcactattactaaaagacacatacaagctggcactatagatgtcggaatagctaaaatcgacacctatagtacttttctcaccttcaaaaggatgaaagaaaaactgacacctttaagcgaacgtgttggttttaaagaaaaaccgacaccactaatatagatgtcgatttttaaaataaccggcactattataggtgtcggtttattagaaaaacgacaaatataggtgccgatttttaaaataccgactccataagatcaacccgagccgacgggatgcgaggggatatttttgacccagtggggcccacacccctatggagaggataaggccacctccagcctctcgatccttccctctctctctctctctcgttcacccaacagctgtgggatgggcagtggtggcccgatgggaggtgcggcggtgacccgtcctccctagtagcgatgggaggggcggcagtgcctcccctctgccagatctaaccgggaggggagtcaatgacggcccgatggcgccctatcctctgctagatccggtggtggcacgtcttccttggcagtggcgagaggggaggaggaggtggtggcgcctccccctccgctagatccggctgggaggggagtcaacgacggtccaatggcgccctcccctccaccagatccggtgggagaggaggcggcgacctgacgggacgtgcggtagcggcccgacgggaagtgcgcggtggtggtggcgccctctcacccggcagcaggaacataaaggattgatgtgttatttatgttgatgttgtgtttttgatgtttgtatgttcttgatgtttatgtgtgtgttcatgttgtatcttgatgttcttgtctatgaattaaatgtggtatataatatggtcaagccgatgcaatgagtaactccccatcaccccaagccgatattgttgttgttcttcagtctccccccccccccccggcgcgagctggcgtctttgaacaattaattcatcaactgttccattgatcaaatttcacaatgtatccaccaaaactccagattcatcaagcaaagcacgacgaactgcttcatcaactatatcttgaagtgtttcaatcatcggattgggaagacaatgcttttgaaaatcagccactgaatcagcccttgttgcgttatgacgaaacatcgaagacaatgcttttgaaaatcaggcactgattgatccatctattacctttgttccaccatcaaattctccattgcgaccaggatattggcgttgacttattcagacatgtaggtgtaaaactcgtgtcccaccaggcatgccaaaagagtgttgacaagaaatccgtgctcggccgatagtgccaggtctatgttgatacaaactaagtcgacaaacacaacggcatgggagatctgcttagctctagtgcatgtccaaaggccgatgagatgcaagcgtgctagtcagtttgatcgtgcaactgacaagatatgtaaacagttgatcaaatagccgatcggctgaccagctgatggagcaattccatccgatgccgatactagccgatagcgatagggttttgagctatcggctatatgtttgatgtagattccgacactttatgcaaataaagacaatcggctgatgatgataaataacaataatataatcaagtacaaaccaatcggctaataatgataccatagaacaagtattgatccgaaggttaaagcatacatcagttggaagtccgatgtcataaaatccacaagattagataaacattgaaaccttttttgcgatcggctaaatccaacttgtatgtaatccttataagccgatggaacgtccagataactcatcggctgaaaccctgataaaacccttattggcaatcaaaagcaggccagagattatgtttctaagcacgacttagtaggtcaaatgtactgatgcagcactaagtatgaaaagaaacataatatctagacaatcaagcccttgactaattttcagggtggtagataccttagctaatataatctggtaaagcgatttagccgataccggcataaacactaaagcgcatctcaaccgatataagtaaatcgaactaccaagctagattaaggccccgtttgtttcagcttaggattattataatctggattattaggagtaagctgaaacaaacatatagcttattatgatagattattataatctataagccagattactataatctagtaatccactttaaaggtgcttttttagattattgggtggctaacacctaacaactagctaataatccaaagaaacaaatggctaacaacttattctatatcggcttagtataatccagcttatagtactctgactcaataatgtagagtacaataattttaagctgaaacaaatagggcctaactaagatatatgatagataggtgcttacattgacgagatcagattgtcgaagccctagccccgccgatgcaaacaaccatgacaagtataaactcgtcgaaaaaagttgaaaaataaaaatggtggtgatgcgccgaatttgtattgatcgagagatagtttacgatgaccccgggtgtacatatttatacccatgggtagatacaagtccttattggacaagaaagaaatcttcctaaagataaaaaggaaaacataaagtccttatcggacactaaacacactttcctaaagataaaaaggaaactatcggactattcttaattaatagataacttgccatatctcatcctccttaactcggttattctggataaacttccttgaatagatctgtttcctgaactgaatcctccaagaatccggctgctggtgacttgataactcccatcggccgattctagaactctgtagacgatattgattttaggaagatgacaacttctgggcttaccaaatttcgccattaacatcttggcagtggttatttgaacatggaggtggcatagcagttttacaatgtaggggaaaaatagtcctgcagtaacaagagatatcagttttagtagcgagacgaaaaaaaactacagtaacactgatgggggacaagttgtaacatactagatttttcatggtaaaaattttgcgaaaaatctttaaagtcactgttcttcgttgtttcgaattggagcctcccaatctatgtacttgttaacgccaaaatttggtaagccctggagtcatcatcggccctagagtcagtatcggcttaagagtcctagaatcgaccgatggaaactatcagtcgccagtagttgtattcggttaaggaaattggtcaattaagggaagcttatctagaagagtccgagttcaagaaggatgcggcatagcagattatctattaattaggaagaatatgttagtttccttttatctttaggatagtgtgtttgctgtccaataaggattttatgttttccttatatctttaggtaagtttctttcttgtccaataaggactagtatctacccatgggtataaatatgtacaccaggggtcattgtaaactatctctcgatcaataaaatttcggcacatggccaccttttacctttctactttttcggcgagttcttgcttcgagttagggcatcagcttcgatcttatgataagaggtatgacttgtctcagctgtttgcgttggcatattagggcgtcgctttagatattctaatctatcttttacagcagttggtatatatcttagttaatctagcttagcattttaatttgatcatatcggctgagattcgttttagggtttatgctggtatcgactaaattatcttgctagattagattaagtaaggtatccaccaacctgaaaatcagtcaaaggcttgattgtctacatattatgtttcttttcatactttgcgttgcatcaaccccagtcgtgtttagaaccataatctttagcctgctttttgaatgccaataagggtttcatcggggttttagccggtgagttatctggatgttgcatcggcttacgaggattacatacaagttcaatttagttgatcgcggcgaaggttttattgtttatctaatcgtttggatttattaacatcggaccttcagccgatgtatgctttaaccatcggatcacttattctatcataattattattagctgtttgatttctactggattgtattattatttattcaagtatcagaatatacattggatatatagccaattgttcaaaaccctatcggcatcggctgcaattactctatcgggttgtcagccgatcggctatttgatatttattttatatatcttgtcagttgtaggatcaaactgactggcacgctcgtatctcatcaatttttagacctgcactgtagttaagcagatctcccagaccattgctcttgtcgatttagttcacgctaacacagatctggctctgtcggctgagcgcggatttttcgtcaacaatattccttttgttccctctgagtttccaccttccacataatttcttttagcttcctctccaagccaaatccaagatatcacagagaaaaattcctaaaaccatcagagagctcgtgtttgttttaagttatctcggagtcaccgtgcaaatattctaaaatccccaatctcatcgtttcctgttaaaaatatcctgccaaaattctatagaaaaatctcttcaaaaattcaaatagatcgctgtgtttcttctcgggccgaattcctagcaacccagcccatcatcgtccaccttctccctctgtttgggccgtgctggcccatggctgctgttgggccagcaaaggcagccgccactcgcgccgtcctttgtgtacgcgtattcaaacttcatgtcccgtacgtatataaactttgtatatgtatacgtgatgtattttctatatgtgtatataaaatttgtatcccgtacatatacacactttgtatatgtatatgtgtataaattatgtatacgtgatgtattttctagtttttttaatatgtacatatataaaattaatttgtatacgtcatatataaactttggatacgtatatcgtatataaactttgcatacatgtatatttttttataaagaatatatttttattgtagtagtatagtagtagtaactgtagtatattactagtagtactaggctgcgccgcgcgtggggctggacgcgcgcccagccgcccattagcgcctcgctcctggctgctctcctccgcacgccgccacgcgcacgaaggaacttgatcagacggtgcagtctttgttgcaccaatcttgaaatcgagcaagcaccactgccaccaacaatctccatcttcactgcccaaccatttaagcaagcatggtacttgtttgcccaagaagaaatcaaagtctccagatcacccctatctccaatttcttcaagccacgctgccgtggtcgtgtgctgatccgctgccgctagccaccagcctcttcctgagccggtgaggccatctcctcatttttttttcccctcttctccatgcttgtactgagctcctcgcatgctcctgcccgccaccatggccgccaccatggtcggcatggccagcgccacatctctatcaactaaccataaaaattgaatctcctcgtccgggaatacgttttgactcgctcacccgtctgcgttcgcttccatgcctgaggtcaacatagctctagatctggaactcgcgttccggctagcttgttgtcttccagcccagcgtccacgtccgatcctgcggggggtgtcaggctgtggaacacatcattctaccatctctgtcgctgtttcctcactggagttccggcgtccttccctcctcctctgttgctcacgtgagagctaggggaagaagacgaacagtgccggttggcactgtttcctattgaacccaaccaacttcatcaaaacccacttaaatagtacctaaccacaattaaaccagtccaaactattatatattagagttttcgttcggtttacctccgattcaagcctaaaaaaccaaatcgatttcagttttcacctatgttatctatagcgttaatcccaaagtgcaaccactacttcacagaccatgaatcataacgctaggataaatcttttgccatccaaatcaagttaactcttgattatcgttttcttttgttcaggctccaattcacaatatttattttatcgtatatttgtagtatctattatattattaaaggaatagaaaaaagagcctccacgttcgctctcatgacctaaaaattctcacattaatcggagaaaaagaaaaggcagaatccatatagaaatacaatttagaaatagctgaaattcagaattaaaaaataaggaatattagaagaggagactagagtccatatagaaatataatttagaaatagttgaaattcggaattaaaaaataaggaatattagaagaggagagtagagttcatatagaaatacaattaggaaataaccgaaattcggaattaaaaataaggaatattagaagtagagtatagagtccatatagaaatacaattatgaaataacttacattcggaattaaaaataaggaatattagaagtagagtatagagtccatatagaaatacaattaggaaataatatagatttggaattaaaaataataaatattagaagtagagtatagagtccatatagaaatacaattaagaaaaaaaaatagaaattcagaattaaaaaataaggaatattataagtagagtaaagagtccatataggaatttaaaactaactaaaatttagaataaacataataaaaattaaagtagagtttagagtctgtatgaaaatacaatttacaaataactaaaattcgaagttaataaaaacatgggaagaaaagtttaaggtcaatataagaatacaaatataggaatacaatttagaagtaactgaaattcgaaattaaaaattaaagaatattgaaagatgagtttagagtccacatagaaatacaattagaaataataaaaattcaaaaataaaaataaataatattggaagaagagcatagagtctatatagaaatacaatttatagaaaattcggaattaaaaaaaaagaaatattaaaagacgagtctagagtccatataggaatatatataatttacgaataactaaaatttgatattaaaaataattaataactaacacatatataaaatataatatgaaaatttagaaataaaaataaataatattagaagaagagcatagagtctatatagaaatacaatttacagaaaattcggaattaaaaaaagaaatattaaaagatgagtctatagtccagatacgaatatatataatttacaaataactaaaacttgatattaaaaataattaataattaacacgtatataaaatataataggaatattacacattagtagttttgtaaagttattgcaaaaattaaaattatgttgtcattttaatatatttcaataatataataagaaaacatatatgctattatatgagaaaagtataatgatgctagctgcgcaatctgcgcgggccaccatgctagtttttattataggattatttggtcgtttattcgtatgtgtatgttggatcgtgtcggagatcccaccggacctgcaggaactgaagtggacctagaaggctacgttgaagcttcagaaggccacgttccacaaggcaagacacagttccaatctttgatcatattgaaacctagtagagaaccacttaattattttttgcattgagtatttataaaattattttgcgtatgatttatttttgaataaatttgttagtatagttattacccattattacgttgttattattggccaaacccacgaattgctatatcgtgtcctttgataacctaggtgtaggtttatatacttcacaataacattgtagtggataagaccaccaaatatctataatcatatacttattttacccgtcgtcacatggtggcgtgtcgagtgacataaaattggttatttgatataagtcactcccctggagtgatatggaagattaataccgtgtgaagatggatgttgtggtttgtgaggccgtgcatattattataattattttgtggaatgtgtatatttacacttggagtatgcatgggcctgtgttagctttggtggctttccccggatataaggactaccctcttatgccatggaaaatgttgtaattttgcgcccatccacaggactaagtaatcagacttagactagtacattgtcccactgtatgaaagactgcagggttactctatgagcaggtttggggtggacttgtggaaggggcttccgccaggttgacataatccataacagtacgaacccgtgaaagcaatgatcatctagcattgcttaggcccagcaagtgcccgactactaggacagatcaatatcccgctgggcagtaactagtagtaagtgggactctcgaatagctatgttgtcctcagacttgcgaactattgacatcatgcaggtaaagctgggcagtctctgtagagatgagtcttgaatcattcgtatgtgccgtgcttccggttaagaagctgtgtcattgggtgattcctatttatcatggtatgagtagcttttaaattaaaacatatgaaatatgtagaagatgaggatgaatggtgattaatattgctaccattttaaaatgacgttttacaactatttgcaaatgaaatgttttataaagtagggaaatactatttatgataggcttgttatgaaacctccttgataaactatattccttgtaagcccagtgtgtgtctgtgtgtggcgctacgtgaagcgacacaaacggtgtgtgccacgttgctttggtggagcgactcgcaggagcgccccgtctgtgttttccctttttttcatacggtcccatcgcctaacatcctgattttccgtttttcccatgatcgctccccctgacccggtttcctgattccaagcgtatatcccctttgggactacctgtatatttattgacaaattttctcctaaaaatttgaagatgtaattatagtacaatcgtagtgtaattacactgtaacttatatgtaattacactgtaacttgcatgtaactacagtgtaacttatatgtaagtttcacataattttgaatcgttagatctattacaagatttgtttcggtgaggaagaaaacaaatcatagcacacacatatgtgaaagaatttgttcccacgacatccattttaccgaaataacatgttatggacagatttttgaaagttacatacaagttacactatagttataatgtaattacatgcaagttacagtgtaattacactacgattgtactgtaattacatctgtctaattttttggggaaaatttgtcgacaaatatatagcaaaatcgatcccgtttctattctaacgagtaaaaaaaaaaatcatccggaccctgtttggttcatgtagtaaagaaaaatattccttaagttaaaaagttactaggccatgaccactagtttctccaccagacttgtgacttgagtaaaaaaattactatgtctctgttcagttaattaggttcaccagatttgtttagtaaaaaattgactatcaaccaacttctaaaagtaaaaagtttactacgtgtcatatccatttttatctgctaagaaaatttgtcctctaagtaattaaatcgttttattaatcttttgtatttttttctcccacattcatccggtagtagttcagttaaaagattcctgagcgaaatcaggcgtatatctacatgtagtaaaaattttactccatgcaagttagaggtcgataatacttgtcaaggtcagaaaaaattcactcccttatacttttcacatcactttcggtgtgtttgatagtaacttttttactaactgaaaatatgacattgtgaagggaataatttatttactgaaatattcaggttgaaaatctaattagtaatatatttactccgttctacgagacaatattcagggttaaacttttgcactgagaagaataaaacgatcagtaacttatttacaaaatatattattacatcgaattatatgattgcaaaaagttttaaaaaataatacaaatggaacaagctatagcaccgcctgtcttgttgacggctgccgtggcaatccaaaccgtcaccattctcacattctagaggagacagcaaggcagcatatatacaagtacatacatagcactgtcggcaacacaacgagaacacacgaaccaccatagaattaacatgaaaaataacgcatagcactacgccaagaaaacatgaagctagcatcgggagtttgggatggagcaggtcgccgggattattagtagtgcctgaaaaggattgatttagaaatcaccatctgaaatgcattattagttattcatttagttcagcattggtgacaatattttttcagatcacctgtatgagtgcacttcatcttctgatgcacctgcatgtgtcattgtttgggttaaaatatgctcctacaagatgaaattttgctctacactatgagtaggcaggattagtggattgaacaaatattatgaggctatgagcattgcataggataggcgatgcttacaggttgaaaaaacaaaaaaatcatgaaaactcatagaaaatctagatggggatttcatggtgtatattagggtgaaatgacaaatgttgatcgtatgaatcaggcataatctagttcagtggacaatcaaaattgtagcaatgacacgcaagatcatagttcttctattgttttcagaagcttagaacaaccctgcatgcacgcaccagaatagtcagatgatcacacatatatagcaccaatgaaacgaccagacaacaactcgtgatgtgtattattttaggtacgatgtatctaatctactcactgaatcatgcatgaatatatggatacacttcaatatatagatcaaacaaccataatgcagaaggcatgaatctgttgggaatcaaagcaactcatgtgaacacagtggacacaaatcacacttacacgtgaagagtacaaggaagaagaagaacacaacacacagagtatttgtgacaccacgcacaacttgtgccttttctctttcttttctttactccacacactaaacggttacaatgagcagctatttataagctactaatgcacacatacactggatgagctacttgatccactttcttcgcacacgacgccccacttccttggccgcatctcctcaaggcctggcgatatgctagctgcatgcatctaggagaactaatccaccacgtgcaggcctaactaactaatccatgcaagactcggctaatcacttgcccacaattatgcatggctaactaactaagctacatatatgtgctctcatctcctggctcttaatttattggctcactactcactgccaaccactactcactgagccatgcagcacagcagcacccacgtacatatagctagctctccaggccatgcaacacacacatgcatatagataaacatgctgaaattaacaaacgacaagattaatttctaacagaatcgacgatcagtcacaacatcaaattgatttgatagttgccaagatattgatgatctattggatcagttgagaggtgccaagatattttctaagattgagctgagatcaggatattatcaatagatgattaagaaagaagataggcgaaagacaacatttacaacaaggtatggactgtaccaattcacagttatgccatttggagttaccaatgctccagctgtgtttatgagattgatgaatcacacactgttggattatcttgataagtttgtcattgtctttcttgatgacatccttatccactcaaaaagtaaagaagaacatgtgctgacggtcgttatagacaaatttcgaccatcaatatatccaaaataaaggggaactagctatgcttgcatgcatattttgtttaagaataatctatctccactagtacttgaaattttatttgtttgaagagaaaattacgtaattggaggagaatcgatggaaatcaaccgaacaatcaattgaactccattgagaggtagacttataggttgatgggcttataaatccagtgaaataacaccaaatgggcacaaccaccacaccacaggaccgaggaatctacaggaggcacaccttccaaattgtggtccatttaggccaggctagggttcttcgcatggaaagcggtagaggctgatccgtagctttggtcgtcgcactctaatccgctttagaagaagcagccaagttgtttcttctcccatgctggtcctatttttaactatacattggttacgcaccaaggttatactaaaaagtcgagctcacgggagttggttactgttgcgtgtctacacttgcaggagatggcgaatgagagtcttacctaggtaaattggtggcgatttactcttggtactgatggtccttaatgcttcttggacctcccttcttttaaattggttcgcatgtgttttggctaagcgcatccttgttatagagacgtcgagagtgttcttagcgtagttgtatgactttgatgtaatagaacaagtttaatagaaccttccattatctaaaacaagtaacctgttaccatggccatccaccaaacacctagctgctcgctaacgacatgttattgggagaaatgcgcggtgacccatagacatggcacatatgcattcaaccaaccaatttatgaccacaaagctcctacgccttacagactatttaaagaaatcacgtcccactttcataatagcaagcaactcatcgatctaggttagctagttcttgttgcattgaatcatccctcatcaaatcattaggatatatacttcatgatggccaaggtcattgcacttatgcttgtggttattacaatgtcaaccatgttagcctcacccgtggaatgcgccaacaagattgctggtatcatccctatttcggcatccgcttacaactttacgacaatgattgatacctttaaagtggccatgtgagtgccaacggaggattgcaccgccaatgttgacacatgcataagtaacacatgctcctacatccgaaaggccctcgatggtgttgttgctgttgcactaccagcaaataaggcggaaactttggaggccacgtccaagcaggctacggttgctgcctctactctcaacatggccaaggctacaggagaaacgaaacaagttgccgcggtttccatcgtctacatgattgctgctgatgcggttgacgcagccgtacccgctgcaagcttagggtaatggatgaaacatttaaagcagccgctgctccaatcgcttgagcgagcaacacctcatctgatccatccatcaacgaagatggaacatgctaccacaactaccaccagatgcaccaaatagcatcacgatatattcctcatgtaatgcttttattatttaaactaatgtaattgccgttttttttcatatagtcttactcatgctaatgacttggtcacattggagaaaagcgttgttggtcgagccatatggctcgataagacctactgatatgttcaattgtctcttctattttgtattgcaatttacaaattggatgtttatatatagttgctccgattaaagggctttgcatatgtatattcgtacatacccgcacatatatatacattatgaatgttgttaaatatgaatttaacatttgacaactatacattgtatttgtatgcaacattaacaaaactcacaaacccatcatgcaagtcaaaagaaaaaggttaatcatgagaaaatgtttgtgtgatcctgaaccacacaattttactttatgaggttaccttcatgacaaataatttattgtttttttacgattaacggtttcggacaaatataaatgtttctaacagagcatgtggacttcatatgcatcatttctaccggagctttgctcatctccattgccatgtcattggaacagcaaaatggtcatatgacctcttgttcatgccgttggcacaagaacatgatagctgggacccaacttggcttcagccataggtatcaacagctataacaaaagagaatgctatgcttggacccaaaggaaaaaaaaattgaaaattggaagcaacagattgctctagattgtccctagaattggtatcggtggtggtgcgcgaggaaataactagaagtgtttcctttgggattaagccgtggcagaaatcaagttgtttgtggtgacgatgttgctgattgaaagcaagagcaatagtgatgtactctaggtgaggatggtcattcatccatgagagaataagaatactccttgcataattaattattagaaggtaggtgtgcaagagtctcacactaactcgaccttatactataaaaaactgtaagttaaacatgtaaccatctatatacatttagagcccattctaataatgatttctatgttacttgcgtcacgggacacttgtgatcctaaaactctgcattccaatttgcaaacctaagtactatgttgagaatggattataacaacctgttaccaatagtaaacataggaaaaaaaattcttatattgcgaacttgtacaatcacccaagtcttatattaccagcttctacaagcaactttttagtcaacctgaggactctcattttacagcggatgaataaagaacagaggattgtcctaggttacgaagttgaaaaatgagttccttatgacacctttacagaaaaatatgtccgggtagctgtgtttgggatagaacataataaggcccctagaccggatggtttttcagtgtagttctataaaaacttttggaatatcattaaagaaggttttaatgaatatattaaacgagttttatgcggaagtcctcccactgtccagccttaattttacggtaataacacccctttcgaaagttcaagatgcatacataatacaccaatatatagaccaatatttttgttgaatgtcggtcttgaaattttcaccaaggttgcaactaatacagttaattctctgactggtcatgtcgtgagctccacataaactgccgtcatgcgaggatgcaacatccaaggtggtattgttaatctacgcgagacagtacatgaattgcatcacaaaaaattgaattttgtgatattaaaggtggaacaaaacgcaactggcaaggcgatcaaaactgttatttctctaccaataaggaggcaattagacatcttttcttttaatgttgctcagcctacttagtttgttccatcatttatatgccatctagaattactccacctgataatgtttcacatgtgttcacactagttggctgtcaggtatttaaaaagatatgcaaccatatggggtggctaacacgtgtaggttggcttgcttatgcaggaactatatggtttcatgaccaaagatactcggcttcctcttcatcaaatcacgaaaatcaacccttagttagctgcaccaaaactagagcaggcccaagacaagcaagaacagtcagtcagcaccgcttaggcaggaagcagatagtaagctaagaatactcgaagaaggaggtcgctcagccgaagccctagttcaaccagaacagtagggaaagcgatagaggctgctccgtagctttggccgttgcactctaatcagatttagaagaagctgccaagttgtttcttctcccttgatggagctatttttaactatacattggttacgcacctaggttatactaaaaagtcgagctcgcaggagttggttactgcagggagtctacacttgcaggagatggcgaatgagtgtcttacctaggtaaattggtggcaatttactcttggtagtgatggtccttaatgcttcttggacctcctttcttttaaattggtttgcgtgtgttttagctaggcgcatacttgttatagagaggtcgatagtgttcttagcatagttgtatcactttgacgtaattgaacgagtttaataaaagcttcgattatctaaaacaagtagcctattaccatggccatccactggacacctggctgctcggtaacgacatgttattgggagaaatgcacggtgacccacagacatggcacatatgcatgcaaccaaccaatttatgaccacaaagctcccgcgccatacagactatttaaagcaatcacgtcacactttcataatagcaagcaactcgttgatctaggttagctagttcttgttgcattgaatcatccctcatcaaatcattaggatatatacttcatgatggccaaggtcatcgcacttatgcttgtggttattacagtgtcaaccttgttagcctcacccgtggaatgcgccaacaagattgctggtgccgtccctattttagcatccgcttaaaactttacgacaatgattgatatctttaaagtggccatgttagtgccaacggaggattgcaccgccaatgttgacacgtgcataagtaatacatgctcctacatccgaaaggccctcgatggtgttgttgctgttgcactaccagcaaataaggcggaaactttggaggccacgtccaagcaggctacggttgctgcctctactctcaacatggccaaggctacaggagaaaagaaaaaagttgccgcggtttccatcgtctacatgattgctgctgatgcggttgacgcagccgcgcccgctgacaagcttagggtaatggatgaaacatttaaagcagccgctgctccaatcacttgagcaagcaacacctcatctgatccatccatcaacgaagatggaacatgctaccgcaactaccacctgatgcaccaagtagcatcacgatatatccctaatgtaatgcttttattatttaaactaatgtaattgccgggttttttcatgtagtctttctcatgctaatgacttggtcacattggatcagagcattgttggtcgagccatatggctagataagacctactgatatgttcaattgtctcttttgctttgtattgcaatttacaaattggatatttatatatagttgctctaattaaagggctttgcatatgtatattcgtacatacccgcacacaaatatacattatgaatgttgtacaatttgaatttaatatttcacaactatacattgtatttgtatgcaacattaacaaaactcacaaacccatcatgaaagtcaaaagaaaaatgttaatcatgagaaaatgtttgtgtgatcctgaaccacacaattttactttaggaggttaccttcatggcaaataatttatggtttttttacgattaacggtttcggacacatatagctgtttctaccagagcatgtggacttcatatgcgtcatttctactggagctttgctcatctccatttccatgtcattggaacagtaaaacggtcatatggcctcttgttcatgccgttggcacaagaacatgatagctgggacccaactcggctttagccataggtttctatagctataacaaaagacaatgctgcgttgaacccaaaggaaaaaactggaaaattagaagcaacatattgctctagattgtccctagagctgatatcggtggtggttgttggaggctgttaaatgtcgattctataccgccaacatatgcataaagttcaaatactaaaacatccaacatagtgatagttgtttaatctcacatatttcacaagtgttggtgtatatttgtatgcaggtgttaaaccccgaagttgggaagaaatctagactaaagtgaggagaaacatgtatccatacaaggatgggttgtgaactttatcaaaatatcagaaactcagcccaaaactccgagaaatgggcagaggagggtcaggggagtccacaggccgaaggccaggccgggagggcccagcctaggttcggccgaaccccgctggtcacgtcccgtttttcgtgtcttctaatttgcttaattttgaaaattagcattcgcgtttattcgcctaaaatagcttaataaaaatttcataaatggaaaagggtttaatttgactaaataaattaattacgccacccttttattttatcgtttgtaattggagttatttgatttttatttggcttttggaagtggagctcgttctcatgaattctgtcaaatccttaaaaaaaataagtcccaaatccagaaaatgtcaaaattccaaatccttccaagttcatacttttccataaaagcatcccaatcgttatcattttccttgctttctatttttctttttttcgcctattcctttctttttccatttcctccttaagtcctggttgatacatcccttgtgtgttctaatctctcgttcaatctaatctctcccgcgatctctctttctctgtctgcaccagggcccgaccaggaggagccagcccaagcgccgctcacatgtgttctgccccgcacgtgtttctgcttcgtcttcatccatgggcatttctacctctccatcaaaacagcagcgcctctttcaattcctcacggatctcttcctctccttcatcaattttctccactaacactaaaaattgaaccaacttgtcgatctgaatccgtttttgcaattcctgatgacttctgatctcccaaccactcacctcctcctccacacgcgcatctcgcagagacgatgaacagccgcgtcaaatgcaaacgttagccatttaatttctagttgattgcactttccatccaccatgaatttaatcatctgttgatcatcaaccaagaaactaaagcagaccaagcaccaaatcatattacactacattatctccaattgaatcaccatgaccgagacaaacctgtatttccaattcccagtcaattctctcaactctccatcttcgtcctccctcagccacattactgatcttccgggaaactgagctgtctcctcgagttcctcctcccactaattaatctctccctctccctcaccaatctcattatttaacaccaaaaattaaatcaccttcatgagcatgagccatttttgtaaaagccagtgactcctcatctcctggctgcttagctcctattcttccctatatatagctgcagcacccctcctcctttcctctttgtttaaccagcgcagccaccgccccgctttacttccacgccaaccgtgacacaccgtgtgtgtgcacgtagtgccatgtgcagccaaagtcaccacgttggctactgcttcatcttcaagcacgatgtttctgctttgctatatatgaaggtcatgatgcttccctcaattccctgctcgtcccttctgcccctcatctgtttccattcatcaataccaaaaatcaaatcaaattgatgagcttgatctgtttttcgaaatctcagccacggccatgtcttgctgttggcacggagatatatcaaaccgtcaacgcgagaacgagcagctgcatgggaggatcatgttagtgatatgccctagaggcaatcatagagatgattgtatcacatactatgtttacatatttatccgactttgttccttgaaatagataactcattattggttaatgaatatgtgattctttcatgagactctttatgttgtgtgttgctatttctaaaggatcactgatcaaatattatatgtggaacaaatctatactactttctataaagttataacccactaactctaaagcttaacatgcaaccatgccacatcatcacatgccactaacaataattacatattcaacctcatgcaagcatgcaagagcatctacagtctatttaattctacaaattatcatgcaagcatattcaatcaccacctctcacatcatttccacaatagttttacaaatctctctatcatttttataatatttaatatatacttatcaacatgttctacattaaagtacgaatttcatttgtttcatgataaatattgataagccctaagatttgatttttttttctttttactcctagctgaattgtaagaaaaaaataatattgaaaattacttagtaattcacgcagcaaagcgcggggaatcccctagtatgtttagatgatcaacacatgtattaattgatgttcatgtctcatggatcatggtatagagataccaaattaataatgtggacacatgttggtgaacatgttgttggatagacccaacatgagacactgcaagagccatatgtgttgtgtcatcagttatctcatttagtgttggtgttgaatccttagacctgaaattattatagttcccaacatgtgtagtagcttacttagggactgctaaacgctactccgtaattgggtaattataaaagtagttttcgggtatgctatgaaacatgtagtgggatatgaacaatcaagatgggatttcccctcctatggagagatatatctgggcccctcgatgttgtagattatggaagttcatggccatgccaaatttgattgaggagtcaatcagaagttatataatcaatcaacaggttcgagtgaatgattgagctattagaggatggcacatatttagccttgagcttaatcgatatcgtgaggcaaaggggttcatacaagtatacactaaaagttcagcagatatgatcttaatgtatgcccggtgggtcaatacattctgctagaggccgctgttgacgcatggaccgaaaaggagttttcgggttacagccgagtgtacatgaacttataaggtcgcacgcttaatgggccggaataaggggattggatggagatccaatatgagcttaattcggatagggatccgaagaggagtcctacgggccttggaggcccgagtgatggatcctatatattcgtgaggggtgtgaccggcggaggtattgcatcacgtgagaaaccctagttgtcagtcccctcccccagcaaaaccctagccgtgcgcgggtgctagcacatctgcgcgtggcattccgttcctgtacgtgtggataccgatagaggcgccgctggtttgcggtgctgattggcatgggaatacagcgaggagaacgcacgaggaggagaaggtcgagccggtgcgaccgactacttcctctacatcgacgcgcgctacttcccgagaattccttcgacttcttagcgccttcttccactgcatagcgcgtcgagtggtaacgatctatgatctagtacttgcatggttcctggtttacgtgacaaaaaaaattgatttatgctatcgtagtctacgcgtatcccaacagatcaatcctgcaccatcatcttcctgctactaccgtctcctctttgctgctcacatcggaaagttgtgctgcctcttctctgctacggttggtaagcagttgcacaccataaaaaagtctttcatctgctgtgctcatccgttcatcatgtggtgttcgcataggttgggacatcgtgtccccctgctgctccgatctgtgcaaccaggatgttgagttccgacaccacgtcatcgtcgtcgcagctgtcatcagtgaaccaacgctgctccttcgtcatctccttccaaacaaacttctgtcaccattaacgccacttgcaagcaaacaagtcatcactgtccttggaacccaagccgttgctaccatgtcgtcatcttgttgagaccacatctacaagtgagctcttgatgttcatcctccattatttccttccatttttatcacccggtggtagcactatatgttgttgtttcgtccatcacgaaagcagcccctgtcactgtcaaccttcctcctttatatgtatttaacagagcccttatcttcttttcttttcattcgcacatgtccaaatgctgtcgtactgctgctttgcctcggccaccatgcccacagtgtgcatgtgcgtgcaccactgttaatctctctctttagatgacatatgaaccacaccagttggtacacaaaatagttccaatcaacctgaaaacgcgagagaatattcctttctatcttctattaattcaatcttccattcttgctgccacctctctctcttgtgatcataaaggtggccgtcagtcatcaccgatctgtttgcgcaccacgatggtcgctgtcacaatggaacccgagctgaaccacattgtcaccattacgttcctatgaatgtcgctgcggtcggtaagctccaaggccctagcagcaccactgctcttatcctccgcttccattgtcttccctgcctccggcactgtctcttgtcaagttgctattgtccgccggtgaaaccacctcaccgttaacgatccaccgttcctaccacttgtctgctgtggtcatgatggttccattcctaaatcactgcaccgacatccctgttttgtacaccggagtagtccatgccatgtggctgccactactcgtatttcccctactactccatgtctctctgccaccaagaggtcgagctccaccatgccattgccttgccgttgtgcttcaactccacagccttcaccaccgctgctgctatctttcatgagcccgacgtcatcttctagcccgctgtgcttttgattctccctacttcaatccgctgcttcattgttgtcacgttgatgagatccattttgtgtggcaccacgtcacatgcgttctggtcaggctagcctcctaaaacccaaaatcaatcaagttatctatctcaacaaatagatctcagccatcctcgtaattggtccacaactctcctccttgtaaccaattaaccgtaggtcatcctaccgacaggtggaccacgcccgccagttcgtaaaaaataatccttttggttcagaaattccagagaatattttctaaatatttctctttctttattcatggttttccaataattcaatcttccagaggtcacatctctttcatccaaactccgattcggcccgttctttttcctaaattattctaaaattgagctctacttcctgatttacttggttatttcatttgatgttatttttttctgccttttctttttgtttatttgtttgctcctttctgcgatcgtatagacgctgttgctgaggaggttgttgttgcaggtgaaggttccgtctaacgatctcgtgggtaaaggcaagtgtacccttgaacatgttgatcctaacttgaaaaattatcttgttttaaattatatgcatgatttgtttcacaaactatcgtgtggatagttatgacctacttgttaattattccatgccttgaattattgttgattatccttgattatttgtcaccctagactgtatgagaatcaaacatggggtattggctcggggtagtagatttgcttagccatgctcacatttttacaagcaaaatataatattgactaatgatctacttattgcatttatttacataaactgtgtcgttgtgcgctatcttcttggtggcatgtgttgcaccatgtagtaattaactggtggaaaatgttttagacctgggcgatggtggatctgtgtgaacctaggaggtaagccatctgtgtgtgtgcttaccgttgatatgtgtggtcgattgagctgtgtgctccctttttgctgtgtgcttgaggtccttagtttaggcaagtcgccctggtcagttaaggacttcacttcgtgcgccattgatctgagccttaccgtgcaaccacatgtccttatgggaaggacctagcttagtacattgcttagctctggcactggcggcccaggtggctagatgataggtttttggattgtaccatgggacctttcacctgtgtggtgaagggaggaccgcccatgggggaagccggtgttagggcgaggtagaggaaacgctttgttactctttggtgtttagcggcaccgaactgtatcttgtgggtaaagttgtacaacctctgcagagtgtcaatctattcgaatagccgcgtcctcggttatggacatgctcggtgatttcacttgacgggtagatttgtgaaagttttacttttgggaaagagctatgtgcaggataaattaatgaatatagctgtgtgctcctgtgtggacgcaatatcctttttgggttggttggttggttaaaaataccgtgattgcaaatgttgtttaaatgaaatttatatctatttactgtatttaaattcgcaaatgcctttatgtaaatgaaccctagctttcctttgaagccttgtatcatatattgcatattcccgtacacttgcgagtactttatgtactcacccttgttgtctcacaaaatttcagagaaggccagttgttttagaagttatgttgctgaggatgtcgaataggttgtgtgccccagttgactgcctgtggtgtgtcgttggtgcctctcgcttctttttccgctgtttatctctgtttggccctgcgtggcaaagaaattgtaaaatctggtcataagaccaatgtaaaaattatatttgtttcctatttattaatataatcatgatgtagttgtgattttatcttttgttactgtgtgtgctagcgttgatctaggactagcacattatatacaaagggatcctagtttgggtcccgacaggattcgataccctttgaaatactccgtaggggaagtgctacatcagtatatccatgcgcttgcggattttatctgtgaccgtaagaattaccaacagtggtgcacgagtaaataactagaagtgtttcctttgggattaagccgtggcagaaatcaagttgtttgcggtgacgctgttgctgaatgaaagcaagagcaatagtgacgtactctaggtaaggatggtcatgcatccatgagagaataagaatactccttgcataattaattatcagaaggtaggtgtgcaagaatctcaaactaactcgaccctatactataaaaaactgtaagtcaaacatgtaaccatctatatacatttagagcccattctaataacgatttctatgttacttgcgtcacgggacacttgtgatcctgaaactctgcattcctatttgcaaacctaagtactatgttgagcaaggattataacaacctattgccaatagtaaacataggaaaaaaaattcttatattgcgaacttgtacaatcacccaagtcttatattaccagcttctgcaagcaactttttagtcaacctgaggactctcattttacagtggatgaataaagaacagaggattatcctaggttacgaagttgaaaaatgagttccttatgacactttttcagaagaagatgtccgggtagctgtgtttgggatagaacataataaggcccctagaccggatggttttcagcgtagttctatcaaaacttttggaatatcattaaagaggatttgatgaatatattaaacgaattttatgcggaagtcctcccactgtccagcctcaattttacggtaataacgccccttccgaaagttcaagatgcatacataatacaccaatatatataccaatatttctattgaatgtcggtcttgaaattttcaccgaggttgcaactaatacagttaattctctgactggtcatgagctctacacaaactgccgtcatgcgaggatgcaacatccaaggtggtatttttattctacgcaagacagtacatgaattgcatcacaaaaaattgaattttgtgatattaaaggtggaacaaaacgcaactggcaaggcgatcaaaactgttatttctctaacaataaggaggcaattagacaacttttcttttaatgttgctcagcctaattagtttgttccatcatttatatgccatctagaattactccacctgataatgtttcacacgtgttcacactagttggctgtcaggtatttaaaaagatatgcaaccatatggggtggctaacacgtgtaggttggcttgcttacgcaggaactatatggtttcaagaccaaagatacccggcttcctcttcatcaaatcacgaaaatcgatccttagttagctgcaccaaaactagaacaggcccaagacaagcaataacagtaagtcagcaccgcttaggcaggaagcagacagtaagctaagaatactggaagaaggaggtcgctcagccaaagccctagttcaaccagaacagtagggaaagcgatagaggctgctccgtagctttggccgtcgcactctaatccgctttagaagaagcagccaagttgtttcttgtcacgcctagaaattctcgaatagaatttcaagcagaatgtgcaataaatcccctgtccaggaccggccagggtacacaaacgacaaaattgacatacagatgcagcggaaaaataaaagataactggagctaagccttgacttggattacagcgtgaacaccactccataggcatcctcgacggctcggacgaagcctactcctcggagaaaccaccatcggaagcatactcgaactctgagggttgggaggtagagcaagactgagtactacccactgtactcagcaagtcataccggaacggagggtatgatgcaagatataaccaaaggaggctaaaaggggttcatttgcataaagctagcatttataaacagtagttgaaagcagaaaagcagatgtagtaaccaccacctgaagtaattagttccattaagctaaactagggtgggactaatcacggtgaatctggttgaccgcccataaccacgggcacggctattcgaatagttttactttgatcagagatgtacaactgtacccacaagacacagccccacaacatgttcccgagcgcatgcatgccaccacgacataccggaaagaggccgtgataggacccttcgcataaccccctctaaccaagcacaccacacctcaggtttcaaccccactcctcgcaaggcagcgggcaatcccctctcgtgcctaggtgaatccgaaagccgcataggccgtcgcagggcccatccgaactccatcacgcccacccttgcctggatgcgtcagctagaggaaagctacactacaagcccagcctttgcccacgctggcttgtggtaagtacgaggaattcttccagagtatcccacgaaccggtccttaattgccatgggtgcgaccatcaaaactatgcacccacaacctaccatttaatatattttaattaaccaacaccatagcggtgggcactaatccaacatcaatactagaatctgaagtctatgcattaatgtaattcccctattgtgtactagttgaactaagcatggctaagcaatccctaatccaacatctagtcatcttacaacccaagctagcaaaggaacatgataacaaatagtatggctgagacaataggtgatcatcccatagtaacattataaaacgatgcaatatttaaaggaaaacattagagcatttgtaatatgggatcaatatgttcaaatgacaaacatgacttgccttgctctacggctggaggaacttcggcaactatctcgaagtacaccggactgtcgggagagctagaatctatgcgatatacaaggcaaacaatgcaaacaggctataagactactaaaacagagaacaaaaccatttttaatggattctttgcatttttcttgatttactgagacttgaatgggcttaaacggagcacagatgaattttctatgaattttagaagattcactgtgtttttactataaaaagaaaaaccttaattgatttattgcgcaataattaaccctggtgacatcagcacatggagggggcagcgccgacatgcgggccccatatgtcatcggctcggggacatcggtccatggtggaccgagtccatgggaccgggtgaggggagcgccatgtggcgcacacgtggcatcgacgtggtggccacgcgggcggcaacgaatgggcccgatctagccgagggtagatcggacggtggaggcggcacgcgggaagcttaagccggcccggcggccctaacgcgcggcggtgagacacgaggcggcgacgcgagacggcgagcggcggcgacgcggcggtgacgcggctaggcggcggcgcctaagggatgtagctcagaggtctatgtaattcatagaatcatgtaatacgtattagtaggactcgtaggcactactagaaaagacgtttttccaggcggtcaaaacacgttttcacgggcagacaaacattccgcctgcatctaaacgacggtaaaattcctcgatttttaccggtggaccaaagcaccgcctgcagcagtttcgatcttctcaggcgccgtgggtagccccgcctgcaaaaatactcacggcgccaaaaaaaactttcccgccaaccccaccccctccataggtttcaaatcacaaatcacaaattctcacaaatctcatccaagaaacaaagtccaatcacaaacatccatacatcaacataaagcaatggattcaaatccacagcatcaatttgcaagttatcatcaatcaacatgcgatgttaacatcaatcaaacttaagaaaaaaaccgtagtcgtcgtcggcgaactcaacttgcatgcggtggccgccgccaccccctcccccccgggccggatatgggagggagggaggtgtccgccgccgccaccgccctcccctctccttgtaggggccggatctaggagagggaggggagggaagccgcatccacgccgctgccgtcgcccctccccttcctctggtcagatctaagagatgggatggagagagggggagccgccgccgtcgtcaccctatctgagccgccgttgctccccctcctccaccagatctaggagcggggagggagagagggggagctgccgccgccgtcggcctgtccgcgccgacatcgccgtccactccaccgctgccgccgtgtccacgccgccaccgtcgctccccatccggcggggagggagggagggagggagggaggggagggaagggggacgagcccggtgggtaggggtggaggagaagaagtgttgagggagagagagagttgagagggaaatgagtggtggggaggaggtggaggagaagataaggagttaagatatttttttctgggtaggtacgatttttgcaggcggacttttgcaggcggaccacaaaaggttcgcctgcaaaaatcatatttttccaggcgccgcttaagttgtccacctgcgaaaacaggcggagagcgaacttcaccccgatttatatttttgtagacggtcattttgctctaagagtcatgtccgtctgcgaaaaaaagacccccacgttgagaaaaatgctttttctagcagtgagggttgtcatcattgggaatgttggaacctacatatcaaaacctatgatcccctgctggctaaagaaaaacctatgatccccataatgcagctgcatgctgtttcagctctcaattgtgtttcatatgcttttgtgaataagtgcagcacatgcatataaaacagccgtacatcacgagtatgcactacgcagtgcgcaaataaccgcaggaccagaggtactacggcacatgcatgatgtctcaccattattaaaggtttcatggactttttatcaaactaggaaggtggcccgcgcgggcactttcaatacttatattattgaaaggtaagattattgtttgttcaaaaaatttgtctcatagatttagggcaaaataatgttattttataataatttaaggattctatttttcttaaggtattttagaaaaccattcacaaacttttgagtaggagatgaatttagtacttacaacttttgaatcatgttttttttctcgagtaaataagaaactattggtagttaattatcatacagtccatctatatacataccgtgtagtatggctgcaaataaaaaaatgcgagtgcaagatacttaaaattcttttgattaaatcatctcatgaaggcgcatgatataataataaagggagggaagcatatgcatgggaaaaaaagaagaaagagaaaaatgaaaaaagggaggggaggcgtacgaacccgcgcacgtaggtgcgcaactatgctgaggtgggaccctgtaatatttagtttgttctaagatcaatttaatataacggtttataatattggacctaccgatttacgtggcagcttgagagcattttaaggaattttaaatgactaattagaatattaactgcgcaatatatatgtattggacatatggtaatatttgttccagcttcatccatgtttatatacatgtagagagaaattaattttgtggctagcaagccattagatgtctaattaatagcaattaattttaacacctatttacaattgttcagagtaactcttacatattcatcttatgacttcgatgatccattgatcaccaatttactaatcaccatgacttgcatgaaaaaaaatatgtagtaaggtttaggatagctgaaattgatgaattatataatttatgtgatagctaactgagggtataaacaaatgaattgacttctaaaaagttaaaatgttatttaaataagacaccatttagaaacttagaaagcgtgcaaacaaaaatccaaaatatggaatcaggaaaataattaatcgctgcatcacacctttaattttcttttcatgttattaacaaaattaatcatctccatatataatttgatatgtggcaaaacggtagcgctacatcggttgtgatcaccttagatgtctcagacactacgctttgttacacgtgcgaaaggcaaaaggtgtatacgtgtattgtgcagcgggcaaagagaatttcggacgctttatttattagcaaacaatagatccgatgattataataatatgtccaccagttctagtgtaagtgtaattagttaatatagattttaaattgttattttaatgggtacacaacataatggtgtagaccttactttaaaacagtgcattacttgagaataatagaccaatgtaataaaaagtagatccgatgatttatataatgaggccatcagttttagtgcacgtataaattagttaatatagatatcgtttatttgataggtacatgatataattgtgtaaaatttattttaaaatagtgcattatttgaaaataatagtataaagtaaaagtacaccggtttaagttatatgatggtagattctttgtttgtaaaattatgattaattatttaaaaatatatccattataaatggaaaaaaagaagaaaaaaagaaaaaaaaaggaaaaaaaggggggaggcgtacgtatgtacgtacgtatatactacatctgctaatgtgcgggaataggataggtgggacccatggtatttagtttgttttaagatcaattttatctaatggtgtataatattggacccaccaatttaagtgaaaatcaagggatagatgttttgcttttttcttagaatttctaggattttctctattttattagagcgccacgtggcggtttgagagcgtttataggaagtttcatggacttttagtatataatataatataatataatataatataatagttttaagatcaattttatctaatggtgtataatattggacccaccaatttaagtgaaaatcaagggatagatgttttgcttttttcttagaatttctaggattttctctattttattagagcgccacgtggcggtttgagagcgtttataggaagtttcatggacttttagtatataataatagaagatagatagatagatagaagatagatagatgtctgattctgttttatctatcaacattttttttcaagctggaccagtactatgttacaattcatacttactcttactgatatcaacaagaaattcctgattaaaaatacatctggaattctggattacatcaggaaataaaaaacgaagtaaatgaaaattgcaaactgaagcagatccgtacttcttttgtcccaaaaaaatatcaaacctattattagaggggacacaatctagtctaacaaatctagacagaagcttgtccagatttattgtaccaaatgatgtattctccaattctagattggttttttatgggacggatggattagttttatagtaattcgctaacttctgtttcatatgcatttctgatctcaaacaggtgacccgtgagtgagcacagcacaaactcgtggtatcgcgccgcgccgccggacggccagggccgaccgagcggcaagggcgtatcgctgtgttccttgacgccgtcggcaccgtgggttctgttgcggcctgggggcctcggttgcctcgcgcgcgagcgctcggccggcaggggtgacgcgttcgcggtttgttttggtcagggtcaagcttgcaagttagaagactgtcgctgtgtgggtacgaccccgcgtcgctctcgcgcgggcaggtcggggggcaaaaaccctagccgcccaggcctcctccccctctcccctgcctcgctgccgccggagctcgccggcggcaaagccggcaacgagcagggaaggcagcggcgaggtccttcttcctcttggcagctccctcccggcgcgacgtggacggggcgacgccgatgaggtaccccaccgccgggagaagtggaggcggcggggcggtgtggggtggcggcggatccggcaccccccatggccggatctggcgcagcagcgcggcccggcggtggtgcgcggctgggggcggcgacggtggcccggcggcgtgatgcggctgggggcggcggcggcggcccgatggctgggagcggcacctggcaaggcggcggcggctccggcggcgccccgcccggatccggcgtccccgaggtcggatccgactcccggatggctagggtcgttatggccggcgtcaccgacgatgggaagacggcgcgtgcggaaggacggcgcatgcgcgacgggaggatgccggcgtcgaggtcgatgcgtgcggcgccgtgcagcgggccgacgcggcagtggctggcgccagcgatgcttgccgccggacctcgtggatgaccaccggtgggggctgctgccagatggatggctgcgttgtgggggacccgactgggacgccggcttgcatggcggcggcggggtcgttgcgcgtcgctcgtgtggcggcgctgcaggtgttggccggtggagatgccgccggtctggggtcgagctcggattcagccgcacagcactgccatcacgaccggcgatgacgaggggacgccatgtgggtgccttctcatctccttggagctcctccccttcttgaccgcctggtcgtggggagctcctttgcgagacggtgaaggcggcggcaaggttgccccaggttgttatcgatagtgatgggcggtggcgggcactctctttggaggtgacggcatgggaggaaggctagctggtcgccgaagtgcagtggtggtttggtcgtgctcattccaacgtgtagctgtgggggtcgcgctggtagcaggttaggtcgcttggagtccagccgacggaggggcgtcgttgttgtagaggccacgtgctgacattgcttgggagtcggtgaggtagcggcaagaggggcattggcaggtgctaggcgaaagccggcccaattcttgggcggcaacggcgacgtctttgggcgttgcaaccctcttgagggcgttgttgaggtgcctccctccccctcttcaaggatcctctaggtgaaaacctcatcctttcgggatgggcgatggcggcgtttttaatgtcgtgaccttcttgaaggcatcgttttggaggtggccgtgtgttcctctcggtgtggtggtgtgtaggcacgtggcggggtgtgttttctcttgtccggttcccctgtcccctgctgcttttgcttttggttgtaaatgtctgttttactcctcttaatgcaaaaatacgcttctagcgtattcccgaaaagcacagcacaaacaacagtgctggcagacatgccttctgcctctattattaatttgtcagagaattattggccaaggttgttcgagctcattcaagcgacgatcttatacctggccgagattctcgttctctcagtagtaatatacattttaggaagattttcaggatcaaatgaaacccatggatctgctgttcatagaaggtttgagtacttgcccgctcttcaaaatggaggagctagcactgccaatgcattgatatatactccctctgtttcacaatgtaagacttttagcattgcccacgtttatataaatgctaatgaatttagacatatagtagtagataagaatgttgtagagtttgctcttcttgaacaaattgatatcagtttgtctgtaccaataatgtaccactaagtttatccttcaaccgtatcaatccgtaagaaaggattaagtatgcgtcctgctgatataatgtcttccacttctctctctctcaccctacattgctgacaatttattttggtacaatggcagtcatcagcaatgccaaattattaggccatctatggcttgaagctgggcatccttcgaactttggtagcttgctcaaaagcataagccatttcaatcagcctcggttcatagcccttcaacccaccgaagcagataccaaatggtactccatgaccatcgtacccagccggcacggtgatcgcgggcatgccgccgatggcaaaaaagctagatgcatgagagttgggggtgacaatcgcatctagctggtgcatcctcatcagattctccaatccatcagctgacagctcgttgagacgctggattgccgctttttccactggaccaatgccattggttttttgagctgcaatcaggtcgggctggccaaaatcttgaagtctctcctgcagcaaagattattttttcatggcttcttgtttttcatatgaaaggtattcaatactttttagaaaatacaagtgctggtttaatttttgcactcgaccgtgcactgtgcataaagtaaattcgctattcttgttaatcggtaacctggtattctcttctttgccaataacctaaacctacactattattgtataactttcgaacgttgaaggataaattatttgacattccttgcaactagctagttttataattttgaaggcattagaactcgtgatgaatgattaattaattcaactagctttaatacttacctccacaggatgtgcattattgaatgctaccacatcggcgagggaatgaactggggaatacagcaagtctgacaaataagcgtttaggcttaacttgaactctgcttgcaatgcgatattctcgttggaataaagaacatcctgcgcggcagacaaatttgttgtgatgttgatattctctatcaccagggctccgtgtttcctttattggagaataggagttattaaatgatgacataatttactatatactagatggagtctttcattgcgagttctaatatattattattccacaacatatacgtgaaatattttgttgatctatacttaaaagaatagattttagctatcattttaatggttcaatgcttgattagtttcttttacaaatattttgaacacaataaatcagtctacagtttttgtaactaaaattatttgttcaccactgaatttctatggggagatgaatggattatcttaagacaaggagtttcttttcaatcatggatggataaaataaaccggactggctacttataagataattttattcatatgaaacaaattaagaattttactgaggaaatgagaaaaaaaaagaaaaggaaactggcctttgtgcatccaaaaggtggttgaggcatgggccaacgtgctcatgcctagtagtcagtgatctattttcattctatatgtaaaacagtatatatggactattccaattatacattcgaacacaacagaaaaataacagtatttacaaaaaaaaattttgttctaatcattattatcttcatacttttttatacgcataatttttcaggagggctttataatttcaaatacctcatagtggaaagatgtttttggtacaccctcagttgtgtcttcccataggctccttcagtgaaaaagccattggggatgccaatcctcttgcctttcaatccatccatccttaagaatcgtccatatccaccactagggatgtatttggatgctgctccagtcgcttcagcatcaagctcatcgaacccaacaatgacatccaacacatgggcagcgtccgacaccgtacgacatattggcctgcattttgtttaaattaacaaaaataaatatgttcaaaacagtatcataaacattcagagataattaatcaaaagaaatggaacatttttttacgaaaacagtggaaatcacatgctcatcatagggctgcaggaat

SEQ ID NO: 63106 - DNA, 15664 bp, Oryza sativa
gtcttgtctgggggagatggggatgacaccagcccggctggtgagcccaaccgtcggcttaattccgaccaccgaattcagcgacgccgggcaaagtatcgacccgtcggtctccgttcccagcgtcaccgccgccatgttcgccgccgccgccaccgccggaccgctgctcgacccgcacgggtcagccgagagcacgtagggattctccatgggcaatttcacaaacaccttgtgagcatacacgaccaaacagagaagagaagcagagcatgtgtggtggcagtggtggttaccaccgtctggccgccgcgggcgctccagccggatttgacagggcggaagttggaccactcggagaggctggccttgccgaggatgacggcgccggcggcgcggaggcgggccgccacgccggcgtcgcggcgcacgatggagccgagcagcgccagcgacccggccgtcgtgttgagccggtcgcgcgtcgccatgttgtccttgagcaggacgggcacgccgtgcatcggcccgcagcggcgaccggtggcgcgctcagcgtcggcgcgcgccgcctgggcgagcgcgtcggggttgacctcgatgacggcgtgcagcagcgggttgaggcgggcgatgcggtcgaggtagaagcggacgagcgtcgtggaggtgaggctgccgttgctgaagccgagctggatggcgtcgacggtggcctcgttgaactcgaagccagtggcggcggagcagcagcagcagaaggcggcggcggcggcggcggcgagagccatggtggccgcggccagtggcagccggagctgagccatagcgcagcgcaggtggtttcacctaataactttgttttatgtctttgttaattcggattgagcacatgcgtgacgagtgacgacagatgagtgatgccattattaattgtcgcacaatgtctttttatgaaaagaaagcgcacatgatgctcttctacctggattcttgatctctccatcagtatgctcgttcaattatagtcataaatatttatgcctttattttgttgtgacatattttattattaaagatattttaaacgtgaaagtaagacatatgattaaacttttgtgttcaaagtcaattgcggtaaatagggatacaagtgagcaatctcactactcacgtaaaaatccatttcatagtttatttttcagttcatagtataaaatttgaaagaaaaagtaactaaaattgtgactatcaggaaaaaaaaccacttatccaccccacttacatcactaatcttaaaaatttaaattctgtgtgtgtgtatatatatatatatatacctcttacaagtcttacctactcctactctcctacatcgcaatcaatcattagttcataaccatttattgtttaatttttctatccctatattctcatcttaaccagattcaattatatttcactttcacattaatccataccaagaaagtatctaatataattttagtttaatatctgggcatgatatgttagatccgatataagtcatgaatctaatgttattttaaattcctatactagtattcattttatattcatgtgccagtgttcatgataattaatagtgtggcatgtctttcagagatacatgtacacctccctgttaccttgcgctgctaagtgagactcacacatatgtcacactaacacacaaacccaccggcgtcatgtatcccacacccatccgtcccaatccccaatacggtcgtccctgatgcgaccccggtaggggtgacgtcccgatcttcacggcgtaggatcacgaatagataactagcctaaaagagaccaagataactagctgcaagcagccaagataacagtgcaacctgacgatcgtactcgaagccaaccaccgtctctattacggtaacctgaatcgagggttcgcctaaccacactctaagtttaccaaccaacacaacctggaatcaatcaaggaaaaacctcgaagggaccaggagcaccaattggggggcgtcgaacgccgcttctgtactctcacaagaaaatcacaaaagcagaggggtagagatttctccctgaatttgttagcacacagctgaacaaaaggggttcatattttcattgtcaaaagtcctccaaatgataaaacatagggaatatttataccaggaacaaccctcctatataggaatgaaaggtcttgggagtttactggacataggctagctcaaaggtcacaaaaagtgaattcccgagaagactcgcgcgtctgtttggcttcctagcagtcatcaatgatttgtctattactccttattgggaagtcgaaatgatgagccgtttgttggaggtgaaactaaacttgattatctttccaaccatatatattaagcatggagaaagttgactggttgggtcgcacattccttggaagttggagcaaatgtttggagacagtgcactccaaaatcagcatgacataaacagtcgtcgtcttcacgtaacccatcgtcactttgatcttctagctcgttgtcgatgcccatcatgtgttgtgcatgtgtaaacctaagcaatagcaaagtacttgatttaggtagtatataattctcgtcaatattgaaatatgtttcagctagtagcgagtttatctcttgttgtagtttctttgcacgtctacgtgtaatcggtccttgaaatggtgtaatggattggctcttatcagcggctaagtcaaatgattgtcttgagtgttcatgtgatgggtgctggggcacatcagtccccatcttacgtagacgcggggttgccttgctcctttgcgcgcgtgatccgccgacctttatctctcgctgacgttgtagcaaaggcttcctttgcccacaaagtttgcaggtggtgctaggaaggagaggaaggggaggccaccttccgaccagactggatgcagagcgccttctaaagccttcacccaacttccttcagctccccgtaccactaggcaaatcatgataactcctttggaactgaagtttgttcgatgagctcccatgtggcgtatgccattgtacgacttgatgatctggattacaaattttgaatttgatggcatacaattcaagttccacgttcagtgaaataggaaatttgatcagcatgaaactttcctagctaactaatgttgtcaagttattgcttgaactcatgtatatgcaatggcaaattggcaatatagtagggcttcaagtgactcatcctttgaacttttctagcttgctcaaaagcatagggtatttcaccgcagcacatgccaaatggcactctttgagactttgaccatcataccaagccggtatggtgatccatggtatgctattgatgatgaaaacgctagaggccacggagttgtgtgtgacattgttgcatccaactgtcacttcttcatatcaagttctctaacttataaggtcatgtacaatggtctttttagcaagccctctcggttgccacgtaaactgatttgatgacatggaggaaagagagaggagttcacataaacattgtctctacgcataagaacaacgcagagttggctcataacgccaaaataacaaggaaagtgaggaaaaatgggcgtcataaggaccatcttcaagaatgagacatagttcggttcaaatgtgtacaatcaaaattttgtgcatgaagaaattttagtgtggggagaagggatcaggcaagccacatacagatagactaggaggcaccactcgccccgacactgcttgtccaggcaactgccatctatcatccaccacgctatcgccatagatcccaggggcatatcccgctgctcctccaccttgatgttgctcgtccaccgctccaccacagccactcctccatcatgcaatcgccagtgatccacgctgccatagatcaactgagcggtactgctctccatcttgacatcgccaccacttgtccagctgacatccgtgaggaattggtgaggatgtatcctgattcagaagctatcatggttgattagtttgtattttacagttcatgatctgttgctagttgccttatcttaattatgatctacatacatcggtgccttattgttagacgaggaataggattgttgacaataagttgtaaaatcggctcctatatatacatcgggaaccaaatgcataaaatgaacatatatacgatatttgttaaaatgaacataaacatacgatattcatagaataccaaacatgacaccgaggtacgatatttgttaaaaaggttcagccatagcctacatgctacattcccaagccacaaattacatgtgctcctccttgatccagtatgttacaatgtatccggatatcacaatcctgacaaatttccatatatcccatcaaactaacccgtagatcttggatatgtcatgtacagccagatggtcctgttgacgccatcaacaaattcggtcggctattacctcggcctgacaagtcaagccgccattgttgacagaaaacacggcgacctgggagatttgcttcactccaatgcaggtccaaggcgtgcctcgagtgtcaagagcgtgctagctggtttgatcctgcaaccagcaacgaaaaacataaaccgtaattagatgaaaggtagtttatcggccgatagagccaatgacgtatcgtcaggacccaaccgatacagttagaccaaatcggctgcggttttctgatggacaagtaaaacaaaacccttaatatgtcctatcagttgtaatatcatcccttttgtttatatcaatcactttaagacagtattatggaaatagctgatagatcattgtttagagcaaacatagataacatattggctagtactccaatacaaattatattaacaaatcaatttaaatatataaaataacaaccgatcaccaaaaaggaaatttaatcgagatcgatctaacttaatatataaaataacaaccgatcaccaaatatgaaatttaatcgagatcgatctaacttgatgtatttatatatcgtgatctacctatataagtggcaaatatacataaaacggatcatgaaacaaacccccgatgctatccatagagtgatatggttggagggaagatgccttataagttggttccatcctcgctaaattagcacggtggtactaaacatgcgcacatagctctcatgggccacacaggccttatcctagttagtccaagatgtcacataggtgttatttggctttgaataagtatattgttgcccaaacctagcagcaaacataggagagaatggaggggtttaaaaactcgggcccaaaaacaagccgttactcaagaaacagcagcccggaactttctggcctgaggctcaggacttcctagcagtttcataggctgaacagatagttctgttagaaacttctgggctaagggcccaaaaattctgactttccttgatagcaccaaaaaaaaaaaaggtcataacttgttgctccggagttcattttcgataaattttggctctttggaaagtttattcagaaggctacacaaccttattgcagtactagtaaagagtagaatacatgatattaacatgtctaatttaaccaaacgattgtatttcatcacctacccaaagttattcaccaaaggttgcaataattcaaaaggagacattattatacattttcaaggtttacacaaataatcttttgcgtaaaccaaactctctaacaatacatgtgtaaatgagctccgagtatgcacaagaattttacgagcagagctaaaatgcaaatttagatggcactatactaagtggtactacaagaaaatccctggctatgagtgacaatatagggtattttctacattgtgcttccatcacagtaaaacatcatcaatttaattatttagataataatagtatcatcgatgcaccaactttgaaccttaactttaataaccatttattattgttgaactctattgttaaaattcatctttaagtttcttttttctactaactggtgaacccttttatgagatgcttaagtagcactataaggttctgtgtcatttgtgttaacaagttttttttcatatttatcatagtatgtcttcatctaagctttgatagtatcaagcctgtttacctcacacataatgaaacaaattttcttaagtactccaaataaaacaatctttgaaaagatacagcacagtggaaactaggagcaccacattatagtccttccagttgttttggcatttcatgacgtaatacttgcaaacagattttatatagaatctctggtcctagatttatagtcatactcataaaaatagaactctattcactttaaaaaacattaacaagttaatttacaaactatatatattatattctatagaaataatatttattttgatataaaattaacaactcggacactaatcattagtttaaactatcagtcgcaacacatatgcatttctagataaaaattgacgtcaacaatttttatagtgcatcacaacattagatcaagacaattggcattcttttcattaagtttctagatatttgtagtactttatatcattaaataatatctacatttttaggataaaacaactccctctttttttatgaaaaaactatgcaagcaacatggatggatcattttttatggtgtgtatggtgattacaattgacgaagtagataagcttatgtgaaaagaaactataaatagtaaagtacaccaccggtccttaaagttgaggtgtggtgtcacttaggtccacgatcttgtaaatccaacatttgggtccataatcatattttactataccatccaagtccaaatcttgtttgactaggtttgaccaccgacgtggcagtccggcgtggttgcatctgtgcgtttacccccttcatgaccccatcgaccccctgtctttgagccgacaagaacgacaaccagactctacaagaatggagccaagcaattcgcgtctattcatacatcttctccccagcaatgtacgtttgctctcggctcaccgcgaagtccaaccggaacctcttcggcgcaatctctttcatccgtttaatgtctagagcagtgtgttgctcatcatgggccccggcaaagccagcaagtccaccctactcgagatcctcactacccgcctccatcccttattgcctcccgaccagcttgtcagtgacgccccaccaccagcgctgacctacaccgcatcttcggctacccagcacgacgtcctcttcccgctgctcatcgtgtgcaagatgctacacttcaacagccacctctgccttggcacatgtgtctctcccaatggccttgcacaatgcctatgtcttacccttgccgatgccgccaccagcggtgaccgggggagacgggctcacgaagggggtaaatgcaaaaatacggccacgctgtactgccatatttgcactcaaacctagtcaggcgagcttttcgacctgaatggtgcatttacggacccaaatattggatttacaagatcgtggacctaagtgacaccacgcctcaagtttaagtaccgacggtgtactttactcaaatataaaaaactatatattgttggccacgatgtattgacgctggactcattgctggggcatgcctttgtgaattgttgaccttgcccatgacttcatcgaccttcacccttcttgtgctggtgcttcttcttattgttgttgttcctcttcttattgtggttcgtgtatatgcttcttttgtgcttttgggcacaccatgaaggtagggacccactgcagcatcggaagatgatgtcagcttgctttagcaggatgctaatggtgaggagaaataatgagcaaataaattttcaagagattagtattgaattgatacttccacacaccactcacgtgggtgaagaagtggacagcaattttaattttagttaatgccaaccatgattttatttttggcacatcgtgcatgctcaataatgatagtccattatgtcctagatgtcctagtcaagatacatgaagccaatgtcataaagtagtcatggttagtgcaaccatgcataggtaataatagttgatctagcggactgaatagggtgttgatgatgaagatatgatgatgaaagaaaggcaaataatgtcgtgggcagatgtaaggcaccatggagttgtcaccaaaatacgcaatggcgtcgtgaaactgcagtggataaagacatgccatcgatgaagatagtgacatgatcaacaaaacatccaaagcaaccaggcccaatagacaataatagaccaagacaaaatctagcacttcaccctagccaagtgtcaactgagttacaccgtcatagatgtagcacacaccagagctgtggaaacatctgattgttatattatgttgtattacatcgatcctctcatggggtatatgtcggagtacataggggatagagacttggagtacaatacaactaagagtatatttatctctaggattctatctctaggactctatcttatctctaggattatatcttatctctataatttgtatctgactcttatctctaaccgacatatctatacttctaacattccccctcggttgtaacgggagcgaagcgaacgattgcgactggattcgaaatcttctattccttcatcttcttccactcaccatcatcgattgcatctctgatgaacggtcctccacctggtggcagtgcgatagctgttgaggaggtgcggggaaggagggaggatgtctggcagggagcacggcacactttgcgatgtctagttttcaaatttcctccactgtactctggccgagtttaattccaaactttttcttcaaactttcaacttttccatcacatcaaaactttcctacacacacaaacttccatcttttccatcacattgtttcaatttcaaccaaacttctaattttagcgtgaactaaacacacccagaactactaggtttgccagagcagcagaggacttgagtagggccaatactgtttcgacaaggtagaagcaggtttcacactattgaaaaccacgtaactttttgtgaattttgggatttttggtacttttttgcacgaaactatttaaaattttaataaattttgactaaatttgaatatattttggccaaattcacaaaattttggaaaattccaaaaattttggctgagatagttgattgctgtggagagggggaccgaaatttcaatccttgataggagactactgtagaacttgtgctactattggagaggatggacaattgcattgaaggaatgacgtaaagggtgaggtgcacggattgcatgtggttggtgaagatttcatatgacatacgatggaaatattgtgtgtgtatgggcgcggagtcaaatttggagggagtctaaatttggtataattggtgtttgtaaaaagtttgtttcttgtacggaaaggtttcctaggggattagcactactggagaagtgatctttgttgggattgaaaaaatcacattagtcccggtttaaataggaaccgggactaaagaagttctttaccccggtttaaaagcccaacgacactttatgatctttagtcccggttggtaacaccaaccaggagcaaagatcaattttagtcccaattcaaaaagtgtcaggcccctgtctgttaacaaccggaactaaagatcgacgcgtcgtatataatccctcccacttatcctctcctcctcctcataaaccctgtccttaatttttcctcctccctttcctcctctctcctgtctctctttctcttccctcttgctgtatccatccatccatccatccatccatctgaaagcatttctctctctcctctctctctctttctcttccctcttgctgtatccatccatccatccatccatctgaaagcatttcccctcggccacatccatccatctatctcaccgcgcgagcgggcagcagagcgaggaagctggcgagcaggcggagtgagcaaggaagccggcgagcggcgcacgaggaggtggtgggtgacggcagcgcacgaggagacggcgggacgggattcagcaggcagcggcgccctctcctccgctggatctggcgggaggggaggagataggaggcggtaggtggcggtgggcgggcggcagcgggcttggtcccgaatcgccgccaagttttgagcaggggctgaatcacttgtggtgaattacgctggatttgcgtgagatggtgaattgagaggtctcggatttagagcttgctgcttactcaaaccataatggtaccaaagtttgtatttgcgcatttgtttagctacagttcatactaagcataaacttgttccttagccgtgagcctttgatttttttttgtgtcaatttgtgatgtacattcgatctgtaaatttgtgatgtcaatttgatttgtgatgttcattcgatttattaatttgtgatgttagtgagtttggctcaaaatcaatatgcaaacagcaaaaaacaatgaaaaaaaagaaaaaaaaacttttgtccctattggttacatcactgggactaaatattgaaataaccgggatcccggattgggcatcccggttgcatacccgggatcaaatagggttgcgaaccataactaaaaacggattccccagcagtgggacttttttactagtttggttcgtggctttaggctgcctacctcaagtatatataggtatatatagagagggaggtcgtggtctcccgatattgattttgagagagccaagtttatagaaaagttagggtttgaatctacatcgatagatcttcgatttgtgtttgctcaggttcggcggtctaaccgactagacaccggcggtcaaaccggcgggaatatcgcagtcagacctacggcggcgacaggcgacaacggcgtattaagcgatcagaccagagctactacgtcagtcagactagagatcattgtgtggtcagaccggcgcatttactccagtcatcatcgaattcgtaattttcaattccactaaaagttttggtttttgggtactacaaccattcaatctcctctggttggcttggttcttgctttttggtcctacagaaacaaatttgtacataggatatgctctaaacctctagaagtctgcttcaggtttcctctctgtgagcaagcatatgctcagttccaaactcttcaagtcaaaattaatttttgtcagcttctggattcaaaaggggacaaatggagttacatgtggaactctgcgagttatccttcatagaaaatttacaagatcattttattctaggaatcacctctcccaggccatatatgtggctatggaaaacaaaaggtgtcatgaaaatcaaggtttatgcatataaagatttggctttccatataaagatcataatcacttgatagtacagtggcaatgggtgtgtggtttcaacctgagtccggagacaatgtttggagggatacctctccctccaatatttttttcacaatccactaagttttcactgcaacagtgttttaaattgcattcccaagctcaacaatagtagttgcgataaacgatcagcccaatgaattactttttactagttaaaaacatgtctgccatgttgctaaaatgttccgtgcaagaacttaggggcctttctgaccttggtagcttgctcaaatgcataagccatctcaattagcctcggctcatagcccttcaatccaccaaagcaaattccgaaggggactcccatcttaccgtatccagctggtacggtgattgccggcatgccgccaatggcgagaacagtggaaactaggtcattgggagtgataattgcatcaagctgctcatcctgcatcagcttctccagtccgtcagctgaaagctcgtttagttgacggatcacagctccctcgagtgcaccgatgccagtagtattctcagctaccaggaagatgagctgcccaaaattctttagcctctcctgttatacacatttttggcaatatcatttagctagctgttctgactgtttttttaattttaagctgattacattacatacaaagattcataatcttcaacaaaataagatgtgcaatatactatggtgatattaacttcataatctgcaacaacatgaatataccttgatgcacaaagagtttggtatacaagagtagtggtgctaattatcagttttatgtattcgggatatttgattttttatttttgtatttttcatcttagacctcattgataattgatagtgtcaatccaaaagagaattttctaatcatgtgtcatctgaaaatactatgaaattggatgtgataattctgttgaaaattctatgcatggtttaggtatgcccctagaaaatgcctctagaaaaatgtatacatgattttatatacgttactaaaggttgaacaagttgattaagtgtatcctgagatatcattttttttccgaagtctcgttatataatatataaggtagtaaagtaaatatgtacattttcttcagatttgcagaaaacaaaaaaaaattctagcaagatatgtgcaatgtggaactgtgagagaatcaacaccagaaggttaattaggagctacacagctgacctcaatcggatgtgcgttgttgaaagcaattatatctgcaagtgaacgaactggggagtaggataagtctgacagataagtgttaaggcttgacttgaactctgctgctaacacaatctgttccccattgttaaggacatcttgtataacagccaagtttgctatgtctaggttctcaatcacaaccgctccttgtttccttcaaagaatgatgtaaaagtcaaatatctaggaaactgacttttctctatcgccatatatatatttataaattggaaggcatatgacctaaactggttgataatgcacatcatgccacaccatatctgttggcctatacgtgcgataatatagaatacggatgttccataaagtccaatatatattcattacagtaaatttcacaaaaattacaccttctttgcatgcaataaaaaaaatacacatttcaatttacttccaaataaagcacacatttgtttctgacatttgcagtaactaaatattatttgattgcagatatataagtttgatggaatacacagcaaccggctagtggaaaattgtggtttccagatgctttaatcacaacttcgtaaatttaattaatataaaaacagctgaaaggggacattccaactgtaactaaatatatgccaaaatttcctcatattgaaatcagggaggcacatatccgaattattgtgcaagttataattgtttatatgtttacatgagaataacttggaatatggaagagtaattgggaacgtagtcaataatttagcttatgtaccaactttttttcagtgatttctctaaaggaactttataaactatggtaaataaattcgtgccaagtatgtaatgtaagcggaaacagaaaataaaaacttagctatgtactatgttttgcatgcaggtaaatcatgcctaaattttggcattttaaatcatatttcatattgatgagggcaagtcatgcatacgttttgatttacaggaaacaaaaggaagcaccttgtaaaatgattgcatgttcatagtataaacttgcaacatatatataatttgatgggaattaataataaatgcgtgatttttatttctgtaaaatgcaatttgaaatgtcaatttttcttctattctgccaacgtatataattttgtgaaaattcctgtaattgcatacctcactgtgtcgagaagttgctggtaaacaatctgttgcactgtcccatttgggaagttgaaaaatccatttgggatgcctattctcttgccttttaatccatcaggcttcaaaaactgcctatatccacccggtgggatgtactttgatgctgcccgtgtggcttttgcgtcacggctgtcgtagccaacaatcgcatccagcacgtggacggcatctgttactgtccgacaaattggcctgcatttgaattgacgggattcatccaaggaatttcatcactttacagtatgatcattttcatccattcgttatgtccgattgacatattttagaacagtagattcagtattccccggactatatatttaatgacattaaaaatattttctaattaaatttgtttgccggacccatcgttttcgcttattggaggaataagcgaaacggtatatttgcaaacgaaaaatattttgtaaataaaacttttatatacgtgttattagtgatctaagaacaaaagctgaaaaataaacttcgatgaaaaaccccaaaatcaactccaaatttaaggtcgaaattcaatttttagcttataagcataagcgaaaagatgagacccgcatctttgaattttctgaattgaaaacatcctcatcttccatactatcatgattcttcatacaaggacattgttgtgatgaagtttagcatcaactatgcaagttaggttgtaaataaaggtctctagccattcctaaaatggatgatattatttggcaattggcaaactgaggctgtgtttagttccatgacaaaattagaagtttgaagaaattgcaacaatgtgacggaaaagttggaagtttgtgtgtgtaggaaagttcgatgtgacggaaaagttaaaagtttgaagaaaaaagttggaatctaaacagggcctgaactacataaccagttggagacttagcgagccatgtagaccataaacaatttgaaaaaaaagagtaataacataataacaaagagaaaaaaccttgattataaaggtatgttattatgaaagttaagtcatggttataaatttgacaactagtgtcaatcaaagaactacagtctacggacagcaaaataggacaatgccatcacaaacatccattatattatattatagagtaaagttcatcaccggtccctaaacttgtaccgctgtgttattccggtccctaaactcgcaaatcgaccgttcagatcctcaaacttattcgactgtgtcatcccgatccctaaacttgcagatcacttgtttaggtcctccaacttgttcagttgtgtcaccctggccctaaacaggacggtctaaaaactttatatcaaaaaataattcatgactttttcatgtgaactctaatgaagacaaactttatatcaaaattgtagccctcgatgcgacctacaactttgtaattgaaaagtttttgaattaaaactgtttagggtcccaaaatattgttgcatgtttatagattttgaaattttaattttaaaattacattttgggacaaaaaatgacttaaaataaaaaaattcaactacaaagttgtagatcgcgtcgagggctacatgtttgatataaagtttgtctttattagagttcacaggaaaaag

SEQ ID NO: 63107 - DNA, 19170 bp, Oryza sativa
ataaggattcatgcgaaaaaattttgtgttaacaacgaatcatccaatttctattgccatcacattttccatcggaagattataaaagtttcatattaatcatgcccttctttttttttcttttcttaatttttttaaccttagcaggcctttacagtataagtatagcatccaaaaatctgacgacttatttagatcagcttcccagatttttttttgtattttgaaaaataaaacaagtaggaaaaatcacaatatcaagcaaattaataaaaatgaccatagaaactaattcaatataatacatataaaattgtttcgaagtaaatatttgaagtccatctctgaatttttatgaaatgtttggacttcatttgatttatgtcgtgtgccatttagtccatgcccatgttggggaagaaataacgggtaaaccgtcattttctatattttctcactagattgatgtggacctcaggatgggaaacatattgacatagctagttgtattttccgtatttttcaacatttcgaataacattttgctgtacatgatattttctgatggcatttgttaagtaatttactcgaagtatctgttatgtataaacatccttcattgacttgtcagtatcgagtttactaagccaattgtccaattggcacattaagaaaataaaataaagtgtactttggatctcgtgcaatcacaagaaaacaactggatagtgacagtaaaaaaacatcaaccatcggtacgggctaaataagtaatgcatgtattagtctcggttctaataagtagctgttattttttatttacacgtaaaacgagctaagacaggcacacgattaattgattatcaataattatgaacttaaaaattaaatttattcgatttctttggaaacattactaaataaatgtttttttcctaaaaaaatacactatttaactgtttggtaaatgggtatacagaaataagaaatttgtaactgccgaacgaggaaacaatcgaggccttagcttacccgatagtgtcctgcctaggggagataggaacaacaccagccctgcttgtcaatccaaccgttggtttgatcccaaccactgaattcaacgacgatgggcagagtatggatccatcggtttcggtccctagtgtcacggccgccatgttcgctgcagctgcaatggctgatcctgtgcttgaaccgcatggagcagctgatagaacatatggattctacatatacatgccaaatatttactaatgtacagtatatgccatatataattgcttgagttttgaataattttgcaacacaaaaatatgctttcctgtctgaaaaatacaaaggtgataagtgataaacccagtgacgaccttacagaattcacactaaattttagtgtggattatgtttcgacaagctacaaaagaatttgcagaattgcattgatggttattttcctaaaagaattctccaagaacttggcatggaatatacaagctaattttttgaactaaagagatcgatattcagcattgacttttgtgatggagaaaccaatggcgaagttagcgagtgagaggaggtagcttagccttacccggctttggccaccgcgagcgctccagccaccggtgccttggatggtgcggaagttggcccactcgtcgaggttggccttgccgagcaccaccgcgccggctcgccggagccgccgcaccacgccggcgtcccgcctgacgacggagcccagcagcgccagcgacccggccgtcgtgttgagccggtcgcgcgtcgcgatgctgtccttgaggagcacggggacgccgtggagcccgccgcagcagctgcccgacgacgacgacgacggcgacgccgcgcgccgcctgcgcgagcgcgtcggggttgacctcgatgacggcgtggaggagcgggttgaggcgggcgatgcggtcgaggtagaagaacacgagctgcctggaggtgaggctgccgttgttgaagccgagctggatgtcgtcgacggtggcctcctcgatctggaacactcggcaaccgtcggcggcggcgtggacgagcacgacggcggcgagaagcagcagctgcagacggcggcgagacatcctgtggtgagtgttaacgtgggtgttgttggagcgtccgctcgctagttatgcacagcacagtaggatcggtgatcctcaacttttggggggcaaccaacgataaatggcgagacaacagaatggataatatttactcctattaaattgatcatcatttaagtttatgcactaaaatcatagataatttacatcaaattaaaacaataaaactccatgccaattacaccttagcatgcgcatattctcccatgctgcattaattgtattccagtgaaatccgtgtccatacagttatatgatgattaatttggaaaattttagattctattacgtgatgatcaatttggtaaggagggagtagtatgatacatgcatttggggttagttaccaaaaatttcggtgctgttaataacttaatattttagctaggacaaacaatagaccgtgaatataattggtaaaatcttggatccaaaccaaaaccatccaccaaaatttaggcattgcaaaaattccagtttaccaatttatttaagcgagatttaaaataaaaataattcaaacaagctaataaaaccttttttccattccaattcaaccaagagattcctcaaataccaatcctaaaaagagatttgataaattaccactctcaatttaagactactaggaagaaattgtcccttcactcgtttggttattatcggtttgactcttaatttaagactactgggacgaaattgtcccttcactcgtttgattcttaccagtgtggtgtgattggagatgaggagtgtatgaggcgaggtgtcgctgcttgttgtccttgtctttagcgatggccgaacaacagtgataggtccagacaggtctagacgaggaggacgtagccagtatagagggagttgaatgacatggcagcccagacgatgatgacgtcagtgagtagcatgacgagaagttgacagagtgccggaagaaggaagaagatgagtagagaggcaatttaggtggtgtttagatcagtgacttaactttagtctctttctttagacactaatttaaagtattaaatatagactacttataaaactaattaaataaatgaaagctaattcgcgagacaaattttttaagcctaattaatccataattagagaatgtttactgtagcattacataagttaattatagattaattaggctcaatagatttgtctcacgaattagtctaagattatggatgggttttattaatagtctatatttaatatttataattagtacccaaacatccgatgtgatagggacttaaaagttttagtcccatctaaacagggccttagtcccagatagtattctaacatgtagacatgtagtcccgaattgatagtggtattttatcaaatcctttttgataagtggcatttagccgaaagccacttgtcacgcgaagtaagcgtaactcaattggttagatttcttgtgtggtggaacctacacaccgatgttaacatcatagatttgatacggataatcgcatttacagctatttatttttgcaatacaggtgatgtataattaatgtctatggtgatatcgtatatgtctgctaaggcccccattcgatctccacacatggagataaattttggttgcacgcgaaatgagaaatcttattagcacatgattaataaagtattaactattataaatttaaattatggacttatttgctttttaaaacaacttttacatagaaactttttaaaaagaccgtaccatttaatagcttgaaaaacgtgctaacggaaaatgaggaatttgaagttgaagttggagttgaagaaatactccctccttccaaaaatctgagttctatttatttttttaccaagagcatgacgtaattaattcattcaccatgtgacaaaaccaataaatatgttaccaataagcattaaaatggtttcttaatttctatcaataatttaatttagcatataataactacaaataggatttagatttttgaaaaaactaaagaatgaaataggtattagacttttggaaggagggagtagaacatatagatggccatatggcccgaggcccacggcccggcacgaagcccgcaattttggcccggcccaagcacggcccggcccgactagggtcgtgcccgtgccggcccggcccgatagccgggccgtgcctgggctgcaccctcggcacggtgggccggcccggcacggcccgatcaaataaaaaaaatatagggataaaaaatagacttatataaccgtataaggcatggcccaaaatagacttattttccagccatttaaacacaacccacagagttgagggatcaaaaatagacttatttccagccatttaaacacagcccacagagttgagggaccaaatataaactctttctgtgagtcagcacaatagcccatcgtgccttcgggccggcccggcacggcccgactagtattgggccgtgcctgggccgtttatgccgcccgtgggctggcacggcacggcccggtgcatcggtcgggccgtgccggcccgacaagcctcggcccaggcacggccgggcttgggccgtgccgtgccgggcggcccagatggccatctatagtagaacagaataacctgccacgatggctttgcccgtaataaacccattcaacacccaaacgccaccgagagtcgccggcggcggccgcatccggccatccaccgccgatcgccgccgcccttctctcccgttccttcttcctctccgctctctcgatggctggtcctcctccgcaccagccgtcctcctccggagatgtcgaggtcgccgtagagagcggctccggggcctcgtcctcaaggtacggcacgcacctatatccccttcctccaatccctaaattgggaaccacaactgatcctcccgaggagtggaggacccgccatggctcatacctcgcatccacgccgcgggaggtgccctggacgcccacccctcggctgcccggccgccgccgaggatgatttttctcctcttttttttttaattatttttcacttctgtgagctttgggcagcccttccatgttgcaaaagttgtgaaattcctagcttggcagttgcacatatcgatttcaatcgaggctgcctatacatcatgtgacatattttttggcctcctatcatacagatttcttacccttcagatcaacatctaatggatgacattaatatacacaaacaaaatacaaaaaacaaacaaacgggtcacgtggacaaatctaaagctcacgtgggctcaaatgggctcaagtagatttcaaacttacatcgtaaatacactaaaattacatatgtaattttcagacttacatcgtaaatacactaaaattacctatgtaattaatatgtaattatagtgtaagtacgatgtaattagtacgtgtggggatcataaacaaattaactttggaaaacacgtacggctagtttaacaccagggaacagtaacgtggacctagttaattagcagctagatgcaagcacggatctcacaaaccatcctacggctaaaaaaccgaatgattgaaggctcataaatctgtcaaacgatggttagcgattccgatttcaattacctaaagtaatgttttgaaatctagcacaagttattgctcattgatgctcaatgcattcgagtgaaattacatttactgagaccttagagctatctatgataccattttatatcgtaacaccgctctttagtctttacgatggaaccaagattgccttcaaccttgttaacctgtgttcatattgggagtttttcttttctttgagcagtggtcctcttgttgctattttaagatgatctcatgtaaagattgaatttctttgttgaatggcttcttttcagcctctccttattttctaggtttagcagtgatgtgattagatcatgggggacccaggacaaaataaacaatagtttcagcttcggaagtcttgtctctgctgactatcgatcattcatctcacttcagttgtcattttcactagaactaaagctatctcaacaagcaaagcaccctcctttgatttgcagctccgtctgcatgcttaaccttaacccttgctgatgtcctctatgcttgaagagcgctcttgatcccattgctaaggaaaacatgaccaaaatgatcattcttgtgacttccgctgaaaaaaaaaggacaacatcataccccactgtaacacataccacccaatgatgctggtcagagctaagttatctccctagtggtaatgcattggaaataggaagagatttgattttgttctatttaagcatatcttcatcttctgcgaaaacttatatcctttaaccagtgctcaactttctgtcctgtacttttttttaggaacaaactgctgagtatggtgaaaaaacattcagatttgatcggctggacagttattgatgctgaagctgatgcatcagacgtggaaatggatgataaattctggcatgaaatacttgatcttttcttcgtgcatggtagggtttcaaaggggagggaagaggatgaccttgtcttctttgttaataatatggtacatttcaatctattgattccccttatttagcttgacggtgtggtcttgtatgctaactgaagctcaatattctatgttggtgcagaaattgaacgggtacaggtccagtgataacatggaaaatccacctcccttttttgtgcgaagatgggctcctaaggtaaattaagctagactatttgtttaacttgatcaataaatgcatgtgtcccttttggtagaaggaaaatttcaagacttctttctattttggaatttctctgtaatttactgttgagttattctgtttgaaactgtatcaagatgaactacatcatcatgtattgtcaaccataacatattttttcattcatgtttctttccaataatatttatcattcattgcacatttacacttgcaccagcaagtcttatactgcatttctttagcatgtacttgattgtctgccacaatttgacagacttaaatttggtaaatttactttcataagctagtgtttggttcataacatactttctagagcatgagctcaacaatttcttatactacatttatacatactgtcttgattttctatttggcctcttttgttttatgtggagcagcttgaaaagatcaccaatataaatttagctgatgtcaattgggaacgttcattctatttgaatttaattgctcacacgtcatactctgttacagttgcaatatgcaggtaatgtttctgcaacaaatctctcaagatatcctgcatgttttgtatttagtatttaggcaaattttgctacaggacatcgtgacttcgcggttttagccataggacactgcacgaaatggcttttgggggaatacactctataaacgtggtaatttgccagcagacaccgtacccattaaaataatagttttcgtttgaaggagagaaaaaccgcatgagatgtcagaaatacccctggacccacatgtcagctctcccatctctcttgtctctctgtctcctccatcgatgtctcctccatcgatgccacagatgggtttgccggcgatgcggacaaggtggcgccacgggacggctcaccggtggtagctggcgacgcgcttcgccgacctgaccaacaacgtgttccgtgcgcctacctcggcaccacgcccgccggcaggggacgccacgtcggggaggcgtactgccacgactgtgtccagtgtccgcgcatgccgcggcccaagatcctaaacgcgttcgacatcattgcatcgtcgccgagcttcgacctgtccgggctgttccaggagcgcggcgagaggatgcgcttcgtgtccggcgcgtcggtggccgacatcatcgccaagctagaggagatcgccggcatggtgagcttcatggcgcggaccaaggactgccaggtgagcatcgaggcgacgcagaacgggcagaagggcgcgctcgccatctccgccaaggtgttcgagctcacgtgggagctcgtcatggtccaggtgtccatggtccgcctatgagctgttaattttggaggtctgtttgattatccatcttcttgccacgagagaaaaacatctatagcgaatctcgattaatttgccagcatcgaggaggcggcggtgctcggatgtccggcagtcgcgcgcgccctgaaccagtggcggcgctagctgtccggcggtcggaggcggcggggtagggcgcgcatccggagccacctgcggcgctcggatgtccggcgggcgcacgtgaggaggcggcaagcagctttggcgggaggtggtggcggcgggctagagcgcgaggaatcgatgagtggtggcggactggcgcagggaagcgtgggaaggaagggggggatagagagaagagagatgggagagctgacatgtgggtccaagggtattcttgacatttcgcgctatttttctctctccttccagcgaaagttattattttaatgggtgcagtgtcccttggcaaattaccacatttatagagtgtattaccccaaaagtcattccgtgcggtgtcctagagctaaaatcgtgaagtcacgatgtcttgtagcaaaatttacctagtatttatcttgaatgattggcattcagttatttatgttaacaaggaaaagtttatttggtgatctagtgatgcacatcctttctaatgtgcaacttaatggttctaaacttctaatctgtcagtaaaaaagttgcctgtatattctcttaaattcttatccttcctttgctcaaatgtgacactgttgccacatgttgtctgtactagttttatgcttctattttctgtttcttccccgctctagcagttgtgaactggatctaggttaccttctaacttacagaactagtcagatatctttcgttattaatttatactggcatcattgtgtgtgtgggtgtttggggcggggggggggggggggggtactcacaaatatttggagtgcaacaatatccattgtcacacaaactgagacctctgattgtgtcatatgttcctccttagttgatatatatagcaaattattattcaacaattgtgtttcttatgatctactgtacagtatcatggatctttgcaaccgtgcagagaaaagcaaaccattatcaccagtttataaggtaatgtacaagtaagcattctgtgccacttactcgtgatgtttaatgttgagctttgtttcatgactacttatatattcattgtttcagaacattccataattttatccacagttttaaaccaggccagtgagtgaactggctatttcttggttcactagtcaggtttttctgtaggaacacagtctgatgaaggtaacattaaattgtcttgagaaaatcctttaaaagattaacagctattcgagttgtttgccaactaatacctagtattgtttcttacgaacaatggtcctatccacttgattccttcctacattgaaagacaaagatgctggttcaaatctgcatattgcaactcctttaaattttgtttcacctgttttggagctaaacagtccagaacacagacaatactggatcaggcttctgtgtgtttagaggattttaccatccttaagaggtgccaccaggtacaaggtaatgacgggtaccattcaaatctaaccattgatttgctgggaggatgatggccaaaagttaaaaatagcaatgctaggtatctatatccgtttctcacgacagacatgggaatgggatcagaggatcagggaggatgccttgcaaggggaatgcacatgatggcacccaatttgagtctgctgctttgatctgaacagagggaggaatctggatgaggaaaaataatgcgtaactcaaagaacaagactttctcatgaatcgatatcctattatttacagcagatccaagctctggatcttgtttttatagttcatcaatataaaactgccaattccactgtaatctggtattccagcatatagctatttacgtttggttcagcaaacccaacaacaaaattcatagcaacaaacaaaaaataaagaggaagagaggtcagtggggtctcagctcagtactgaaccagcggcgatgggagtggaccagggtggagggaggtccctgccgtcacctgcccccacgttccctgctctctcctcctagcgcatcagaaggtcgtcgagccggtccactgccacatctgccacgcaaaggtcatcgctgtcactgtctgctcatcgttctcgttgttaggccgcccatgaaatcgaggaagcctcccagctaccgccgccctcggccatatctggcacccctgacatcggcggcggccatgtctgtcccaaaggtgggcgatggtcggcaggagagggaagacggggagacagcgcatgagctgcagagccaaggaggtaatgtcgttggatggggagaaatagttgatgcgaaattaccatgttaccctcccaccattagaaatagattggtacctgctctcaataggccgtcgtggcgggcggtacaaaacctttccagccattagatggtgtgtatttgactgctaggattatggtacctcctgccctcaaggactgcagaaagcctcgtgtgtgatcatttggctgggttttctttattcttccaagccttgggttgaaatgaacctgactctgaaagagttgttccattttatttaactcttaacttctgtatttcattgttgcaatgctatctaccctagctaaagtttaacatgttctcagtgttaagtaattccatctcaaactcattgtcttatcaaaacaggtcacaaaaactgtgtatgcatccccgagccgcgtaaattttcatcttgatcgaaggaaggtgattttttttctggccttttctgttaaaagagatggtttttctatatacattcttgtttctttgaacaggcagtagaaacggtacctgcataccccaatatttgtttctcaattgatgacttcgatgatacctttgatgcagttgtaagttcccatttaattccccctagtagaagagatagtgttcagcgttctaacaagtgttgtcatatggatgtatctttaatattgcattgttttcattgttttcatatatatactctataggaaaaccctaatgattaacgtggtcattcaaattttagcaggttttatcagaccctgaacattgctactgtgttattctcaatgcacatgatggggcagcatttcctgaaaacactgaatcgaaaaatcctagctcaaatgtgctatctggggtaaacactgggagcaaacaagaaaaaccaccaaaggttctctctctctctctctctctctctctctctctctctcacacacacacacacacacacacatacgatgcaggtttctttgtagtaccattttcagatggaaagaacttcaaatcactttttttgttgtgagtagttctgcagttagaaatatatgttatcacatcttgcatttttttagataatgtcacataagatcagaagttttaatcagtttttaaaagagttatgcattgttaaacattaccgatctgcagtactttcttgtttccggtagtaattgagtgccaaatccatcatatctttaagactgtgatcattcatttaaaaccgatctactttaaaactgtgagcatttgttcaaacccataagagtcttgttaaacttcggttgttggcaactggtaatttattgtggtcacaaggacaacagtttcaggccccatattatcagtgccatagtaaagtagtattttcttggcacctcaaccttttctagttttatagatataataatattttatatgctttggagggcttgctcagtcgtgccttctcagttgtgcacatctttcactatgctcctaattattttaatataaatttagaactattgacaggttctctctgcctactggcatcactcttgttcaaagcatagttacgctttagaagatatctgcttctgcaacacaactttatgatgtataatgtcatacaatattaatgagtttctcacctacatagggcttctgtgattattattgcagagaactctcttttcaggctacgtcagctaccaaaacgttcgagaagcttatgatggttagtctttcgtccatctaagtatttccaaggaaactattgttcagttggtcttctgaagtatttgcttcctttcaactttatctgcacagaaactattgtcacatgattaatattcctgtcaacatatttcttcctccatagctaaatctaatagaatcatatgtttgatagtactggttttaactgcatcaaccctttgctcaactagtggatttcctgtttaaaaaaattgtaggtacctaacatttcattccttgtaggtttcacattttctgatatcctgttatagctggcagatcaaaatttgagagcttattctcactcgggcatgaccgcactaaacttgataaactttatatgaggggccctgaaggacgtggagaagttgaagtagctgtttctggaatagcaggtcagttatggttagtctgagagtcccaaatcatcagtgccataattatcatgctgtgacatgcaatcatgcattatctgtaatgagtagttctaatagaatggatttgggactcagttaaaataatgacacacatatattgctatggtaattggtaaactactgtcgtatctttatactgttgttgaaatgtttgtttctctacaagttatcactttttggtgcaatgctaggttatagtttgcattttgcattctataacaaatgtacaacattagaactacttccaaatatccttactgccccaccccagacatgcacattcactttttgggttactgtagctctagtgcaagttgttgatccatcaaactctcacacgggaatgattgtcttctaccagatcagagccatgagagatcaaagaaagatccaggaaatagctttcgggcccttgtccatagtgcagcatctactgcatcaaaactagcaaagcatgcctacgaggctgcatctaccaacaaacgctttgatgatgagcttctgcctctaaaatgttgcttgatgtcagtatctcttccttgggactacattgcacatgacctgctgcacaaggtaaaatccgtcactacttgtgaataataattattttgatgactaaaattgttaataactagttttcttttcctgcttttgttttcacaattatcaactattcgctgttgtcaaacaatatctttattctgtgtgagattgttgataactatttttgctttcttgcttttttttgtcacaattatcaagtattggctatcactactggagaactaatcttttgtcgtggtaccaaaaaacacaaatttctcagatctattaccaaccatactaaatatgttatttagtaccggttggtaacaccactagtactgtacaatcactaaacattgtttttagtcccggttcaacattgtcagaccgagtcagatccttagggattaaagatcaaccggtactaaggatcaacactttagtactgattgatgtcaccaaccgatactaaagattattttcaccttcctcgacttcctttacatttatttatttcatgtagatgcatcggccatgtaaacgaagtcgacgaaggtgaaaatggttaaataagcatttaataatttaaaacatcataattgtaaatatacattttcatgtattatcttttttaaaattctaaaaacattttcaatgaattcttcttatttctagtgattttaatgagttttaaatggacttaatcagagctatggttaattatatataaattctagaagttttataaaattgtaagtattttttttcatgtattatacttattttaactatttttagaagttttttaaaattctgagcatattttcaatatattcttatttctaactattttttaaaaaaaaatggacttagttttctgttcttattccttcattttctataattttcctttgttgtctttttttttaacattttcatccaatgtctctaaaattctaaagtactcttattttctctaaaagtttattctctcctctttttccacaactttttgtgagagaaatgtgtagaaacatagctagaaatgtaatatgttaaccatacatcaatagaggatgaaattgctaaccttttagatcctttcgattcgtgtaatatcaccaaatactttccaaaaaaatttggcagcacttctcttcctcctcttggcaacaatggttcgagctagaggaggaagaaggcatataaaagggaaatgagctttggtactggttggtaacaccaatcggtactacagatcaacataatctttagtagcagttggtaacatcaactggaacaagtattagtcacaccaatcgatactaaagatcctgaggggcggcttgacacggtttgacaatgttgaaccgggacttaaaaactatcttttattaccaaccggtactaaagattgtatagtaccgttggtgttaccaaccggtattaaaaaacatctttagtagtgatataactaaaatcactaaagattatagatccgagaaatttgtgtttttttaccacgaaagagatctgttctctagtggtgatatgtaacttatgatatgaaaaagttgaggttgacaggccatgccatgtaacaggaaacacctccgttggacctatgatccgcaacagtttcaaaccaatacgaattttgggaagaacagcatggttgagaagtggtactcatctactgggacatctcatggtcaacaatgagaatttgtttcaggatccttactgggctagccattggggcgagttgaaaggaagaggattgcttgtgttatgaatgttgagactgcgattccagttatgcaacacaaggaatgatcttacgtacatgattttggaaaagtttgtggttagcaagtcttgtgtgctcgatattgtgtaagatatgtgatgtacatgtgtactttaaatagactttgtatagtttttatgcgccgttgtacaatgttgaaagaagacgtgcaaagaaagcatattttaacttttttatcacgaggatattacatcttgtactggtagctaatctatacttactttctataaagttacaacccactaactctaaatcttaacatgcaactatgccacatcattacccactagcaataattacatattcaacctcatgcaagtatgtaacatcatctacaatctatttaattaaacaaatcaacatgtaaacatatccaatcattacccctcacatcatttccacaatatttttacaaatctatgtatacatagtaattacctgcatgcatgccactggttttttaattttgcatgtatgccactcggatgataattatagtggaatttttgtaatcttctaatggcaatcttgcaataatgatttacatcattaaaaagagctagataatgtgatgctggaagatggtgcgtgctacaatttgcatcaaagcataaatctctgcatctaccctataattcaacaactgggtcttacatccttcatatttcattcatcaaatcctacgctctgtattcatttatcccgatcgaacgatcctgatcgactcacctcgcctaccccgcgcgggcgcatctccttgccctgcacgcgcaatcgacgtattgtgcccccctcaggagcgcactgccaccaaccctaattgccgccgccccgtaggccgtcgatccgccaccgctggccttcgtcacgccgttgccagtctccgtcgcgccgccgtcgtttggtctccgatgagcctccatcgtctgctatccgtcgcgccaccaccggaatcccctgccgaccagtatccctcaccgtgacgccttcctcgcctcagtcagggccacggacaagctcgacgggcggccacagaactagggcaccgggcggccttcctccaggtcgccatcttgtggattttctgccgtgatagcatattgggatttgtaggggggtttttctgtgtacagagttgaattcttgtctgttgatgctagctgcatcttgcttgtccacaggttaaccccgacaggagtacgggacatcaatggatacatggttatggcaattacgagcaacatcagcaggagcctccatagcagcaggaacccacacagcaggtatgagattgaaatgctacgcagtcgtccacatttttctcatcatacatacatacactgtagaagttcacttctttaatttcgattgaacaaacaagcattgttgtacatttgctttgtgaactgctggcccaaattgcacgtagttcctgttttcaggctttccaaattattatccagttctttcaatctttttatagctccattgttctgttgcatgacagagatcatgagtttgacagattgtttggtacctagcaattgttttgtgtagtttaatgtgacttatttaaccctaattatacttacattgtaattgcattataaatattacatttgatggatttttatggaggattttctatcaaatgttagccatgaaaaagggagttggttgatctacatttacctattatgctcctctaatcttgtaataaggcaaatgctctaattataattattcatcaatgataatagattaataaacggttttaatttttttttgttgcatgcatgtatgtataaaaacaggcaccgttggacaggcagattttaattagggccatctctgggattagaattgcttaagttcacttttagatcaagaagaaaaaaagtaatgtacgtcagtccaacatgcagcatagaagttcaggatttataacctgaaagaattttctcaaaatttttgtctgaaaaattcctgagagactgaaattcgataaagttttcagtcctaagaaaccaattgctttaactatattggacttggttatggttggatgagacgctgtggttgacaggtctctataatgttaatttctatcggttgggcgcagcgtggcactcatcttgccgtagggacaaaccaaggcagatttcaggttaggcatcccgctcatctgaaatgatcagataacatgttcattgttaaccaaaatttttgactgcttcaagaatgcaggactacttaaggtattattagttgatgatcgatgaactttgccctctatttcttgtttgattgcttttacaattaaaaaaaatcaattggttatgacttataacatctgcatttgattttatattgatttctcaactccgtgtgttccatttaactgaaaatggattgccactatttgttttattccagattcatgcaaatgcagttgggaggcctataacccttatgtggcctgtaacacccttatgtaggtattgctttcttgtttcagaattagaatgtgactgccctttcatgaccatgtaagcaatgacttagaattgtcgagaccaatgtggatgctccttttatttgcagtaatttggcattcttttgtgtacctcactacaatcagtagaatatcctgaataggtactgatttattataattctaaaggtcaagctaacaaatttaatatttgtttaaaattgcaatgcatgtcaacttatttcttaagcaaggtatattttggatccgagatgaacatattcttaaccatattcactccaatcaaagcaagtggaatgtgggatgttgtgtgagaaacagaatttgaatgtttacagggtttagctttcattttgagtttggccatgccaggtcaatttttggcatttcaatgtctatgcacttggtcttataatgcttttgaaatgaatgtctggatctaatcgtgcaatgtgtcttcaatttatttttaccccgccacacatggacatatattgtccctagacttgtgtcgaggtgattagggctgttttcttttggagaggttgggaacccctcccctccgcacggaaaacggagcgatagattaacacatgattaattaagtattagttataaaaaaacttaaaaaatatattaatatgatttttgaaaacaactttcctatataaacttttcgcataacgcataccatttagcagtttaaaaagcgactcatgggaaagaatttagcctagatatagttgatggtcttaaattatttttttcagacaatatgatatttttgccctttgtcttaaattaacatttgagactgattctagaaatgtaatttgactaacatgaaatttaataatataatttattaatcaaaatattattacaccgtagcgttagcatggacaaattactagtatgtatgtagtatgtatggttctaaacaactgggggtgagtttgaatctcctcgctcgtcatacccccagcagcattgcaacaacatgaaatccaaagaagatgaaaatagctatggcactggagttttttgtcacactcaagaccctttatcggcttctccacaaaattgtcatacactgaaaagaaaaagagaaatacaaaagaaatgcaatatgttccgttaaatagcattatatgtcaacactggtggagaaaggggttttactcccggtgagttggttcgtaacctcactgtagtcccggttttcaaaccggactaccaattcgggtctaaagatcactatctttagtcccgggtgaaaaaaccgggagtaaaaatccatttttagtcatggttggtgagatagagtcttcttagtcccggttggtaataccaaccaggactaaatat

SEQ ID NO: 63108 - DNA, 895 bp, Oryza sativa
ttctaaaaagaagagatatggaggaggaagagataaggccagggaggagatagaatatattaactgctcctcctcctcctcgatttggcctcgtactctccgccgcccatgttgcgcatgctgatcttttattccggttggtgttaccaatcgggactataatctttagtcccgattggtaacaccaaccgggactaaagataatagagatcttttgttccggttggtgttaccaaccgggactagaaatagatattttgttccggttggtaatactaaccgggactaaagataaaaaaactactctaaccttttgaactgggattaaagatatctttattgcaaccgggactattgtgtattttggccgaccatctttaccaaccgacagaagatggtttctccaccagtgcaagtaaagtcaaggtagagacaatgcaatttacttgagaagaaaaaacagtgaaatatgcagtgaaacagaaaatataataattaaccttaccaagaacatgctgaggttgttcttacctaagcttctttattggccagatcaatgttctcgatgcctccaaatcctatacatattttgtgtgctttatttttcattctgaatgtgtacatttcaagcttggatcaggggaaggccggagaaatcaaatatgccctaaagcttaaaaagacatatgtcagatttacaagctagtagtgttggttgatatttatctctttccaacagaaacaaagtattaagtcttttttacggttctttataaacaatttaaagtgtcgtctgataaataaaagagatgaatgtgctgatatataattcaagatggaaaactccaattcagtcgcacacttcatgccccgtttggcacagctccagctctca

SEQ ID NO: 63109 - DNA, 8139 bp, Oryza sativa
  unsure (1)..(8139): unsure at all n locations
gtgttaggactaacttcgacaggatgtgcattgttgaatgcaattatttcagcgagagaacgaactggcgagtatgataagtctgacagatagttgttcaggtttagcttgaactcgnnnnnnnnnnnnnnnnnnnnnccacttttagtgccatcgaatatgacactcaaattagctatctcgaggttttcgattacaactgcaccctgttgccttcagagatgagtaacaattaattaaatggttgtagtttacttctggtaaaattactcaattgctacatatatgatattagacaacttcgacaaagcatcgtacagggaaaagagagaaggttcaaaaatttcgttgatgattacctctgaaatgtgataggtaaaaataatcttcaaccatttttttagtttaattcttgtagcaatacaccaataccaacttccgaaagggaatataagcattaattgataacaacatggttgttagctggggtgttggggtttcatgtatgaactaaattgctcgttttgaactttgaagtcattgtcttttctgcccaaagtcaaggcaagataacttacacaacccaacattatttttcttcaatacacaactcatattaattttatttccttgtactatgtatatatttttggcacaatcccatcatgtgtcacaaattaaacgaattacgttgaccatatcagcaacctaaattttcatgtttctcatctaataggtcatatctatttatactaccaccacaacttacagtatattagtataatatttttttctaccagagtagaactcacggttcttaaaattatctctgatggggataacagtggtcgtagtagagatgaccgtagaggtagtcttcctatatatacttacaaaatgtgaaaaatcactgaagtatcgtcataatattcttatcataggatcttacgtaaacgatacaaatatcctcgcgttagatatatattgctaagttaactaataaatattatttgggctatggtctagatccttaaaaaattacctcattgtgttgaggtgttgcttgtacaccatcttcctgacagttccatttgggaaatcaaaaaaaccgtctggtatgccaatcctcttacccttcaacccatcaattctcaagaattgcacatatccaccagcagggatatacttcgatgctgcttttgtggctttggcatcaagagcatcataacccacaatagcatccaacacatggacagcatctgccactgttcgacataacggtctgtgtatttgaaatcaaaattcaacatatgtaaaattaatgttttgataggataagaaatactttagatgtcaaattaagaaaaatgggctataagatatacctatgctcataaagtttatatggtcaattttacaacctctaaacctatattcatacaacattgttaggaaatcccctcattaaccgaagaaaaggccaaaaaataccaatattgtttgtaggatgatattatagtagtttgactccatatctgatataaattgataatcattaatgttcaattgcagaattatttaattaaggaaaaggtaagaaatatgtgaccccttgacaactacaacatggcattattatttttattctaacttttcgagttcaagagtaacaaataattaaagcaatgaaactatgtattgggatgcatcttccacacaatttagatgccaagtaaatatcggacaattgcaactattttttatgaatttttggttatcaattctaaaaaataaattaatttatatttgaataaatatattttaatttataaaaaaaataaaaccaaatgactaaaatatcgtactcatatttatgccaatgcatacttaatttgaaaatagaaacataatacccaataatgaatttaataaagctacaaagaaataattactgttaataaactgtacaaactatctttttatattataagtcgttttgaccttttttttctagttaaacttttttagtttaactaaattgatagaaaaatttagtaacatctacaacaccaaattactttcattagatataacattggatatgtttcgaaaacatgtttgttttatgttgaaaatattattatgtttttctataaatttaatcaacctagaaaaaaaggttaaaataactgataatatgaaacgtcactacaagaaaacatgcctttagtaaccatggatttagttaccaaggaatttggtggctatagtccatcactagcaaccaacatcttaatggcttggttactccaagtcgtacaacgttttagtacactttgtatatgtgaggaccctacgacaaccaaggactgaaggacttaagataattatttgaaaatacagaggactccaattgaaaagtgcagctattatctgttctcgccatggaacacatctccatcatagaaacacttcaaagacatcaaaacctagggctcagcggtggcagtggggctgagcaacttttcttatatacatgagcaacctttcttatttggtttgaccccaactttttttttatcaggtgcaccgtatcaatagccttctgctatatacatgccaagcatactgtggtcacaaacctgtcccaagctttgaaattctataaatgtacggcatatatttttcttgtattagaagtgattgggtgtgacatccacacttaagtagtattagttattttctgactattacaatgtattgttcaatcaaatatactcagatttgccataattattttgtttatattatggtgatattttgatctgtatggattgttcttgtgtgtgaccatatcttttagccaccaaggttaatattgttcttggtggcaataggtatttaataactactactctgtcccataaaaaacctaattctagctataaatctggacacttgtgtgttcatattcatagtcaggattggtcgttttttaggacggagggggtaagagccaagggttatagtgcacttttatttaccaagtactatttggttacaaaataataccaatatttactcggttactattagttcaacctattgttaccaagtattggctggtaactggaaggtatagtacgtttaacaaccggattatagccatcaagatacgtccaaggtataatggtggttacatatcatcaacagtgatcaacatgtgatctccaatgactaggcaccttaatgactaaaactcattttcctttagtgaacggagggggtacgaattaacaatttttagcatatacagctggtgaaaataaaaacttacccgacggtgtcctgcctagttgtgaacgggataacacctgaccggcttgtcaacccaaccgtcggcttaatccccaccaccgagttcgccgccgctgggcacaggatcgacgccgtcgtctccgtccccaccgtcaccgccgccatgttcgccgccgcggcgatcgccggaccggtgctcgacccgcacggatcggccgagagcacgtatggattctgcggacgtcacacgtgcgcgcgcacacacacaaacagttagatgacgcccagtctagcttgcgttcgatcgccatggcaggcggcagctgtgtcgagcttgccgccggctgcttacccgggattggccgccgcgtgcgctccagccgcggagacccggcgagctgcggaagttggcccactcggggaggttggccttgccgagcacgacggcgccggcgcgccgcagccgggccaccacgccggcgtcgcgcctggcgaccgcgccgagcagcgacagcgacccggccgtcgtgttgagccggtcgcgcgtcgcgatgatgtccttgaggaggacgggcacgccgtggagcgggccgcaacggtggccggtggcgcgctcggcgtcggcgcgcgccgcctgggcgagcgcgtcggggttgacctcgatgacggcgtggaggagcgtgttgaggcgggcgatgcggtcgaggtagaagcggacgagcgccgtggaggtgaggctgccgttgctgaagccgagctggatggcgtcgacggtggcctcatggaactcgaagccgagcgagccgccgccggcgagcgcgacagctgcgacgacgacgacgacgagcgcgggctgccgagccatggcgttcaaactggatagtttttccggtcagacgtgcactgctgtctttaacaatacggcagcagcagaacatagtgagaaagtctggtttgcttcttaacggttgcgttcatcctatttgcacacctaaactttcatttgcatgcaaactttttcttaaaaacttttcaaacgcagatgttgcatgctgtgagtactgtaactttcatatggttaaaatcaaatggtcaagagcatttttttttagtgagaattgttattagctttgcttgtaaaaactttgtaaggtatttttgtaaaatatgtagtgcaacttcatatatagtgtgtaaacctgaaaattattgttggatacaaaatggaagcctgatatttatctacgtcatcatgagtaaaactacggtgacgtagataaatcttagtcatcctttaacgatagtttcctcgtacatttgcactgcatatatatagagtttacactatatgtttttaattttttttaagtatggatagcaatactcaaactttaatattggatatgttacacgtcaaacattttaaactaatcgtattcttcctttaagtcgatcatgaggcaattttacatattttcattatttatactgaaaacattacctaagttataaaatgattcttgtgtgctttcttaggttcacttggtaagctgaaaatgaatcttaaagcaaatgggaggaatgcaaaaggtgaaaaattgagaaacaaacattccacctcaggtggcgattggatggatggttggattagggaggagatatcaacactgacaacacatactacacaataccccgcgcattgcagcgggtatttttagatgtatttgcaaaaaaaaaacacagtgaaagaacatgatgttattttaaagtgatatcgtatgatttctacttgagaaatataaaagttaactgaattgattgatacctgagggaataattacagcatatgtcttgtaggttgaggacgatatcaacatgtccctgtgtttcatgaacgcactcaactgtttgttgaagatattgatgtttctgcatcaagtatatatagtataagaaccgggtgcagctagtatttgctttttttaaaaaaaaaaaagaattgggtgcgatatatacaatagctacaacaatgttgcaaaatctggcataatagagtaaattccctgtactcttaaaaattcatgcaatctctctcgtacctctaaaatttacacgatcctttctatacacccgaaatttctacttgatccctgtctagggtctatctgataccatttgtgtgacatcccagcctaattaggatatagcttgtgtggcccatgagagctgtgtgtgcatgtttcgtaccaccttactagtttagcaagggtggaactaacttataagggtttgttctcccaaccatatcgctactgggttaacctttttacacaaagcgtagaagaaagtgtaagtggagtgatgtgtaagttggctcgtccgtcggatgtgctgggctacgtggttctgaagagtggttgttacaaatgatatcacagccgaccctcgcagttgcacgtacgtgtcaatgtgcgggcatatggtgcatgtcacatgtggactctgtgtgaggcacatggcatggcatatggcgccaacactggatgtacggacgtgcgctaagaggggttttgttcctgggatttgcctatgcttgtgtgggtgagttggaccgacggggacgtcaggtcctttgagggatcgtgtgatatcccggctgttgacggtcattagcgatcaatttcgaccgtcaatattaacaaaatagaggagaactagtcattcttgcaatgcatattttgtattaaaataataataatccactagtattaggtttactaaccttttgcagagaataaccataaagtggagaagaattgacatcaaatcaaacgatcaatcaatcggacgatgtcgagaatcagacttatgtataaaatgggccaagaactaagaattgacaagatgaattgggccaaaattcacaagtctgcaacaaggatcaggagaagaggccgccagccaaaccatgggctggttgggccgacccctggttcggtcgaacctcaggttcgtccgaacccccctcacggccgggaaccccaccgattttagggaattttatgatgtggtccatcacaaatgttatacatgttgcatgctaaactgtatggattatgatgagaaccataatcacgccacacatgtagaatttaccgtgaatctcacatgtcaataggaccgttgatgagggtgcacagtatggacgacaaaacacgcccctaatttttttaaaaaaaaattaatccattccgatacgttccaatgtgtttaaaagcctcttgctctatttttttttttaaaaaaaaccactcttagtttttattgatttggctagaacatgtttttttcttttctttagcttatataagtgttcgataattataatggtcgcctcaaatagctatggctcataacgatgatatacgtgtgttgtaggtattaaagattttgtttttctgcttatcaacaaataaatgacataatcaattttttcaaccttcatttaaaaaaaatattcttccgactttggaagagtgtcaccactaattcattttttttgtttcttggtattttctaaatataggacatcaatttgtgtttcgcgtaggggcgtcgaattgccctgtatgtgaatgctaaagcgtatttatagaatttactttgtactttccacacataaatcttagcaaatttactatatccatattgttatagtaggaaattgaagtttttttgggattcaactgtatcgtgccttgcttttgttcttgattttgttctctaacttagccaacagctaggtgaggtggggggactggatagtaaagaggataagaaagaaggatgaaaacgaaaaaatgaaagactattccatagggatgtggaaggaccttcctgcaatagaagtttctcgatgagaactttatgatattttccgcagatgatgtaacaaataaaggatcatcctttcacttatttagatattctaaggtggttcgttaaagtggtttttatatcatttatatatgcattagatgagtttatcgatgtgacatgtattgaacatatatgttaaaatcttcacctaaatcttttttacccattttttatctcccacttacaaatgaatgtcgatataatatattagtacaacattactagagattatagattgatgaccagctattgatgattgatgatatgtaaatatgtgatactggctattcaaaccactttttccaattatacaaaatcaccatccaaaaccatcaaaaggtgtaatataaacagtattgcaaagtttggaagcttgatgtctagtttcaaaattgggggtgctagatggatttctatccaaagtttaggggtatatgaactttttactaaattcaataaatcctggaagtaatttatataaatcctaaaagtaacttaacacaaataaaagtaagtttttacggaattaaaagtaaatccgttgtgtggggttaagggtaaaaacataagtctatctagaaattaaatttaatcatcgtcaattatagagctaactaaaattaacaataaaagtaaaaaactaacaatatgagaagtaatttaattaaatttaaaagtaatttacatatatgataaaaattaatttacatatacaataaaagtaatttaaaacatattttctctcggaatataatcatgtaaaatttaattataacattggataatagacctgataagtaatttaaaagaaaattttaattataacattggataatagacctgataagtaatttaaaagaaaattttatttgaaggttagct

SEQ ID NO: 63110 - DNA, 9287 bp, Oryza sativa
ccgcgctcgccatgggcgccgaccgcgccgtccacgtcctccacgaccccgacccctcccgccccctcctccccctcgccgtcgccaagatcctccgcgccctcgcgctccaggagaaccccggcctcgtcatcctcggcaagcaggtaggcgcgcccaatcttcgatttgaccgattttgtggtatagagattgaatttacttgatttcactgataaattcgtgggattgtaggtaggtgatgttcctgcatgattacctagttgtggtgattcttttttgcttcacagtgtgattatccaaggattttcttaatgggaagagttcatgggatttcaggattattatatatttcttgcctcattacatatcttttatgttttattgcattagggattagggattcttgttagcttgtgagactgggattggggtatctcaatttgatcgagagctttcattcttaatgcgaagagttcatgggatttcaggattattatatacttcttgcctcattacatatcttgttatgttttattgcattagggattagggattcttgttagcttgttgagactgggattggggtatctcaatttgatcgagagctttcattcttaatgttcttataatgttcttaatgcgaagagttcatgggatttcaggattattatatacttcttgcctcattacatatcttgttatgttttattgcattagggattcttgttagcttgttgagactgggattgggtatctcaatttgatcgagagctttcatttttgcagcataattaattgtgtgcttgtgattacattttgacggcttcatctaatcaagacatattcctgtgatttggggggcatgacttttgtgaatatggaatgattgactctgtatttggagcttagtacttcattcttacgataataaaggttgctatttccccgcaaaaaaaaaataataaaggttgctattagtgtgttttgggttgaatcttagtggtttacttcttggttcgttgaagcttgtgtaaattgacaatgttgatatccatgtgattgtatagtgcaaatttagttaccaatatgcactatggtaccaacagtgagatcccatctcaaaaaataaagtgagatctgagagaaccatggttgtgttaatgcaagccatttgctgattttgcttctaccttaatttaatttattgccctaaagtgaggtatagtattattctgagacactagggtgcatctctatacagtgtacttgtgttcaacatccatgaaattggcaaattgctcctacacatgtcctcgtagtgcttgactttgttgaccctgtttaatatgaaagttcaaagtgtagaattggtgcattttcccccctttagacctaatgctcctggattatttcatgacattgtctaattgctgcatataagacttgaatccttagtactattttattaaactttgacgtcttgattttttttcaaaatgttgacagtctttgctgtcatgagcaaatgagtacgtacaaaagacaaataagaaaatattagctaactagtgataggaaatttaacttgaaattatatatattgataatcatcaggtattatatcttctggtaattgcaggcaattgatgatgattgcaaccaaacaggacaaatgctagctgggttgcttaattggccacaaggaacctttgcctcaaaggtgtgttttttgttactccttccattgctttttactgctgtcatgattgccctcgcatgcaagtggggcgccaagagcatggcacagcaggctgggctgggcttgtcattttaagttcattacttgaagatttgttctccccttctcatcacttccccccgtgcctgttaatcctctcctcaaacacagctcctggctggggagatccagggccaaaacccccagttacccaagggttgtcccattgatatttaaacctagacaaccattacctttaatttgattaccaaatgagttcttaacaatgtatttgctccttcaatttttttctgcatttaaatgatctgctcctagaccctaaaccgtatgaagctcgtgttgaactttggtatagtttctcccacaattgtggaattggccacataggaccttacagtttttttggtttgctcatttttgtccttctgccatgtggcgtcccgtgtggacttgtccagtcagcgccttctttccaatttagactatgcaagtgactgaaatgcgtgctttgcatcacctgaaaaaacaaataatgaactacatagggtcatcctacatcgatggtaagaaaaattagggcaattcagttactttatatagtttgtagcatttgaaggccctgaatattgcctgcccgaaccctggatattgcctgcctgagaccatctgtgatgtcataagaggcattaccattaaaacaagccaactaacgaagctcagggcgctaacataccaattcacagttgaatgaccaatttgagcaagaagcaagggaccaaatgaactattaatctttcagattgtggaaggaatttctgagcactgatggaagtttgctgttccgtttttttaatcccattttaggaacattaattttttcttctttcaagatatctgatttccttttgttggccgaacatagtagagcaaccaaaaaaaatcactgtaatggcgttttctatgggttcacattgaccaagtgtttattggttttctcttatcatggtgtttccaattcaagtttgtgttacacaggcagttgtattcaaagatgctgtttgattctggcaggttatattgaacaaggaaaaggctactgtggagagagaggtcgatggcggaatcgagaccattagcttggatttgcctgcagttatcacgtatgttccatgaaacatttattttctttcttttagttttatttaacaaggctagtacttcgattcttcataagcattgcgatcatttagtgatctctgtcacatagctggatctttgtattgcattgtggttttgagccaatttcagaaattgcctaaactattgtttgatttttgtgacagcacggatttgagactgaaccaaccaaggtatgcaacattgccaaacataatgaaggcaaaatcaaaagtcatcaagaaagtcacccccgaagatctggatgtagatatcagatcagacatggaagtagttgaggtcactgaaccacctaagagaaaagccggtgtcattctttcatccgtcgatgagctcgttgacaggttgaaaaatgaagcccgtgttttataacattctttgtactaatgctcatgagctaaggaatgtggcatatgcaaataaagtgtagttataaatggtcatcgtatgcaataaaaatgtggcgttcccgtatagcaccagtatacctgctaatggtcatcgaaatgctagtgtgtgtgtgtgattttaagaagccatgtaagcagaagtgttcactaaaatcaatcaatctttactcattcagaaaaaaagataattctatttatagaaataaagatctaggcatctagcacacgtatgatgtggtaaaattagtttcgtctccactagatatgccttgagctctacaactatttacgtttcaacctcgttgctgttgtttcgtgggatgtagtgctggcttggtaaaggtaatttggttcaaagctgaaatattttcaagttaataaatcgagaggacaaaaacattgagctaggaaagtgttcataaatgggaagtgtctgatttttcttttaactgaaggagctcatgggttgtacttggaagcagcttctcactaaagtcagagatataggtccaaacaggagggactcgtcctcatggacccatacatcaaaaacacacatcccaacttatataggccgtgtttatgtcccccttcaaacttccgaaaatttcgtcacatcaaatatttgaacgtatgcatggagtattaaatgtggataaaaaaaacaattgcacagtttacatgtaaattgcgagacgaatctttagagcctaattactccatgatttgacaatgtgatgctatagtaaacatttgctaatgatgaattaattaggcttaataaattcgtcttgtagtttacaggcgaaaaatgtataatttgttttattattagtctacgttaaacactttaaatgtgtatccgtatacttaaaaaaatttttgccaagtaactaaacacaaccatagtatattacattacatgagtcttatcaggttgtattatcagatcgtactaagtacatgaataaatgggagtgacatacagtttgagccgatctatacatactctcttcgtcccaaaaaaagataaatcctgggtttccgtgtccaacgtttgactgtccgtcttatataaaattttttttataattagtatttttattgttgttagatgataaaacatgattaatactttatgcgtgacttatctttttttttcatatttttttcaaataagacggtcaaacgttggacacggaaactcagggtttgtcttttttttttgggacagagggagtacaaaatatcactgaccccctggtggaagcagatcgtctgacgttaggcgcacaacgtcagagggacgtccagcgtcgatccatcgtccgatcgacatctcacggtgctgctgcttccttcgttccgcatcgcacgagcacggcgaggacggcccattcagcccatttacgagcaaccgcggagggacaaaaacgaacgagactgctcgtcattcgtcaatctgccatcgcgcaaaaaaaaagaaaagaaaaggcaacccccggcatggctgcccaccgctccgctgtggctcgcgcctttctcgacgcgggcgtgagaggagcggactgccgaggaagactgcttcgacctcgccctcctctccatccctcggccccatgtcctcccccacgcgagagcttccaggcattgccgtcctcgacaacgacggcttccacagcggcggcggcggtcgcgcgagcgcaacgaataaggcggtcaaacgggctcgcggtcagcccatgccagtgaaaatggcccacaaacatcctcaatgtcgtgcgccgccgttcgttgctctgtttctggaggggaaaaagggcgccattatactcggatggagggaaaaaaaagaccattcggctgctgttcttacggcgatgaagatggtgagcgagcaacaagaagcttttctccacttgatcgtaagtctgcactagttacctatcttcttctatatccttcattaatagcttcttagaattcatcaaactccccttattaggttgccccccttgccatcaaagaaacatcagactaaagatacaaatcaagttctgccatctaactcgtgagatggaaggagataggtttgtaatacatctccatgctcgtgtattcttttcctttttgtcatatgtatgcactagtctcatatttttttatagagaaatgctagtaccatgttctgtacctcacattggaatggaattcaaaagtccagatgaggcttggatattttggcatcactatggaggtcaaaaaggctttgaggtcaggaaaaggtacacaaacaaaagacaatcggatgacaaagttacatcatttagatatgtttgtggaaatgagggtcatcgaggacaagacaagagggatcatctaacaaagtgtccctgagctgaaacccgcactgattgtcaagtccgcatgggtgtagtattggacaaaaagacggaaaagtataaagtgactaacctagttttggaacacaatcactccttgcacttgcctgaaaccttgcactttatggtttcacaaaggaaaatttcagatttacaagcttttgaaattgaaacagctgatgatgcaggaattgggccaaaggcagcacaagagttggctagtagctaagtcggtggatcacatagtcttagctatagccttcgtgatcgcaagaattatttgtggagcaagcggcaaagagagatggcatatggtcaggcaggtagcatgcttatgtatttccaggacaaaattgctgagaacccatcattccaatatgcattgcaaatggacagtgaagaacagatagcaaatattttctgggctgatgctaagatgataagtgactatgtacattttggggatgttgttagttttgatactacttttggaacaaacaatgagagcaggccttttggtgtctttgttggattcaatcattttagagaaacagtagttttttgtgctgctctcatgtatgatgaaacattcgactctttcaagtggctctttgagacttttctaaaagcacataatgggaagcatcccaaaacaatatatacagatcaagatatagcaatgggaaaggccattgaggaagtatttcctgcagcatggcatggattgtgcaccttccatatttcacaaaatgctgcaaaacatctatcgcaagggaataatggagaatcaagtattctttcagatttaagcgcatgcatgtatgagtatgaggatgtgacaaaatttgaatatgaatttaacatcatgagggaaaaggtgagcaagcaaacttggctagatagtatatacaagttgaaagaaaaatgggctaaatcttatatgaggaatgttttcacattgggaatgagaagtacgcaattgagtgagagtttcaacaatgacctgaaaattcatttcaaatctgattttgatatcattcgttttttcaagcattttgaaagagtggtgcaaggaaaaagaaatacggaactagcttccgaatttgattcaaggaaaaaattgcctagaatcaaaatgagggcacctatgctgctgcaagctagcaaggtgtacacccctattatatttgaagcttttcaaggggaatatgagagatcaatggcagcatgcactaaagcattggatggcgataatgaatttctagtatcaattaggagttttgagggagatctaacatttgaggaggagtacagagttgttggtgatccttcagagcagacatctatttgcagctgtgggcaatttaataggattggaatattgtgtgggcatgctctaaaggttcttgatttgatgaacatcgagtcacttccagcacaatatatattaaagcgatggacacgggaagcaaggagtggaatagtaacggacagcaagggaataaatataattgagaacccaatgatggaagcttcccttcgctacaaatttctatcccacaggtttctcactttggcccaacaagctgctagctatcctgagtgcacattgttagtaaataatacacttgacattcttagcaagcaaattgaagagcacctcagtggatgtgctagtacttcagatcaaagtgcaacccacaaggaggttatgcccccaaataacttgttgagtaatgcacgcctaaagaaaaaggaggttcgtgttagaggttcaaagcgaaaaagaatttggcttgacaaaaaacgagacactacacaaaaacgacaaagtaaaaaagggtaaaagtccaaaggtatgttctaagaagatattgcaataccatgttactattcagtcatgtgttcacttcatccttttacattatttggttcgaaggaacaaaagactaggcaaaatgcactccatgttggtgcagcaacacaagtggcagaagatagttttgctatggacaaggaggagcctggagaatacatgcacctaaatagcttcactcagcttttgacggtaatacatgcacctaaatagctatgaaaatatataataaaacaaccaatgattaatctttttctttgtaggggcagataaatgatgatcttttagttgacgatgcattttagtgatgaagtcatgttctggaggataacccaagtttggttgcaatactgtgataatacaagtatgatggagctggggaaaaaacatgagaacttttgtgtctatggttaattttgttttggcagatcctagtgaagcacttctgttctgttttggggttatcctatccaagacatactcttatattggcagcactcaatgatgtatatatgtctagctttcatttgctatcttgaaagcaaaactttagggacaaaatatgttcagtcattagatgtccaatgcagcaacaagtatcacattttaatgttcagtgttcactgtccaagactttctgccattgctatctgaaactctcaatctgattttgtcacaaataaaatgacccaattaacttcttcacattctcaaatgctcacaaaaatcagagtatcaaattgacattattatcacattcaatactgaatcacagtttcaattgacatcgattttcaatctcaattcagatattcccaaattctaaaacagagattttcgccctcttcagaaagctatggtggtgctgccatgcttgtcgcctccttcccatgcctgtccgggcttggcagcaacggtcgccctttctcccgtttttgttcggctcttgcgattccttcgacgtgggtggtggtgaagagcttggcgccgccgccgctgtggaagccgtcgttgtcaaggacggcaacgcctagaagctctcgcgtgggggaggacatggggccgagggatggagaagagggcgaggtcgaagcagtcttcctcggtagtccggtcctctcacgcccgcgtcgaggaatgcggcgagccgcagcggagcggcgggcagccatgccggggattgctttttcttttcttttttttttttgcgcgatggcagattgacgaatgacgagcagtctcgttcatttttgtccctccgtggttgctcgtaaatgggctgatgggccgtcctcgccgcgctcgtgcgatgcggaacgaaggaagcagcagcgccgtgagatgccgatcggatgatggatcgacgctggacgtccctctgacgttgtgcgcctaacgtcagacgatctgcttcccccgctggtagatttcaattatggctgtgtttagttcagcgtaaagtttgaattttggttgaaattagagatgatgtaactgaaaaattacgtgtgtatgacaagttgatgtgatggaaaaggactgtagtttgaatccaaactttggatctaaacacagcctatgactaaccattatttgcctgcgtaatattttactactactatgaggtatttactatttta

SEQ ID NO: 63111 - DNA, 3331 bp, Oryza sativa
tatctccagatttgctaaatgccaattgacgaatccagcttgcaatgatttgacaacaaagaggataataggcagtatccaccattcattgtcttccctactcttaaagctgcacaagattccagagaaagaagagaccagcatatcagtaaagcagatatggcaaggtgcaggtttttccctaacatagctaaaagaacaattaagtcctgtgaattgccattgagaagacagttaaaagaaagtgtagaatatataatctagatatatatttaaacagtttttttaagagttcttttaacagattagacagaagacatactaaatccaaaattaaaaaaaaaaactacggattgagcttccatattcctttatcaaggtgcagaatatatgactaccacatattacatcacagatagagacaaaatcagatgtccccaatttataaaagattttggttaatgaatccaatttgaagaatgctatttattgtacaaaacaaaaggtttcaagttgttcaatttaaataaagacaattcaaataaacatactccctccgtttcaaaatgtttgacaccattgactttttagcacatgtttgaccgttcgtcttattcaaaaaattttgtgaaatatgtaaaactatatgtgtacatgaaagtatatttaacaatgaatcaaatgatatgaaaagaataaataattacttaatttttttgaataagacgaatggtcaaacacgtaaaagtcaacggtgtcaaacattttgaaacggagggagtactattttaggctggtcactcattcaggttttcgataaagtgagtatgccaaagatataggaaaatgttgttggctattaccaccaggaccaaaaacacacacaatcgtacatacaggaaatgaacattggagactagtcaacatgaactcatattacatcaattatctttctgttattccatgcaataactcttgggtgatttaaattcaatgactacgggtaactcacagcagcctatatatgataatcaggttcatgaaccacgaatccaagtatatggacatggtcacatctcctaatcaccgagagcatgcacccaacatccaaactaatcattcaactaatgcaaaaacaatgtgaaccttattatcatcacatgtatggctcatgcactcatagagaggaactgatatgctttccatggtccatcactactaaatgcatgcaggaagagacttgtgcacaaaagaacatgaacaagttaactcctaacagggactttcttaacctaaattatattaatttagatttggatataaatatatattctgttataaatgtattttgcaaactcttattattgcaaccaacagtggaaaattttggaaaggttggtagatctgtagcatgtagtctttcccaactagacatgccttgaacccacgatatgcagccacatgggcatccctaaatccccagaaatactgcctaatctcttatgttagttttgatgtgcaaagtcataggataatctggttgggaacatatcatgtgcacacaagcttcccgtgcacaccaactagcaaatgtcacagaaaattctacaaaaaattagacacatagtttcaatagtactacacctacatgtgcaatcttatcttcaaattcattatattttagccgtaacaaaaaagacaaaatcctgacagatttttacccttaaaactgtcagatttttcacttttttattacgactaaaatataatgaatttgaatatgagactttgcatatatgtgtaatactattaggagtaaatgtccattttgtagaatttttcgtgacatttcctagttggtgtgcacaggaaagttgtatgcataaggatatgttcccaagctagtttcctgaacattggaagtcaccttttctttatttggagaatgaattctggaattcaaaagaaatattagaactacaaaccttttagtgtttagtgcatgaggaacggaagacactgataaagaagacagcccagagtacaaagctccataaatgattgctacaatctgcatagaataaaaattgcatataaaatctccaccgcctgttatgaataattaagccataaaattgagtatatgaacattacttaagtaacaggatgcaaaccaactcttgttaggctattctgaaatagaactttgtaacaaagcataacagatcatgctactcatgcaataccacaaataaaggggttcttagacaaaccatgagaggaaaggcttacaatgtttatgacagaagtagtattccaaagtgcaaaaatacgggtcacggaagatctctttggtcctcggctgaaaagtgcattgagaccagcaagaaagggagacagcaaagcaaggggaggaataagaagtacagcaaggaatgctccaacagatatccaatagtactgcacaagcataagcagggtgacggaaaaatcacccagtagtataatacatataagcagctgcaaagtttcctgaaatattatagcatggttccagtaaagatgccttcctctcaaatatgtgtgtaaaacaggattatagtgcttaccgcataaccaatgggcctacaattttgcaatagcaatgagaaagggaaaagataatctcttttacattccagtgattttagtgtaccctcattgattatcccaccattcactccacctgtcaaacgctttctagaaacagcatagcttgtgcaaggctgatcttgatttagcttcttggaactgatgttcttcctgtaggattaaaagcgataccactattttacacagcaagagtaatattagtaaaatatgatattgtgattggtaattatttccataccttgagcgatcgatgaattctgagacatgatcatgctgatgaagactcttatagaagtgctcattgacagcaacaacaatacctagctgataataacaagaagcagtggcttggaaccatcctaactccactcgaacaccatgccgctcaagttggggatttccatgactattaatccaagaaacaacaggtcccaaagttgatcggatgttcccttgccgtactgtcctcaactgagcattcaagcccgcaaccaatctgttccagatcgcagttgacacatactagagaaagggaatgaagtcaatggaaatgattggataataattttgcacttctacatagaggcttcagatatctagaatatcatatctagactgttcattatctaaatacagcatctgcatgctttactaggtcccaaaaactatgcaccaaaca

SEQ ID NO: 63112 - DNA, 4257 bp, Oryza sativa
  unsure (1)..(4257): unsure at all n locations
ggtagctacattttgggacggaagtattagcaaataacatcattcaaggtattagtatttattggttatttaagctaagttcagatacatctttaatgtatcattaaaatgaaactctgctgaaattggctagtaagttagttcatactaataagttctggcaaaaatgctgctacatccacgtggggtataacttgattgattttaaacagcctacatattgtataaaaccaagaacgattactgttcattatggtgcaaaactggaccagacagttcttgttttgaaagttatcaccactgctggctctagcaccacataacattattgaattacaattactgaccttcaagcctttatagagtgctcgtgatctgcaagagcgaagacatgaatggtcatattcagatttaacgtactcttgaagacgatggattttctttcttctgcgccattgcttccaagaccaggcacaaggatatgcaagtactgaaagtatactatgtatagatccttcccaccactcgtatgcagccaccaaattgatctcatcgataaaacggttaaaagcatcttcatatctggcaaaaaaaaagtaacaagatatcacctatggcaaggaatacaaacaaaatactgatggagacatgaacattcttcggaaatatatatgacatagttgggatggtgcaagtaaaatatatgggactttacggaagatcgttattcttacaaattgcatgagatgggatggtgcagccgtgcaggtacattgtttggttggttatatagcatggtaggagactatctttggtaggtcatttggtagttttttaaatgatatgcattatattgcctgtagcttagttttttaacatgattacatgaatattcatttctgccaataagttcatgaaaatgaccaaaagattatttggatctttaaaggtatgtttttatatcgagtttcatctgtaacatcagtactaagcatgacattttgatctgagtctaatcattataattccaacttccaatcgctcataaagaacaatgcaattcttatgcaggtagtaaggtatgatgctagtagtaggatgcaatgtagaatgagccagctattaagaaatttaaatagtgtatgttttccctgttcaacattagtaaatagtaacacgtaaagtagctttttactatagaaaatgtatttacattgtgaatcattatgagatgaaataactataagtgatactctgctaatgtagattcttagaaaatcttacacgattccgattatagcatcagggggtgagtaaggaaggtgccaaggttcccggaaggtgttaggtcccatgaagtacattctgtgggcatggctttgtgtttcttctgccctgctagccccaggtacctacagaacaaatcagtgccaccatttatcgaaacaaatacaagcagaaagatttctttaacaacctgagatagaaagcataagtggtttctggacatcctttaaaatccaactgcactttgaatcagaaactattggagaaattatgaatttgtaaaaatcatggattgagcatttgactattgtgagttgacgtgcagatgccagatctagtgatttcacaatggggaaatatccagtgaaaaccatcaaataagtgaaaacccatgaaagccatgcccataagttctctaaatttagacatagatataggcattaaatacttttctaccaaatcgcaagtccaaatacagcttcatttgagaaataagacaaatttcaggtgaatagcgtcatgttactgttcacctgaaatttgtcttttttttacgcctaaataaagtttgagattcggtgggaatgtatttcatgcctacacctatctctagtaatcttttcataaatttacagaacttttaggtccagtttcacgggtttttacttatttgatggttttcatcgtatatgtcccctttcacaatagctctacattaatatttaatcgatcctaagattatgttgtatgaattgatacatacctcagccaatgaaagcaaaaaggggaaagaagcacagccatcattgtggattgcatttgttgaccggtatgtgatgtcactctcaccaatcttgactctgagagcacttaagacaagtgccaaaagaataatggtaaaagataggataattgcaaaagaccaaggaccaccaaaagtataaataagttcctcaagtggtgtgtaacagtttggcatcttgtacttagaagatatgcacttatatgggcaggacggctcggtaacaccacctagcatgtaaaaagttaatggttagtttctccaatttaacatcataaattttggagttacaaggcaattaaataattatagttccacataagaccatgtctttccaaggacctacctcttacatatatgaagtcagcgcggttaggaagactatccagagaacaaggcatacacagagatgaatcggacccaacaacatttttgtatgtaccgattgggcattcctggaatataatttaatcattactggttgcgaacaaactaataaaaagcatttgctagttaccaaaacaatagtacataaaaagaaactacctagttgcaaagtattgaccatatcaatataggatgttttattagctcatggatacagatagaaaacccggagtacacaatgaaatcctacatagttcagttaaaattaaaagcgtgtctgaatttgcaagtgacacagatcaacctggccattatgaactgttaaaagcataatataaacagaggtctgtgttcaactaactgttggttaagaactctgagcatcaagcagtagttattttggcaaaatgttgcttaagattatagcagtggcacagttatttgcagttttgcaccctctggggggcaaacagtttacgtagtagctgccatgcatcaccacaaaaaccattatttataaggaacaaataaccaccccatcctggtatttctggataagggcgagaaaccagtgtggcaacccaagttcaaaatagtttatctacgagtggtggtgatatcagaggacataaaatctcctctataacccctataattttcctctattcacatggagagaccaaattttggctcctattgcacacatctagcatgaggttaaccaacaggacagaaggacacaactatattctccctcttacatataagccttatatgaaataaagagattaaatttcttgaatacacacatttaaaataataatattatttcctatggattaggttattatcataacaggaacatgaagcaataaaggcacaatgagagaagtgctcatacggtgcaaaatgttccatatagtccaacaggacacttttttcctgttactgttccagtttctccaaaatgtccatcatcattaccagatcctccactatgcaaaaataaaaacaacaataaattttcagaatatttttttctaaattctagtactcaaatactttttgttctagctttgtcctaagtcaagcatgtatatctttgaccatcaatttttagaaatccgtatagttcaaaatatgagttgtatttattaaagtatttgtcagtgaatctaaaaaaaaatcatatgatgttaaaccatatgagtttttaaaaattgatggtcaaagatatacatgtttaaggacaaagctagaacgacaagtaatttgaaatgaagggagtaatacttttcaggatcaaagcaacacgcaaatttaattccatgacaaataaataatgggccatgcaacagcaatactagtaaaagcaggactatatcctgaaggtccacgaggatggtaataatagttgcattcatgaagtaagcatgcatttcgaaaaaagatgcacaaggttgctcaggatcactgatcatgtagcatactatctgtaggtccctgaacacaaaaactcaactggcaggacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 63113 - DNA, 835 bp, Oryza sativa
gccaaaaaattctggcatgattattatacatttttttttacaaatccagacaaatacatcgcaaatatattgcaaatatgttaaacgatgaaaatgcaatcaaaggaatgagaaaggcaaaggaaaaggaaagaacaaagaaagcaaagaaggaaagaacaaagaaaatagctgtcaatggaataaattgaattattgtggtaaaatttttattttttggttctcgcaagattgactcccggctagggttccagcggttaccgctaaggatccaagattaacgttgcataaatgcaaaggtaagttattttggggtaacttatccttatctattgagagctacaaacataaataaatcatcatattctacaaaattctcacgttccataacttccggaaagtttacaagataacccacaaagccgcctccagaaaaacccttttactccaagattcttgccactaattatcatggcattttgtaaagagtccaggtatcgctgacaaaatgaaccgggaaaaacaggaaagggaaaaaaagaaccaagcaacgttttctaagcactactctacaattgaattagcaagggtcactattacttacacaatgtacaacagatctgacctgttccacctgtacactcaaaacaagacttaaacctaagcctaagaactccagaaatctagtttactcaaaataccaaggctattctaaccacgatcaaaatgtatgctaatgcatatctaactttaatatatctgcactagtctggaatactcctagaaattggaggaaaagttgcaggtttagatcactaggctgcctctcaaattc

SEQ ID NO: 63114 - DNA, 1004 bp, Oryza sativa
aacttattttgtaactcctgataatattcttctacagatttatccccctggtctgagcgttgcaatttctttaaaagatcacgtctaaaagaaggagcacaaatctagtgtgcatatagttgtctttaagagcaggtataatagcagactataagcaagctataaacacatatcaagaagataaaagaggagagagaagagcagcgggctacagatttgtagccagcaacagcacagactccaagacataatgtatgtgtgacaagtgggatcatatattaatagtgtagtatatgtttatagataactattgtatatattggctattaaattgaccatagatgatttggagctaatagttggttatactattaaacttgctctaacgcttctcatgttgtaggtgctagtccatcaatacttatttgagtccatcacaatgttgcaaaatcattaaattcactagtagcttgcctaaccctatgctcatcaggaataaatgtgcactaaattttttatctacagtcatttctcaatcaaaataagcttcagcattataggcaccatgaaaagagggaatcgtaaacttaactttaactttagcatatggatcatcacacacattatgaaaattacctccaatacctcgacgattgaagctcagcaagtttctatcaatattatcctattttagattcaccaacctgtcgagacaattattgatcgttgtaagattggcattcagcatgcgctggaacctctcggtagaggtttgaaccatcctctcgatcacaacagtcatatctctgttgatagctccacattggtctttgaggactttgacaagttcctccctgagcacgcagtccttaaatttatcgttggtgcatgacatggttagtagaatatagaaaatagcacaaggatattatccctatcaactactaggtgatgagagaaagacacttgcactcaagcatcttaccacacgcatacacgtagca

SEQ ID NO: 63115 - DNA, 2122 bp, Oryza sativa
atgccacgtggcaacttaggaccgatttaagtgaacgttgatggacaaatatttttttaaaaaaataatgcaaaataatgggtacataatattatataatataatggtggaaactttattttcaaatattgtagagctaatttatttatgtctacttgtagagatttatatgctgtatattctatatttgtaaagtaatttttattcaagatttattatcacttattattattattattatattattattattattattattattattattattattattattattattattattattattattattattattattattattattattatcatctcaattatatacctgaaataaagaaagaatagtaacgtacctagaaaaataaaagaaagtttatgtacgtacacaccttgaacgcatgcaagcagtaccgtacctatatggatcggatcaacacaagctccttgaacgaaagccagcaatacatacctatatatggaacggaacagaggagtacttttgagataaatctaatctaacggtttataatattggatccaccgatttaagtgaaaatcgagagatagatattttgcttttttttctcagattttctagaattttctaatttattagagcgccatgtggcggcttgagagcgttttgagaaaacttaatggacttttagtatataatagaagacagatagatagatagatagatagatagatagatagatagatgtaagagtgtcatgacccaaatttgttatgagatggtttaggaaatttgtgtgccgaattctcagctttggttgttttcccttgacaaaccacagcatgactaggtagctcattgagcttgtctcggatcacagttagaattgtgttatcccaatttggttctgtcgcattcaaaaaataaaagatatatagttcagtctattgaatgcaccatggagttgatagtgaactgcactagattaggagttttctatgactttgtttggttgataatgaggatttttattactgattcttccctttttgaataaatacaaatcaacctagtatctttctgtacatgggtttaactttgtgacaggaaaatattaaccttcgtgaatcatccaaagttactgcatgtaacaatttctactactccgaaattagagcaatactggcaaatttatctagcaatatctgaaacaatttctagcaatgtttaacaaatttatctattattctagttaaattattttgtaattgtttggtttgcattaacaaatattgtcatagcgttagcacgggtaaattactagtattgttgtcattcataatattagatctgtttgtctttccttgtagtgtcaaaagccaagacgtaaaaggataaattagcattattatgttttatttatggagtcgtctaagtttagaagtccatgttgcaggtcgacaatgaactgctcaaaaggaagggttgatgaccaaagcaatcaatagaggtatagcaaaaaaagaaagatgagataatatgccacatagagttgtctatttaaatccatatatacaactcactagtcagcttcaatgccgagtcaaaccttttcaatataagagtgtcatgacccaagagggaaatacccgacaatccttgatgacgaagaattatagtgttgaagttcctgcgcatgctccacttgaatgcttagcacatgctgcacaagtatagtcttgtagtttgtggtatcgatgactcctaaaatctccccatcatcattttccatctcaggatcattggtttcacctagaagcttagcaacaagagaatattcttcctcaacatcactagaacttacatatccaccatcatccgtagcgatgcacgcatactgacttgtacaatccttcatgacatgtcacatgcccttgcagtggtggcatatgatcctaattcttcgccccgtagaagccactgacgaggagcttttcatgggtacctgcactttaatagacttactcacctcggtagctcatggattcatgatggaacggggacgggtgtcgatggagcctggttggtggaaggcacaccagagcgtgcaagaggagataccgt

SEQ ID NO: 63116 - DNA, 2292 bp, Oryza sativa
gacctgctcttctatcactggtatagcatcactcttattatttgttgccaagttcattacgtgaatggaaagtatgatcacatcattacctgactggcactcccagataaccttgctgagaagactcctgccagcagtacccaatcctccccaaagttgagtgaccaactgagagagatttcaaactcattgaagcttcttagcactcggccagtgagcgtgagggcacaaacgtggggcatagaatgcgtctagcgaatcaatacgattgcaccggagccaaaaactcctgaagtgcatttgaaatttgagcaagcggaagatcccaaggatatacttacagcccgcagcactgggattaaggttaacctgttttttaactcactgactcattttattcgcttaatgtgtttgtaccttcttataatcgttttgcctgatgaattctctcttgttttttctgccccacagaaatctctagttcaagaatgcttgacttttctcaacagtgctaataagtgagtttggcattatctttacaaccgacttcacactactgcatttctaatgcatgtttgtttctgtgtcttttgcagggaacaatttgtagggtcgaatcacagcaactaagccaaccagggagggggggttgaatggttggtatacctaaaacccgaaacttttagcggaaataaaagttaccctcaaattcgacggatcgctgtttgactgaagtgtatacgccggtctaaccgcctgatgaacgttggtctgaccgagatcgaactccggtcgaaccgccgagatcgtctgccgctccctgtcgccgccgccggtctgaccaccgtgtgcccgccggtctgaccgctgcgatgccgccgggctgaccgccaaaacccggtgaaacacaaatcgaagaactcttaaagtggataacgactttattgattctctctgtgtttacaaagtacactaacagcactccttgcaaaaatctcgactaaactcgaaaccctaactcaacgctcaactcaattgctctcaaaagcgataccaggaagcctcacgctccctctctatttatacccgaggtaggcagcttaaagccacgaaccaaacccatactagaagtcctaatcaccctaggaaaccctctagtacaagaaacaaactttacataaccaatcataccaaatttggactccttccaaattcgactccgcatcccatatgcacacaatacctccatcatatgccatatggaatgttcaccttccacgtgcattgaattctagccttagtatcccgcatgatctctgaccactacggatgtcgtcttatccccgagccgactcccgatccatcaccgcaaatactctcccggcatcttgagtcacctacacatagaacaaacaaaagaaaccatattccgagaccaaactatccccaacttgactcattagtagcaaacaacagtattacatacgcatagtatccatctagaagccataatcatgaaacaatcacggatatctaaacaaacaacccgaaaccgaaaccgacacagagtcggccggtcaaaccgcgggctgcgccggtctgaccgcgtgatacatgccggtctgaccggaccacatccagcagtacctgtagatcacctgtgaaatccaatcatctccaaaaccacttcgtgaataaattccaaatatcaaaactaataatctccaatgccaatcgttcatcatagaataacaataaaaaacacctttaattttacacaattaaaaagcttaaaggtttgctccgaaccatatcgtggcagcccagattgcttctttcttactattaacccactgatacatgtttagggaatcggagaaaaaagggcaaactacatacttgagcttcgtgaggagtcaccagagcggcagagctatttaaagaggtgagcactctagatcaacaagggagtaggcattaattagacccaagcgaccagaagttattacatgacaatgcaacccagagctgattcctttgcttttgcagataagagcaggtacaatagcaggctattaaccggctataaacatattttaatgatataaacgatgagagagaagagcagcgggctacagatttgtagccagctgcagtacggacttcaagacacactgtgtgtatgacaggtgggaccatatactaatattatagtaagtaactattgtatgaattggctattagattggctataaatgaattggagctggtagtgggctgtactattagact

SEQ ID NO: 63117 - DNA, 1880 bp, Oryza sativa
tttatcactcatagtactttaagtgtgatttatatcttatacatttacataaaatttttgaataagacgaatggtcaaacatgtgataaaaagtcaacggcgtcatctattaaaaaacggagggagtattttgttttatccagttgcttcttaagagctcgccgtgtttcgttccaaaataattcttcaaacttcaaacttttccattacatcaaaacttttctacacacacaaactttcaacttttccgtcacattgttccaatttcaaccaaactttctattttggtgttaactaaacacagccagcgaatgctttggtcaggagttggcattctgtgagagaatcagtgctttgcagtggtttgctgctattatgtgttctttgtaatcatcatacagtgtcgtaccaatattgataatggtgtggcgttaatgtgatttcctctcttttgatgtctgttgctattaatgccgatttattgttttagaaaaaataatgagtcgatgaatattcctctttgtcgatctgagaagcacatttctagttgttttcgtattccgataaatattcgttctgatccatatcgtttcgtttttgtattcgataatatttgactctgtttttgtatctggggtttcctgttttgattttgatttctgagaaaaatgaaaacggaaatggtagaaccagtttctttccgtttctgaaccctttttatcccttgaagaaaacaataaaataaagttaatatgggtgttggggctggtatggaaatgacatggacaagattagatattgtaaccacccatataaaacttgctcttaagatactatgtgctaggagaaagtcctattaagcaaggcagatgctaggacatatgttggatatgtagaacatgaattagtgggagggagaaacatagatgttaagtttaatatgttttttattccaaaatatagcaacctatactagaacatcacctattagtatgaatatgatggattggtcttgaatatgaaacattttgcctcaaaagatggaacattacacattcctaaaacccgagttttttttaaaaaaaatactatatttctaaatgttgttatcatgtggtagtatttcaacaggacatcatttcaagaaaacaaagccctatactccggtcctctctacttaatttcactcggccagctgaagggtgtctaatttggccgcctgcaggacaccctttatcacaagagcttttagggatcgaataagctcctatgtccgacctagaactatctcagggtcatatgtatatatggtccaactagctgaaaaggagaacgtgggagttgtggaagattaattgaacctgaataatctaagttttatcataatattatttttcctgatgcaacacacatgtttttttagtatgtatataatagtcttccatgtaaatctccacatcaactatggggtatcatccaaaaaaaatacacatttcggggtaacacccacaaattcagttcttgagattctcatctcctagcctacccatggtctgatcaggctgcactttcttttggctctctcgatccaatacacaataacacagtatattaccagatatatattctgagagatgattctccctgatccccaacataacttacgttggcatgttctgtgctgtttgcatctgaaatcatcttgaacgctcatcattatttatggcctgcacgtcgatgccaatgaactatcaaatccaatgaatataaacaatacatttcgtacttcgtttcatctttcttttcctacaacataactaaatctaaacaaataagtattctatggcatagtattataaaagttgagtcttggaaaagct

SEQ ID NO: 63118 - DNA, 1922 bp, Oryza sativa
ccaaggtaacgcaaatgttttgagttgcctatgctctcaggtaactttctcaccgttgaaaatttaaaaatcaatacacggatactcgggagttccttgaaccaacaatcaatcacgggagcgaattgtttaatacttcggtaagattcattgcatattagggaccgcagttttttattttgtgtgcaaatagtcactatttctgtacagctgatatttcccttggtgaatattgacagatggcgaacctttgatgggattttagctaggtcactcacatgttgtatgatgaagcactcatccttggagactagctgtgcagtatcatgtatcaagtcatgaattacgtacatatcactatagccagctgctttctgaaagaatgaccgatttacaaggtcattaaagcaagatgatgcatcttcagcctccacatacccttgtgctacccaaatgtctgctaaaaactccttgtcaaatttatgatcctttggatacagggcacatattgagaagcatcttttcatgtgtcgtggtaggtaaacgtaactcagtcgaagggctggcaaaatgtcagtctcctcttgttccaatttccacaattcacttctcaatatgtcctcccagtgctctacacttaagttacttttcaacaagcgtccaagagttttggcagccaaaggtgaacccttcaacttgggaagtatagctctaccaatgcgctccaactctggacgaatgtgctccagctctgggctattgcgagagctgttggatccgaatgcgcatagtttgaagaaatcccagaaaacatcattttgcagtccgttgagctcatagggatcactgttgctgactaggttagcaactttggaagatctagtggtgaccaaaatcatactgccctgaagaccattgcttaaagttctatgaaatgttctccatcctctctcatcttttaagacatcatcccacatgtcatcaaggacgagtaaaaacttctttgacttgacactatcacgtaaattaaccataagagtatcccttgtatcagaatcttgtgactttactccaagagacttcagaacatctcttgttaacctgtttacctcgaattcatccgagacacatatccagagtatgcagtcgaagtgattccgcaccactctatcctcacagatttgttgtgccatggtggtcttcccgatgccgcccataccaactattggcagcacaggcaactctgtcctccttgcttcagctgtagtgctgcatgccacaggtctgcctctcttgcgtccacgtactcctagcttttgcttcaactccttcagttctttttcacgaccaaatatctcatctggctcgtctaggacacggcatgtctctggtctgactaatcgatcaaacttctttggtgttttgtgaaagcctaaacccttggattggtcaaaaacctgctttagtctatttttgattttcattactttactgaagttgacactgttcaggaactccaaaaagggttcatgcgagtgatcttgccccaagttcttgctcgtgtccaccttcaccttgagagcatagtaattgtactcatcaaggaggtcctcggcatcgtacgctacatccttgatctggcgaagatgccagtcttctgtatccttgtggctatgccattcaagacgatcgatgaggtcatacattgtggatgtagttgattggatcagccataggtcgttctcgagattctgaagatcatcctcaatctggtgcagtggagctgttctgttgtctctagctgatgctgatcctacccctcctggatccacttgcagcagatgctgctgctgctgagaacgtacggcagccaagacacgtggtgcggcccagttgaagaactcacggaaggcattggcatc

SEQ ID NO: 63119 - DNA, 1921 bp, Oryza sativa
gaaataacattaattattagaaatcaacaattataactttgcaaatgtagactgcatcatcgtaaacgtctataatgtttgaagaaagtttactgcattatattctttacacatctatctatatattatatactgaaaatccattaacatctgctatatactaaaagttcattgaactccctacaaacgctctcaaactgtcacatggcgttttacaaatgttcttaagacgccatgacgatctaataaattagaaaaaaaatcctaaaagttttgataaaaaaagaaaaaaaaccattgatattcctttaaataggtggacccaataatttaaccattagatctttaaaaaaatccagtacccccaaccccgccatatgtgggcacatatgtaagtacgtagtccttcaaccctctaactctcctcggagatcccactctcctgtcctattttcgagcccaacttttcctattttctaacaaacacataatgtataaataataataatcggatagttaatgatcatgactctcaaagttacatgcatttttctcaatttatttgcattttgttgtgttatttacaattaaatacataattcaagatccatttacccatatttactatataaaattttgataacgtagctgttctgactacaaatatttgagtctaaattccagattcaatcaccaccaaagagcttggaaccatgatacatactctgggcctaaactcaacggaggcggagttgcaagatattattaggttgtgttcattagatgggtttgggagctaatctctcccacacacgtaaaacgaagcagctcattacattagaatattattaattaaatattaattatttattttataaaatggatttatatgttttttaaagtaatttttctatagaaaacttttagaaaaaagcacggcttagttgtttggaaagcgtgcgcacgaaaaacaagggagctaagttgggaaaggagtgggaagaacacaaccttagtgaggtggacaccgatcgaagcactagcatcgactttccatgactttcttagcctaatagcacgctacatgattatgtgaagcacaaaggactgagatgagggccggagggagacgttccgcatctccgacaagtactagaaaacagtgtcatttctatcgctgaggagttcaaaattaaattcagaaaaatagcaatttgattaaaattctcattcaaaaatttagaaaacccaataaaactataaaaaatgtataacaagattccatgtagaatatgaaatatcaacagtccatataaaaatataagttataaatatctgaaatttggaataataaaataactattaaaaaatgagtccaaatacaacacgatacgaaattaagtataaattaaaatccttaaaaagaaaaatctagaataaaacaataatttgatttgaaacaaattcgaaattagaatcactcaatcactaaattcaaaatataacaaatatttttttaaagaagttatcattattgattcacatgcataatgaattgcatatatatatgaatcaattaaaaagagaattgacagggttgtaaaaaaacatttattgccaataaaagtttatcgagatttcttaaaaaaagatatacaatgaacaccgagttaaaaatagaaaacaccttactttaatttcatttcagtttattttgttataactgctttcagacaaatacacatctcgcgcgggctatcatcctagttatattgaaaaggtttgactcggcattgaagctgactggtgagttgaatatatggattgaaatggacaactccaagtggcatattatcttatgtttcttttatatatatatatatatacctctgttgattactatggtcatcaagcttgctgg

SEQ ID NO: 63120 - DNA, 3000 bp, Oryza sativa
  unsure (1)..(3000): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaaaagtgtaacagctttcgcatgtattccttgagatgttagagaaaaccaaataaattgcggtgatgctctcattagcatgtgtgttaaaatgtcaatttgtgagtaaagccttcctgatcaagttgtaaatactatgaagcatcattttgattggattctggaaacagaagaggagatctgggacatcctttatataggcttgggaggaagagattggatcagattcgagaggaaacgacgacggaagaatcggattcgagagaaaactacaacggaaattagggtttatcccgagttcatcggatctcgaatcctacaacggggtttatcccgagttcatcggaataagaactgagacgaaattcatgggattaagcacgaatttgatggatatttcgtggggacaaggtagaggaggttgataggattccgttcccgcaatcaatttgagaaaaggagcaggccggatttgatggaggtggtggcggctctgcagagtggggcgtcagggagaagggaggaagagggaggcaaagctacgggctgaggaaagaaaagagaacaaggagtaaccggattcggctttaagtaggaagataatttttattaactttttaatctaaataattgctgagatgatatttcatttattaaaaataattctaaggctcaagtaaatcaaacataaatcctgaaaatacttaggcatacaaaatatttaatgataattttatctagctcatgtttatgttcaaatttttcatagattttattcacacacttacttaaatcattaaataatttctaaaaaaaatccccttttcacaacaatttataatttagcgatttttagggtgtgacagatactattttctctacttttggttagatgattaattacaatgcaagtacatactatgtgatatgcaccactgagtcatgctgacttttcacgtaaacaaaatacacatcttcttttgattgcaaatatgcaaatatgcaaatatttttgctattagaatgctgcatgatttttttttacaatgggagcaaggacataatcacataaccatacatgtcgacgtcagaatttgaaagcacgcgtacagtgcactatgctcttctaaaaggcatggtgcgtaaggttaaataaatattggtcattgaacatgaaaaagaaatttaaaaacactaaattctcacttccaaataaataagcaactggttggctggataccttagagctagaaatagaattgaggtagactacagttgtttgggcaaagacatgatgttcacacttcagactaaaaatgaagggttttcgagtaaaaaaaaagaagggttaaacaattttagctcagcaagtaaataacttaactgtattgtcattttaaaagagtataatcattatcatacatactacttttttcatgtaccagaagcatgcatgtgttgaatagcatgataccaggatatggatgcgtgatacaacgttttctcttgacctgcatgggtatatatatatccatgtacctagatgtttccttgcataagcacttgcttaacaaaaagtgtaacagcttcgcatgtattccttgagatgttggagaaaagcaaataaattgcggtgatgctctcattaacatgtgtgctaaaatgtcaatttgtgagtaaagtcttcctgatcaagttgtaaatattatgaagcatcattttgatcgtagtctgtacacatattcctagatataggttgaattcatgaggactaagctagcatcacgtcaagacggccgagttttgtacacacgttcatagatataggtgaaattcatgagaagttagctagcatcacgtcaaaacgacctagttttgtttagctaaacagtatttaccaaacaccactgtcttctttgtatgaaatagaatattattttgtatggtttgctatgtttcatccatttaaattaaattttcattatatatgggacaaaatgaagataattttaacatgtgcagtaattaacaatgagcatgtgtccctatttggtactgaaccaaaatatgtcattgctagggcagcatgcactattactacatggagccatttaatattaataagatacagtggtcctacaaattaactgttttaaattccataagtgtttcagtaatatttgtttcttaattgaataataatcttcaacgtaaaatggttatatatgctgaaacaaattaatctccaattcaaatatttatgaaattgtatttttctaactggaatatgtataaaaaattgtgtcagttattttgaagttattctaatctaatacacactaaaaattgcagctattgatcaactaatggaattagattcattttatcatgcatattggattgagatgagaatcataatagtcaaatggaacagtacatatgtaatatatttgagtcacaaggtaggttgcattggtttgcagaaaacctatttggtcgcggcacagttcctagtgagagtgcatattttttcgaatatatattttttggcttacaaatatataactgttcgttattatgaatcattacaggttaaaaaatcactcccgatcatcactaaaagatttattaaacggttatactccagccattaattccaaaatatgacttattcatattcatagctaaaggtagctatattttaggttgcaagaaatgattagtctatctagtcattaaacatatgggggatccac

SEQ ID NO: 63121 - DNA, 7053 bp, Oryza sativa
ttgaaatgatcgagcgtatgctttctaccctatgcccatctctggttctgtctcttagctgatatataaagtggaatctaaactaaacaaaagtacaaaactggtaagggagtcgattacatggtgattgcaatcataccatcggggtgccctaaaatttttacactggtaattggtgttggtattgcaatcaattatcaatttcgttacgtagaacaggaaatagagattggaattggtattgcagataattgtgcttatcaaaaaggttgtcactggattttttttagttactagctaaaggccatgcgttgtaatggatattataagagataaaaaaacaaaagtaaagggaaaaaatacaagtttagtagtggatattaaaagagataaaaaaaacaaaagtaaagggaaaaaagtacaagtttatagcatagggagatgattaggcatatgatgccgcatcatatccaaagcaaaagcatgtacatgtggggacgttatggcgccacatgtcagcttgtgacgttggaggtaggctcgaacgccaccactagcattatttaaggtaatatagatacacctagcttttatcattcattgagttcaacaaactttatgtatatttaaagaaacaaatatatctagagacataaacactagtactacagatttggacatctatgatgggtcatctgagatgggccgaaaagtatcccatttaaaatatggctactggggagggcctgtcatagatgcgacgtcatctgtgatgggatagttgtaacccattacagatgatctatgacgggtcacaaccaaggctcgtcataggacatgccatctgtgacgggtgtagtgttatgaaccatcgtagatgagatcactcatctctgatgggtcttaattgccttatgtactggtggtagttacgatcagtcatttccaaacaaaatcccggatagagatatgccttatatataagttgtagttctggatgatatctacaactttataactaaatgtttttattagagatcgtttacatccccaaatatgtattacagtgatgagatctattttgaagaacaatatttcaaaaatttcaaattacctcggatggaaaatgccccatatcaaagtcatagagctcaaccagatgtacaccattataattgacgatattttcatttaaatagtttgcatgcccgaatattgattataagttgagatctatcctaaaaacgaaaatttgaattcttcaaacgatttcagacgatgatattccctatgtaaaagttttagaacacaatgaaatctcaaatgttttagttggttacatttccatttgaagtcatttagagtgttaaatgtatgttacatacttcatataggaataattaaaagaataatattgaaaaagtaaatcacatgtgctctacaagtgggttggtaagtgaggtttgtgtagagagggagatcctgagttccaaacttgacacatatatgcttgtctatattgttagcaacacatttttttttctaattttacaaaattagaaccgtgccactactgtcatttttccacccatctccttgattttccatcttcttccttcttactctcatcctcttctctcccctccagatcgccggcgaagagagcaaaccaagaaaaccagatcaccggctaataccgcctcgatttcaccgtgacccagcatcgctccccattgcggagcttggaggaggagggcgccacatcgtcgggccggcgcaacaatagcaggagggccctcatcgtgcgtggcactgcggatgatgcgtgcaatgtggcctagggaggagatgtatgcaatacttctttgcctggagcatccagggtcgatgtgatggcgacgaccatgttgctgtgcggtggcagtgtaggttgcggcgtccccggcgcggggcgccgccaatttcttcgattttcttttttcttcattttttctttctcttttcttcgatttcttctttcctttttctgtggcttcgcacagtcggcggcgtgatgcggacgaagccgggtgacggtggcgtggcccaacgagggcacggcaaggtcgggcggcagcggcgcgaccttgcggtggctggcgaggtgcggatggcggtagggcatggccgcgcgaaggtgacatggccctgcggtggccggtgaggggcggcgcagcaagccgaggacggctcgccgcagcagcccgaggccgacgcggcgtggcttggcggtcgggcgcccccgcagttggccgcgaggcaaccatgctggcgcgatgcggatggccggcaccggcgccccaggcgttcaacgacgcgatggtaggcggcgcggcagccaagctcatgtgtggcgtaggcgaccgacgttgcctctcctacttttccccttttcatttttttgttctttttcttcgaccagataaaaaccagatgaagacgggagaaagaaggaagagatggaaaaagaaggagattgatggaaaagatgacggcagtggcatggttctaaatttgcaaaattccagtggcacagctacgaatagaagaattgtaatgacatttttctgaatagtcaaatttgcaatggcatagatccaattaaccctatttgtattttggttgattttttcttttaattgttcctagtgctattgttaacaaattaatatttttattttggatgttttttctttcagttgttcctagtgctattgtggacaaattaatatgtgaaagtaagtggcttggctaggtgtttattttggatattttttctttcagttgttcctagtgctactgtgaataaattaatatgtgaatgtggcacggctaggtgtttattttggatgttttatctttcagttgttcgtagtgctattgtgaacaaattaatatggctaggcatgctacgttagtgttgacggaaaacacggttgcctacgagatttgcttcactccagtgcaggttcaaagcgtgtctcaaatgtcaagagcgtgccagctggtttgatcttgcaaccagcaagaaagacaaaacaaacgtaacgtaattagatgaacgataaccgatcggccgatagggctgatgacgtatcattaggacctacccaatatgggtaaacctaatcggctgtgtctttaggatagtcagttaaagtaaaaaccctaaatatgccctatctgttgtaatgccgtctctaaagtatttatgaatcactttaagacaatattatagaaatagctatcagggttatggatgccacatacccgatagtaatcgactaagctcggcagggcccaccacatactgtcagggttatggataccacataatagtagttgactaaatctcggcaggacccaccacataccatgtcttatacggaaacaaccttcggatataggaggagttccgcataaggaaggatgaatagagttctacatggaaacgacaaggactactcgtattgtatccatattggtctctctagttctacttggacaaggagacacctataggtataaatacaagaccccctaggaggagaagggagacggaacaatagatcaagacacaatatcaacatacaagccaacacacgccaagacaagccgctggatatcgacatcagagatatgcctgggccaaccctatccggtacctacagatgccggctgtagggatctagcgttgtctctgatctcgccgggcacaaactcgaggaggaagactaccctgttgtcgactacgggatggtttcacggccgccctgtcgacaacagttagataggctaccccaaatattgtactggtgtgattatggtgaataagagcaactaccggcttcggccaacaggagtaaggttattacctgacaattcaggggcccgaacctgtataaaaatcctcgtcttcgtctcttttacctaagtctcgcatatatcctagtaccaacgatccctatactatgcaaataccggaatcgcaacatcaaacatcgacaatagccgatggatcagtacttacagcaaaagtagataatgtactggctaatactctaatacagacttatatgaacaaatcaatctatataaatatattagatagcaatcgatcaccatatatgaagtttaagcaagatcaatctaacttgatgtacttatataaagcaatctatctatataagtggcaaatatatacgtaaacagatcatgaaacatgtactatcgtttatattaggaaagatcagccgaaaccccaatactatccttaattatgattaattccaggttagtttttagattctaagcacgactaaggttgatgcataagtatgcaaagaagcataaagtctaaacaatcaagtaattaaccactttttaggatggtgggtatcttagctaatctaatctagtaaagtaatttagtcgataccggcataaactctaaagtgagaatcagccgatatgactaaattgaaatactaagactagattaactaagatatatgatagcaatggtcacgataaaagaactaatacttctaaagtgacataatagccccgatagcgcaggtcgttacctcttgtcgagagatcgcagccgatgccccgactggaagcaaaaacttgtcgaaaagtaaaggaaagggtggcgatgcgtcgaaagttgtattgattggattgtctcccttattacaatggtttggggtttatatttatatcctgagtacaaaacttgtccattatgggcacgattcaaactttcctaaagataaaatactaacaagtcctcacagcggactcttaccaaatctctaactcaaaactgacataaatatcctaattaatagatacaattaccttaaacgagctctgtctctaaacggcaatgacagatatctaaatcaaggcccataccgagtctacgtcaggctatatcgactgcttgccatatcagctcaatcagacttcgactctgtttcccgccgatgcgcaatccgtatttggcaagattcaatattcttcgattcctctttgatatccaactctaaatccgagtctatcttgccaaatttcactgccaacagttatacacaatttcattcagatgaagaaaatggagaacatataaatgccatacctaatctataatagcttttccagctttcctggtatcagtgtacacctatgattctttggcctctttcgctttaacataaatgattacccaaatagaccaaccatctaccaaagtatgttgacaagatggcaactcaatcataaccgtatagatccataaaaatttttgattatctatcaaataatgcaaaggtgaactattggcttgggtggtttcccattgagacttgaacaggtgttgaggcgaatttcgcataaacacacgaaggcctaagagatttgtttagctctagtgcatgttttaaaattgggtttagagcaatgcaattagtttgatcctgcaactaataacaagatagaaataaaagatagatcatggagtcgattagctatagggccaatatagtacctctgcctagttgtagacgatgaaatttcggatcaacggctataaccgatggaatattaataaacataagaaaaaatatattagccaaaacttgacattataatttccaatgatttgtctttagtaaagtcaatcttgataaagccgatgcattgaaataactgtcaataacttcaataaacaatttaatgaatcatcataagtcgctatcaaataaaagacaatcgttaggaatatttccttatcaatcataatcttgataggttggacataaccgaggcaatataagattaaaaataataaagataatcgctaattgattgtattagatttgataactaaccgatggagtagattgattattgataaaaggataatttaccaataaaacaacgaataatatctatcgatttgagcaaatctgtcttaataaaatatgacctgataaattggacataaccgagatagtataaagtcaatattgaacctgatagatttaaacaagccaatagatactgaagaaggtgattgatatattgattctaactaagacagcaaatccattgaagaaagaaccgatatatctgataggcgacgtgtgcacagaccaaattagtatattggacttaagaaagtattagccggaccgatacaatcatacaagcaaaatagatgaaacttacttttttgccaaagatcgaaacagatgcagcccaaacacgaaaatagggtggcgatgcaccgaaacttgtatatttacaaaacccaaggcaaacatatttataccctcagattagaaaagagtccaactcaaacacgactcgatcggctaaaaggaaactgagtgcaatttacatacgacacaattggtttagaattctatctgtagaaggaaattaaaacattccttaatacagaagttgatataaaatctgcgaaactatatctgatacgcttcccaaccgaatccactacaatcatggcgtcaatttcgcctttgacttgatcttgactaacgacaattaccaattctaccgtcaacaagtagtaggagcaattggcatattcggctaactgcaaatgccatgcattgcggcgattataacaacacagtgcatcctacattgatttcccctaatatcaaatgatagaacttacgagcgaagcaagataggaaaatagtgtagctctaggctccaagccatccatctacttcttgataatattaaacttgtctacattaaaagtttgttgctatatagtgcccatcaacgcaaacggtagttagaaatgagaaatgtatgattgtaacttctatgcatatgcaagtccaaatgcgtatgatatgcatgcatttgtcctttccaagaacaactgcatactcatgccttcacagatatctgctgaacattagttgcttgtaattttaccttatctgttgctcacttgcaattgatttt

SEQ ID NO: 63122 - DNA, 2952 bp, Oryza sativa
ccagccaggactaaaggtattttttaattgttttttgttgcttgcatattgcccaaatccgcacatcaaattgacatcacagataaaatgcggaatgctgcctcctcccgcacgccaccaacaaccaccgcccgccgcccactgctgacgccaccgacggagaaggggggggaggagaggagaggggagggtgctgccgccgcttgccacccgctgccgcctgccgctgcccactgccgacgccgccgacgatggagaggggaaggggaggaaagcgaggagaggggaggggaggggggaggagtggaagagccgtgaagtggataagtggaggaggcgtgcggctgcgtgaggaaataaggacgacgaggaaatagttaaaaaataagttgaggagataaggacgggtggggaggcgtgcggctcagtgcgctgttccggattttttcaacttttgacccagttggtataaacaatagggactaaatattgacaccaaccgggactaaagatagtgggggtgtgacattcgcctaacgactttttaaactgagacttaaaatgtaccaactgggactaaagattataaagtgttattaggttttgaactggggctacagatcttatttattcccggttcctattcaaaccgggacaaatgtgatttttgccatccggataaagatctgttctccagtactgttcacactcaaaaatttcaaaatgctgaaaactcaatgtacatatgcaaaatttgctcaaatactccactaaaactagcattttagtttaaaaattacaaaaatacaacacaaatagtctaatgggtcatgcctatagagtgagtctggctcgaatttaagtagggaggtcattttgggtcaaaattaagggtgatccaggacctgtatcaggggcggagcttgattagggggtgcccaggaacccggtcaagaaaattttttagctatacctcatctattttcaccatgtacgcacccccctcaatacaaacttaggcatccgcatcagcttaaagtcgatttaaagtagagtaaattaagcaagtgacaccatcctccatttcgctctagctccgcccccgtatcactcctgaaccccccatgctatctctgttcatccctacacgacgccagtgcaccaccagcatcccaccccacacacgtcctcacgccgttggacttctttaaccgatgtcgagggctagcgtgacatcgagcctgtgctcctcgcttccacccacggtcatggatcgagctcaagggcaaggaggcagagcgaggagagcgagctcgtcttggtgcttcgacaacgaccatcctggcgacatgctggttggggacgaccactggatgccctgctcatgtctcttgatctctgtttgtgcagcacgaaggggcgtcgaaggaggcctgacggacaaggccgtcggcgatgcagaggttggaggaattgttctccgcttcttcttgtgattcaaaccatggggctaaggggaatttcatccattgaagtggtaaaagaggcaaaatcaagccaatgaattaaaaaagggacgggttcgtttgaaagatcgttcagctttagcatttttgctgcgcgaaacaaaaaaaaataccagtattaactattataaacttttttataagaaaaaaaactatataaaaaatgttttataaaaacatattatttaccagtttgaaaacatagtaacaataaacaaggaaaggaagaagggcaactgtttattactacttccgtcccaaaatataagaatttttaaaattggacataattattaagaaaataggtagaattaaatggaggagagattgtgtttagttaagaagtgaaggtagacgagaaaagtgaatgatagagttgtgattagtttggaagaggatgttaggaagaagtcgttatatttttagacaagttctgagtgatagaagttattatattttatgatgaatgaagtatgagatgtagtagagacattgcaggtttacgtttcagtggaagctagcccctgttggcaaaatacttcgacttgtttgacaactcgagcgaagaggattggaagtttacatgaggagattgatggtgagattaagatgtgaatttgatttttaatcccaatatcttgtttagtagatatggtgaaaattgatagggagtttaatttgagattatgtcattaatgaaaaatggatgcttgggatttatttaggcagagtaaaggatgaattccctcttaattaccacctctattcaggtattgaaaaggagggagtctacagagtggcggatctaggaacttttatgagtctggacaagcctaacgatagagaaggacaattaactccatacaaccacgtgcatgatttaggatagatcaagttctaatttatttttttttgaagagaatcgacttctaatttatgaagaagagaagcgatgcgcaaaattatatcgatgaaatgtaactcgttaattgttaatgttgaataactagacagttatatatatagttagtcattttgctactttatgtgctgattaactgatctgacattcattagaactagttaattaaacacgtaatttgctacgggtagtattttactcaattgtatgcgacaggctaaccgagactggctctgccgctggagaaaattgatggtgagattaagaagagaatttaatttttaattctaatatcttgtctactagaggtggtgaaaattgaatgggagtttaatttgagattagattattaatgaaaaaatattattgagatttatttggacaaaataaaggatgaattatctcctaattaccaccccttctcaattctccatcctcattccccgcggcagcggcaggctcaatgccttctcgcatcgattcttgatcccaaggagatggtca
